United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 9

SEQ ID NO: 33697 - DNA, 1155 bp, Glycine max
  Peptide Sequence Number=SeqID_150475
atgtcttcattcttgtctgattctgccatcggtttgggtggcaatgattttgggggctcgattgagcaacccatgatggaccgagaggtcatttctattggcggttcctcatcgaatgatactcatcgtagtgcttctgatagcgagtcctattcattggagagggtgagggcctcgtgtcttactagtgggggcacttctcacctttgcaggaatgcacaatgttctgttgctgccagggagcctgtcctggttactatgatcctccccccttctgcttctaggggtgtgaggagaggtagtagtggtggagatgtcaaggcatctcctcgcgtgcaacgtagccatagagttggatcatcgtcgtccacccctgctgtcgctggctgtggttgggtgagggatgacgttttgaaatataagtcatctctcaccttggtggtgagtgtcgatgctcttcaatgccaggtgaagctggccagccctgaggactcttgcaagatattcattcagacttgtgggagtgatgacttcttattcttaagggtgacgtcaggatggggagcccgtttcccattctactggcagtttcaccctaccaggttcaagtcatttgatgaggatctattgacccttgtggagagggaagggggtcaacctgctgatgagtttgaccttattgcaaccacttgtgctcatgcggtgttgcctccttcctctttggctccaatgaatgctatagattctgccaaagtctttctcctaaggagtttagaaattctagaggagaaaggacaatggcaccaagaggctttgcgcaacgtggcatccttagaggcagagcaccctaaggtggccaacgccaccattgcttttgctaaggccgtaagatcgaaccaccaactgtcttccaaagttggtggtgtcttggccaagttgttgtgcaccaggctgcatagtgatgaattgtttaaacgctgcaaggacttgcaagtagataaaaaggacctggttgtcaagttggaaggtcttgcgatggagagggatgagcttgtgaaggtggttgatgatttagaggcccgacttaaggagtcagagtccaagttggaggagtttaagctgcgggctgttaaggagatggaggccagaaaatag

SEQ ID NO: 33698 - DNA, 612 bp, Glycine max
  Peptide Sequence Number=SeqID_150476
atggaacgtgaagaagggaaacaacctccccaaaagaccccattacacaatcaacacgagcaagctaattccaacaattttgttctagaacataacttgcaagagcaaagtgggacattcacaacttttgcatcatttgaaagtgaaactgagggcgagtcttcctttgatgacaatgattatgatggggatgctgattttttcctgagccaagagttcgaatcggaacttcaatttcttgagagtgaaggaagcaattacaacaacgatgatgacaatgatgaagatatggaagaagatgacatcgatgtagatgaattgacttatgaagagttgattgagttgggggattttataggacaagagaagagagggttgtcagcacatgaaatttgttcatgcttgcatattcacattttccattctgctgaaaacaaaagtggaattgatcgttgtgtgatttgtcaggttgaatatgaagaaggtgaacctttggtggcaattcagtgcgagcacccttatcacacagattgcataagcaagtggcttcaaattaagaaggtttgcccaatatgtaacactgaaatttcagctcccaagatggttagttaa

SEQ ID NO: 33699 - DNA, 297 bp, Glycine max
  Peptide Sequence Number=SeqID_150477
atgggggtcgatgaggctgaaagttgcgctaaagaggtcaatggggatgaacctcttaaggaggcgcgagttaagtttctcattgtaatagacttgttgtggggattaaatattcataaaacccttgcaacatccaccttttccatagttccgatttctctatcagaagtcacatacattccaaaagggttcaccaagctagagaagcattcctctcctcatgtctatagtggtattccagtgaagcaaatccatgctaatatgtttccaaatgttacatcaacactccacttttga

SEQ ID NO: 33700 - DNA, 267 bp, Glycine max
  Peptide Sequence Number=SeqID_150478
atgtcatcaggttggcttgacggctccacaaaagaatgtcatttcatgtactctattgttgtccatatgctcccacgaacgaaggttcgcgatcatcacagcctaagcgtgtccattcgatactctcacttaggaaaactagacagcaagtgtcaaggttaccctgtcgtacataggcaactcccttcccccatggtgatcaatctgagtctcaagggagttccaaaccgaatgacatgccctaagtacaagtgttctccctcatga

SEQ ID NO: 33701 - DNA, 168 bp, Glycine max
  Peptide Sequence Number=SeqID_150479
atggccagctctaagaggcattgctctcctagtcagggcaccgtgagttctaacactgattctgaaaaattaaattttgatgtggagattgaggataaacatgctgaaacacaagttgttaattggcctcttgatgaagagaaatctgaagaagaagaagaagaataa

SEQ ID NO: 33702 - DNA, 324 bp, Glycine max
  Peptide Sequence Number=SeqID_150480
atgttggctttttactctaacctctttgctgtggggcacccgggtcgaatggccttggaggacacttataagaagtattgggaagttgtaaagcaagatgtgtttgaagccacttctcatttttttaggaagggacaacttatccctaataccaactcaagtgtcattgcccttatccctaaatttcctaatgctaataggattgagcattactgccttattgcattagcgaattttcagtttaagattaaaaagatcctgactttcaggcttgcttccattgtgcctaaaatcatttcatcaccccagagaggattcatatag

SEQ ID NO: 33703 - DNA, 138 bp, Glycine max
  Peptide Sequence Number=SeqID_150481
atgccatcgcaacatagagtgcctgtcacccccaacaaggtcattaggccctgcattaaccgggcgttcatcaagaagtactgcgccccaaggcaggcgcagggcgtgacactacagcagcattgggatggccggtag

SEQ ID NO: 33704 - DNA, 996 bp, Glycine max
  Peptide Sequence Number=SeqID_150482
atgggggatacgatctccatcaagagtgcagccccaatcaaaacttcagaacttcgagagtggttgttgaagctttggcaccccgtgtgtcaatggaaggtgacaagcataattagtgatgaccatcgaaaggaggacctggcacttgttcgacagaatgtccctttggatgaagtggtaactgagaaagataaacccgaaggaagtgatccaggggagccaatagccaataaggataatgagcacattgttgtagttgatgatgttagtgactctggttctgactctccttccaaagttggagttgaggtgcagcaagatttcaagctaaagtccaatttttgggcagatgaagtggacgatgatatagaagaagggccaactacagaagaagaacctttcactgaagttgtctccaaagcttctaaggaaaagaagaaaggcacaaataagaccacaactccaaagaagccagctaataactgtcgatcggtagcttttaaactatctcttggctcgaaaacttctttctttgctgcagtttatgcctccactgcctacgtcaaaaggagggatctttggtctgagcttacagaccttcagcaaaaacaccttgggtcttggcccttcattggagatttcaactccaatgtaggggcgcaggagaaaagagggggcaaaatgtcatgttctatagcttgtgaggaattccaagcttggatggatgtcaacaaccttattcatcttaatataaacgagcgaatttcacctggaccaataatagaaaaggcagagctcgtattgatcttttctttgatagatcgagctattggcaacgacatatgcttattggactggtgtgatatttcagtttgcattctccctagaagcaaatctgagcaccacccattgttgatgatgcttgaacaacaagatcatactaaccttgtccttttaaatttctccaagtttgatcttctcatcgtgactacctaa

SEQ ID NO: 33705 - DNA, 216 bp, Glycine max
  Peptide Sequence Number=SeqID_150483
atgagttgtcgttgcttgccaccacacggagaggaactccttaatcagagtggaatcctcagaatccacctcaaggatttgatggagaacaagctctcaagttggggtcaggaaactcaattgtgggaatgtatgtttgtccctgtgtatgttggatttcaagaaaaacaatgtcttcgactaatgggatgtgatacgtctattattgataaatga

SEQ ID NO: 33706 - DNA, 561 bp, Glycine max
  Peptide Sequence Number=SeqID_150484
atgacagtggaatggagaaggagaaaaggtgattggagacgccacttcaaggagaagatgagtcaagaacaagctcaccaccataggaagtcatgcttgaaggtgggaaaagatgagtggatggaaagggagagaaggggcatgaaattaatgagattagcaactagctcatggtttcaactttcaagtttaggcctgatacagtcaatgtttgttatatcagttgagggtccgtcttatgtggggtgtagtgaagatggtgcatctcaaaaagataattttgaaattggtgtagatgattggttgcatgttccctcaatggaagatgccttttcccttggagattgtgctggttttcttgaacacattggaagacttgtgcttctagctctagctcagttggcatctatttatgtatactccggagcacggaatgatataaacctcttcctgagtgtcctcttggtagttgctcaggaggcctactgtggatgtgtttggatatactttaaaaccacgttgaacgaaaaaatcacactttccaaagcaattatgttgtag

SEQ ID NO: 33707 - DNA, 1227 bp, Glycine max
  Peptide Sequence Number=SeqID_150485
atgggacgagcttcatcattacttataatttttttggttcttggttcttcctttgccacctataatgtggtaacgatgataaggcactacggatcttcagaaggtgtggctgttaatgatggtgcattgttttttgaccctattactgagatgcctgatcatgtaaagaatcggaagacatctaaagtgccctttcatgtcgcgttaacggcgacggatgctccatataacaaatggcagtgccgcgtcatgtattactggtataaacaacaaaagaagttacctgggtctgagatgggaggattcacgaggattctacattctggaaatcctgacaacttgatggatgaaattcctactgttgtggttgatccccttccagcaggtttggatcggccgattggatttatagtttataatgtttctgttgctgttagaattgaattgataggatacattgttctgaataggccatgggcctttgttcagtggctggaaaagactaaaatagaggaagaatatgtgttaatggcagagcccgatcacatatttgtgcgtcctctgcccaatctggcctatggaggacatccggctgcttttccatttttttacattagacctgatgagaatgaaaaaatcataaggaagttttatcctgaggagctgggaccagttacaaatgttgatccaattggaaattcgcctgtaattataagaaagcttgtagatttcatcatcattgtgttgaaagatcctaatgatttgattgcaaagattgcccccacatggatgaatatttctttgaagatgaaagaggatccagagactgataaagcttttggatgggtgctagaaatgtatgtcttaccaaaaaatctgatagatatttttgttttagaagagccaaggtatgcttatgctgttgcatctgctctgcatggtgtgaggcacattctgcggaaagacttcatgctgcagcccccatgggatcttgaaactaacaagaagtacattatacattacacttacggatgtgactacaatatgaagggtgaattgacttatggcaaagttggtgaatggagatttgacaaaaggtcgcatctacgaggacctccaccaaaaaacttgcccctgcccccaccaggggttcctgaaagtgtggtaacccttgtaaagatggtgaacgaggctagtgctaacatcccaaattgggacacatcgtaa

SEQ ID NO: 33708 - DNA, 510 bp, Glycine max
  Peptide Sequence Number=SeqID_150486
atggctgcagcaattgagttgagcaaaggagcaattgaaggcattgaaattgagttcattgagatttcggaacttcccatgttgaacactgatcttgagaacaatgggacatacccaccaatagttgaagcttttcgctgcaagattcttcaagctcatagtgttctcttcgcttctcccgagtataattactctctcaccgctccactgaagaatgcaattgactgggcatctagacccccaaatgtttgggctggcaaagctgctgctattataagtgctggatatgatgactttggtgggggaagggcacagtatcatcttcgccaaattggagtgtatcttgatcttcatttcataaataaaccagaattcttccttaattcattccagccccctagaaagtttaacaggggtggtgatttgattgatgaagaggccaagaataagttaaagcaagttcttctatccttgcaggaatttacccttggacttataagcaaaggctga

SEQ ID NO: 33709 - DNA, 127 bp, Glycine max
  Peptide Sequence Number=SeqID_150487
atggagttatatttcagttgtggaggggcactgcaaaggtttggcaaggcaccccggttctggacgaacgtggacccacacaatgtgctagttgatggtgtgggggtgatgcgagggagaaatctag

SEQ ID NO: 33710 - DNA, 339 bp, Glycine max
  Peptide Sequence Number=SeqID_150488
atggaaaagcttcatgctgtgtgcatcccatacccagcacaaggccacataaacccaatgctcaagctagcaaaactccttcatgttagaggcttccacgtcacctttgttaacacagagtacaaccacaaacgctttctcaaatcaagaggtcctaattccctcaatagtgtcacatcatttcaatttgaaaccatccctgatggtctctctgataaccctaatgttgatgccacacaggacacagtttctttatgtgattctactagaaagacttgcttaagtcctttcgaatacctcctttctaaactcaatagtgaaccatcacttcacatgtga

SEQ ID NO: 33711 - DNA, 120 bp, Glycine max
  Peptide Sequence Number=SeqID_150489
atgagggggcactatgaggatgggtgtgcactttttaggaaaaggttgtttcaagttggaggaaagctgttagagcgagctattgaagaaactggatgcagaataaagtatgaagtatga

SEQ ID NO: 33712 - DNA, 261 bp, Glycine max
  Peptide Sequence Number=SeqID_150490
atgggggagggatgttgtacgcagccttacccttgcatatgcaaagaggctgtttccggattcgaacccatgaccaacaagtcaccaaggcacaactttaccgctgcaccagggctcgcgctaagcagtggaggtagagcaaaagcaatgattagagccgaaacaacaagtgaaatatgcagagggtttgcaatttgccgtgaaggtgggcatcaagtacagtggaaaaggaggaaggataggtctcaaaagaggaaatga

SEQ ID NO: 33713 - DNA, 2467 bp, Glycine max
  Peptide Sequence Number=SeqID_150491
tggagacccgacagcgtatgagaggttttggcgacaaacgggtgacaagagcacgatcacaatccctggatggcagtctctgagttatttttctgatgtgaccaacatttgctggtttttggaggcagagtttgcgagggaagtggtgaggctgcacaatgtggttggaaatgcagtcacggaagggcgtcacattgtggttggaacaggttcttctcagctatttcttgctgctctttatgctctctccccaattgattcacctgaaccaatcagtgttgtatgtgcctcaccctactactcgtcgtacccatcaatgacgaatcacttgaaatcagggctttacaaatggggtggtgatgcagaaagttatgagaaagagggtccctacattgagctggttacttctcccaataatcctgatggacacgtaagaagatctaaggtcaacagaagccagggatttttggtccatgaccttgcctattactggccacagtacactccaatatcagcgcctgcagatcatgatctcacgcttttcaccgtctcaaaaagcactggccatgcaggaatgcgcatagggtgggctcttgtgaaagaccaagaggtagcaaagaaaatgactaaattcatagagctgaatacaattggagtgtctaaggattctcaactcagggctgctaaggtcttaagggcagtttctgatagctgggaacaaggaaactccaaagagagcgagtcattcttcaaattcagccacaaactcatggccaacaggtggaagcaattgagactagttgtggagcgcagcgagttgttcagtttgcccaaattttctccagcattctgcacctttttcaatcaggtcttggagcctcaaccagggaaacgtggaagactgcgaaagcttccttcgaggatacaacatcttaacgagaagtggaatacactttgggccaacaacgacattaactctgcccaccatctgttcgacaaaactcccaaccgaagtgtctacctttggaattccatgattcgagctttcgcgcagtcccaaagatttttcaatgcaatctctctgtttagaaccatgcttggggctgacataagtcctgatggtcacacctatgcttgtgttatacgtgcctgtgctaacaactttgatttcggcatgctaagacgtgttcatggaggtgctgtggctgcagggttaggaagggaccctgtttgttgcagtgcacttgtggctgcttattcaaaactaggccttgttcatgaagcgcgtagagtattcgatgggatcgctgaaccggacttagttttgtggaattcgttgatttctggatatgggggctttggtctgtgggatgtggggatgcagatgtttagcatgatgagactttttgggatgaagcctgatggatatacactggctgggttgcttgtgggtattgcggattctggaatgctgagcattggccaaggattgcattgcttgagccagaagagtgggcttgattctgattctcatgttggtagtctgctgttgagtatgtactcgagatgtaagcacatggcttcggcatatagagtcttttgtagtattttgaatcccgatttggtcacatggtctgctcttatagttgggtattctcagtctggggagtatgagaaggtgctgctctttttcaggaaattaaacatggaaagcaagaagccagattctgttttgattgccagtgtattggcttctattgctcagatggcgaatgtaggactcggatgtgaggtacatggttatgctcttcggcatggattggaattggatgtcagggtctcctctgctcttgtagacatgtattcaaagtgtggtttcttgcacttgggaatttgtgttttcagggtaatgccagaacggaatattgtttcttttaattcagtaattttgggttttggcttgcatggatgtgcttcggaggctttcaggatgtttgataagatgctggagaaaggattggtacctgatgaagccacattctcttctctcctatgtgcctgttgtcatgctggacttgtcaaagatggccgggagattttccagagaatgaaacatgaatttaacattagagctaggcctgagcactatgtttacatggtgaagctccttggcagtgctggagagttggaagaagcttacaatctgacccagtccttaccagaacctgtagacaaggctatcctaggagccttattatcatgctgtaatatttgtggaaattctgagctggcagaaaccgtagcacatcagctttttgaaagtagtcctgccgataatgtctatagggttatgctttctaatatatatgccggtgatgggaggtgggatgatgtgaagaagttgagggataatatgacaggaggcccgagaaaaatgcccggactaagctggattgatggcagttag

SEQ ID NO: 33714 - DNA, 714 bp, Glycine max
  Peptide Sequence Number=SeqID_150492
atgaactttgagaagttcaagaatgccgagaacaatgtcgttaacatagcaaaacccggaggcctcggccttcttggcgtggtgcaggccgccggcccaattaatggcgatatcggcgtcgccgcggttgaggcggacggcggcgccgatggagccgccggggaaggcgcggcagaagtcgaagaggccgtcgaagacggggcaatcctcgccgacgttgaagcgcttgagctggcggtagtgggagtgggaattctgggagaggatttgcggcgagacggtggagaggaagtcgacgtagtcgtcggagtggaagcggccgatgtcggcctccgcggcggggaaggggcggttgacctgcatgcggcggtggaggccgtagtgcacgatgaggttgtgggccatgcgaaagcggtgcggcttcatcgggtgcccttgcccgtagaagtagtagccgatgcacggctcgtagaagtacgtcattctccgcttcttcgcgtccgtgcccaccgacggcaacgggacgccactcactgtctcagctctctcccctctcgccataacactccaaacccttctttctccctcttttttttttttcctctgcacaatctagctactcttcctaccactactactgaactttcaaatttatatgccacgcatcatttcgttattctattatcattccaaaactctctcaaatctagttaa

SEQ ID NO: 33715 - DNA, 540 bp, Glycine max
  Peptide Sequence Number=SeqID_150493
atggcccttcctgttgttgggttggtttggtttgaagacatgttgtattgtatttgttctagttgtcaaatatctaaagccaccatagcaagttgtctctcctatgtgccagaggccagggggcagggactgaacattagcaggattagagcttctgatttctcatgctgtcatgcatatggtgcccatataagtctctctctgtgtgtttgtgttggcgagttggtttacactgggaattatgatctataccctaatgccttttcatgtctaccggcagacctgacttggagctttcctacttcagattacaatatatatgcaaagaatacattactggaacaactttccaggcttccccatgcacccaatgcaccttttcaaacaacaccatcagtcatagaagttccagaagaggaagaggaggacatggatgtaagaccaaaaccttgtatatggagttgtgaagattttgattctgatcatgatgatgacatgggtagttcaaagaactctgatttaactgcccaaacgatgtaa

SEQ ID NO: 33716 - DNA, 867 bp, Glycine max
  Peptide Sequence Number=SeqID_150494
atgagtcacaaagacgagtacggagatggggataacaagaataacaatgatgatgaagatgatggtgatggtgatgacaacggtggtcatcatgatggggataacaacaataacaacgataacgaagatgatggtaatggtgatgatgacaacggtgatcatcatgttcttcaacaacaacaaacaattacacgttgtttgtatccaaacgcctataaaagtggtgattgtggtggttcttgcggtgcgtatggtcgtggtgcctttacgaactgtggcgcgagccgtggtgacggtggctctggcagtgatcttggtgtcagaatctccaatacctgggttaatccgaattctaacaatcctggtccaagtcatagtcaaccaagtgtcatgctcactagttcaacctctcaagggatgggaaaacttacttgtcctcacactcatcatcaaaatggtgtggttaagagaaagcatagacatataattgatttgggtcttaacattgttgcatcatcatctttacctttgaaattttgggattatgcttttgctacatctcttgtcaattcagagtctactacccttgcttcatcttcttcagaatttatttctataccaaattttgtaccagttaatacttatcctatgcaaacaaggtctaagtctggtattcacaaccctaggttacatccttctatgtttcttactcattttgagtctaaaactataaaacaagctttggcaaatacagatcgacttactgctatgcaacaagagtataatgccttgctaaagaacagaacttgggacttggtaccattagctcctaataggcaagctattggttgtaaatgggttttaagg

SEQ ID NO: 33717 - DNA, 483 bp, Glycine max
  Peptide Sequence Number=SeqID_150495
atgacagtgtcgtttcataagtttagggattttttcccaggaactgggcacagtaaagacattggggtgggtgctggaaagaattattctctaaatgtcccactcaatgatggattggatgatgagactttctgtggtctgtttcgccccatcattcaaaaagttatggacatctatcaaccggatgcagttgttcttcaatgtggagctgactcgttgtctggtgaccagttgggttgcttcaacttgactgtgaagggtcatgcagattgccttcgtttccttagatcattcagtgttcctctaatggtcttgggtgggggaggatatacagttcagaatgttgctcgttgttggacttatgagactgcagtggcagtaggagtggagcctagccctaagttgccttacaatgaatattatgaatattttggcccagactatataatcttcacatcgagctatccacaatggaaaacctaa

SEQ ID NO: 33718 - DNA, 333 bp, Glycine max
  Peptide Sequence Number=SeqID_150496
atgtcgtccaccaatattatttttctctccaagtttctgctccttcttatccttcttttgaaccctcatgaagccaacaacacaagagggtgttctacattcgtttgtgtggctggtgcaagacccttggaacataatgttcctaagtacattaacttgaagcctcatgggaaaagcaatggaaagagaggtttcgcccaaggagggggcgtggaagcttgtttgccaaaagggtttcgacggtcttctgctccaagcagatatattaattatcagcctcttggatcgacatgttcttcaagcaaggtagtgaataatggtcctcgagcctga

SEQ ID NO: 33719 - DNA, 183 bp, Glycine max
  Peptide Sequence Number=SeqID_150497
atggctagatgtatattgaaagctaagtctatgccaaaggagttttgggtcgaagctatttcatttgatcatcttaaagtctttgggagcattacatacgctcatgtgtccaaccaagggagattcaagcttgatgataagagtgtgatgcatgtgttcattggttatgatgcaagttcataa

SEQ ID NO: 33720 - DNA, 549 bp, Glycine max
  Peptide Sequence Number=SeqID_150498
atggaggaagaaattaatgttattaagaagaatgacacttgggagttatcaaaacttcctaagggtcatgaagcaattggagtcaaatatgtgttcaagattaagaagaatgccaaaggagaggtggaaagatacaaagcaaggcttattgctaaaggctacaagcaataccataggttgattatgaggaagtttttttaccggttgctcacaatattatctttaccgacaataacccaaatttgtttgaaagctatgtcttttgaatttgagatgacggatattggactcatgtcctattacttgggacaagaagtgatgcaaatggagaatgacatttttgtctttcaagagagctatgaaaagaaagtgttggagaaattccaaatgtttgattgtaactctgtgaacacaccgatggaaggtaacttgaaactgccaaagcttgatggtggagagcaggaaaatcctactttgtttaagagttttgtaggaagtttgaggtacttaagtacaaggttggatattatgtatgtggttggtgtataa

SEQ ID NO: 33721 - DNA, 495 bp, Glycine max
  Peptide Sequence Number=SeqID_150499
atggctctcggcgacgatgcacagcaccactctcccttgttcctcgatgcccttctctgcgaagagcgagaaaccttcaaagaagactttgatgaaaacggttatgagcgtgagaccgaaaacaacgaaccctctgtgataaagtcgcaatctttgcccttggttttgcacgataatgatctgttctgggaagacgaagagctcgtgtcgttaatcgcgagagagggagagactcatttgtgtttttatggtgtcgttgctaatggggccttggaaggacctcgtgttgagaatctagcagacatggatatcacattcaagggttacgggattggcttaagggctagggttagggggaattgggtcgatggaaccatgaaagatggggtggatttgattccaatatcaagccgcaattcaaagcctccaggtgttgaattgtgggcagttcttgatgtccctgacattaggttggcgcttcttggaaaaatttaa

SEQ ID NO: 33722 - DNA, 186 bp, Glycine max
  Peptide Sequence Number=SeqID_150500
atgcctccacctccaaagaagcgagagattttgaggacttcccttaaaggtgttgacaaggtgaaaaaggtgtgtctacaaactcttcgtagagagtttgaatccttggatgttcgtgctgtagagaaggttcttcattctctaaccataaaaattgattttgtggtttgtgcaattgaagagtaa

SEQ ID NO: 33723 - DNA, 378 bp, Glycine max
  Peptide Sequence Number=SeqID_150501
atggaggagaaaaaattcaaagaatacatggttgtggaagaggacgtggacatggccaaggaagaaaaggaagaggagatgatgacaatgttgataataatgaaagaagttatcaacccactagcagtcgtgaaagaggaagagatagaggcaattttggaagaacaaatgaaaggaggtatgataaatcaaattttgaatgttataattgtcataggtatgaatgatgataagtgcttgtggtatcttgacaatggagcaagtaaccagatatgcagttacaaggagaaatttgtggagcttaaagaaaaggtgaagggaaatgtttcctttggtgactcttccaaggtgcaaatcctagggaaatgttccatttaa

SEQ ID NO: 33724 - DNA, 631 bp, Glycine max
  Peptide Sequence Number=SeqID_150502
gatccaacaacaacaagatgttttaaggtggttactagaacctttaagcgttcagtggacacaattggagtggcaggataagtatttgtcaggtccacacggtttggttcagttgtgctcagatgtgcctgttatgtggtcaatttttcatacagtgacattctttgagagggcacttaagaggagtggattgaagaaagccaattggaattcagaaaacagctcaacaccaaattcaatccctttaaatccaatggcctctcgcatatcatggatggtgactcctctcttgaaactacttcgctgtatacattccctttggtctccatctgtaagtcaagctttacctggtgaggtcagagctgcaatggtcatgggtgatgttgagaggttcagtcttcttggagaagggaactctaaattaccaaaaggtgtcacagatggatctaagattgacatgaataaagaaggatacactgaacccaatgaatcagatattcgaaattggtttaaaggcatcagagacagtggtcttctacaagatggtagagcaatggttccggatgctcatggcattcttagtggatcagacttgaaagtggaagtgatggaggaaacaattccaggataa

SEQ ID NO: 33725 - DNA, 189 bp, Glycine max
  Peptide Sequence Number=SeqID_150503
atggaccgaaggttattgcctctttgttatttgagaaaggggggtggtttgcggtttctagatctgagaaaagggagggtggtggtgtcgccaccattggcttggaagagagtagttgtggtagcggtttcatcgttatcattggcgtcgttagcatgctggttgcatgtgttgtggttattggcttga

SEQ ID NO: 33726 - DNA, 453 bp, Glycine max
  Peptide Sequence Number=SeqID_150504
atgatgaagaagagtggttttgagaagatggtgtcgcagaagaacaagaacaagggaggctatgatgatcatcagaaaccgaggaataacaggtttttggtaaacatcaatatcatggggagtgcggggcctataaggttcgtggtgaatgagaaagaacttgtttctggggtcattgatactgctctcaaatcctatgctggcgaagggaggcttcctgttcttggatttgatgccaccaatttccttctttactgcgcaaatgctggctttgatgctctgagtccattggaaccgataggatctttggggtcgaggaattttgtgctgtgcaaaaagcaggtgcagtcatcaaaggcagcaccccaatctgagttggtgtctcaaaagagcaatggtggatggaaggcatggttaaataagtcatttagtttaaaaatcctatcccattga

SEQ ID NO: 33727 - DNA, 465 bp, Glycine max
  Peptide Sequence Number=SeqID_150505
atgatgcatctctcgcaccatataccttgtcatcattctctcattcctcgaccctcttccatattctcctatccccctccttccaacccccttttgtcgtcccatctccctcgtccttctccccgctcctccctcctcttgccacctccctccaccctcatcgacgcctaccacaacaacctttccctgaccccttcaccctctcctagaaacctttatggcaaccactctttttctctgaacttcgagtttatgtcaaacccaatcggcgacttaacaacccaaacaaaactctcccctcaccactccaacgctttccttagttccatcatctgtgaagttgagatcatgggagcaatggtggtgggtggtgactggttgccggtaacaatggaggagttgttgcaaatcgcctccaacaatgacatgcaagacaatgttgaggttcacaaggaagagagctag

SEQ ID NO: 33728 - DNA, 1599 bp, Glycine max
  Peptide Sequence Number=SeqID_150506
atgtcgtcgacgacgcagaatcgtcgttcgtcgtttacttcctcgacggcgtcgtctttggcgaaagcgaaacgacatccatcgtcggtgtcgtcgtcgtcgtcggggaaggcgaaggtggtttctactcagaacttggctgtgaagagagcgcctctcgccaacctcactaatcaaaggaacgcgccttattcttcttcttcttcttctttggtgcaaggttcaaataaagttgccaagaccaagaaagaggctcctgcaagaaccagcgtctcaaaatcaacaatttctgggaacaaatcttcccagttaaaatctgttaactcaagctccgttgttattccaaaggctaattctttatcacaaaagaaggatgctgctcccacagttgccacatttgccgtgcctgttcgtagcggcattgatgtttctcctagtaaatcagatggaaggttcgtttctatggatgagacaacatcttcatgtgattctatcaagagtccggatgaagttgaatatctggataacagggatgtttcagatgttgattcaattcagaaaaagataataagcaatttgaacatttctgataccacagagcccgaaggaaacgtatgtagtagggaaataattgttgagttggaagaaagagtggacaagattgtcaatatcgataacatttactctgatacgcagctttgtgcaacctatgtttgtgacatctacaaacacctacgtgaatccgaggaaaagaaaaggccttccactgacttcatggacacaattcagaaggacataaatgttagcatgcgcgctatattggttgactggcttgttgaggtggctgaggagtatcgtcttgtacctgaaacattgtatttgacagtgaactacttagatcggtatctttcagggaatgctatgaataggcaaagtaaatatgaggagatttgtgcacctcaggtggaagaatttcgttatataactgacaatacttacttaaaagaagaggttttgcaaatggaatctgctgtcttgaattatcttgagttcgaaatgacagccccaacagttaaatgtttcttaagacgatttgttcgtgcggctgctcatgatgtccaggagatcccttcacttcaactggagtgtctaaccaactttattgccgaattatctctcttggagtacagtatgctgtgttatcctccatcacaaatagctgcctctgcaattttccttgccagatttatacttttcccttcaaagaaaccatggaattccacattgcagcattacacgctctaccggccttcggacttgtgtgcatgtgtaaaagatctccatcgtctttgttgcagcagccatgattctaatttacctgcaatcagagataaatacagtcagcataagtttgcttacttcctcctcatacttcacttgcgaacagtacaaatgtgtggccaagaagtgcatccctccttcaatacctcaagaagttttccagagttgaacaaaatgcatagttggaacttggaagatgatgcagatggagatgtgctgatggagctagtgttcttctccatggctagcataaaatag

SEQ ID NO: 33729 - DNA, 480 bp, Glycine max
  Peptide Sequence Number=SeqID_150507
atggaaaattgtcagtgggagcaagagttacaaccctacaatcaacatgaagaagaaagaagttctaatctggataatttgttgatgcaattcaaggaatcaactgaatctactcaacaagcatttaaaagtctagaaattcaagttggtaagctagcaaaagaagtggctaaatttatgtccacaagggaagaaaactttgtagaggttgaagctcaagaggaaagccttgtagaagagcatgattcaagagaaaaagatgaagaaaaaatcaatacccctcctcatcaactgattatcaaggaagaaaggcatggagaacatgataaatctttaagtgtcattctctccttgaacaccaacacttctcttgcaatgatatggaaggtgtttctagaatacatgagtttcatggagtctatagctaagaggcgaaaatgcaaggaagatgagttctatgtgacctttatgccaccttga

SEQ ID NO: 33730 - DNA, 168 bp, Glycine max
  Peptide Sequence Number=SeqID_150508
atgtgggcagagaggttcgaagaaccaagggaaattagcgagtgtgactactcggcatttggtgcactcatttggcacagggaactcatgggcctcacattgctactgttgacgagattcaagactatcctttttggagttttggagcttggggagcttgggtgctga

SEQ ID NO: 33731 - DNA, 231 bp, Glycine max
  Peptide Sequence Number=SeqID_150509
atgtcatcgggctcgccgcctctagatgacaataggtgcagaatgaccataatttgtctctgcgtgccaccggactggatcgtctctggatggcaaaaatgtgtctggatgaccaaaatttgtctgcgcatgtcatcgggctcgatgccgctggatgacaaaaggtgcacaatgaaccatcatttgtctctgcgtgccaccagactctatcgtcactggattgcgaaacag

SEQ ID NO: 33732 - DNA, 855 bp, Glycine max
  Peptide Sequence Number=SeqID_150510
atggacatgaacattggagcccttacctcaggtcagatttcttccattgctcagagtaactcctctaggctcggatttccaaccttgatcactgccctctacagagctataggagttacctctgacagtctgacctataagagcctgatcccgaccattaacttggcctacattaagaagagttgttggaatgtggatgatctgacaactaactttagaggggcaaggaaggcaagggctcgaccagctgatgttccctcttcttctgctccaccagctccttccactttcgctactcctacaccagctcctccaggcccatctgcccaggaatctcagcgctttgaagccatgcttcatagtcttcatcaaggacaaattttgttaatgcagagcttgcaggtggtagctcctccaggatccattatgttagtggaacagttcatggagaaggtatcctggcccgaaatcctgccttctattgtgagagaaggtgggggtcccagtgctcaggtacctcagcaagtacacaatgcatcttctgaagccatcatccctggagcttttgatttttcaggtggaggattagagatgagactcaatgaggctacttctcctaagctagtaccagtaccagctgatccaccatctatagtggtggatccatcttctccagcaccagaagcacctctcccatctacacctcttattatctctaaagaccccacaattccagtacctggattagcaactactcctcctgctacccccgttatctatttttcagatgagaaggagggatggactacaactcctccggggactccagtgctacatttggatgatgaggagtag

SEQ ID NO: 33733 - DNA, 1738 bp, Glycine max
  Peptide Sequence Number=SeqID_150511
atggttggttatgacttggctgagtttgattgtacatccttcacttacaaatgtgaaagtagtaaaagtactaacaagtggaagttaaatgtatgcagggagtttaatgaggcaacaggaatggatgatccagaatctacaatggcaaaagttgctaattttgtggagcaactgcatgccaacttgtcatcaccagttgagaaagaaactattacagcacgcttgctaggtattgccaggagaagaaaggatgctagagcaatcatcggttctcatgcccaagccatgccattgttcataagcattctcagaaatggaacccctcttgcaaaagttaatgttgcttccactctcagtgtcctgtgcaaagatgaagacttgaggttaaaagtacttcttggtggctgtatcccaccattattgtctcttttaaattatgaatccaccgatgccaggaaggcagcagctgaagcgatatatgaagtttcctcaggtggtctttctgatgatcatgttggtatgaaaatttttgttacagaaggtgtagttccaaccttatggaatcaactaaatccaaaaaacaaggaagacaaaattgtggagggttttattactggagcattaagaaatctttgtggcgacaaagacggctactggaaagctacattagaagctggaggcgtggatatcatagtagggctcttgtcttcagataatgctgtttctcagtcaaatgcagcttctctattggcacgtttaatgctggcattcagtgatagcatccccaaagtaatagactctggagcagtcaaagctttacttcagcttgttggtcaggaaaatgacatttctgtaagagctagtgctgctgatgccctagaggtcctctcttcaaagtctaccaaggctaaaaaggtcattgttaatgcagatggtattccaatccttattggagctatagttgctccttctaatgagtgtatgcaaggtgatggtggccaggctctgcaggagcatgcaactcgagctttagccaatatctgtggtggcatgtctgctttaatactatatcttggagaactttcacgttctcctcgccctgatgcaccagttggtgatataattggcgctcttgcttatacactcatggtctttgaggaaaaagttgatgttgatgagaaacattttgatgcaactcagatagaggatattctagtaactcttttaaagcctcaggacaacaaactaattcaagagcgtgtccttgaggctatggctagtctatatggaaatgtctgtctctcaaagtgtctcattcaggcagattcaaagaaggttctgattggacttataaccatggctgccactgatgtgcaagagtatctgatactttcattgacaagcttgtgttgtgataagattggagtatgggaggccattaaaaaaagagaaggtatccaattactaatatcattgcttggattatccagtgagcagcatcaagagtactcagttcagttgctagcaatcttaactgaccaggtcgatgacagcaagtgggcaatcactgctgctggagggattccaccattggtgcagttgttggagacaggatcacagaaagcaagagaggaagcagcaaatgttctgtggagtttgtgctgtcacagtgaagatattcgtgcttgtgttgaaagtgctggagccatcccagcattcttgtggcttcttaagagtg

SEQ ID NO: 33734 - DNA, 4209 bp, Glycine max
  Peptide Sequence Number=SeqID_150512
ggtgatgtcaagccactaatcaagttagctaaaacatcctctgttgatgctgctgaaactgctgttgctgcattggccaatcttctctttgatccttttattgctgctgaggctctagcggaagatgttgtttcagctttagcaagagttctggcagaagggaccttggaaggtaaacaaaatgcatctcgtgcacttcatcaattattgaagcattttccagtaggtgatgttctcaagggtaacactcaatgtcgtttcactgtgcttgcacttgttgattccttaagagctatggatatggacggcactgatgctgcagatgctttagaagtaattgcactgctagccagaactaaacagggggtcaactacacttaccctccatggtcagctctggctgaaatgccatcaagtttagaacttcttgtctgctgcctggctgaggggcattcccttgtgcaagagaaagcaattaaaattctatcaagactttgtggggatcagccagttgttcttggtgatttgttatctgctagttccaaatccattggttcattggctaatagaataatgaactcctccagtctagaagtaaaaattggaggttctgccttactaatttgtgctgcaaaggagaagaaaaagctttcaatggattcacttgatgcttctgggtttctaaaaccattaatatattctttagttgaaatgataaagcagagttgtagctattctttgttagaaattgaagttgttgcttctaaaggttttatggagagaagttcttttcaagaagtcgatgagtttgatattcctgatccagccactgccttgggaagcactattgccatgtggttgctttcagttattgcttctttccatataaagagcaagctcacaattatggaagccggtggacttgaagctctctctgacaaactttcaagacatacttcaaatccacaggcagaatatgaggatacagaaggaacatggattaatgccttgctcttggccattttatttcaagatgcaaatgtcattctatctcctgtcacaatgcgcattataccttctatcgctcttctgctaagatctgatgaagtaattgataaatattttgctgcccagtctatggctagtcttgtttgtaatggtaataagggaatagatcttgccattgcgaattctggtgctgttgctggattgataactattattgggcatgtagagtcagatatgcctaatctcatggctttatcagaagaattttctttggtacaaaaccctgatcaagttgttttggatcacctttttgaaattgaagatgtaaaagtggggtctaccgccaggaaatctatacccctcttagtggatctcctgagaccaataccagaaaggcctactgctccaccagttgctgttagactcttgatatgcattgcagatggaagtgatagcaataaattaatcttggctgaagctggagctctggaagctttgaacaaatacctgtccttgagtcctcaagactcaactgaggcggctatttctgagttattgagaatattattttccaattctgaccttattaaacatgaagcatcaactaattcattgaaccaactcatagctgttttgcgtcttggatcaagaaatgctagatatagtgcagcaagagcacttcatgaactttttgatgccgacaacattagagactcagaattagctaaacagggcattcaaccattggttgacatgcttaacacaacatcaggtaatgagcaggaggctgctctcatggccttgatcaagttaacttcaggaaattcttcaaaagtatctcttcttcttgatgtggaaggaaacccacttaaatgtttatacaaaatactgtcttctgcttcgtctttggaactgaagagccatgctgcccaactctgctttgctctgtttggcaatagcaagatcagagcagatccagttgcctcagaatgcctagaaccctttatatcagtgatgcagtcggattctgagactagaatagaatccggggtagagcttgcagcagcctacaatgttgtgtatctccttgtgagcttggtttctggtacaaactatcagcttatagaggccgccatatctactcttatcaaattgggaaaagacaggactccaattaaactagacatggtgaaagctggcattattgataattgtctcaagctactacaattagcacctagctctttatgctccacaatagctgagctgtttcgcattttaactaatagcagcgcaattgcaagaagttcagatgctgcaaaaattgtagaaccacttttccatgttttgctccgccgagatttcaacttatggggacagcatagtgccttacaagcacttgtaaatatattggagaaaccgcaaagtcttgcaaccttgaagcttactccaagccaagttattgagcccttaatttcttttctggaatccccatcccaagctattcagcagcttggcacggaactgttatctcatcttcttgcacaggaacattttcagcaagatattacgacaaagaatgcagttgtgcccctcgtacagcttgcaggaattggaatattaaacttacagcaaacagcgataaaagcattggaaaagatttccacaagttggccaaaggcagttgctgatgctggaggtatttttgagcttgcaaaggttattattcaagaagaccctcagccaccacatgcactctgggaatcagctgctttagttctctctaacgtattacattccaatgctgattactattttaaagttcctgtggtggttcttgtgaaacttttgcactcaacacttgagagtacaattagcatagcccttaatgctttaatagttcatgacagaagcgatgcttcaagtgctgagcagatgatggaagctggagttatagatgctctgttggaccttttaagatctcatcattgtgaagaagcatcaggtagattactagaagctttatttaacaatgtgagagtacgagagatgaaggtgtctaagtatgctatagcacctttgtcccagtatctattggatccgcaaaccagatcacagtctggcaagcttcttgctgctttggctttgggagatctttcccagcatgaaggacatgctagatctagtgcctctgtttctgcatgtcgtgcattgataagtttacttgaagatcagccaactgaagaaatgaaggtggtggctatatgtgcattgcaaaactttgtcatgaacagcaggaccaatagacgagctgttgcagaagctgggggcatactggtgattcaggaattgcttttgtctccaaacacagaagttgctgcacaagccgctttactgatcaaatttttgttttctacccatacattgcaagaatatgtgtcaaatgagttgatcaggtctttgacagctgcactggaaagagagttatggtcaaccgccacaatcaatgaggaggttttgagaactctacatgtgatattcatgaacttccctaagctccacacatctgaagcagcaactctttgcattcctcatttggtaggggcacttaaatctggtggtgaagcggctcaggactctgtacttgacacattttgcttgctaaggcaatcttggtcaactatgccaatagatatagctaagtctcaagctatgattgctgctgaagccatccccattttacaaatgctcatgaaaacctgccctcctagcttccatgagagggcagatactcttctgcactgcttaccaggttgtttgactgtcaccattaagcgtggaaacaacctcaaacaaactatgggaagcactaatgcattctgccggttaacaataggcaatggtcctccaaaacaaaccaaggtggtgaatcataatacttctccagaatggaaagaaggattcacttgggcatttgatgtacctccaaagggccaaaagctgcacatcatatgcaaaagcaagaatacttttgggaagacaactcttggaagagtcactatccaaattgataaagttgtatcagagggggtttatagtggattattcagtcttaatcatgatggtaacaaagatggttcttcccgaacacttgaaattgagattatatggtccaacaggatttccaatgatgacatttga

SEQ ID NO: 33735 - DNA, 213 bp, Glycine max
  Peptide Sequence Number=SeqID_150513
atgactctcccaatgtttgcaacaacaccatcattgccagagccacctagaaacaatacttgccacaacggagtgaaggagaatccactagctatcaagaccttgggagtgtcgaacgatgacagagcttgtggcacactatcaagatgtacgttcaacaacaagcttaagggtagcagtcacgttcaacaaggtatgcaccttcgaaagtga

SEQ ID NO: 33736 - DNA, 863 bp, Glycine max
  Peptide Sequence Number=SeqID_150514
atgagcttaatcccaggattaacggtgaaacttagtgaaatatgctacgaaaagaagaactctttctctccttctctcctcttcttcgccagaaacccctttctctctcctcctcctccttcttctccctcccaccacctcacttaccctcttcctcatcattcaggttaccctccatcaaagccacctcccaaaatgaccccccctcctccaaaccctaaactcattcctttcccccattgtcaaaaccacctgcatcctcatcgttgccaccgccttactcatgcgtttccaccacaccctgccatcattgttgccctactcactccccctgcccctgacactggcactgccctcactgaggacgaagtcgagagggtcctcgaagatcgtctcagcaccaaccctcacgacactgacactcgccatgcccaggccttcttagtgcccttcttctcgtccctcaatttcaacatgcgcgaccacaccatgaaggatcccgccatgcagattgatcgccaattgcaggtggtggttgtttgcttcaggtgtggtggtgatggttcagctggtggcttgggacggaaccggacggtgacagtgacattctccttcgccttgctgacgtcaggcgcggcggcggtagtcaccggagagactgacgccttcgacgaaggcctcgacgcggcagaggaggacggcctcgaagcggtggaggacgacgacggagtggtaggtcttccagcgggtttgacggctcccgccggcgacttccttgagcggagcggcgagacggaggctcttagggaggagcgggcagcggaagacattgacggagaaagagaggtgagaggtggaagaag

SEQ ID NO: 33737 - DNA, 288 bp, Glycine max
  Peptide Sequence Number=SeqID_150515
atgatgtccaaatttcaggacgatccaacgggtacatatgttgaaggaatcaaagaggaagttgtgttatcccctgctcatgccctttctttgattgctactggcgaagagcatagacatgtgggttcaaataatttcaatctagtcagcagtcgaagccacactattttcaccttgactgttgaaagcagttcccgagatgaaaatataggggaagaggatgtgacattgtcccacttggtaatactgataagaccaggattattcattactatattgctccagtaa

SEQ ID NO: 33738 - DNA, 216 bp, Glycine max
  Peptide Sequence Number=SeqID_150516
atggggcggcgaaaccctaattcccctagctgggggtgtggggaattggaattgggtgaagtgagggcagaattcgggaaacggagagaggagaggaagaagggagaaacaagattctactactgccagccaccggtaaaaccttgtaacacgctacctcacctcactttccttttcacaccacaccgtgcttcacttgccttggcctcctgttaa

SEQ ID NO: 33739 - DNA, 462 bp, Glycine max
  Peptide Sequence Number=SeqID_150517
atgccttttgggctcactaatgcacctacaacttttcaggttctaatgcataatgtgttccatccttctttaagaagattcatcgtcatcttctttgatgacattctcgtttacaatccaactatagaggattatgctactcatttggaacttgtgttccaaattaacaaggagcataaaattttcttaaagaaggataaatgttgcattgccatttccaaggttgagtatctaggacacttcattactaaggaaggtgtgtctactgacccttctaaggacagacatccaattgcctatattagcaaatccttgggtccaaaacaacaagcatggatgtccaagctcatgggatttgattttgaaatcccatataaggaaggggtggaaaataaggctgcaaatgctctttccaggaaatctaggcctgaactactaccaatgatgcttgacaatgcatag

SEQ ID NO: 33740 - DNA, 495 bp, Glycine max
  Peptide Sequence Number=SeqID_150518
atgaacaaagatattcaacaatcttgtcatagaagcaaaccagatttagttgcatctcctggtctgttccagcctctcccaattcctagcaaggtttggaatcacatcaacatggacttcattgaagctaagtggtggtacaataccaatttccatttagcaattcaaactaccccttatgaagtagtttatggcccgctaccttccattcaccttccttatcttctcagagagtcctccatagtggatagaactttaaatgctcgagaggttgtcatcaagatcttgcaatttcatctcccgagggctcagaatcacatgtctcaacaagttgaaaaacacatgggtgataggagtttcacaattggtgactttgtttacctcaagttgaaaccttatagacaacattctatttaccacgacatttttcacaagcttcttccaaagttttatggtcctttcaaggtgattgatagtattggcaaggttgtttaa

SEQ ID NO: 33741 - DNA, 240 bp, Glycine max
  Peptide Sequence Number=SeqID_150519
atggctgctcattggggattgctcagagatttggtggcaaggcacaatggtttgtgggtggctatggtggatggtttgaggtttttgatgatgctgaaaaagatttgcttgataattattctcatcatcaaaaagggagagaatgtgaataatgcagattttgatgatgttgagaagaattcacttgctaatgattgtcatcatcaaaaagggagagattgtgaatgtatgaatacataa

SEQ ID NO: 33742 - DNA, 252 bp, Glycine max
  Peptide Sequence Number=SeqID_150520
atggagggaggagtagggttgttggagtggggagaaggttcactttatggtggcgatcgattccagttgtggaatgaaagcgatctacgtaacaagcgatatttggacacgtgtgggaccgcatgtcaaaggcgattgacgcttgcagaatatctcaggttgcttaccatttattcttatcttaatatcctttacacctgtacactcaattccaatgtacctctactacatacatctgttgtgcatgcatag

SEQ ID NO: 33743 - DNA, 190 bp, Glycine max
  Peptide Sequence Number=SeqID_150521
atgaaaagaatacgaatctggggatcccacggtcatgtggctccgcatgccaccggactcttgggtcatggtaacaaaaggtggggtggtcgacaaaagcagcatttcgtttctaaacgaccatttagaggaaacactgggttcaacaaaaatagaagaaaatcactcaaagtgtatcaaccttacacag

SEQ ID NO: 33744 - DNA, 528 bp, Glycine max
  Peptide Sequence Number=SeqID_150522
atggctcttgttctcaacgtctcattgtgttccatttctaaaccccatctttctctctcaacctccaatcccaacaaagcttcttcaactcttcctcttcctattctgggacttaaaacaaagcaaagtctccaaccatctcagaaactcacattttcattgggtgaatcagtggctggtgccaccctcgttgctctcctctctgcttctttcatctttgttgatcccgcacttgcattcaagggtggagggccatacgggcaggaagtgacaaggggacaagatctcactgggaaggactttagtggcaagactctgatcaaacaagacttcaaaacgtccatactgagacaagccaattttaaaggtgcaaagttaataggtgctagcttctttgatgctgatttaacaggtgctgacctttcggatgctgatcttagaaatgcagatttttccctggcaaatgtgacaaagatcaacccaaaattttgcataatcgcagtgactaaatatagggcaattgtatga

SEQ ID NO: 33745 - DNA, 1002 bp, Glycine max
  Peptide Sequence Number=SeqID_150523
atgtctatcaactctgactctgatcacgaggagacccctcctccttttatcgaccccagccagcaaccttctagcccatttcacatccatcccagtgaaagtcgtacctctattattgttaccccaccacttacagggaacaactaccaatcatggtctagatccattcggatggccttgatatccaaaaacaaaatgagcttcctcactggaacaatttccatgccgactagcactgaccctctatttcctcgttgggagcgttgcaatacgcttcttatgtcttggttgattcactctgtttctccctttatcgcccagagcatcattttcttcgaaaatgctgctgccatctggattgatcttcgcaaaaggttctctcaaggcgatttgttgtgtgttgccaagttacaagaagagatttactctctcaagcaaggttctgcttctgtcatcgactactacactactctcaaatctttgtgggaggaattagacaatttccgtcctttgactccttgcacttgctcagtcaaagattttcattatcaggatttcattatccgatttctcaaaggactcgatgagcgcttcaccatggtccgatcaaagattctacttcttgatcccctaccttctgccaacaagtcagggggaggcaaatcgaactttttcaattgcaaatatgaccactgtggtcgccttggccacaccagcgatgtctgctatcagaaacaaggaaataccattcctaaatgtgaacattgcacgcgatacggtcacaccatggatatatgctacaccaaatttggatatccacctggccactcaaaatacccgggccgacctcgccttcccaacaagactggagcttctgaaggtggcgccgctggtggtgccgctgtcaacaatactacaagagaaggaaaccgaaccctacatggagaagaaaataaggatgggtcaactacaatacccgatcccaacatcacacaggcctaa

SEQ ID NO: 33746 - DNA, 147 bp, Glycine max
  Peptide Sequence Number=SeqID_150524
atggtttgtgccttattgtcttacttggaaccagacttcacggatgtaccactaagagaagatcaacgtgaatacctctgcaaagttgctgatggagtgaacccaacaactggaaatgctacacgtgatacattgttctgtaattag

SEQ ID NO: 33747 - DNA, 315 bp, Glycine max
  Peptide Sequence Number=SeqID_150525
atgactgctggcaaaggaaaacccatttttgaagtagttcttcctttgggattgccattcaaggtcgctcccgactggcggtggaaaaaaaaaactggtggaccattcggtcctgccaacaaatcttattcggagccccatgaattgcttgtcattcatgcatcctccaccatcgagtctggagccccacgaattgattgcttagcgttgttcatctatcctccaccctcaaatcttatccggagccccatgaattgcttgtcattcatgcatcctccaccatcaagttcgaagccccacgaattgattgcctag

SEQ ID NO: 33748 - DNA, 651 bp, Glycine max
  Peptide Sequence Number=SeqID_150526
atgacaaacccaacaccaaaacctagtcctagtcttcttattacccttcgtgtgatcttaggttgttggttgtgttcatccgttgcatttggagccacctacaatgtggtcaattttggagccaaatccgatggcaaaacggactcaaccaaggcatttctcaatgcatggtccaaagcttgtgcttctaccaaccctgcctcaatttacgtgccacaaggaaaattcttgcttaaaagtgtgactttcaatgggaaatgtaacaacaagggtatttctataaccattgatggcactttggtggctccttcggattatagtgtcaccggaagcgccggtacgtggttggaattcgagcgtgtcgacggcgtttcgattcgcggcggggtgcttgacggccaaggcactgccttgtgggattgcaagaactccggcagaggaaactgccccagcggagccacggttatggttgctagccagaagaagttgaagcaaatatcaaacgaggagttagtcactgtatatgccatacaaacactggcgttcaccaactccaataacattgccatcggtgggttgacctcaatgaacagtcaaatgttccacatagtgttcaatggatgccagaacgtgaagctgcaaggagtgaag

SEQ ID NO: 33749 - DNA, 372 bp, Glycine max
  Peptide Sequence Number=SeqID_150527
aagaagtcctcaacaagggaatatcaatgctagttgatcatggagactttcaattgattactggtccaagtggtactcaagtgcctagttgcatcctttccacgaatgatatagtggtttctaaaaagggaactaaatgttcattggactctttcatgaatctttttaaaggttatagtgtggtatctgttcctagactcttggtcatgcgtaatactcttaggtttgccatgggaaatctccctttttcttacctaggagtccctcacttttgtgataagtcatcatggaggtttggagatggcacctcaatctccttttggactcagttgggacaacctcttgttgaaatgctaaatattccagaagcag

SEQ ID NO: 33750 - DNA, 1497 bp, Glycine max
  Peptide Sequence Number=SeqID_150528
atggtaattgctaaattaacagatggaaaggcaactcatattccttatcgagattcaaagctcactcggttgttacaatcatcccttagtggccatggacggatttctctcatttgcacagttactcctgcttctagcagtagtgaagagacacacaacacattaaaatttgcacaccggagtaagcatgttgaaattaaagcttcccaaaataagattatggatgagaaatctctgatcaagaagtatcagaaggaaatttctgagttaaagcaggagctgcagcagttgaagcgtggcatggttgagaatcccaatatggccgcatcttcacaagaagatctggttactttgaagcttcagcttgaagctgggcaatccaaattgaagtcgagattgcaagaggaggaacaagctaaagcagcattgatgggaagaattcagcgactaaccaaattaatcttagtttctacaaagaatgcaatgtcatcaagcattgcagaaaggcccagtcatagacgaaggcattcttttggggaagatgagctagcatatttaccagatagaaaacgtgagacctggattaatgatgacacagggagccatgcttcagttccttcaccagaagaaaaggatgacattaccaatttagatgaattggggaaggattataaaagaagcaaaaggcgtggaatgcttggttggttgaagctgagaaaacctgataatattgatggattatcgccaaatgttgatagtgagggctctggaaatgggtcacctgcatctgcttcaaaattaactccgaacagagttatgcttcatgacatgaaagattcacgcaggagttcagtcagaagaaaggataatgcttcatctctaaattcttttccaggaagaactcaagcaggtgacttgttcagtgtaactgttggaggtcatcaacttcctccggtgagatctcaaatactagtgattcatattgctggaaaggcacatgatacatgtatcttgaaaccgactggaactactgttacagatcaaatggatcttctgcgtgaacaaataaaaatgttggctggagaggtggcattttgtattagttctctgaaaagactgtctgaacaagcagctaacaagcctgaagatatccaactacaagagggcatgcataagttgaagggtgaaattagccaaaagaagaatcaaatccgtatcctagagcaacggatgattggatcaataggacatgcaccaaataacagtgaaatgtctcagtgtgctacaacccatggtgaacagatgaccaaaattaccttcttaaaatgcccctctaaccatagtctggattttggacaccgtcagcatagtgatgctataatgccgataaatgctgctattgcggccactacaactgccacagcgaagtgtaatggcagtgcactatgcacctctacgccactattgcacactattgacaaccctgatattaactga

SEQ ID NO: 33751 - DNA, 153 bp, Glycine max
  Peptide Sequence Number=SeqID_150529
atggtggatgcttcaagtagcataaggaatgtgggcttgttgctcctaaggagcagaacctacaatcacctgctgctaaagtcagagttttgtaaaagatgtggagcagcacttaaattaagggacttgctagatgcacccagcacactttga

SEQ ID NO: 33752 - DNA, 423 bp, Glycine max
  Peptide Sequence Number=SeqID_150530
atgattgctatgttgaaaaactcatgtagaatcgcactcaaggaattgaaacattggatgactcctgaaaaggtcaaaacttcaatcgcaacttttccttcttcagctgaaatagtatctgaaccactgggggttgtgttagtcatctctgcatggaactacccattcttgttgtcacttgatccagtcgttggagctattgcagctggtaatgctgttgttttaaaaccatcagaaattgctcctgccacatcatcactgctggcaaagcttatcggagactacttggataactcatgtattagagttgttgagggagcagttgatgaaacatctgcattactgcagcaaaagtgggacaaaattttctatacaggttcttgtttgtcactcttctgttttcttggtggttctgaatcctga

SEQ ID NO: 33753 - DNA, 225 bp, Glycine max
  Peptide Sequence Number=SeqID_150531
atgcggatcaacctaaataccctagcggatcaacctatctacagtggcacaaaagtaccagaaagggaaatggtgcttacctcgacggtggacgatggcgaagctcttcacgacaacctcctcaatgcacctcacgaaaacctcttcacgacaatagtggtgggtgaagaagaagaggaaactcaagcgctagtgaagaagaagaagaaatggcaacacgggtga

SEQ ID NO: 33754 - DNA, 354 bp, Glycine max
  Peptide Sequence Number=SeqID_150532
atgttgagtgaaagttccaacactaaaccacatgctaaatataggatcatggttaagactagaggattaggccgtgcgttaggtagggttggtgccagaggtctggggagaggaggggatggtgatgatactgacggtgctccccagtgccaaaggccgaccgcatcggcacgcaggcgacgggtacttgtcattcttgatgatgatgtgcctgtggtacccgcagactcgcctgcggtaccagaggcagaggttgctatagctggggatgagtccatggtagatgttgccgcacaggccaccggtgcagagactgatgcacaggataccggtgcagagactgacgaggactag

SEQ ID NO: 33755 - DNA, 258 bp, Glycine max
  Peptide Sequence Number=SeqID_150533
atgtcgtcgacgccgcaggactctgtcaaaacgacggcgtcggcgaagaacaccgcgttcgacgcggaagcggcgtcgcggctcgtgaatgagcttaggcgaaacttcgcttcgaacaaaacgcgcagttacgagtggagactgtcgcagctcaacgcgctcgagaaactcgtcgtcgttcacgagcaggagatcgtcgacgcgctccgaaacgacctcggcaagccgccactcgaaaccgttgcatacgagtgttga

SEQ ID NO: 33756 - DNA, 636 bp, Glycine max
  Peptide Sequence Number=SeqID_150534
atgggtgacatagacgaggtgcaagaacagatgaaggacgatatggtggccttgaaagaccaaatggcttccatgatggaagccatgctaagcatgaaaagattgatagaaagtaacgcggccacgactgccgccaccgaggcagaccctaatctttcgtttgccacgaatcaagcatatcaacctgccccaaacatggggggacaaggaggagagatattggggagcactggtggcccgcatctagggtataacataaatgcctacccctatggcttacccctcaatttcacaccgcccaccatgcatgagaacgtggatcatgccgttcccataaccttcgaagcgttccacgctatgcctcagcctaatactgtgggagcctctcaaccccgctcgatacaaccactacatttctacgtagggggaccaccaccgatagtggaaggaaaaggaaaacttaatctcactgaggagagattaagagcggtcgaagcgtctgacagcttagccggggcggcgaacacatggtacactagcttggaaccctcccagattcattcttggaaggaccgaatggtttccttcgttaggcaatatcagtacaatgctgatatggctccagatagaatgtag

SEQ ID NO: 33757 - DNA, 384 bp, Glycine max
  Peptide Sequence Number=SeqID_150535
atgaagcccgaaatgtccttaaggattaaagaagaggtgaaaaagcagtttgacgttggctttttggctgtggctcgataccccgaatgggtggccaagatcgtgccagtccctaagaaggatgggaaggtgatgtcctttagactcaagaatgccggggcaacctaccaacgggttatggtagcattattccatgatatgatgcataaggaaattgaagtctacgtggatgatatgattaccaagtctagaaccgaggaggaacaccttgtaaacttgcggaagctgtttgaaagactgtgtaagtaccaactcaaattgaatcccggcaagtgcaccttctgggtcaagttgggaaagttactcggcttcatcgtaagttag

SEQ ID NO: 33758 - DNA, 440 bp, Glycine max
  Peptide Sequence Number=SeqID_150536
atgggtccggatcatgcgcaccaacatgaccaccctcacacatatatggatgaggtgagtgtgcacgtggctcagctcatatctgacgctctttatcagtttgcagggattgcacctaagagacaccctatggactcggagaagtccaacagggccctggggccttcatcaagaaatactgcacccccaggcaggctcagggccaagcaccacgacagcctggggacggccaatagcaggcagttgaggatgcaccaccaccacctgctgaggttggaacgctgtatacgacatgtggctgaccaacaagtggccagccacaggggtcaggctgcagtagcatggcccggagattggcctgatttctccacaggcgcctctggagagggagacagagcccaggaggatgaggacatggccgacatgttggacttcctcct

SEQ ID NO: 33759 - DNA, 757 bp, Glycine max
  Peptide Sequence Number=SeqID_150537
gcggctgcctctgcgggcggtatcgtgggcagcctgtctcagtcacagctcggcgatgtcggagaaaagctggtcaattcccagttctcccagcgccaggagtccgaagcggatgactactcttacgatctgttgcgcaaacgcgggattaatccgtcaggtttagccaccagcttcgaaaaactggcgaagctggaagcgggacgccagagctccatgtttgacgatcacccggcctcagaagaacgtgcacaacatattcgcgaccgtttattcgccgcattacccgccgctgcaagccagcaatccgacagtcagggttttattgacgacagccatctggacctgtttttacgcaatgcgtatatcagtcgcgactatcatcagggccagcaggataaagccgaatggggccagggtattattgccaccttcacatccggttataccgaagggctggtgggctttggtgtagacggcattgcacagtatggcgttcgtctggacggtggccgtggaaaaagcggtgcgggcggtatcgacttctttaaacaggaagacgatggccgggcaaagtccgatttagcgaaatttggcgcaaccgccaaaatgcgtatctcaaataccgtgctgagctacggtaatcagcgtcctgagctgccgatcgtgaatgccgacaactcccgcctgctgtttgaaagctacaccgggaccctgctgacctcaaaagagatcgacggtctggaagtcaacgccg

SEQ ID NO: 33760 - DNA, 375 bp, Glycine max
  Peptide Sequence Number=SeqID_150538
atgcagctttctgaggataaagttgtaaaccctcaggcctcagcatcatcagcaacgcatggcagcggaacccgaccccgtgagaaccgaatcgaacccgccccgactttgacggataaaaaccgcgttgaccgggttcggggtcgggttcgggttttccccgataacccaaaacgggggcgggggcgggtatgggattacagccgctacagctactgcagctctcagcctctcagtcaaggagaagtggtggagaacgtgaggccgctcaagagaggacgcaacgaagaggaagtactattggagaatgtggagctgatacttgacgcatttgattatctccaacttccatttgcactaaagcaaggtatatag

SEQ ID NO: 33761 - DNA, 258 bp, Glycine max
  Peptide Sequence Number=SeqID_150539
atggataagagcttgaaggtaagagaatatgagtggagggagaaggagagagagaagagggagaatgagcgagcattcactaagggtgacactcagtggctaagcacaaggaagaatccagaagaagatgagttgtcaggttcgctgagtgcaccgctccaggtcatcaagcacaccactttagctcatctacttatgcgcactaagcgatccagatttgcgctaagcgcgcgagcacggaccaacccacctatttaa

SEQ ID NO: 33762 - DNA, 333 bp, Glycine max
  Peptide Sequence Number=SeqID_150540
atggcctcatctaacttcctatttcccgagggaaactctattaataggcctcctatctttaatggtgagggttatcactattggaaaatccgtatgcagatttttatagaagccatagatttgaatatatgggaagccattgaaattggttctttaaatcctacaacggtagtaggaaatgaaactatagaaaaacctagagatcaaagggatgaagatgaaagaaaaagagttcaatataacttacaagccaagaatataatcacttctgcattaggcatggatgagtactttagagtttcaaactgtaaatgtgggatacattacaagtaa

SEQ ID NO: 33763 - DNA, 258 bp, Glycine max
  Peptide Sequence Number=SeqID_150541
atggtggatgagaggagagaagaagaaggctgcgcacttgcacaagctcttgaagaccaaagctatcctaagaaagaagatataaagtggcatttgattagtgacttcttctacaagaaggccattggttatgtgtctcctctatcccctcctccatcacctatccatcttccatgtgattcaaactctaaggattctagtgatgagttttttaggaagcttgatgaagattttgttgctgccaagcaaaagggataa

SEQ ID NO: 33764 - DNA, 1105 bp, Glycine max
  Peptide Sequence Number=SeqID_150542
ggagaagaagatgaatcacactcgcttggagtcttgtcatgaatctccccttaaagtatacaaattctgttttgtcccagaaaaacttggtgatatggttatactcttaataaggtttggcattcttgtgtgtcttgttgcatccatatcacttgctctccactcagcattctctaaaccagaccggtggttcccgttaccggagcatattcgcgccgtccagaatacttcagtcattgacaacagaccaacaaacatctcacatcttcaatttggcattgctggatcagcaaacacgtggcatggccgtagcaactacactaaactatggtgggatcctaacaccactagaggttatgtttggcttgacaagaagcctaagattttgcacagtgacatattagtaccaccttatcaaatctcacggggctggactcggttcaagcacgtgcactcagcatctgctgttcggatagctcggatagtttatgagagctttaaacttggtttgccaaatgtcaggtggtttgtgatgggagatgatgataccgtgttctttactgagaacttggttactgtgttaggaaaatatgatcacaatgaaatgtattatattggtgggaattctgagagtgtggaacaagatgtgatgcattcttataacatggcatttggtggtggtggatttgcaatcagttatgcattagcagctcaactagccaaaataatggatggttgtctaagtagatacttctatttttatggttctgatcaaagagtctgggcctgtattcatgaaattggggtgccccttaccagagaaaatggattccaccaggatggtcccttcatattcaatactcgacctatgagctctgacccgtgccagcagccagctaggtttttcctggatcaggctacaaaggtgggaaaaagtggaagtatcactatctacaagagacatgaaggcaaggaagcaaagtgcaacagagaaggcactaataatgaggaagtgcaaagaattagagtttctgccttgaagctggatccagaatattggaagaataacttcttagcttgccatgatagtaatgtactcgaatag

SEQ ID NO: 33765 - DNA, 300 bp, Glycine max
  Peptide Sequence Number=SeqID_150543
atgaccacagattcaccttcactccttatgttcccatggactcggtggagtcgccaactgtcgcaacctacccttcggcgggagggcgacgcgagactcaccagtacatcttccaaggaaggaaaacgcgcggagtctccaccaaagtttattcgaggaaaacgtcggaaaaaccggaaaaggggtgatctacgaactttaagtgcgaaaggttcgggagttgtatttatgcacggggaagggtgtttccctttctcctacgtattcctcaattgtgataaggaaatcagacctacatag

SEQ ID NO: 33766 - DNA, 1179 bp, Glycine max
  Peptide Sequence Number=SeqID_150544
atgggtgacgtgcaagctacgttgcaatcgttagctcaacagatgcaacaacagagtttgattatgagtgaattaagcaagcaaatcgctcagaagggagtgaatcaggagagtgagaactcggtgggggaatcatcacaagaggaatctcgtctttctggcaagaaggtgaagttgccactgtttgaaggtgatgaccttgtggcttggatcacacgagttgagatttactttgatgtgcaaaacacaacggacaaaatgcgcgtgaagctggctcgactgagcatggaaggctcaaccatacattggttcaaccttttgatggaaacggaggatgaattgtcatgggagaagttaaaaagggcgttgatcgcacgttacggaggccgacggctagagaatccatttgaagaattgtcaacaataaggcagaaagggagtgtagaggagtttgtggaggcattcgaattgttatcctcacaagtgggtaggcttcccgaggagcaatacctgggctatttcatgagtggattaaagcctcagatacgaaggagggttcgaacgctaaatcctctaaacaggatgcaaatgatgcgcatcgcgaaggatgtagaagaggaactgaaagaagaagatgaagatggggagagaagtgatagtaaaaagggggtgcaggatcggatgggtcgaaataattgggctggatcatttcagaagagccggagcgggttgaacccgagagacccaattcgttcacctaatttgggttggtctaacccaacgcagaaaacgggttctagcggctctaacacgatctcaacgttgtcgttagcatcaacaggaaggaaaggggagaccgatactcgcactggggtgtcggagaagtggaagggagtccggagcatccgtaacaacgagatggctgagaggagagccaagggtttatgcttcaaatgtggggggaagtatcaccccactctccataagtgtcccgaacgagccctaagagtattgattttaggagaaggagaggctctgaatgatgaaggggagataatggccatggaagctgtgcagcctgacagcgaagaggagattgaagtagaatgcaaatccatgggagtactaggaagtatgggagagcaccgtactatgaagattgaagggaaaattgaaaat

SEQ ID NO: 33767 - DNA, 819 bp, Glycine max
  Peptide Sequence Number=SeqID_150545
atggagcttgcaaagagggaacaggttaaccggtttaccaagattgctgctccaagtggactgttgaatgacttgaaccctggaattataaatcatgtgaggaatagaaaacaagtgctttcaattattgagaatcttgtaaggtctgaaaaacatgaaagcactagtgtggggagtaagcacgcagcacattgtatacaaggaaatgtagaagttagtaagagggatcaagaaaatgtggctgatgtaagtgagcatcagcatgactttgcttgtgaggaaggagcccttcatagcacttcagggagcagacaagctagaaagtttcctgtgacaacaaatgattcttcttccttgattttggagggtagagtttgtgattgtgacataggcagtttagataaaggtagtcttaaaagttgtatgacacagtcaacgaatgttgtggaggatgatgctttagctctgaaattgtcatctgaaatgagggcatcaatgagttccaccgctgctactgttgcttctcaatggttggagcttctgcaacatgacatcaaaggacgcctttcagctttacgtcgtagtagaaggaaagttcaatctgtaatcactactgagttgccatttcttttatcaaaggaatttggaaataaccaagattatgatccttgcactatgaaaatgtctgcgggacttcccactggcaaaatagcagatatgcatcgggcaagatggacttctttgtttgatcatatggatgaagctctttctgaagaggaaaagaaacttgtgagtgcaaaaaagacagcattattttaa

SEQ ID NO: 33768 - DNA, 273 bp, Glycine max
  Peptide Sequence Number=SeqID_150546
atgaatgcatcagaatcaggaggcgagaaagtgaaagagaaagagaacgagtttgagaggaacaaacggatttggatagagaacctaaagaaggaggtggctcgcgcgatgttacaaccggagaacgaggaatggtgcctgaaaatcgcggtcaacatggcgtcgagaagcaataccgagcgtggcgcaaggacatgtgcacgggtcaatcagcagaataatgcgactgatctcgcaacgcagccgtcgcaagaaaagcaggaaggaggctaa

SEQ ID NO: 33769 - DNA, 486 bp, Glycine max
  Peptide Sequence Number=SeqID_150547
atgatgagtataaaagttgatctggatggtgatcaaataaagaatcctgtgtttgacagtgaggaaaaggcttttgattcctacacgagatatgctacaagtcatggtcatgttgtgaggaaagatggtgttagtcgggatgttcatggtaaggctatcaaacataaagctcatagtctgcattcatttgatgtaaggacttgctacataatgggatgtttgttggctcaaaagggtagttatggtagtgtttgctttgaaaaaagtgatttgtataaccatttgcatcggaaaaagtgtctgctaattacagagggtgatgtgcgagttgcactgagttatttaaaaggccagtacgtagtatctacttctccatttctgaaatcagcattgtttctcaatctccatacacaccagcaggaagcataccaaaacatatgtctaggatttgggactttcctcactctcaaacagcttccaagttga

SEQ ID NO: 33770 - DNA, 405 bp, Glycine max
  Peptide Sequence Number=SeqID_150548
atggcaactaacttggactctgcataccatctgagccaacttgcttatcctcttcttaaagcatctggaaatggaagtattgtgttcatttcctctgttgaagctgccatcgatcagcttaccaaatatcttgcttgtgaatgggcaaaagacaatataaggagcaacagtgttgcaccttggtataccctaacatcacttgaggaacctttgcttgcaaacaaacagcttgttaatgagataacatctcaaacgccgataaagcggatggcagaaacgcatgaagtttcatccttggtgactttcctttgtctgccagcagcatcctacatcactggacagattgtttctgttgatggaggattcactgctaatggatttcaacccagcatgagaatttcttaa

SEQ ID NO: 33771 - DNA, 534 bp, Glycine max
  Peptide Sequence Number=SeqID_150549
atgcttttagtttatgtggacgaggtgaaagaatatgcaatgaagcaaattaaatctcaatacaagaataagctttatcatttacatcaagcttatcttaaagaaaaggatagatcaaaatttgtatctcgagaagattggaattggctaattaaaaacaagtggagtggttcaaaatttcaggaaagaagcttgacaaacaaagctaatcgaagcaagcaagaaataaaatcaattattggcacaaaatcaatcgtgcaaaaggcatttgaaatgaaagaagattcaaaatatggtaaatggccatatgctctggaagtttggaaggccacacacatgagatctaatggaacttggtgcattccaaaaggagaagaaatcatgaaagctttggagaatgtgggtgatatatatcaagaggaaatttcaaaagctcctataccacttgttgaaaattttgccatgctgtcaagtcaaactaactgccatgccatgcacataaaccactgcactatatgtatatggtttatgtaa

SEQ ID NO: 33772 - DNA, 192 bp, Glycine max
  Peptide Sequence Number=SeqID_150550
atgttagtgaaaaacctcgtcgggcgcctaggagtatatgacaagacaaactacacactaacaagtcaggtcactctcactaggcttaaaggagcaatcaaaccgagtgtatttacccccaatgcctacactctgaagagtccgtcagggcctctacctcctgattcaagtccaacccaaaaaatattttag

SEQ ID NO: 33773 - DNA, 710 bp, Glycine max
  Peptide Sequence Number=SeqID_150551
atgccactgaagggcaagcatttgatgatgtgcccgagcctaacacctcgagggggccctcagtaccacccacaaccacaacccttgccttttgcaatgggaagagtccctcttgccatggtggaaagggaaaaattcaatcatatagaggaaaggctgagggccattgaaggaggcagatataatgcttttgctgacatggcagagttgtgcctagtgcctgacgtcatcatctctccgaagttcaaggtgtcggactttgataagtacaaggggactacttgccccaagaatcacctgaagatgtactgtaggaaaatgggagcatatgcgaaagatgaaaaactattgatgcatttcttccaggaaagccttattggggcagccgtcacctggaacttggcaactcaagtagcacctccaatgatggagatggagatgataacaatgataatagacacattaccagtgttctactatgagaagatcgaagtggctatgataagagacaaatttgattatcttgctttgatgaatgggaagcctggggaaaatggagagaatgaaaacgagggaggaacccatgctgtgattgtcgttcctacatggccaaattgcccaccagctcaacaatatcaatactcagccaatatcagcccttctcattacccaccatcctatcagccaagaacacttaatcatccacaagg

SEQ ID NO: 33774 - DNA, 159 bp, Glycine max
  Peptide Sequence Number=SeqID_150552
atggaaagatcaaacaggaaaagaataagttatgaagggacttatagtgctggaaccagtggaggattgcaaactcatggggataatggcgataatgcgagaaggattgaggaagcaggtattgaactgatgatgagttgcgtttccaatgcgtggtaa

SEQ ID NO: 33775 - DNA, 249 bp, Glycine max
  Peptide Sequence Number=SeqID_150553
atgggtaagatggcaatgattacttaccaccgtggtcgtttaccttaccaggattccttcaaagcacttgaggctgatatacagcacaccaatgctttagtatgtgaagtgctatgcaaaacttgcgacaggaatgccaatggaggcaagagcaatttgagaattctgcagcaggatgagctactcgtgcacagcaacaagcaatggcaaagcaatttgcaaacaccaacaaaggcgaaccagttctaa

SEQ ID NO: 33776 - DNA, 438 bp, Glycine max
  Peptide Sequence Number=SeqID_150554
atggcaaacaacagtggtatcaagaaccttaacgattctaggaatccaagatcaaggatgggtcaaggtggtggcaatcttctggaaaatctaccgatcctcgacgacaagaattggcattggtggtatgcacgtatgaaggtgatacttgggtatcaagaagtccttgagatcgtggagaaagggtattcatcgcttgcagaagatgctacaaaagaacaaaaggtggcatataatgagaataagaagaacgactgcaaggccttatgtttgatttaccagagtgtggacaatgcccattttgaaaagatcgttggagcaaaaacctcatcagaggcatggaagatcttggagaaaggaaatgaaggcgcagttgaagaaggtgtgtcttcaaacgatgcgcatacaattcaaattgatgcagatggagaaaaatga

SEQ ID NO: 33777 - DNA, 216 bp, Glycine max
  Peptide Sequence Number=SeqID_150555
atgtcacccataatagacgaactcacatcagagttacgaacaaagcgtggtgatgcccctactaatgttagtgatcaatgtccttgtgacacacctgctctagcttctcatctcaaggaggtgagcttagctattagagagcttctcaaggaagctttctcaaagaagcttctcaaggaagttttctcaagaaagcttctcaaggaagctacctag

SEQ ID NO: 33778 - DNA, 336 bp, Glycine max
  Peptide Sequence Number=SeqID_150556
atgattgaaagtacgggaagtttgatgagaatcatgaaattggccaaatacaggctaaaggcccaagtggagaaggacgaaggcctaagtggagaaggacaaagcccccgagtggagaaggacgaaggcccaagttccttgttgaaccaatatcagacttatcaaggtaatccttgtggcgtctaccctgacttatcttccttcatcggaagtggtgtctaccctgacttatcttccttcactggaagtggcatcatccaaatctccatagcctgtatcaaacgattcgctcctactcaggttcacatcatctggtatcagagcttcggctcttga

SEQ ID NO: 33779 - DNA, 987 bp, Glycine max
  Peptide Sequence Number=SeqID_150557
atggatatgaagatcaatcaagaagagcaatttcctattgcaaagggaactgatgctgttgaaggcataactttagatttgagcgaattaacttgggatctatatttgagctctaattccttggcaaagttgtctaacatgagatttcttaaaatccatgattggtgctgcactttcggatttaatgtgtacctttcaaacggtctcgactcatgggatggatttagtcttgagtctttgccatataacttttgtagagatttccataaccttgactctgttggcaacaagttattatcagatgatcagcataatgcatcaaatttattgttcttaaaagcactccttcacaacattggctacttagtgtctttaagagagttagaccttcgcggaacaagtgttgagagcttgcctgcaaacatacaaaacctttcaatgttgacaacactttggctagatgattgcaggaaactcatgtctctgccgaagcttccaccatatcttgaacagttgagagcctttaactgcactttgctggagacagacaccactcaacgtttggtgttacaacacatgctgcaaagcagcataccctcctacatgcacaaacaacgtgtatattcaggcggtggatatttcattctcgcgggagaccatgtcaccaatgagtgtggcagacatgtgggttggaacgacaagtctactgtgcattgtgcaaatttaatttcagatcttgtgttgtttttgtatcatgatgtctgcaaagtttacagagagagtaaagttcatagcagtagcgacatgccatttaactttgaatttgattactatgatgtcaaggttggacgggataaacggagtatcaaagggtgtggggtcttcccagtatatttctctacattggggttgaaattggttagtagtagtagtagcagcagcaaggaggtggagcctcaaataatgaaaatgaacaggacttcatcg

SEQ ID NO: 33780 - DNA, 726 bp, Glycine max
  Peptide Sequence Number=SeqID_150558
atgttgcatactaataacctagtcaatggtctccctcaaattaagaatccacaagttgtatgtgagaaatgtcttgttagcaaacaacctagatcagcatttgggtcttatgtccctagtagagcaagtgatttgttgaatattatttactcagatgtatgtggcccctttgaagtttcttctctaggtgggaacacgtattttgtctcatttgtagatgaattcaacaagaagttattgacctatccacttaaagctaagagtgaagtatttgatacctttaaggtgttcaagatactagtggagaaacagtcagggaaaagtttgaagatcctaagaacagatggtggaggggagttcacttttgaagaattcgagaacttctgtagagataatggcataatccatgagataacaacttcatatacacctcatcataatggtgttgcagaaagaagaaatagaaccattatgaatatgaactcagtttcactagtaccagagaaggtttggtcaggtagaaaaccattagttcaacatctcagggtttttggaaccttatgctacactcatgttccagatcagaaaagaagaaagctagatgataaaagtgaagccatgatttttattggctatcaccctacaagttcatacaaactctacaatcccaagaaaaagaaagtaatctacagtagagatgtacaatttgatgaattaaaatactag

SEQ ID NO: 33781 - DNA, 468 bp, Glycine max
  Peptide Sequence Number=SeqID_150559
atggagaattcaattagacatcaagatgaagctataccacatggagaaggtaatgctaaacaaatcacagaacaaataagatcaggaagaatggggagaatgcttgcaagactcagagattaccacatgtttcctgacagtgcaatcacagatgagggtgagtttatgaatatagccttgatgactactatagaaccaaagtttgatggtaacatagctaagcataaagctaggctagtagttaaagggttcatgcaaaaggaaggagagggttacttagaaatatttgcaccaatggctagatttgagactataaggtttctagtaagcttggccagttggaagaattggaaaatttggcaattagatgtcaaatttgcattccttaatggccctttagatgaagaagtttatattcagcaaccccctggatatgaagtcataggcagtgaagacaagatgtactga

SEQ ID NO: 33782 - DNA, 219 bp, Glycine max
  Peptide Sequence Number=SeqID_150560
atgacatattgtctggagcatccagcaagaaacatgctgcttatgctggtggagccatttgaacctaacaaatcttgttatgtttgttctgaggtttgccaaatctcccctcctagacaacctagcagtagcgcaatcaaagatgaaatgaaatatggagcaacagaaagagagaatgaggttttactgctgctttaccaccaaagtaacacaaattag

SEQ ID NO: 33783 - DNA, 319 bp, Glycine max
  Peptide Sequence Number=SeqID_150561
ttctatttctcgatggaggcaagggatataactcagcggtagagtgtcaccttgacgtggtggaagctcgtgggattacacgaggggtgggggggctatatttctgggagcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacgg

SEQ ID NO: 33784 - DNA, 860 bp, Glycine max
  Peptide Sequence Number=SeqID_150562
atcagcccaagacatggtcaaactggatttcgtgggctgaatactggtataacacaacttaccatgtgtctattggtaagactccatttgaagtggtttatggcagacaacctcctagtattttgcgatttttaaccaatgagaccaaggtggcagctgttgcgatggaattaagtgagagagatgaggctcttaatcaactcaaattgcatctttccagagctcaagaccagatggctagctatgttaacaagaagaggcgggatttgtcttttgtcataggggaatgggtctttttgaagctacgccctcatcgacaacactctgtggtcaagaggatcaatcaaaaattgtctgctcgtttttatgggcctttcaaaattttggcaaaaattggagaggtggcttatagactgcaactcccagaacaatctcggattcacccggtttttcatgtgtctctgctgaagaaagccataggagagtatcaagttcaaggtgaactccccaaagacttggaaataacagatgctgctgatgcgtacccagaacaggtgatgggctccagagtaattatgcaggggggtgtggctgtgcaccaaagtttgatcaaatggaaacataattctttggatgatgttacttgggaagatgatgcctttttgcgtggtcaatttccagattttagccttgaggacaaggctatttctaaggagcagggtgttgatagaaacatagatccagagacatctgcatttgtgtttgttactgcaagcacccttctctgtgagctgctttttgctctattccctgagttgttggttgttgaaaaaggttttactgctatcaggacatcttag

SEQ ID NO: 33785 - DNA, 393 bp, Glycine max
  Peptide Sequence Number=SeqID_150563
atggaggaagaagttgatccatcgataaagagggagaagcacaaggaaaatggagtgacgaatgtgggctgcgaagacgattttcttgatagcccaattacaaaattttatcaagaaggaagtccaagcagcttagacatggagctaaggcagaagggatgtactgagccagtcaagttgattaaagttatatggagtccacccttgtccctcctaccaccaaagccactgaacctcaatttgcatgcaaggattgtgggtcgttcacagttaagctacaagggatttattgttggatcatctgcattagccatgctccaagccaatagccttgggcatgagggagagtgttggaaagccacctcaattgcagtgacccctaacccatcttag

SEQ ID NO: 33786 - DNA, 183 bp, Glycine max
  Peptide Sequence Number=SeqID_150564
atggtggatactagacatgaatgttggttgaatcaagtaaaagaaaagcaactgctatgtgaccagggcatacaacatgtaaactggagctcggtttttggtttacaacagctggggaattcagaaaacaactccagaatttggacttcatgcctaacccaacctcttaaaactgagttgtag

SEQ ID NO: 33787 - DNA, 528 bp, Glycine max
  Peptide Sequence Number=SeqID_150565
atgattgtcacacaccttcgctccaagggagttgcgctaaggtcatccgagaggaaaagctctatgaaaaagaaaaagactaggaagaagagaagaaggtcagagtatgaggtggtaaaaggaagatacatttatctgctggagatcaagggatatggttggtacatcctctacatttatttgctggagatcaagtggatagggttctttgatattcatgaacttgtctatgcaaggttggtcaaagatttctttgttgctctggtggtggacaataccaacttcaccttaaaggctattctgaagagtactaaggttctaatcatagaaaagcatttgtcaaatcttttgggggtacatgttgacagcaaaaggctctatggtgatttgtttgacatcacatgcctcaaaaagagcaagattatgaaaaagttattgaaggagaatgatgatgagtttaaatccaaattcttgacatcttttgggagaattgtgcactggatttgcatgcactctgtgttgccttga

SEQ ID NO: 33788 - DNA, 584 bp, Glycine max
  Peptide Sequence Number=SeqID_150566
atggagatttccttgattattgctcaaattgaggagtctcaagaggccacaatgacaaggtggagcaacaagaggaaacaaatatacaagaaatccgtctatgactcttcaacttggaaagataaggagacattcaagaaggagggaggattttcattcaaatctcatgaaaaagggttacattgcgtcccaatatcctacaaaagtgctatggttgtgttggataatggggatatcactagtgcatcttcttctagctcttctagtttttctagtgagagtgaaagtaaatgcgatgtacaacccctgaaagtctttggcacagaagaaatgagaaggtctgggaagggctcaactaccttatgcaatgccaagtggatccgtcctcctactgcttacctgaagggtaatgttgatgctgctttattcatggacctcggtatttttggtgtttctacatgcattagtgattacctaggtgaatttgcttctgccagaacaacttggtgttttggtaatccatcaccacgtgaagctgaggctatagggctgttatctactaagaagtggattgaagaatcagg

SEQ ID NO: 33789 - DNA, 4299 bp, Glycine max
  Peptide Sequence Number=SeqID_150567
atggcgactgcgacggaatttggggtatcgcaattcttgaagggtacctccaggcaaactctgtttttgaagaagaagcctcagaggcagaaaagtcgcatgctttggggtgcactctggaatcggaattggggtctgggatcaactcgcagagctttgcctttaaggtgtcagactcaggaaaatcccagagctgtggtttctggtggcgtaagcagttctgtagaggagcaacctgccttgtttgagaagcccgcttccgaagttgttcatttgtaccgtgtcccgtttatgcaagaaagtgcagctgctgagcttttgaaggaggctcaagtgaaaatctccagtcagatcgtggaaatactaacggagcagtgctataatgttggccttagttcgcaactttccggtggaaaattttcagttcttggatggcttcttcaagaaacattcgagcctgagaatctgggaactgagagctttcttgagaagaagaggaaggagggtctgattccagttattgttgaagttggccccaggttgtcattcaccacagcatggtctactaatgctgttgcaatttgccaggcctgtggtttgacagaagttaaccgtttggaacggtccaggaggtacttgttgttcaccaccactgaactgcaagattatcaaatcaatgattttgcatctatggtgcatgataggatgactgaatgtgtttatattcagaaactaacatcctttgagaccagtgttgttccggaggagattcattatatacctgtcatggagaggggacgaaaggcattagaagagattaatttggagatgggttttgcctttgatgaccaggatttagaatactacaccaaacttttcagagaagacattaagcgcaacccgacaaatgtggaattgtttgatatagcacagtccaacagtgagcacagcagacactggttttttactggaaagattttcattgatggacagcccgtgaatagaactctcatgcagattgtgaaaagtactctgcaggcaaacccaaataactcagttattggcttcaaggataactctagtgcaatcaggggtttcccagtgaagcagctccgaccagttcagcctggttcagcatgtccattagaagttgcagtccatgagttagatatcttgtttacagctgaaacacataattttccatgcgcagtggcaccttatcctggtgcagagacgggtgcaggaggtcgcattagggatacacacgctaccggaagggggtcctttgtccaggcagctacagctggttattgcgttgggaatctcaacacaccgggcttttatgctccatgggaagatccctcctttacttatccatcaaatttggcaccacctttacagattctgatagattctagtaatggtgcatctgactatgggaacaaatttggagagccattgatccagggtttctgtagaactttcggaatgagacttcctggtggggagaggcgagaatggttgaagccaatcatgttcagcgcaggcataggacagattgaccaccttcatatatcaaagggagagcctgacattgggatgctggttgttaagattggaggcccggcttatcgtattggtatgggaggtggggcagcctcaagcatggtgagtgggcagaatgatgcagagctcgatttcaatgctgtgcaacgtggggatgctgagatggctcaaaaactatatcgtcttgtgcgtgcttgtattgagatgggggataaaacccaattatcagcattcatgatcagggagctgggtgctgagatagatgtccgagcaattgtggttggtgatcatacaatgtctgttctagaaatttggggtgcagagtatcaggagcaggatgcaatcttagtgaagcctgaaagccgtgatctcctagaatcaatctgtaacagggaaaaagtttcaatggctgttattggaactatcagtggagatggacgtgttgttttagttgacagtgtagcagctcagaagtctatttcaaatggactccctccacctccccctgctgtggatcttgaactggagaaagtccttggtgacatgcctaagaaaacttttaagtttaatcgggttgtttatgagcgggagccacttgatattgtccctgggattgaagtgatagattctctgaagagggtattgagtttaccgtctgtttgttcaaagcgcttcttgacaacaaaagttgacaggtgtgttactggtctagtggcacaacagcaaactgttggccctttgcagattcccattgctgatgttgctgttacagctcaaacttttgctgatgtgactggaggtgcttgtgccattggagaacaaccaatcaaaggtttgttagaccccaaagcaatggctcggttggctgttggagaagcactaacaaatcttgtatgggcgaaggtcacttccctttctgatgtcaaggctagtggtaactggatgtatgctgccaagcttgatggggaaggagctgacatgtatgatgctgctatatctctatctgaagcaatgattgaacttggcattgctattgatggagggaaagacagtctttctatggcagcccacgccgagagtgaagttgtcaaggctccaggaaatcttgtcatcagtgtttatgttacttgtcctgatataacaaaaacagtgacgccagatttaaaactcaaggatgatggtattttgcttcatattgatttgtcaaaaggtaagaggcggttaggtggatctgctcttgcccaggcgtttgaccaagttgggaatgagtgtcctgatcttgatgatgttccttaccttaaaaaggtctttgaaggtgttcaagaccttctttctgatgaactgatatctgctggtcatgacatcagtgatggtgggctgctagtttgtgccttagagatggcatttgctggtaattgtggacttagtttggactttgcatcgcaaggtaacagccttttccaaacactctatgctgaagagcttgggttagttcttgaggtaagcaagaaaaatctggctttggtagtgaataaattgagcaatgtgggagtttctgctgaaatcataggtcaagtaacagccaatccatcaatagaagttaaggttgatggggagacttatttaactgaaaaaactagtatccttagggacatgtgggaagagaccagttttcagctggaaaagttccaaaggttggcatcttgtgtggatatggagaaagaaggactaaaacatcgttatgaaccctcatgggaactgccttttactccttccttcactgatgaaaagcttatgtctgcaactataaaacctaaagtggctgtgattagagaagaagggagcaatggagacagagaaatggctgcagcattttatgctgctggttttgaaccatgggatattaccatgtcagaccttcttaatggaaagatctctttgctagacttccggggaattgtgtttgttggtggatttagctatgctgacgtgcttgattctgcaaaaggttggtctgctagcataagattcaacgagtccgttttacaacagtttcaggagttttacaagcgtccagacactttcagtcttggtgtatgcaacggatgtcagctaatggctttgttgggatgggtaccgggtccacaagttgggggtgtgcatggtgctggtggcgacctatcacaaccgaggttcattcataatgagtcagggcggtttgaatgccgttttacaagtgtgaccataaaggactcaccggcaataatgttcaaaggcatggcaggtagtacattgggtatatgggctgctcatggtgagggaagagcttatttccctgatgaaggcgtgttggaccgtatagttcattctgagttggctcctataagatattgtgatgatgctggaaatccaacagaggcctaccctttcaatgcaaatggctctcctttaggggtggcagctatttgttccccagatgggaggcatcttgccatgatgcctcatcctgagcgttgcttcttaatgtggcagttcccatggtatccgaagcagtgggatgtggagaagaaggggcctagtccttggttacgcatgttccagaatgcaagagagtgcatgaagcttgaagcacttcaagatgagtatattcgttatgctacagagaagtgctcatctatgccaaaagaatattattcagtgtttgagaccatcacaggtctggttctcttgtga

SEQ ID NO: 33790 - DNA, 345 bp, Glycine max
  Peptide Sequence Number=SeqID_150568
atggaggaatccaatcgggaaaataacaaagatcacatttcccagtcaagagggtccgctcttgacggtgaagaacacgttggagaatggaaaaatccaatcgggaaaataacaaagatcacatttcccagtcaagagggtccgctcttgactgtgaagaacacactggagaatggtggattcaatcgggaaaataacaaatctcacattaaccagtcaagagggtctgctcttgacggtgaagaacacattggagaatggaggaatccatcggggaaattacaaagatcacatttcccagtcatgaagtcctctcttgaccgggaagaacacattggacaatag

SEQ ID NO: 33791 - DNA, 210 bp, Glycine max
  Peptide Sequence Number=SeqID_150569
atgctcactgcagcagaaggctcaatttgggcgccagattgggttttcgtaaaaacaaaaacgcaacaccactttccttggagcgacaacaaaggtcttcgagcaacaatgcttgttcaagttcaacagccgctcatttttataaaaatagatctaacggctacagttcctctggcacggtgggagaccaacgaatctttcccaccctag

SEQ ID NO: 33792 - DNA, 528 bp, Glycine max
  Peptide Sequence Number=SeqID_150570
atggaggacacccttcacctaaacatggtggattccaccttggaagcggcgaagaggttgttatccaagtccctaagggttggtgattgtggaggccttttacaatgcaatggaattggtggaatccctccagctacactagtagaaattacccttggaacctctcaatcaccattgcatttctatgatgttagtttggttgatgggtttaaccttccagcgtcagtgaagcctgcgggtggtggtggtgcaggttgcggtattgcggcgtgtgaggttaacttgaacgtttattgcccttcttctttggttgtggagaggaatgggaaggttgtagggtgcaagagtgtttgcttggctgcaaagtctgataggtatttttgcactggtgagtttgctgggaggtgcaagccaactgtgtttgctcatcttttcaagatcatttgccctaattcttatagctatgcttatgtggtcaagacttgtgtggcacctcgctatgtcattatattttgccctgcacattga

SEQ ID NO: 33793 - DNA, 2001 bp, Glycine max
  Peptide Sequence Number=SeqID_150571
atggccaaaaccaaaacacctgtgcttgtgcttcatctctgtgttctgacccttatggccacaaaccttggaaaatgtcagcaagaagagtttttcttcaacgggtttggtggtggtggtgcctccaacataaccttaaacggaggagcagcgattgagcacaagggcctacttcgtttaacaaacgacaatcagagagtaatcgggcacgcgttttatccaacaccaattcagttcaagcacaaaaacgccaaagttgtatccttttccaccgcttttgcgtttgcaatcatcccacagtacccaaaactcggtggccacggtttcgccttcaccatttcacgctccacatcgcttaaagatgcgtaccctagccagtacttgggcctccttaacccaaacgatgtggggaatttctcaaaccacttatttgcagtggaattcgacaccgtccaagacttcgaattcggagacatcaacgacaaccatgtcggcatcaacctcaacaacatggcatccaacaaatccgtggaagctgcgtttttttcccgaaataataagcaaaacctcaatttgaagagtggtgaagtgactcaagcatgggttgattacgattccttaaaaaacaacttagaagttagactctccacaacttcctccaaacccacttcaccaattttgtcatacaaagtagatctctcaccgattctccaagattccatgtacgttgggttctcctcttcaacagggttactcgcgagctcccactacatcctcggttggagcttcaaaacaaacggagacgccaaaactctctccttgaaaaacctcccttcgctctccgcctcctacaaagctcaaaagcgcttaatgttagcactgatcattccaattacactcgcagcaattgctctagcatgttattacagaaagatgagaaagaccgaattgatcgaagcttgggagatggaagttgtagggccacacagattcccatacaaggagctacacaaagctacaaaaggcttcaaagaccagaacctcatcgggttcggagggttcggtcgtgtctacaaaggtgtcctcccgaagtcccacatcgaagtcgcagtgaagcgagtctcgcacgaatcaaaacaaggcatgcaggagttcgtgtcggaaatctcaaccataggaaggctccgacacagaaacctcgtacagttactaggttggtgtcggaaacaaaacgagctattgttggtctacgatttcatgcgaaacggaagcttagacaaatacctattcttcgaccaaccgaggagaatacttagttgggagcaaaggtttaagataataaaaggtgtggctttagggttagtttatttgcacgaggagtgggagcaaacggtgattcacagagacgtgaaagcggggaatgttttgttggacaacgagatgaacggaaggttgggtgattttggtttggccaagctttacgagcacggtgcgaaccctggcaccacacgtgtggtgggaacgctggggtatcttgcgccggagctcacacggacggggaaaccaacgacgagttctgatgtttatgcgttcggggcgttggtgttggaggtggtgtgtgggaggaggccgattgaggtgaaggcgcagccggaggagcttgtgctggtggagtgggtgtgggagcggtggcgcgtggggaacgtgttggcggtggtggaccgtaggttgggtggggtgtttgatgaggtggaggctttgttggtggtgaaggtggggttgttgtgttccgcggaggcgccggaagagaggcccagtatgaggcaggtggtgaggtacatggagagggaggtggcgccgccggaggtgggggatgggaagaaagaaggtggcgggggagatggggagtttaagggttatgttcattcgtattcgacggcgtcgttttttgacgtggagagtgcatctgcgtcgtctctgtcactttccggtggccggtag

SEQ ID NO: 33794 - DNA, 2319 bp, Glycine max
  Peptide Sequence Number=SeqID_150572
atgggttcgaatctggaaccagtgccaattacatcccagaaacatgacccggcatggaagcatgttcagatgtttaagaatggggacaaggtccagctgaagtgcatatattgtctgaagatgttcaagggtggtgggattcataggattaaggaacaccttgcttgtcagaaagggaatgcttccacttgcagccgtgtcccccatgatgtcaggcttcacatgcagcagagtttggatggggttgtggtgaagaagaggaggaagcagaggatcgaggaggagattatgagtgttaatcctttgaccactgttgtgaactcacttcccaataataatcaggtggtggatgtgaatcaggggctgcaggccattggcgtggagcacaattcaactctggtagtgaatcctggtgaaggaatgagtaggaatatggaaaggaggaagaaaatgagagctgccaagaatcctgcagcagtttatgcaaactctgaggatgttgttgctgtggagaagaatggattgttccccaaaaagatggacaaccacatttatatggccattggtcggtttttgtatgatattggcgcaccttttgatgctgtgaacttggtcttttttcaagaaatggttgacgcaattgcttcaaaggggacgggttttgaacggccctcacatcatgaacttcggggttggatcctgaagaattctgtggaggaagtgaagaatgatatagatagatgcaagatgacttgggggaggactggctgttccattttggttgaccaatggacaacagaaactagtagaatactgataagttttttggcatattgtccggaaggcctagtgtttttgaaatccttggatgctactgagattttaacttctcctgattttctgtatgacttgataaaacaagtagtagaagaaattggagttgggaaagtggtgcaagtgattacatcaggtgaagaacaatatggtattgctggtagacggttgatggatacttttcctaccctttattggagcccttctgctgctcattgcattgatttgatacttgaagattttggaaatcttgagtggattagtgcagtgattgaacaagctaaatctgtaacaagatttgtgtacaattacagtgcaattttgaatatggttaaaaggtataccttagggaatgatattgtggatccctctttctcacgctttgcgacaaactttaccacattgaaacggatggttgatcttaaacacaatttacaggccttggtcacttctcaggagtgggcggattgcccatattcaaagcaaaccgctggtcttgaaatgttagattgcttaagcaatcaaacattttggtcttcatgcgacatgattgtttgtctaacagctcctctcttaaaagttctgagaatagctggtagtgagatgagacctggaatgggatacgtttatgctggaatgtaccgggtaaaagaagcaattaaaaaagcacttggtaagagggaggaatatatggtgtactggaatattatacatcatagatgggaaaggctgtggaatcatcctcttcatgctgctggattctaccttaatccaaagttcttctatagtattcaaggagatatactcggtcagattgtctctggaatgtttgactgcatagagagattggtacctgatacaagaatccaagataaaattatcaaagagataaacttatacaagtctgctgcaggagactttgggagaaagatggcagtcagagctagagataatctgcttccttctgaatggtggtcaacatatggagggggatgccctaacttgtcccggttagcaattcgaattctcagccaaacatctagtgtcatgtcctgcaagagaaaccaggttccttttgaacagataatcaacacaaggaattacatagagcgccaacatcttaccgatcttgtcttcgttcactgcaatttacgattaagacaaatgtttatgagtaaagagcaaaattttagtgatcccctatcatttgacaacgttagtaatgttgaagaatggattaggccgagggacttatacgtagacgatgagtgtgggaactcagattggatggcactggatccatcttcagttaacacaatgcttttaaggcctttaaatgatgaaactgaagatttgggtgaaggttatgatgattatgagattttcagttttgggaaagacagtgaggatgaaaacactggagacaagttgtgtaatatcaacgtgtttccattgttttcccaagtagtggttggaagaaattaa

SEQ ID NO: 33795 - DNA, 834 bp, Glycine max
  Peptide Sequence Number=SeqID_150573
atgaccaaaccaagcttagggaggtggcaaagggtacaagaacaacaacaactacaattgtcagggcacatagtgaaggattgttggtccacacctaagaggagcaataaccatggaagtggagccaaggttgaatacaagaacaactacgagtctaaggtggcaaaatctgatgaagtcgtagtgtctacccctactgacaaaccaattactacttctaatgcatgcttagacttttctatgatggtcaacgacaagactttctctgtgaatttgatttgttggcctctttctcatcttgatgtggtgttgggaatggattggttgtcatctaaccatgttcttctcaactgtaaaaacaagaccttgatctttggcgcttgtgcccaaggtatcccaagatcttcaagtttagagatctcccatatgagtgaatcttgtattggggagatgcctatagtatatgaatttcctcaagttttccctgaggatgtgactgagttaccacctaagagggaactcgaattttccatcgacctagtgtctcagtctagtcttgtatcaatagcaccataccagatgtctccaatggagttagccgaagtgaaggagcaagtagaagatttgttgaataaccagtttgtgagaccaagtgtgtcatcatgtggaacgcaaatgctcttagtaaagaagaaaaagggtagcatgaagatgtgtgtggactacagaaaactcaacaaagtgacaatcataaacaagtatccattattgagtattcatgacctcgtggatcaactaagaggtgcctcagtgttttcgaagatcgatttgtga

SEQ ID NO: 33796 - DNA, 204 bp, Glycine max
  Peptide Sequence Number=SeqID_150574
atggttgggcgacctaacaacaccactgctgaacttctacctcatatgactcaagtgctagagaccttagtgcaagatcatgatgttgaacaaatcgagtatcgggggttacctactttcactaagcacaatccacccaagtttgaaggcaactttgatccagaaggagcctacatgcacaaggacagaaatacattcccataa

SEQ ID NO: 33797 - DNA, 336 bp, Glycine max
  Peptide Sequence Number=SeqID_150575
atgaatcacaccacctccgagccaaacgctagtgacctttactatcctcaacctctactctccaacaaaccgagcacacctaaaccaccgcacttaccatattcatcgcacacagagcgcgccatcactgcagaccaccaccatcaacctccgtcaaacacccaacctctgatgacaaaaaaaccacaacctgaatcattgttttccgtctatgagactaatcccatctttgtcacgctctccttgtgcggtggttggggagtcagaattgcaccattacggcttcgtctgcgtcgttctcttctgcgactctctcctcttgaacaaccatggtga

SEQ ID NO: 33798 - DNA, 300 bp, Glycine max
  Peptide Sequence Number=SeqID_150576
atgacatcatgggacgcgtggttccattctatgatcggtggtctcgcagtatgggaaaacattcttgtaccggttcagttccatgctcccattggtcgtaacaaaacagacatgatcaaggaggtgccgatgaacacacgcagggagtatgtgaaagtttcgttcaaccctagttgctctttggacaagggcttgtgggacttgaggggcatctacatcggctctaaaaccgatgttgaaagtgacgatgttgaatgtatcatcattaacattggttttcaaaaaccgatgttaacataa

SEQ ID NO: 33799 - DNA, 1008 bp, Glycine max
  Peptide Sequence Number=SeqID_150577
agaatcaataatgtagccttgagagagcaactgagtgatgtggaatccctttcagaggaacttattgacaggactctgcctacttttctacaacaagtagaggatggaacttggacttcaggtgggtggcctcaagtatacactgactactcagtgtccaaacttgcagttaatgcctatacaaggcttatggcaaggaagctttttgagagaccagaaggtcaaaaaatttatattaactgctattgcccaggttgggtgaagacagctcttacagattatgtagggaataatactgttgaggaagggacagatgctggagtcaacaatctcatagaggaagaatctaaatggaaggtaggaaatggtataaagattgatgtatggcgtgacgagtggattcccaacaccatccacaacaaagtgtcttgtcagcctcaaaatgaagttgaagaccagatgactgaaacgcttatcagaagcatcttttctgaacatgatgcccaacaattccttggaatccctttgaggatgttccctgaccaagatagagtggtgttgaaatattcagaggatggatggggagtacacgacatcttgagtgttattgttgctccaaaacgtaggaacttggtatggagaacccgtaaaggaattgtgtcagtaaggaaaactctccgaaggaaaatccaagtcttagatcccatttcccctgctgcggagaggatgaagagacaattgaaccctgcttcatgtattgtgaaaaggtccaacaaatatgaaaccaaggatagggggctttgcacagcagatgtttgggatgttatgaacggtattggaattggcatgggcgtagtttgtcgtgatttagaaggaaacgtcttggcctcggccacgagccaacttccttatgttcctttccccaaaattgctgaagttcttgtccctgagatggacccttcaagtaacaagggatccagttttccaaaatttcatcttggaaactga

SEQ ID NO: 33800 - DNA, 339 bp, Glycine max
  Peptide Sequence Number=SeqID_150578
atgggttacgggcccttccattgtcaagaattcggatggggaattgtgaggtcaacttggttggtttgggaagtggcaaatgtgctatacttggaatcaccagctggtgttggattttcatactcaagcaatacattgacagatgaaattacagctagagataatcttatttttctacagcgatggttcactgaattccctgagtactcaaaaaatgacatcttcattacaggggagagctatgcaggtcactatgctccacaacttgcacaacttattgttcaaacaaagaccaacttcaatcttaagggggtagcactgagtatagggaaattttga

SEQ ID NO: 33801 - DNA, 459 bp, Glycine max
  Peptide Sequence Number=SeqID_150579
aggggtgtaggagtcaaagacgcagcggcggaggacggggaaagagtcacgcttgttgacgagggagttgatgttgaggggaatgggaacattctaggaccatacccacttccacccaaaatggtctacatatccaacaccacagtgacactcttatgggccgatgacttcggacacaagagatctgctcccttgcgattcagatctgaaaatcctcctcttccaaacgacaccaaaatcaatgatgtctttgtcgcaaaggctgagaatcccgaagaggagctgagcagccttggcaaaattgagtttttcggggtcgacggtggccatgtggtcgccgagcttattagagaggcggagggcatggatgcagtgctggaggagcttgatggtgcaatggaggttggagagctgggcagttttggcggcgacggagcaatgacggtcggagagctcgaa

SEQ ID NO: 33802 - DNA, 384 bp, Glycine max
  Peptide Sequence Number=SeqID_150580
atggctgcttttgaagcaggagggtgctcgtaccggtcggaggccggagccggcgccgtcgtcgtagaagagttcaaagccgcgactttcatcctccgcggtggctgcgccgccgcggaggacgatgacggggttgaagggggagcggtcgccgccgttgcggcgggtgcggcggagggcagcggggcgggaggggtggtccgaggaagggcgctggccgatcatgtacatggcggcggcggggaagcgttggcggcggcgggggtcgaggtggacggagcggggcgggtgttcgatttcttcgatgaagccgccgtcgcagtcgggacagacgatggtgtggtggggccagacgcgaacgaagcggctgcagcggtagcacca

SEQ ID NO: 33803 - DNA, 465 bp, Glycine max
  Peptide Sequence Number=SeqID_150581
atgagcaagcgggagcacgagtcttttaaagaatatgcccaacagtggagagatttggcagcgcaagtggcccctcccatggtcgagagggagatgatcacgatgatagtagatacactgctattattctactatgagaagttggtgggttatatgcccgctagctttgcagatttagtgctcgcgagagagagaattgaagtaggcttgaagagagggaagtttgattatgtctctcccgccggaaccaacaataggaggactagaacagttggggaaaagagaaaggagggggacgcccacgctgtcacatcgacacctgcttggccaaaaccttaccaagcctcgcatggtacccaccaatacgcacatcatcactcgagtttttcggcacgcgccggaagctcttcctgctcagcgctcgtccagccaaggacgagatcagtgtttttatgctttttctga

SEQ ID NO: 33804 - DNA, 252 bp, Glycine max
  Peptide Sequence Number=SeqID_150582
atgggaaacgaaattgagaggaagaggaggcctgttactacaacatcatctaggacacctcatactactacatcaactaggacacctcattttggacatggtggacatccaatgtctgggacacttggagcacatgttagtactacaacatcactaagagctcatgttgatgaagcttctttagttggagcaaatgtggatttctctccttcactaagagcaaatgatggttctactccttcattcggataa

SEQ ID NO: 33805 - DNA, 135 bp, Glycine max
  Peptide Sequence Number=SeqID_150583
atgttggattttagtatggctaagcgcggcctgtgcgttaagccggagtgttattctattgaggctgagctaagcgcgccatgctgtgctaagctccaactctcttcggttttgaaaattgtagacttaggctaa

SEQ ID NO: 33806 - DNA, 351 bp, Glycine max
  Peptide Sequence Number=SeqID_150584
atgatgcatgaaccacatccaaacttctttgctctcactcttaacaattgcaaaaacaagtggaaaaaatgtttcgactaccattttgtccaaggacagtcaacaaattcaattgctaacaacactacaccaaccttgatctcgaatcgaagatcctccgattcactagttggtgttgccataaatcttcttccaccaccggacaccagagctgttgaattactccctcaccacctccttgtcgcctacggatgcatctgtcgtggtcgctccaggtctgtcagcaacaacagtgtcaccaacgcaatcgtggtccagttaatggcagccttcgagattgagggatggtga

SEQ ID NO: 33807 - DNA, 435 bp, Glycine max
  Peptide Sequence Number=SeqID_150585
atggacgataaggtgggggagaacactcgcccacgtttggagggagcatgtggtgttgttgtcccatgggggactttcagacagacttttctagagatgtatttttcagaagatgtgaatcacaggaaggatatggagttcctcaagctgaaacaggggagcatgacagtggaaaagcatgcagcaaggaatgccaatgccaatcatgggaaagagaagaagcctatgactcacagtcatgttaagtcgtattctacccttcctgggaaatatggcaaccattttgggggacagaggaccaatggattccaactcgccagtggaggatttcactcagctagtgggagttcccagccagttaaaagggtgtctcagcctactagtagaagttgcggtggtagtggtgctcctgctacacttgctatgccatcctaa

SEQ ID NO: 33808 - DNA, 201 bp, Glycine max
  Peptide Sequence Number=SeqID_150586
atggagcatgaaacattccttgcaacttggttggcagagattgattcctctcccgatggcttgagattctcaaatttgcaaccacagcctaggttgatcaaccatgaaaaacctatgctatgtaggtggcacaagcttaatcccttgaaaattgagggtaggagatttgccctggattcagctaaggactactttccttag

SEQ ID NO: 33809 - DNA, 864 bp, Glycine max
  Peptide Sequence Number=SeqID_150587
atgagttttgtttttcgaggaacaagagcagatattgaaaatgggtttccaggatttatacctgagaggcgagcattgcgcgttcatgcaacacgtcctagtaattccaattcactcacttttctcgtgacaggtcccatttacgccttactgcttatatgtttcagttcttctgttattcatgatactgaactctcaccagatgtccccaaactttctggtaagctctggctggtgcttggtgttttcttgatggcaacaatgttgaggatgtatgcaacatgtcaacagcttcaagcacaggcccaagctcatgcagctgcagccagtggcattcttggccacacagaattgaggttgcatatgccaccatcaatagctcttgcaagccgagggcgtctgcagggtctcagacttcaacttgcacttcttgatcgggagtttgatgatctagattatgaaactttaagagctctggattctgataatgtttctactgcaccctctatgacggaggaagagattaatgctcttcctgtccacaaatacaaggtttctggtcctcaatgtggtggttcctcaatgcaacaagcatcatcttccactcctgctgagaagaagcaagataattcaaatgctgttgggagcatgaaagcctctgatgatgacctcacttgcagtgtatgcttggagcaagttaatgttggtgacgtactgcgaagcttaccttgcttgcatcagtttcacgcaaattgcatcgatccctggctgcgccaacaagggacatgccctgtatgtaaatttcgagctggatctggttggagtgacaatggacataatgatatcatcgcggacatggtctga

SEQ ID NO: 33810 - DNA, 783 bp, Glycine max
  Peptide Sequence Number=SeqID_150588
atgggcgatgcaattgatttgactggtgacggaggagtcattaaaaccattgtaagaaaaagcaaagctgatgctgtcggtccaacagaaaatttccctcttgttgatgttcattatgaaggcacacttgctgatactggtgaagtttttgacactacacatgaagataacaccatcttctctttcgagattggaaagggcagtgttatcaaggcttgggaaattgcagtgaaaaccatgaaggttggagaagttgcaaaaataacttgcaagccagaatatgcatatggtagtgcaggatctcctccagatattcctccagagtactgttctcatgccattgattttgtttggaaacataattatgaaacaaaaaagttcaaatatcaacctgggatacaaattctactgcctttggcaaatgcaaggctagtcccacgtgtagtgagaggctttatagcaccattctgtgcaacacttgtttttgaagttgagctagttgcctgtcggccaaggaagggctccagtttgggaagtgtttcagaggagagggctaggcttgatgaactgaagaagcagagagagctagctgctgctgccaaagaggaggagaaaaagaagagagaagaagcaaaagcagcggctgccgcacgtgtgcaagccaagttagaagccaaaaaaggtcaaggaaagggtaaaggacatcctaattcgtccattctgaatagagctaccttttcaatgaatgaaggtagagatgtagttaggtgcttagtgaggtga

SEQ ID NO: 33811 - DNA, 1086 bp, Glycine max
  Peptide Sequence Number=SeqID_150589
atggcatcaaagaagagaaaggcacctgccacaccttcccaggtccgatatgaccaatctaagttcacttctcctgaggcctgggaaaggtacactgatattgtggaagaactggagagaagaaaaagggatgaggaattaactagttttgctaaaggcagcatcgatgctgccattgtaaaggaattttacacaaacctctatgacccggaagataagtcacctaagcaggtgcaagtcagaggtcacttgattaagtttgatgaggacacgctgaatacattcttgaagacccctgtaatcatcaaggagggggagacattatcaacttactctagatttgcactcttaaggcctgatcctcaagagttggctgctaagctctgcatcccagggaggggatttgagctgaatgctgatggtcagcctttgaagattttaaggaagaacatgaccacactcgctcagacttggagtgttctttcttattccaacttggtccctaccttccacacttctaacatcacagtggatcgggcccagtatgactcctctaggcttggatttccagccttaatcacaactttgtgtaaagctagaggagtcacatcagattctagaactttggagaatcttagccctgccattaacttggcatatttaaagaagaattgttggaatctagatgatacaacagtgacattcaaagagccaaggaaggccaggggtaagagatctgaggctccccctacttcatctactttaccagatccttcagcaccatccatttcgactccacatcttccacagtttcatgttcagctcccagcttcttctgctcctgcattagatttcttgtttactccagagatgcttcactccatgatgcagagcctccacagaggacaggttattcttatgcagagttttcatagtctaggcctgccttctattatgcctatggaggatttccatgcacaggtggtctggctaggagtcccaccttctccttctagagggggtgggacctccgcagcccaagaacctgactctgctgagccagtggaggagcacacagaggagtag

SEQ ID NO: 33812 - DNA, 186 bp, Glycine max
  Peptide Sequence Number=SeqID_150590
atggctcaggaggaggagacttctccagatcccatgccagagccattccctgcacctatatctgaggacaccatgccattagcaccagccatagagctagagcagcccattcttcaggatgtaccagcagctccagtgctggatttaaatgaagatcagccacaggatgagaatggttgtgattga

SEQ ID NO: 33813 - DNA, 1050 bp, Glycine max
  Peptide Sequence Number=SeqID_150591
atgatgaatgggaaaattccaaaaagtattggtcaactaacccagttgaatactctaaatctattccagaacaactgggatggcacaatgacaaatattcatttccataatctcacaaacctattcagtttctctgtatcatctaaaacgaactcatttgccttcaaagcgacacatgactggattccaccttttaagcaattatattatctgaaaattcatggttgtcaagttggccctacatttcctaattggctcagaaaccaaacgggcttggagtatgtaatcctagaaaatgctggaatatctggggagataccccgttggctttacagcatgttctcccatattcgggagctagatctttctcacagcaaaataagcggctaccttcccaaaacattgaacttctccatcccactttggtgtactatcactgctcttgatctaaggaacaactcgttgtctggaacagtgcctgccaatattggtgaagaaatgtcaaacatggagtacttggatctctcaaataacaatttgaatgggagcattccacaatccataaataggatgcaattgttgttatatcttgatttatctaacaattatttgacaagagttgtccccgtgttttcaatgagtatacaacatttaagcatcattgatctatccaataacagtttgtcaggtggaattccaacttcattatgctctctgccttccatttttatcctagaattgagcaacaataatctctcgacaaatttgtctacagtctttcaaaattgtactagtatgggatctctgtcgttaggaaacaataagttttttgggtctgtgcccaaaaagatcaacaaaaactttcctatacttgaagagttattgttaagagacagtacaagtggaggtttcaatcccttctccgtatctctgacgttgggaactccatcagagcagtcggaggaaaaactggaggaatctcagggaaccgctagagatatcgttgtcgttgttggaagacacgtgagcccgcttagaggtaagagatga

SEQ ID NO: 33814 - DNA, 162 bp, Glycine max
  Peptide Sequence Number=SeqID_150592
atgtggatgctcaataaagaacttgctgaattagaacaacagtcatgggaatcgctaaattgctttgttgcgcagtatccaaaggttttgaaaatatgccaaatccgtttcactgtttcactttggattttgcctaatgaatttgaaaaccaattaaagtag

SEQ ID NO: 33815 - DNA, 477 bp, Glycine max
  Peptide Sequence Number=SeqID_150593
atgctgatctccccttgcgaaaggatcgcgagacacccagtggacccggacgagcccaacagggccttggggtttccagctctggttacgggcctctgtcagtcctatagggtgcttgtccccccagcaaggtcatgctatcatgacatagggattgcacccgcaagacacccagtggacccggagaagtccaacagggtcttggggtttccagatctgattacgggtctctatcagttctacggagtgcctgtcgcccccagcaaggtcatcaggccccctactaaccgagctttcatcaagaagtactgcgcccccaggcaggcgcagggcaagacaccacagcagcctggggatcgccggcagcgggcaacagacacaccgtcgccacctccaaagcccctcagctcatctacaaaagctggagtgttccctatgacccgaccagcaagcgaccaagtccaaagccaaaggtaa

SEQ ID NO: 33816 - DNA, 759 bp, Glycine max
  Peptide Sequence Number=SeqID_150594
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 33817 - DNA, 357 bp, Glycine max
  Peptide Sequence Number=SeqID_150595
atgtcatcaagcaaaggtccccggacgaaattaaggtatgacagaggtgaagattattcctttgctaacctaaaagagttgttcccaatacccaatatcatcacccctctcaagttcaaggtgctggactttgacaagtacaaggggattacttgccccaagaaccatctaaagatgtattgtcggaagatgggggcatacgcaaaagatgaggaattgttgatacagtcctttcgagaaagtcttactggggtagttgttacctggtacactaacttggaaccttcccgagtccattcctgggaggacctaatggttgccttcgttaggcagtgtcggtataatggatttggatag

SEQ ID NO: 33818 - DNA, 108 bp, Glycine max
  Peptide Sequence Number=SeqID_150596
atggagacccgaaacacatacttttcacatgagatgcggagagtgtactgttactcttcaagatgtgactgcgacgtggaaatcaacatatcgacaatgatgatttga

SEQ ID NO: 33819 - DNA, 345 bp, Glycine max
  Peptide Sequence Number=SeqID_150597
atgcctatgttggatcaatttcagtcatttatccacgacttcattgataacattgttgatgtccaagctgatggaaactgtgggtatcggtcggttgtcggtttattagtcactatagataagtggatggatatagccgacatgggatatgtgattgcatcaagtcaaccaccgggagattcttcggtgcatcgcataatttgtatcggtcacatctatgacaatcattttgttcagatttatttaaaagaccgatgtcttttaccgtcggtagcattgttatggtctaccaattgtcatcctcatgcgaggcagtggccaacatcatatattagtagaatgtaa

SEQ ID NO: 33820 - DNA, 345 bp, Glycine max
  Peptide Sequence Number=SeqID_150598
atgtctaccaatattatttttctctccaagtttctgctccttcttatccttcttttgaaccctgatcatgatgccaacaacacaagagggtgttctacattcgtttgtgtggctggtgcaagacccttattggaatataatgttccaaaatacattaacttgaagcctcatgatgagaaaggcaatggaataaagaaaggtttcgtccaaggagggggcgtggaagcttgtttgccaaaagggtttcgacgatcttctgctccaagcagatatattaattatcagcctcttggatcgacatgttcatcaagcaaggtagtgaataataatggtcctcgagcatga

SEQ ID NO: 33821 - DNA, 297 bp, Glycine max
  Peptide Sequence Number=SeqID_150599
atgatcttgccagcaaataagcattgtgacacagcgtcgaaggatatagaacctggccctatgctccttcgccagcctggtgcatcttcttctgaaggatttgaagggtccacaaatttgcttgttgttgctgaagctattgttgttgtcttcttgcttcatatcactccagctagtatgctgcttttgttgctgctacgtgaaagagtgatggtagttacggttgaaggagcagggagtaaaagaatgataatggacttccacaaggggaacaacaagatggtgaagagaggttga

SEQ ID NO: 33822 - DNA, 210 bp, Glycine max
  Peptide Sequence Number=SeqID_150600
atgactttattttgcacatgctttcctatcgaaccaaaagatcacacgcacgatcacggatcaataggattttctcgaaggtggggcgggatatcgccagtcgagaacgactttgaatggcaatcccaaaggaagaaccacttaaaaatgggttttcctttgccggcagtcattttccctgccgaaaaatttatctggtcagaagattga

SEQ ID NO: 33823 - DNA, 951 bp, Glycine max
  Peptide Sequence Number=SeqID_150601
atggctaccttgactgtacccccagttcctccttcccccagagatgatgccatgcagctctaccgtgcttttaagggatttggatgtgatactagtgctgttatcaatattcttgctcatcgagatgctacacagcgtgcctacatccaacaagaatacagatcaatgtattctgaggaactttccaaacgcttagcttcagagcttagtggaaagttagaggtgtcaacttgtttaatgttacaattaactgcagttctgctctggttgcatgaccctgcaggacgtgatgcaacaatcattaggaagtctctaacagccgacaacagaagcattgaaggtgctactgaagttatatgttcacacactccatcacagctacaatatttaaaacagatctaccattctatgtttggtgtttatcttgagcatgatattcaaacaaacacgagccccggcgatcatcaaaagctcttgcttgcatatataagcacacctcgtcatgaaggccccgaggttaatagagaaattgctcagaaggatgcaaaggctctttacaaagcaggggagaagaaactgggaactgatgaaaagacttttatccacatattcagtgaacggagtgcggcacatttggctgccgtcagttcttattaccatgacatgtatggccattcactgaagaaggcagtaaagaatgaaacatctggggcctttgaacatgcacttttgacaataatccaatgtgctgttaatccaggaaagtattttgcaaaggtgttgcgtaaggcgatgaaaggtttggggactgatgattccacactcataagggtcattgtgacaaggactgaggttgatatgcagtatatcaaagctgcatatttaaagaaacacaagaagactctgaacgatgaaagctttgtgatcgatctagccgacctcacctggtag

SEQ ID NO: 33824 - DNA, 2625 bp, Glycine max
  Peptide Sequence Number=SeqID_150602
atgacggggcgaaagtgttctctgagtgcaagttttctgctatgtttgagtttgattagcatagcaatcaatgctcttgaggtttcatatgatgaaagggcacttacaattgatggcaaaagaagaattttattctctgcttccattcattatcctcgcagcactcctgaaatgtggccatatttgattcgtaaagcaaaagaaggtggacttgatgtaattgaaacatatgttttttggaatgcccacgagcctcagcgtcgtcagtatgaattttccgaaaatctagatcttgttagattcattcgaaccattcaaaaggaagggctttatgcgatgattcgaattggtccatatataagcagcgaatggaactacggaggtctcccagtttggttgcacaatattcccaacatggaatttaggacacataatcgtgcatttatggaggagatgaaaaccttcaccacaaagatagtggacatgatgcaggatgagacactatttgccgtacaaggaggacccattattattgctcagatcgagaatgagtatggaaatgttatgcatgcatatggtaacaatggaacacaatatctcaaatggtgcgctcaattagctgactcttttgaaactggtgtgccttgggtcatgtctcaacaaagcaatgctcctcaattcatgattgactcgtgtgacggttattattgtgatcaattccaacctaacgacaaccacaaacctaaaatatggactgagaattggactggcgggtataagaattggggtacgcaaaatcctcatagacccgctgaagatgtagcttatgcagttgcaaggtttttccaatttggtggcacatttcaaaattattatatgtaccatggtggtaccaactttaaacgaactgccggaggcccatatgtcactacttcgtatgactatgacgctcctttggatgaatatggtaatttaaatcaaccaaagtggggacatcttagacaacttcataaccttctaaagtcaaaagagaatatcttaactcaaggttcctcacaaaatacagattatggaaacatggttacagccacggtgtacacttatgatggaaaatcaacttgcttcattggaaatgcacatcaatcaaaggatgctacaattaattttcgaaacaatgaatacaccattcctgcctggtctgtttctattcttccaaactgttcttcagaagcttataacactgcaaaggtcaatactcagacaactataatggtcaagaaggacaatgaagacttagaatatgcgttgagatggcaatggaggcaagagccgtttgtccaaatgaaagatggacaaattacaggcatcattgacctgactgctcccaaactcttggatcaaaaggttgtcacaaatgattttagtgattacttatggtacatcaccagcattgacatcaaaggagatgatgaccctagttggaccaaagaatttaggctaagagtgcacaccagtgggcatgtactccatgtatttgtcaatggaaaacatgttggtacccaacatgctaaaaatggacaattcaagtttgttcacgagtccaagatcaaattgactactgggaagaatgagataagtctacttagtaccactgttggattacccaattatggtcctttctttgacaacatcgaggtcggtgttcttggtccggttcagttggtggcagcagttggtgattatgattatgatgatgacgagatagtcaaagatctcagcaaaaatcaatggagttataaagttggactgcatggggagcatgagatgcattacagctatgagaatagcctcaaaacatggtatacagatgctgttccaaccgatagaattttagtttggtataagaccacattcaaatctcccattggagatgatcctgttgtggttgatttgagtggattaggaaagggtcatgcttgggtaaacggtaacagcattggtaggtattggtcaagctaccttgcagatgagaatggttgctctccaaaatgtgattatcgtggtccatacacttctaacaagtgcttgtcaatgtgtgcacaaccttctcaaagatggtaccatgttccacgctcatttcttcgtgacaatgatcaaaacacattggtcttgtttgaggaattgggaggccagccctattatgtcaactttctcacagtaactgttgggaaagtatgtgcaaatgcctatgaagggaatacgttggaattagcatgcaacaaaaatcaagtcatctcagaaattaaatttgctagcttcggcttaccaaagggtgaatgtggatcttttcagaagggaaattgtgaatcttcggaggctttatcggccatcaaagcgcaatgcattggcaaggataaatgttctattcaagtttctgagagaacacttggacctaccaggtgtagagttgctgaagatagaagattagcagttgaggcagtttgtgatatacaacttacgattgagaaaactactttggccttagatgattcagatgaaaaatattcatgcatcattgtagctccaggcttttcacagaccaaatcatctaagtcatacgattga

SEQ ID NO: 33825 - DNA, 1131 bp, Glycine max
  Peptide Sequence Number=SeqID_150603
atggcgagagaagcattcattttcaaggaaagcgccttgttatctctcagagcgttgaagagcttgttgatgttgatatttgcggttgctatgctgctgctgctgccattcagagggcggaggagggtgccaccggccgagaaacccagcggcaaagaggagtgccaccggaaaggcgcggtggtgcgcatgccggccaagatggtgccagggaaaagtggtgctggtgcggtggcagcaaggagggagttggccataaggagggtggtggaggatgatgatgatcaaagatgtgtgagagagtattggcttttgggaaccaaaaggggtgataccattttcacacaatgttggaaaccagtttctgataagatcaggggactcgttcttcttatgcatggactgaatgaacacaggtatagtgattttgcaaagcagctgaatgctaatggctacaaagtttatgggatggattggattggccatggtggaagtgatgggttgcatgcatatgttcattctcttgatgatgctgtctctgatatgaaagtatttcttgagaagattctaaatgaaaaccatgggcttccatgtttctgctatggacactcaacaggtgctgccattattcttaaggcactgcttgatccaaaggttgaagctagtatagttggtgctacattcacatcaccagcagttggagtggagccttctcatccaattttggtggcacttgcgcctatactttcatttttgctgccaacatatcaatgtaattctgcatacaagaaggggttgccagtttctcgagatccagaggctctaactgctaaatattcagatccattagtatgtacaggatctctaagagtacgtaccggctatgagattcttcgaattacaagctacttgcaacaaaatctcagaaaactgagagttccatttcaagttctccatggcactgctgattctattactgatcctgatgcttctcaaaaattgtatgaacaagcatcctcaacagacaaaactatcaaactgtatgaaggctttgcacatgacctcctctttgaacctgaacgagaggatatcattcaggatataattcaatggttgaatagtcgaatatga

SEQ ID NO: 33826 - DNA, 225 bp, Glycine max
  Peptide Sequence Number=SeqID_150604
atggagccttgtatactttcagctgacagaaaatttgattcaggttacccaaaatctgatctggttaagttccctcaatattttggatacagtttagaggaaaggattaaacctagatttgcaattatgaaaaattctggagtgaagttactcccgaatcaggttctttcactgtcaagcagcaacttagatgaggccttgaaaaagaaaatgcaaaatggttag

SEQ ID NO: 33827 - DNA, 2127 bp, Glycine max
  Peptide Sequence Number=SeqID_150605
atggaatttaggacacataatcgtgcatttatggaggagatgaaaaccttcaccagaaagatagtggacatgatgcaggatgagacactatttgccgtacaaggaggacccattattattgctcagatcgagaatgagtatggaaatgttatgcatgcatatggtaacaatggaacacaatatctcaaatggtgcgctcaattagctgactcttttgaaactggtgtgccttgggtcatgtctcaacaaagcaatgctcctcaattcatgattgactcgtgtgacggttattattgtgatcaattccaacctaatgacaatcacaaacccaaaatatggactgagaattggactggcgggtataagaattggggtacgcaaaatcctcatagacccgctgaagatgtagcttatgcagttgcaaggtttttccaatttggtggcacatttcaaaattattatatgtaccatggtggtaccaactttaaacgaactgccggaggcccatatgtcactacttcgtatgactatgacgctcctttggatgaatatggtaatttaaatcaaccaaagtggggacatcttagacaacttcataaccttctaaagtcaaaagagaatatcttaactcaaggttcctcacaacatacagattatggaaacatggttacagccacggtgtacacttatgatggaaaatcaacttgcttcattggaaatgcacatcaatcaaaggatgctacaattaattttcgaaacaatgaatacaccattcctgcctggtctgtttctattcttccaaactgttcttcagaagcttataacactgcaaaggtcaatactcagacaactataatggtcaagaaggacaatgaagacttagaatatgccttgagatggcaatggaggcaagagccgtttgtccaaatgaaagatggacaaattacaggcatcattgacctgactgctcccaaactcctggatcaaaaggttgtcacaaatgattttagtgattacttatggtacatcaccagcattgacatcaaaggagatgatgaccctagttggaccaaagaatttaggctaagagtgcacaccagtgggcatgtactccatgtatttgtcaatggaaaacatgttggtacccaacatgctaaaaatggacaattcaagtttgttcacgagtccaagatcaaattgactactgggaagaatgagataagtctacttagtaccaccgttggattacccaactatggtcctttctttgacaacatcgaggtcggtgttcttggtccggttcagttggtggcagcagttggtgattatgattatgatgatgacgagatagtcaaagatctcagcaaaaatcaatggagttataaagttggactgcatggggagcatgagatgcattacagctatgagaatagcctcaaaacatggtatacagatgctgttccaaccgatagaattttagtttggtataagaccacattcaaaagtcccattggagatgatcctgttgtggttgatttgagtggattaggaaagggtcatgcttgggtaaacggtaacagcattggtaggtattggtcaagctaccttgcagatgagaatggttgctctccaaaatgtgattatcgtggtccatacacttctaacaagtgcctgtcaatgtgtgcacaaccttctcaaagatggtaccatgttccacgctcatttcttcgtgacgatgatcaaaacacattggtcttgtttgaggaattgggaggccagccctattatgtcaactttctcacagtaactgttgggaaagtttgtgcaaatgcctatgaagggaatacgttggaattagcatgcaacaaaaatcaagtcatctctgaaattaaatttgctagcttcggcttaccaaagggtgaatgtggatcttttcagaagggaaattgtgaatcttcggaggctttatcggccatcaaagcgcaatgcattggcaaggataaatgttctattcaagtttctgagagagcacttggacctaccaggtgtagagttgctgaagatagaagattagcagttgaggcagtttgtgatatacgagtaagcggcgaagggaggaaacactag

SEQ ID NO: 33828 - DNA, 888 bp, Glycine max
  Peptide Sequence Number=SeqID_150606
atgccccagaataagattttccaagaccaacaacaatcatcgaatccgattcctgatctttcccttcacattagcctcccaaacagtgctccttcttcaatttgcagtgaaggggattcaccctttgatgctgaaggcctcaaatcacacagtgatggttcaatcaaaggtagtagtagcccttattatcacatagacacacaactttccttagccaaccacacaagtactatttctactccctctgaggctgaaagcacctggaggaagagaaactttgttaggctttgtcatggggtttctcatgagggtcaaataagactcatcaatggaatccctctctacagtaacctttcttctttggataacactagtagcactattaatattccctcaatagagagaaaccaattacccaccaacaagttttccttttcttctctatatgcacttccacaccctccttcagctcctaattatgcagtagaaccaatctcaaggtttcgtgagatgaccatggagagtgctctaagaccccaacaagttccgtactttgattacccacaccagcagcagcatcagtttgggagtagtaatattggagcttctgatttttcgaatggatttgtgaggtcgagaatgttttcaaggcagcaaagtaataagaggaacatgagggctccaagaatgcgttggactagttctcttcacaatcgctttcttcatgctgttgagctacttggtggccatgaaagggctactcctaagtcagttttggagctcatggatgtcaaagatctaacactagctcatgtcaagagtcatttgcagtgtgtagactttgtccaaggtctatctaagaggcacaggaaccaaggcatgcagtga

SEQ ID NO: 33829 - DNA, 192 bp, Glycine max
  Peptide Sequence Number=SeqID_150607
atggcgaggagctgccctcgcccgggcagggccttcttaggtcacagttacaagtcaagacaagttgactgcgaaaatcaaccaaggtacatagagacggattttgtttcggagccccatgaacgttattgccaagggctgttcatgtgtcctccactttcgagtttggagttgtgtttcatgattgcctaa

SEQ ID NO: 33830 - DNA, 576 bp, Glycine max
  Peptide Sequence Number=SeqID_150608
atgtctgaaaaatcccttgaaggtgcatattattttgtcactttcattgatgatcactcaagaagagtacaaatatacttgttaaaaacaaaagatcaagtaattcaagcattcaaggaataccatgtcatggtggagcgtgagactaggagaaaactgaaagttaataatggtggagagtatcatggcccttttgaagcatattgcaagacatatggaattaaacttgagaaaatgacaccaaagacaccacaattaaatggtgtggttgaaagaatgaaccgaactattaaggagagagtttgggttaactctgatcatgactcattccacgtggcacatgctgttttaaggcaacaagttgtcgaggcgaatcaaaatgaagtttattatgggtccgaacacaatgagacctcaatggagctgtcaacagagacaaataatacagaaattgttgagccaaaagtcgttgaacaacctcaattacggtgttccgccagagataggtgtccctctaaaagatattccttaaatgagtacgtgacacttacaaatgaaggagtcttaaagttatga

SEQ ID NO: 33831 - DNA, 774 bp, Glycine max
  Peptide Sequence Number=SeqID_150609
atggatatcatcattaatagcttgttgaatgaagaagctaggaggaaggaacaaggtatggttgttcaatctgaagataacattgtagaaaatcgtggaagaagtgagaattgtgaaacaagtgcaagattgcctattactattgtggcaagtcaggtcacaagaaatctgaatgtcgatatctcaagcaagataaaaaaaatcggcactattaaaccagaccaaattaatttgaagaaaaaggaggataagagcactatggccatggcagtagatggagatgacaatgtattcctcattggagaagacaactatcttaatatttcttgtgatgattgtttatggattgttgactcgggtgcatttttccatattagcccacatggaggatttttctcaacctatcaaagtggtgactttggtatggtaaaaatgggaaattgtgtcacaagcaaaatagtaggcattggtgacatcacttttatgatcgacatatggcataagctcgtgttaaaggaggtgacacatgtacgagacatgggtctcaaccttatctctgtcaggaagcttgacaatgttgggctgattaatcactttggtgattgcaaatggaaactcacaaaaggcaatatgattgttgctcaaggaaagaaaaaagacgccctatatgtcctgcagggaagaatatgcaagggagaggccatcgttgcccatggtgactcaagcatggagttgtggaatagacgacttggccatatgagcgagaagggatga

SEQ ID NO: 33832 - DNA, 432 bp, Glycine max
  Peptide Sequence Number=SeqID_150610
atgaaagacttgagaccaggaaagaaaatccttgggttgaagatcactcgagatcgatctaagaagttattatggctatctcaagaacaatacattgagaaagttcttaagagatttaatatgcacaaggccaagctggttagcattccacttgccgtgcaatttaagttgagcaaaaagcaaagtccaacaagtgaaggagacaaagaagaaatgaaaaaggttccttattcatctgttgttggcagtctcatatatgctatgatatccaaacttcaaaagtgtgtggctctatcaactactgaggctgaatatattacaactaccgaagcatgcaaagagatgttgtggatgaagaattttcttcatgagttgtgccatgaacaacaaaattatatggtgcactgtgataatcaagttccatacacctag

SEQ ID NO: 33833 - DNA, 861 bp, Glycine max
  Peptide Sequence Number=SeqID_150611
atggcgactcgcgacggcggcatgaagtcgacgtcaataaacggcgttaagatgtacacgatagcgtcgcagcaaccgtcactcgcttcatggcttccctccaacaagaagcagaactctcatcgcaacgtcaaaagttacacgcagaacctgcaactgctcgaagacttgcgcttcgccaccgccgccaccaaaatcaaggccactcccgacggcgagtacatcattgcttccggcatctatccgccgcaagtcaaggtctacgaggtcagggagctaggcttgaagttcgaacgccacttggactccgagatcgttgattttcaggttctgacagatgactattcgaaacttgcatttttatgtgctgatcgctctgtttatctgcatgcgaaatatggaaagcactacagtttgcggattccaaggatggggagggacattgcttatgactgctggtcttgtgacttgctttgtgctgcatcgtccccagatctgtacagaattaacttagagcaggggcgattcctctcttcccttaacacacaatcccctgcattgaatgtagtttctcgaagcaagattcatggattagttgcctgtggtggtgaagatggtgctgtggaatgctttgacatgcgagtgagatcttcagttggtagaattgatgctgttggacctagtggtgatgttgaccaggaggtcactgcattggagtttgatgaagatggtggtttcttgttggctgttggaagtagtgcaggaaaggattttaaggaaaggttgtcttcatcccacaatcataggtttgtgaaagtggatgtatatactattaagacaagacaggcttatttcatataa

SEQ ID NO: 33834 - DNA, 165 bp, Glycine max
  Peptide Sequence Number=SeqID_150612
atggtgacaacgatggggatcatgttccttaacgacaatacacaattacacgtgagcatcctaaatcaagtggaggtagagatcatagaccaagagaacaataaacacatgcaattcgtccaacaagatgagagaccgtatttagaaggactcattattatctaa

SEQ ID NO: 33835 - DNA, 1233 bp, Glycine max
  Peptide Sequence Number=SeqID_150613
atgcagggcttcaatctgaaggagaataagatcatgagaaagatattcagcagtgataacttcaaaggagaaaatcagaattcgtcagaggccaaaaaggaaagtcctagtttgaatcaagcatcggcaagatgcttctatcatcaaaccaaaaagatctttgttggttcctggaacattggaggcattacaccacccaagaacttggacatggaagactggcttgacacacaaaataattcagcagatatatatgttctggggttccaagaaattgtaccactaaatgcagcaaatgtactaggtccccaaaacagaaaagtttctatgaaatggaattctctaattggggcagcccttaacaatagaacaccaacaaaggttgttgaagaaaataaaacagctgaacctcagaagatatatcctttgaaggagcacatttatgcagagggagaacatggacaagattttcagtgcatcataagcaggcaaatggtgggaatgttcatcaccatttgggttcgatgtgacctctatcaaacgatcaggcacttgagtatcttgtctgttggctgtggaatcatgggttgcttaggaaacaagggttcaatatcaattagattttacttgcatgaaacaagcttttgctttatatgtagtcatctagcatctggtgggaaagaagtagaccgaagacatagaaacgtaaatgcagctcatattttgtccaggacaattttcccttctggtcctctgcatgatatgcctcaaaaaattattgatcatgaccgagtagtctggctaggcgacttgaactaccgaatctatatgccagactctacaacaaaatcattgatcaagagaggagagtgggaaaccttgttgaaacatgatcagctcaagatggagctcacagagggacatgtattccaaggttggcatgaaggagctatagagtttccacctacatacaaataccgtctgaattctgtagactacctaggctgtgatcagcagcatagtctcacttcagatgctttatttgaaccattagcagccatggctactctaagtctaaccacaagattgtactgcaggtgcgatagaataatatggtttgggaagggaatgaagcaaatccaatacaacaggagcgagtcaaaactttctgatcataggcctgtacgagcaatgttcacagctgatatcagggttgcagggacttgtaaatga

SEQ ID NO: 33836 - DNA, 631 bp, Glycine max
  Peptide Sequence Number=SeqID_150614
atggtgccaaggaaactactaacagagagaaatgtggtagtatactacactgaatttgacgaatttaaggaggaattagaaaaaagaaaatgggatgaggagttgacaagcttccctgaaggtagtattgatgtagctattgtcaaggaattctacgcaaacctctacgactcagaagacaagtcacctaagcaggtgagggttagaggtcatctgatcaaatttgatgaagatactttgaacacttttctgaagaccccaatgattctggaagagggggaaaatctttgtgcttattctagatttgaactcttgaggcctaatcctcaagagttagctacaaagctctgcatcccagggaggggatttgagcttaatgttgagggtcaacctttgaagattttaaggaagaacatgaccactttagctcagacatggagcattctttccttccctaacttggttcctacctccgacacatatgatgtcagattagacagggccaagttaatttatggaataattatgaagatggacgtgaatgcgggttacctcatctctcaccagatctctattatagcacagcatgactcctctaagcttggatttctagccttaatcatagctttat

SEQ ID NO: 33837 - DNA, 526 bp, Glycine max
  Peptide Sequence Number=SeqID_150615
ggtggcgattgcatggaaggttgttaaggcaatgtgtgagagtggtgtggcaccagatgttgttacttacagtttcttgttggatggtttgtgccaagggcaacatcttgacctggcggttgtgttgtttaaccagctgattaagaggggcatggcacttgatgtttggagttatagtatattgattgatgggcttctcaatgagttgcataataatggtccaccccctgatattgttacttacagtaccctgttgcatgctttatgcaaaatgtgcaagagtgaaaggatagacgaggccgttaatctctttaaagacatgcatctaaaaaatttggttcctgataccataacttacatttctcttgttgatgccttgtgcagatctgggagaatctcttatgcgtggaagcttgttaatgagatgcatgacaatgctccacccctggatgttatcaattacattgatgcactttacagaaaccagcatcttggtagcaagtgccttgcttcagcatattgttga

SEQ ID NO: 33838 - DNA, 246 bp, Glycine max
  Peptide Sequence Number=SeqID_150616
atggaaaaaccatatggatctgagtggccaaaggaagaaaaggtgaagtgcagagaaatggttgctcctgaagcacattatcctcgtgttccgggaaagggattggggaggtttctaatgcaacttgttgaacttatggcgcaaaagattgcagaggccttgcctgtaaggtggactatcttgaaggcaacacctattaaagatgagctctgtcctacaaaaatgaaccatgcacgatcattgtag

SEQ ID NO: 33839 - DNA, 825 bp, Glycine max
  Peptide Sequence Number=SeqID_150617
atggcatttccgaacaagaagctcatcgacgaccccaatgatgttgtgactgaattcattgaaggtcttgtggagacatattccggactacagtatttagatggctttcctctggtgaaggttgtcttacgtgcagatgtttcagctgcaacatatgataaagttgcaatcgtatcagggggaggaagtggccatgagcctgcccatgctggatttgtcggagaaggaatgcttacagcagcaatatgtggagatatattttcttctccacctgttgactcaattctagctgggatacgagctgtaactggtcctaagggatgtcttttgattgtaaagaactatactggtgatcgtttgaactttggcttggctgctgagatagcaaaatctgaaggttataaagttgagactgttattgttggggatgattgtgcactacctccacctcgagggattgcgggaagaagaggtttggcagggactattctggttcacaaggttgcaggagctgctgctgctggtggtctttctcttgctgatgttgctgctgaagcaaaacatgcatctgaaatagtgggaacaatgggtgttgctttgactgtgtgctcaattcctggtcaagttgcatcagatcgtttggggccaggaaagatggaacttggtcttggaattcatggagaacctggggcagctgtggctgatattcagcccgtaaatgtggtggtttctcatgttctacagcaaatattgtccacggtatgctgtatgccacaatattgcatgaaagctcttgatgggtgtatgctaattaattgggaatga

SEQ ID NO: 33840 - DNA, 885 bp, Glycine max
  Peptide Sequence Number=SeqID_150618
atgtttgatagatggatgtgttgggtggattgcatggccaacatggtggcctctgtggaaaaccatcaatcctctttcactgaattgagccttgcatcaggagagagcaaaattaacagtcaactgttaggttccaaagagagggcatcatcatccaagcactttggaggaccacgaagtcagccattacaactaaatgagcaaggccaaattcttgaggtagccattgaagctgctgcaaatgcaattataaatctgaaggacaatttaaatgaatgggatggtaaagttggtgatggtgactgtggatcaactatgtatagaggtgcaaaagcaattcttgaggacatcaaaaattaccctctaaatgatgctgcagaaactgtcggtgaaattggttcatcaattggaagatccatgggaggaacaagtgggatcatgtatgatgccattcctatgcctcctttaaaatatactatattttttaaggcagcacattcggtgctaaaagcaagttcccattctggtgtcacttcaaaacaatgggctgaagcactcgcagtttccattgctgctgtaagtaaatatgggggggctagtgctggatatagaacattgttagatgcccttatcccagcatcgttggttcttgaagagaaattaaattctggagttgatccttgcatcgcatttgttctctcctctgaagctgcattggctggagctcagtcaacggtagacatgcaagcacagcatatgcaggctggacgttcgacttacttttctggagagattctttcaacagttcctgatcctggtgctatggctgccgctacatggtacagagccgcggccttagctgtgaaggccaaataccagagctaa

SEQ ID NO: 33841 - DNA, 475 bp, Glycine max
  Peptide Sequence Number=SeqID_150619
atggagaactcatcatcttcaaactatctctaccgagagtgcctccgcaaccatgcagccagcctaggcagctatgccacggatggctgcggggagttcaccctcgacgcggatagcgtctcgtccccttctctccagtgcatggcctgcggttgccatcgcaacttccaccgcaaggtcacgtgccctgtggtggaagggccgcaggtcgtgactggagggagcggggacatgatggagtattcaggaggggagggaagaatggagatgggagagaggagtggtggaggaagcagcaagaagaggttcaggacgaagtttagcgctgagcagaaggagaagatgttggggtttgcggagaagctagggtggaagctgcagaggaaagaggtggatgatgagattgagaggttctgtaagagtgtgggagtcactagacaagttttcaaggagcttgggaagattcaagtagcag

SEQ ID NO: 33842 - DNA, 309 bp, Glycine max
  Peptide Sequence Number=SeqID_150620
atgggaatgtttgagcagagcgagaagggagcagtacctgttagggttcttggcgtctacgaatggaaaatgaagagagcaaaaggggagacagtgggggtctcttcttacgctgatgccaccagcaggattggcgagataggtgtgccgccattgtcaatggcgagaagcttcgcgacgtggctgcatggtgagtgtgtcgccagcacaactggcgagatgcatggtgacgtgggtgtgtcgcgtgggtgtgccgtcagcacgactggcgagaagcctcccccattgtgtcgccattgcttcctctga

SEQ ID NO: 33843 - DNA, 546 bp, Glycine max
  Peptide Sequence Number=SeqID_150621
atggacggtgtaagggcggcaaagggtggtggtggctgtggaaggggtgcagcagtgggggtggagggtggagatccaaagaaattgccatcgttgaacttgagcaaacggaacattcaacttcttctcttctctcttccgcgaaagcattctaacttcttctcttctctctaccgcgacgagcctcctgcgtcttcttcttcgcgagccttctccgcgagcccgctgcttatttttcccttggacccatttgccttcgaggtaggtgcccgtaaccttcctttggttttgttatgcactatagttgtagcatttaggtggaaccttagggtagaagacgccggaaaaaatggggaaagggtgtttacggtggcgccttctggaagatccgtcttccgaaacttccaaaagaacgtgttctggaagattcccggaagaagggttcttccgaaagtactgaaaggtcttccggaagaaccggtcatccgaaaagcttccggaacacctcttccggaaactttctggaagaaggattcttccggatga

SEQ ID NO: 33844 - DNA, 824 bp, Glycine max
  Peptide Sequence Number=SeqID_150622
atggggaggctactccctcttgtcattgagtccatagcccacaacccattcagccccttatttaatcccattgaaattataggactagtttggatagatgctagaagagcttttgagagtgtttcttctattgcaagtattggttctgccatgcaaaacacatttgggaacttctcaacaccaatgattagtgtgtctgacaagaagagaaaagatactgaaatagtaaatgggcctgcagttggaaagaaacctcgtggtagaccacctgggaggaaaaatcaagtccaaggtcaaaacacactgcctcaatcaagtaatgttgtcaacaatcaagtagtttcttggcaatcttcttcttcaactctaccaccatctgggatctgtgcacccaacggatcacaggttcaaggatccaatgttgccaaaggctcattcaatcaccctctgtttttcgttccaaaccattcacaaattctagagacacctcctagaacacaatcctctcactttatgtttgaccctgaaaaacaaatggcttataaagagagcagtcattgcaattctcctatcgaagcagatacaggaaaagcaagtaagaaggatgatgtaaggggcaaactgaacttcgatgcctctaatatgcctgagagcttggacaaatcattggctaatgaggtttctacatctgagttggacaagggagttgtcatatctgacattgatttttcaaacttggactggtcactccaaggaaccagtttcgaagatttttttgaccctataggtctaactgattccaaagataatgcttcaagttcaag

SEQ ID NO: 33845 - DNA, 141 bp, Glycine max
  Peptide Sequence Number=SeqID_150623
atggttggtttcatcaggcccatagtttggaaggaaggtgcaaaggattccatgctcaaagtcatcattgaaactggacctacttcattcaagtgctttcgtactgatttgcattcgaatgaggcctacatttattcgtaa

SEQ ID NO: 33846 - DNA, 1416 bp, Glycine max
  Peptide Sequence Number=SeqID_150624
atggcactgccaccaataaaaggaagagaaggcccgcaggaacaccaggattgtctccaatatttgatacctgatgatccggatgcagaagtggtgtccctctcgccgaaaacgttgctggaatcggatcgttatgtgtgtgagatctgcaaccaggggttccagagggaccagaaccttcagatgcataggaggaggcacaaggtgccatggaagctattgaagagggagacaccagtggtgaggaagagagtgtttgtgtgtcctgagccaacttgcttgcaccatgacccatgtcatgccttgggtgaccttgttgggataaagaagcatttcaggaggaagcacagcaatcacaagcaatgggtctgtgaaagatgctccaaaggctatgcagtgcagtctgattacaaagcacatctcaaaacgtgtggcacccggggccactcttgtgattgtggccgcgttttctcaagggttgagagtttcattgagcaccaagatgcttgcaacatggggaggctcaggcctcatgaatctcaacctcttcaaccatctgcatgcctttctagaacagcttcaagcccaagtccttcaagtgagaccaatttcagcacagctccatggccaacaaggatgataatacaaaagccatcagaaacacccacaatcttcatgaacaaccctattactgctatcaccactgctgaaacctcctccaagagcaacaacaaactactccaccccaacttggatcttcaactctccacccccaccaataacaacaactccaacacctccaacaccaacacatcaaatattgcaaaccccattgataatgctgcaatatcagctaagagggatcattatcatgagaaccattcaacccatttgcaactctcaattgggtcatcagatatgagtgagaagaatgatcaatcaaacaggaactcatcagagaagagcagcaataacagcaacaacattaatgatcagaataataagcagcagtccaacaacatggccttgttgagggttcaagagcaagcaagggagcacttgaggatagccatggcagagaaagcatatgctgaggaagcaaggaagcaagcaaagaggcagattgagcttgcggagcaagagttcacaaacgccaagaggataagacaacaagcacaagtggaactagacaaggcctacgctttgaaagaacatgcaatgaagcaaatcaactccaccatgctccaaatcacttgccacttttgcaaacaacagttccaagctcgaaatgcaaccaccaccagccccgacgataattctttggtgctgagctacgtttcttctgctattaccacggaaggaggagaagttgaaaacgataatattgcaaaagatcatgccaaagacaacaactaa

SEQ ID NO: 33847 - DNA, 234 bp, Glycine max
  Peptide Sequence Number=SeqID_150625
atggctacatgggaagatatagactcatcatcctcagaggaagatgaggagcatgcaaccaacttgtgccttatggtagactcagataaagatgagcttataggcctaggatcttctttatcaatggattcctttgcttcttggaagatgaatggcagcggaatggaaaaggaagagagagaggagacgccacttcaaggagaagatgagtctagaagaagctcaccaccatag

SEQ ID NO: 33848 - DNA, 288 bp, Glycine max
  Peptide Sequence Number=SeqID_150626
atgtttttcctcacattccctgaatctatcattggagaaacaacatctagagtcaacaccagagcctctctaaacagagaaaaaggaatgttggctcttctctcaacccttgagcttaagactattgatgaagcattgagtgaagattctttagagactgctatggacgaggaattgagtcaattcactaagaacaagggtataatcagtaggaaggaccatcattcttgtttctttgttcatagaggctctagtcttgactccatatgctatttctctaatgattag

SEQ ID NO: 33849 - DNA, 429 bp, Glycine max
  Peptide Sequence Number=SeqID_150627
atgaagttgtttttggaatctcaaaatgtggaattgtgggacattagaaagattggccacatcaaaattgattatcctcttcttaagaaagacttcaagagaggagacccaaagaaaaaggcaacgatggctacatgggaagatacatactcatcatcttctaataaagatgaggaacaagcagctaacttgtgtatcatggcagagctatatgattttgaaagtgtcatagatttttctcatcagaaagaattagaacaagctttagataacttactcaatgactctcatattttaactaaaaaatgtgctattttgaaggagcaactttctaatgttcagaaagaaaatgagaagctcataatggataatgaattgctttttaaagagaaaccattgtctaccaaaatcccatttctagctttgtga

SEQ ID NO: 33850 - DNA, 282 bp, Glycine max
  Peptide Sequence Number=SeqID_150628
atgggttggagaatccttgcaaggcctaaacaccctaacgcaccggcgttatgcttgtttgattttaccttttcttttcttccttacttggtgtatccagtactaagttttggtttacaagctttagctcaagccatatggaatcaaaatgtaagtggtggaatgggcgaattccatgggcttaataggttccaaaggaagaacccgtctatgtttagggggagatacgatcctgatggagtgcaaaattggttgaaggagatcgaaaatatcgggctatag

SEQ ID NO: 33851 - DNA, 288 bp, Glycine max
  Peptide Sequence Number=SeqID_150629
atggtggtgaaatcactctctcctgaacatcatgcttgtgatttggctgaggtctttgcagaactcaaaaagcacaatatgaagttaaaccctaaaaagtgcacttttagagttggtggagaaaaggcaaaacgattcttaaagctattaaagaaatcacaaaatgacttccattgggatgaagagtgcgaaaggatgttcacagaatttaagagtttcttggcaaccctacccatcttgacccgacctacttcaggtgttgaacttttactctacttatgtttctaa

SEQ ID NO: 33852 - DNA, 330 bp, Glycine max
  Peptide Sequence Number=SeqID_150630
atgaagcccatcaaggagaaagatttcaagaggcaatcatgtcaaccgaagtttgtaacatacaatcttctcactgaaagtcgagcacatattttagaaaaggcattcaacgaggagatactggtagaggtggccgctgaggtgattttagaggaggatatgctagaggttggggcaacaatagccaacaacccaccgaagaaggcgagcaaagacaataggaaaatccccaagggtcgtggtcaaccaagagggccacaatcaatccataatggccagagcttcaacgtcactttcgaccacgcctgcggtggatttacctcggttgta

SEQ ID NO: 33853 - DNA, 336 bp, Glycine max
  Peptide Sequence Number=SeqID_150631
atgatgatctcgccacaacgagataggtttttgccacagcgaaacaagatgtttgatcaactaaaactgacagagattcaccacaacgaagttgaacttcgacactgggagtccacaaagattaagacctttgaaggaatgggaagaatcaaaagaattctcagactgtgtcgttttgaattctttgacaagggagaagggagacacaaaagaattcaagcggttagtcctttgttcttttggaaaagggagaagagatacacaaaaagaattcagcggttagtccttggcgaattctttttggcaaagggagaagagaatgaagaggatgaatag

SEQ ID NO: 33854 - DNA, 156 bp, Glycine max
  Peptide Sequence Number=SeqID_150632
atgattattgcagtattgtaccctgagaaattcatagctttggatgagaagcaacaagcacattcagctcaccacctagtactttatgtctttcataatcaagaagtgtctggtgtaggatatcacaacagcaagcatgaagtaagggttaaatag

SEQ ID NO: 33855 - DNA, 684 bp, Glycine max
  Peptide Sequence Number=SeqID_150633
atgccccctcacattaaaaaacgtccagcgcgtccctaccaaaatggtgatggtgaggagcaaaatgacactgatgaaatggaagaggaggaaaatgatgtcccaaccgtgaaaagttccagtgagcttgacgtagtgcttggccatagtggcgcgaagaaggaggccatcaagaggagaaaaggaacaagagggaaggaaagttggtgtgatggaggagaggtagttgtaggaagtatcacgattgaggttaaagaactccgtgtgaatttccatggagacgaagctctcggggatgcagtttgcaaagaagaggttgtattcatcggagacggtaatggggtaagaacagttaaaggtagcgggagggggaggaagattgaggaaggtgaagaggtgaaaggtgtaaggggaattgaggatgtagaaggaagaaccctagccgcaaggggttcaattgtgacaatggggccaccacagacattgacgacgtcgcgattgccacacgacctgggtaggcttgcaatcacaatcctgatgccactgttgacatttaatgtggtatttcttatgaatgtattagaagttgagaataaggttgatgaaaagaaagtggctgaacctgcagataatgggaattcaaactcaaggcacatgcttttcttggatgttggccattcctga

SEQ ID NO: 33856 - DNA, 117 bp, Glycine max
  Peptide Sequence Number=SeqID_150634
atggatgatttacaaggtatactcgggtatagtgggcagagagcatgggggactcgaaagcctcactttgctagtcctggcgggctccaagactatgtcatccatgtggttgtgtaa

SEQ ID NO: 33857 - DNA, 240 bp, Glycine max
  Peptide Sequence Number=SeqID_150635
atggggtgttcgatcctcggcaagatttactttgaatgtcttgaaaaggttttagtaattggatatgtagtggatcagatgtcgagctcgacgctgactccaccattcttcattgatgccattgagacacgatggaaacacaatgatacgctcaatgtgaaccgtttctatgggttcctccattgtcgatgtgcgccgatagacataccaagatacagacctcgcatagcttacttctag

SEQ ID NO: 33858 - DNA, 720 bp, Glycine max
  Peptide Sequence Number=SeqID_150636
gaaggaagagttgggattcttttctcatgtggaggatttccaaacgttcccttgatggggatgagggccctagcgggggtccttcaaggagtccgcaaggcatgggaaatggtgcaaaagaaggacaaagaacttaggggaagtagcaatggggccgtcggcggctaccataggttgaaagccgctaaggaggaggaggttgaagccccggaagaaagcaaagaggtgcaagccctcaaaatggagcttgagaaagcccaagcggtcaaggaaaagttcaagtcaacagccgttaggatccgaaaggagaatgccgaactaagagacgtcaacatagccaccgccaaggccttggagcaagagaccaaaagggcccgcaaggaagaatacggtcggaacaagttccgaggggccttgtggggcagtaacagcgaacttaaactccgaagagaggagagggaccagtcacaagtagaaggcatgattctgaaagacgaattgaagacttgcctgaggtcaaaaaggagcttgtcccaaaggctgagcgagaccgaaacaaacatgttggccatcatcagcaagtacaaagaagaattagatttggccaccgcccatgagcacaaggtggtggatgaatacgcccaagtgtacacagaaaaggaggctaggggaagggtgattgactcattacaccgagaagcgatgatgtggatggacctg

SEQ ID NO: 33859 - DNA, 378 bp, Glycine max
  Peptide Sequence Number=SeqID_150637
atggccacaatgatggaggccatgatgagcatgaagaagataatggaagccaatgcggttatagtttccgctaccagcactgttgctaaggtgaacccgatgcccccatctgatctcaaccaaatgaatcatccaacctcagatatggtgggcaaagatttgggaagtacagacagccccatgatgtgtaaattcaaaacgagcacgcattcccgccatatggcttgcctcccaactatacactactcaatgtggcgtacactcctaatgaggatgtcaataactctgcccccatactcattgagagccgacaacctcatcatgtacatgtctctcaacccatgggggagacacatgaaattccctaccacaatctag

SEQ ID NO: 33860 - DNA, 3774 bp, Glycine max
  Peptide Sequence Number=SeqID_150638
atggcctatttcatcgatcggcgtcttaacggtaagaataaaagtgcggtcaaccggcagcgctttttgcgccgttataagtcgcaaatcaaacagtcgatctccgaggccatcaacaagcgttcggtcaccgacgtggagagtggcgaatcggtgtcgattcctatcgacgacatcaacgagccgattttccatcaggggcgcggcggcagccgccatcgcgtgcatccggggaacgaccactttgtgcaaaacgaccgcattgagcggccgcagggcggcggtggtggcggcagcggtcagggcaatgccagccaggacggagaaggtcaggacgagtacgtgtttcagatttccaaggatgagtacctcgatctgctgtttgaagacttagcgctgcctaacctgcgcaaaaatcagcatcgccagctcaatgagtacaaaactcaccgcgcgggcttcacctcgaatggcgtgccggccaatatcagcgtggtgcgctcgctgcaaaactcgctggcgcgaagaaccgccatgaccgcaggcaaacgtcgtatgctgcacgaacttgaagccacactgagcgaagtcgaaaacagcgagccggcgcaactgctggaagaggagcggctgcgtaaagagattgcggaactgcgggcgcgcattgagcgcgtgccgtttatcgacacctttgacctgcgttacaagaatttcgagaagcggcctgaaccgtccagccaggcggtaatgttctgcttaatggacgtttccggctcgatggaccaggcaaccaaggatatggcgaaacgcttttatatcctgctctatctgttcctcagccggacttacaaaaacgtcgatgtggtgtatatccgtcaccatactcaggcgaaagaagtcgatgaacaggagttcttctactcgcaggagaccggcggcactatcgtctccagcgcgcttaagctgatggacgaagtggtgaaagagcgttatgacccgtcgcagtggaatatttatgcggcgcaggcctcggacggcgataactgggcggatgactcaccgttgtgtcatgaaattctggcgaagcatattctgccggtggtgcgctactacagctacattgagattacccgacgggcgcaccaaactctgtggcgcgagtatgagcatctgcaggcgatgtttgataactttgccattcagcacatccgcgagccggaagacatctacccgccggtcaccgaccggctttttctttaccccgcccggcttaacccctctgaaaaccctgctgtttttctgtgcggatttaaccttctatgggatagcgcgccacagaatgaaaaaatgagaacgccgttgaatgccagcatgatttacagtttgttcattattggttccgtgctggtcgcagcaagtattctgctgagctccttctcgtcgcgtctcggtatcccgattctggtgatcttcctggcgctggggatgctgaccggcgtggacggcatcggcggcattgcttttgataactacccggtggcctatctggtgtccaacctggcgctggccatcattctgcttgatggcggcatgcgcaccaaggccagctcgttcaaggtggcgcttggtccggcgctgtcgctggccaccgttggcgtgatgattaccgccggcctcaccggcctggctgccgcctggctgtttaagctcgatctgatgcagggcttcctgattggcgccattatcggctcgaccgacgccgcagcggtgttttcactgctgggcgacaaagggcttaacgagcgcgtcagttccacgctggagattgaatcaggcagcaacgatccgatggcggtgtttcttaccattacgctgatcgacatgatccagcaggggcagagcggcctgagctggatgtttgtggtgcatctggtgcagcagttcggccttggcattgtgctcggactgggcggcggctgggcgctgcagcaactgatcaaccgcatcagcctggcgcaagggctctatccgctgctggcgctgagcggcggcatcattgtgtttgccctgaccacagtgatggaaggcagcggcattctggcggtctatctgtgtggtttcctgctgggcaacagcccgattcgtaaccgccacggcattctgcaaactttcgacgggatggcctggctgagccagattggtatgtttatcgtgcttggcctgctggtgacgccgtctgacctgtggcatatcgcgctgccggcgatgattctctcactgtggctgattctggtggcgcgtccgctgtcgattctggtcgggctgctgccgtttaaaggctttaccggacgtgaacgcatctttatcagttgggttgggttgcgcggtgcggtgccgatcatcctcgcggtgttcccgatgatggccgggctggagaattcaaaactctacttcaatatcgccttcttcgtggttctggtatctctgatgctgcagggcacgtcgctgggctatgccgctaaacgggctaaggtggtggtaccgccgaccgcgtcgcccatcagccgcgtcgggctggatatccatccggaaaatccgtgggagcagttcgtttaccagctcagcgccgacaaatggtgcgttggcgccgcgctgcgcgatttacaaatgccgcgcgaaacgcgcattgccgccctgttccgcgataacgcgctgatgcaccccaacggcaatacgcgtctgaaagagggtgacgtgctgtgtgtgattggccgtgagcgcgatctgccggcgctgggcaagatgttcagccagacgccgccggtggcgctggatcagcgcttctttggtgactttatccttgatgccgaggcgcgcctgcgcgatgtcgcgcagatctatggcctggagctcgatgaagagactaacgatcagcagtcgctcggccagttgattatgggtctgctcggcagcacgccggtggtgggagatcaggtcgagtggaaccagctgacgtggacggtggcggaaaaagaggataaccaaatcgtcaaaatcgggattggtcgttacgagatcgtcgatgcagtaatggatgtggagaagctggataccgtcggcatcccctgtcataccaaccccggcctgagttatcagctcgacggctgggatcatgaaaccagcgtaccggcgtggattgatggcgaaccggtcgatctgcaaatcggccactatgacaagcagcaagaccgctggcggacgactcctgagcgcgtacttgattctggtcaggccatcttttacttaagaaaagagagcaggttttatggcaagtacattggtaatgaacgatgcaacccgctcggtatttggggagaactggacagttttattccgccgcagcaaattgaataccgctttgtcgcacagttaggtctgtcagtgctgtgcacggcctggttctgggtgcgtatgcgccactacacctaccgcaaaccgttctggtttgagctgaaagaaatcgtcaaaacgctgtttgtgttttcgctgctggatctggcgctgattgccttttccaaatgggacttctcgcgcatggtgtgggtatttagctggacttatgccctgctgctgctgccgctgatgcgagccggcgtgaagcgtgccatcaatcgcgctggccagtggcaaaaagagaccattatcatcggctccggtaaaaacgccatggaagcctacgcagcgctgcagagcgaggagattctgggctataac

SEQ ID NO: 33861 - DNA, 135 bp, Glycine max
  Peptide Sequence Number=SeqID_150639
atgtatcgtgggccccgtggctcgttcggtgtagaaggtcgatcgaaagtcggcccgtctgggtgcgatcataccagcactaatgcaccggatcccatcagaactccgcagttaagcgtgcttgggcgagagtag

SEQ ID NO: 33862 - DNA, 585 bp, Glycine max
  Peptide Sequence Number=SeqID_150640
atgggtgaccaagaggagatacaggaacagatgaaagccgacatgtcgtttttgaaagagcaaatggcttccatgatggatgccatgttaggaatgagacaactcatggagaataacgtggccattgctgccgctgttagttcggctgctgaagcagacccaactctcccagctaccgcgcaccatcctctcccaaacatggtaggacgagaaagaaacacactgggcacatcagcaacccccatttgggatacaaccgagtggcttacccttatggattaccacctaattacacgccaccagtcatgcatgatgatgcgggtcatgtcccttcccccatccttgaaggggagcctccttgacagtcggatgaggttcacaaggatcgtagagagtatgcccaaggagacatcgatttctaccccccggtcctcgttgaggggctggcacccaacacactgccttagcccaacctcacaggagaacctcgaaacctcccagcacagccattattcttttccacagaaggaccgcccccggcagcgaaagaaaaaaggaaactcgatctcatcgaagagagattaa

SEQ ID NO: 33863 - DNA, 912 bp, Glycine max
  Peptide Sequence Number=SeqID_150641
atgcgtaccgctgccctgctgcttcccctcgccctggacgccacgttcaccagtgcgccgctgctggccgcgccggccaccgcggcgccggccacggcgacgaaatcccagctgcacctgcagactttccatcccggcccgcatgcgatgttctcggtgtcctcggtgctgatcgaaggccgccacgacgcgatcctggtcaatgctcattttggtgccagtgacgcgcgcaagctggtcgagctgatccgcgccagcggcaagcagctgaccacgatctacatcatccacggcgatccggattactacttcggcgtggccaccctgcaggacgcgttcccgcaggcacgcatcgtcgctaccgcgcagaccgtcgcccacatccagcagacccaggccggcaagctggcctactgggggccgaagatgggcagcgacgtgcccgcgcgcatcgtggtgccgcaggtgctggacggcgatgccctgcagctggaaggccagcgcctgccgctgatcggcctggatggcccgaccccggatcgcacggtgctgtgggtgccgtcgctgcgcgcgatcgtcggtggcattccggtggtggccggcgagcacgtgtggatggccgatacgcagacgccgaaatcacatgccgactggctgcagaccctgcagcggctgcaggcactgaagccggaggtggtggtgccggggcattacgcgccgggtgcggcactggatgccagtgcgctgcgcttcaccgcagactacatccgtgcgttcgacgttgaggcggcaaaggcgaaggacagtgcggcactggtgaaggcgatgcaggcacgttatccgacgctggacggcgtggcgtcgctggagctgagtgcgaaggtggccaagggcgagatgcagtggccatga

SEQ ID NO: 33864 - DNA, 336 bp, Glycine max
  Peptide Sequence Number=SeqID_150642
atgccccattacttcagaatgcaccctaggcctaaggccatcccttacaaccctcaattcaacaaaaacaagcaacaattcaaggataaatccctcacgtttttgagcaaatacatgcaacttagagcaccaaaatacatcaatggaaagctagagagcccaagaatgaggtgcaggggtgctcacccaggcgagctaacctacacttttttttttcgggagacgatactaggctgccttgcagaggcgctttccatttgtccaaagctaggcaagggacgacgacccatcggtcatgaccctagcctctacttgcgtccatccctaagtacctga

SEQ ID NO: 33865 - DNA, 369 bp, Glycine max
  Peptide Sequence Number=SeqID_150643
atgaccggtcctctccatgagtcgatcttttgctttctcataagggtggacccttgggtactagtacctatcaccttcagaggactacacgtcctcgccatcagagggttgcacaccctcgccttcagagggctgcatgtcctcgccttcagagggctacaagccctcgcctttagagggctgcacgccctcgccttcagaggactagacatcctcgccttcagaggcatgcacgccctcaccttcaaagggcgacacgtcctcaacttcagagtgctgcatgccctcgcctttagagggctacgcgtcgtcgctttcagagggctccacatctgcaccttaagagaatttaaggtcctctgcccttaa

SEQ ID NO: 33866 - DNA, 281 bp, Glycine max
  Peptide Sequence Number=SeqID_150644
atgacccttcgcttagtgaacatccacaactcatccttcttccagattcttcctcgcgctcagccgaggagggttgcactcagcggatggctcgctaagccagatgattggcttagcgagatgaaatcaaaaggaagcaggctagcacaatccgtgaaattccgtgatgtggcggaaatcgaaaaagagggggtacaaatagcaatctggcccacttgggccttccagatccttcctccagaaggctgttgcttctggaggaagcaaccttgctcgcctgg

SEQ ID NO: 33867 - DNA, 249 bp, Glycine max
  Peptide Sequence Number=SeqID_150645
atgagatttcggatgttagcgttcattcctaaacgaccatttagaggaaacactgggcccgacagaatagaagaatatcactcgaagtgtaccaatctcacacagggcagggtttgtggtaagttgggattttggctcaaggcttgtagaacggttggacatgatatatgtcaggatgttggtttggccagcggctcagggaaaaaggagaagtcccacattatttccatgatacacatgcaacactga

SEQ ID NO: 33868 - DNA, 167 bp, Glycine max
  Peptide Sequence Number=SeqID_150646
cgacatggtctcacaagcacgtaggtggtctccgagaccgagattggcggcgcctaagatctggtggctacgacgatgtcggtaggagcatcgtcggcagccgacaggggcttcttactgctgggaacgcagcctccgcctcatatctggtgtctacggcgcggtaa

SEQ ID NO: 33869 - DNA, 354 bp, Glycine max
  Peptide Sequence Number=SeqID_150647
atggcgaggactttgagccctctaaaggcaagaactttgaatcatctgaaggcgagaactttgagtcctctaaaggtgagaactttgagtcctttgatggcgaggactttgagccctctaaaggcgagaactttgagtcctctgagattcaaagggtacatctacttgggttgttatactgagaacaagagaggatacatctcttgtggatcagttcaagtggaaggtacatccacttggttgttcaaagagaacaagggagggtacatcccttgtgcatctttggcttgcaaaggattttacaaggttgaaagaaatctccagaaccattggttgcttggggactggatatag

SEQ ID NO: 33870 - DNA, 735 bp, Glycine max
  Peptide Sequence Number=SeqID_150648
atgaccttcgaagctacacacagtgccatttcttcgccggcatcggcgtctggtcctatgcccttcggcgcgcaggatggcctgacgatcgacctgtttggacgggttcctgcccgtgccaacctttctccgcggcaggcaaaggaactgcgtttgatgacgagcggcacctctggccggcctggcattggctcatccaagagtgcagcccttcagcaatctttggcgagcaggttgcaagcaaggacgcagaaccttggctcgaccttgtttcgtctgacctggaagccttgggctttgcgaccgctgctgtcgcgttccctagcgcgtctgtcggcgcaccccataaaagagatcgtacttacttcgtggcccacgcccagcagcatgatcgtggacgccaaaccccatccgccgatcacatccggccgcaagccaaccgatccgcagataggcctggcggatgtggcggttcacctggcgagttggggcacgcccacggccagcgagcccggcgggacgggggatcagtacgtggccaggtcaatcgccaagacgggcaattcagcaccaacgatgctgacgcaccaggtggagctggcgggatggccgacaccaatggcagggacgccggcgcagaacgggaacaacgcagcgggaaacacggacagcagccgacggacggtagaactggcgacctggccgacgccacgtgcagccgatggcgagaagaat

SEQ ID NO: 33871 - DNA, 431 bp, Glycine max
  Peptide Sequence Number=SeqID_150649
atggtcattcccaagttcaaggtgccggactttgacaagtacaaggggactacttgccccaagaaccatctaaagacgtattgtcggaagatgggggcatacacaaaagatgagaaactattgatacatttcttccaagaaagtcttactggggcagctgttacctggtatactaacttggaaccttcccaagtccattcttggaaggacctaatggttgccttcgttaggcagtatcagtacaattctgatatggctctggataggatgcaattacatagcatatgcaagagggagcacaaatctttcaaagaatacgcccaaaggtggagagatctggcagtccaagtggttccctcaatgacgaagaaagagatgatcaaaataatagtatacacattaccagtgttttactatgaaaaaatggtggg

SEQ ID NO: 33872 - DNA, 683 bp, Glycine max
  Peptide Sequence Number=SeqID_150650
ggttcatcttgaactctgagggccatcctgggaagattctcaggaaggatttgactacactagctcaggtgtggagtgtcctctcgtactccaacttggcccctacatcacatacctctgatctgacagtggacagagctaggctgatctttggcctaatctctcacttggatatgaacataggagtgctgatctctggccagatgacctttatagcccagtctaacacttctagacttgggttccttgctctgataactgcattatgtagggccagaggggttgtctctgacagccttacctttgagtgcctaagcccggtcattaacttggcctacactaggaagaactgttggaatcccgacgatccaacagtttctatccgaggggctagaagggcaagggcaaggccagctgagcttccttctacttttgcagctcctactccagcatccacctcaatagccccttctgtcccaatggtggcacctctagactttatccctacagtagagcagtttgataagatggtagcttggcccgggacccaaccttctcttcacagagaagacgaaggtcccacagcccaggtacctcagcatatggaggataagtcatctgaggccaccatcctagagccatttgatataggagaagaggcagaggagacacatatcagacag

SEQ ID NO: 33873 - DNA, 243 bp, Glycine max
  Peptide Sequence Number=SeqID_150651
atgccaaatctctatgaccgaaccacgaagctggaagagactcttactcagttcatgcaagtgtcaatgtctagtcaaaagagtacaaagtctgctatcaagaatctggaagttcaggtgggccagctcgcaaagcaattagcagaaaaatcatccagcagttttacaacaaacacggagaagaatctgaaggaagagtgcaaggctgtgatgactagaagcaaaatggcaattccaagctga

SEQ ID NO: 33874 - DNA, 231 bp, Glycine max
  Peptide Sequence Number=SeqID_150652
atgataaagggattgaacagaatagcaatagcccaaaacggtcgtaaactacactcgactgatatttgtggacagacctcaccggaaatcctgccagaagaatgtttaccatcgatgatgagaatcatgaaactggccaattacagactaaaggcccaagtggagaaggacaaagcccccgagtggagaaggatgaaggcccagaggcagagacactatcaagactattaa

SEQ ID NO: 33875 - DNA, 717 bp, Glycine max
  Peptide Sequence Number=SeqID_150653
atgaattcagttacaagacgcattgatctaacttgcaagcttcttgctcctgttgttactgggtttataataagctttgtatcgctaaaagcatctgctctaactttagcactgtggaatactgtgtctgtttgggtggagtattggcttttcacatctgtatataaagggattccagctttgggcctaagtagccagaggaggatggaaagaccttcacaaagtgaccaacaaaggaacaatcaaactttggaggaagatagcttgctatctggtactgatggtggctcggaattggcagatagaaaatgcacaagaggaataagtgccggaattgaaattgctgcaacagttgtatatcctgtgctacagtctcaaatatcaactattagaactggactttggtctatatggtcacaggatcttgttcctgaatctgatcgtttgattgttgggggtgtacagaactcacttcaatctttgatggatttattggcctatgttatgggaatcataatatctaatccgcgggacttctggaagttaagtttgttcattcctggaagtcacattagctgcattcctctactgcatccatgtataccatgtgcggaagcacatctttcacttcgaacgtctaaagtggagttaatgtgttgcaacagcatcttaatttgcgaaggtctatctgttgggaaaaagttatgtaccgtttga

SEQ ID NO: 33876 - DNA, 1167 bp, Glycine max
  Peptide Sequence Number=SeqID_150654
atggaagaaaacgtgaaattgaaggagtctccgttcactggacaacaagaaaagccatctgcactaatcacttatttgtacattggccacttcttagcaagatggggtgccagaatgtgggaattctctgttggcttatacatgatcaatatttggccagaatcgttgctgtacgcagcaatatatggtgcagttgaatctgccgctattgctgtgtttggtcccataattggaagatgggttgataagttgtcttgtgtgaggtctacaaatttctccattttcatcttgctggtgatcataatcaatgtctgtggcggcattggtgtgctttcaactcttgctggtacaatattgattgaaagagaatggttgttagttatatctgaagatcaacccccagaattgcttacaaaaatgaattcggttacgagacgcattgatctaagctgcaagctgcttgttcctgtcatttctggtttcataataagctttgtatcactgaaagcatctgctataaccttagcactgtggactactgtctctgtttgggtggagtattggcttttcacatctgtatatcatggaattccagctttggtgcaaagtagccaaaggagaatggaaaggcttatacaatgtgatatggaaatgaacaatcaaactatggagaaagatagcttgcttcctgttactgatgatggctcagaattggcagatagaaaagccagaaaaaaaatttctgagaggattttagagattccctatattgctgcatggagagtttatttacaacaagaagttgtccttcctggactggctctggctttgctattttttactgtactcagagtcattgatgaaattccaattacttgcctcagctttggaactttaatgacagctaccttagaatgggaaggaatacctgaatatattattggaatatcaagaggaataagtgctgtgattggaatagctgcaacagttgtataccctgtgctacagtctcgtatatcgaccattagaactggactttggtctatatggtctcaggatcttgtttctgaatccgatcgtttgattgttggaggtgttcaaaattcgcttcagtctttgatggatttattggcctatgttatgggaatcataatatctgatccacgg

SEQ ID NO: 33877 - DNA, 177 bp, Glycine max
  Peptide Sequence Number=SeqID_150655
atggtgaggggaagtgtagaggtcgaagttttcaaggaagtctggaacttcaaagtcccttccaaggttaagactttcatttggctcttgagttctgtaactcctgttgtgagaggtaatgggagcacaggaaatatgtatataaaggcaagttgtgtgggcctacgggaagtatga

SEQ ID NO: 33878 - DNA, 420 bp, Glycine max
  Peptide Sequence Number=SeqID_150656
atggatgagattcaagacctacctttggttattcttctattatacttgatttgcacattctacaatggtcaaatgaatcaagatgtcgccacgagagatgatcaacaaacgagagacaaatttgtcacatatgtatctctagaggatgaatcatcttcacgtaaaggacttcaaatctatgactacaaacttccctttcgagtctttggtctggcatcacctaatgtgtcgacagatggtagtatagaggaacctactcatgaagaggagttagatggtaaagggagatttctctataagcctctcgagcagtggaatggtggtggtgacaacaataatgtggtggtggtgacggtgactttggcggtggtagtggtggaatggtggtggcggaaacgaaatggtggtagatttaaatag

SEQ ID NO: 33879 - DNA, 110 bp, Glycine max
  Peptide Sequence Number=SeqID_150657
atggcggtcaatggcttcgatgtcgcacctggtcaacttcctcatgcaccagaagatcacccacatcggcctctacgaccccaaccccgacatcctccgcgccctgtcgg

SEQ ID NO: 33880 - DNA, 540 bp, Glycine max
  Peptide Sequence Number=SeqID_150658
atgggtaaagtagaggaggtgcaagagcagatgaaggctgacagggaggccatgaaagagcaaatggccacaatgatggaggccatgatgagcatgaagaagataatgaaagccaatgaggttgcagttgccgctacccgcgctgttgataagtacgagcggggcccccattatgcgcaaattcaaaacaagcatgccttcccaccatatggcttgcctcccaactatacaccacccaatgtggcatacattcccaatgaggatgtcaataactccgctctcatgctcattgagagccaacaacctcatcatccttgcctcggatatgccactgaagggcaagcagttggtgatatacccctacaaaacactttggagggccctcagtatcacccacaaccacacccctcacattccacaacgattaaaaaccctcatgctatggcggaaatgggaaagtcggatcatctaaaggaaaggctcagggccattgaaggaggtgaagattatgcctttgctaacctagaagagttgttccta

SEQ ID NO: 33881 - DNA, 327 bp, Glycine max
  Peptide Sequence Number=SeqID_150659
gatcatgcccgcaagacgcccaatggaccccaagaagtccaacagggtcttggggtttccaactctgattacgggcctctgtcagttctacggagtgcatgtcgcccccagcaaggtcatcaggccccctactaaccgagctttcatcaagaagtactgcgcccccaggcaggcgcaaggcgagacaccacagcagcctggggatggccggcagcgggcaacagacgcaccgtcgccacctctaaagcccctcaactcatctacaaaagctggagcgttgcctacgacccatggtcgaccagcaggcgacaaagtccaaagccaaag

SEQ ID NO: 33882 - DNA, 433 bp, Glycine max
  Peptide Sequence Number=SeqID_150660
atggagttcaaatatcgtgatggtcaaatccgaaggacaccatcaccattgcggagccctcttccttccaactcctatgtctccaatcgcccattacatgggtgtgactttgcatcaggtggctttcctagtaatgtttcagcgccaagagttttcccaatggtcatgccgatcaatgtcaacgaagtattccaacgagagttggagaaagagaaaatatggcgagagctagagaaggaaaaaatcaggagagaaatcattgctcgtgagatggcttttgcacaacgacgagagttggaagatgaagtgagaaaggaaatggagttagagagaacatctagaatgtcgatgcaaagatcagaggggattgcatttcgagaaccaatttcagagtctattaatcaaagtcggtcgaataacattaccatgtttg

SEQ ID NO: 33883 - DNA, 317 bp, Glycine max
  Peptide Sequence Number=SeqID_150661
ctgcaatctctttagctggtggtgtcggtgtggaaaccccacattctcagggcttgttgttacatgatggggcactctatctaaaggctttgaaaccttcagagctggttgacagcggtctacacaagcagttagagatgcagttccaccagttccgtaaagatcggactttctccatccgtgtagagttcatcccggacaaatggctccgcctctccctaaaggaacatttttcaatgttggtactgctactgcatcgcgatccagctataggaattacggatgctggtggtgctggttgccatgatgctaggtag

SEQ ID NO: 33884 - DNA, 249 bp, Glycine max
  Peptide Sequence Number=SeqID_150662
aaagttgaagcctttgctaaggctaagaagaagtctctggaagaagcatgtaataaggtcaagttggatgaaactttggaagggaaggaagccttggaactagaaggtgtccttgcctccattaaaactttgtttattgaaaagcataagaaaaagttggcagaagaagaaagacttgctgccttagtagggaaggagtctaaagacaatctagtagaggttgtgttggatcgagtggcctcagaataa

SEQ ID NO: 33885 - DNA, 1512 bp, Glycine max
  Peptide Sequence Number=SeqID_150663
atgcacttcatgctgcagaaagaggtggttaaccgtctggtagccggcccgggcagcaaagcttacgggcgtctcagcgtgatggcgcaatattattgtcaggtgattccggtgctggaagtgccaccacaatcgttcaccccgccaccgaaagtggattcggcggtagtgcgtctggtgccctttacccagccaccgtatccggtcagcgatgtgcgtttactgagccgtatcaccaccgaagcgtttggtcagcgacgcaaaaccctgcgtaacagcctgggacacctgttcacggccggtgcgctggatgaactcaacatcgacgcctcgctgcgggcagaaaatgtcaccgtggcgcagctgaatctgcggagaactgagtgcatgagtgaactggcccgcgtttgtgttcaggtactgagtcagtatgtggaatcgcaatcctctcccgatgaggatcgctacgtgtttgcctacaccatcactattcgtaatctcgggcgcaacagcgtgcagctgcgcagccgctactggctgatcaccaatggcaacgggcgcgagaccgaagtgcagggtgaaggcgtggtcggtgagcagccgcatatcgcgcccggcaatgagtttcagtacaccagcggtgcggttctggaaacgccgatgggcaccatgcagggacactatgtgatgatcgacgaagagggcgagaccttccacgtggagattccggtgttccgcctcgcggtcaatttcgatgcgcaacaggacgagctatggctgaccggcgacctggtggcgcgcggtccgggttcgcttgaggtactgcgctacgtcaggtcgctcggagactgtgtgcgcatggtgctgggcaaccatgacctgcatttgctggcagtgtatgccggtatcagccgtaacaagcccaaggatcgcctgacgcccctgctggaagcggacgatgccgacgagctgattaactggctgcggcgccagccgctgctgcaggtagatgaagagaaaaagctgctgatggcgcatgctggcattacgccgcagtgggatctggagacggcacagcagtgcgcgcgcgaagttgaggcggtcttatccagcgacagctatccgctgtttctcgatgccatgtatggcgacatgccgaacaactggacaccggaactgagcggactggcgcgcctgcgttttagcaccaatgcgctgacgcgcatgcgcttctgtttccctaatggtcagctcgatatgatctgcaaagaggcacccgcctcagcgccgccgccgctgaaaccgtggttccaggtgcccggcaaaatcagcagcgattatacgcaaatctttggtcactgggcttcgctggaaggaaaaggcacgccagagcatgtgatcgggctcgacaccggctgctgctggggcggaacgctgaccctgctgcactgggagagcggccagtattacacccaggtctcgaaccgtgaccaggccatggcggaaagcgcg

SEQ ID NO: 33886 - DNA, 384 bp, Glycine max
  Peptide Sequence Number=SeqID_150664
atgcgtggtggccagcgcaacgcgcaacgcttcggtcgccagcatcatcaccacgcgatcgccaccggcgcgctcagcaaagaactcggtgtggccggtgaaggggatgccggcgtcattgatcacgcctttgtgcaccggaccgttcgccggcggtcaccggctgcgccgtcgcgatgggcagcagcgtcagcgtaccggcctgctgcggctgtggtgccacgccgggctgatagtcgcgcagcgtcagcggcaaacccagttgagccgcgcgctggcgcagcacgtcgccgtctgcgcacaccaccagctcaaccggccagtcacgctgagccagcgcaacggcgagatcgggaccaatcccggcgggttcgccgggcgtga

SEQ ID NO: 33887 - DNA, 511 bp, Glycine max
  Peptide Sequence Number=SeqID_150665
atggagaattggcgaacagcgctaggcaatcaattcgcggggctccaaactcgttggtggaggatgcatgaacgacaatcaattcatggggctccgaataaaagtggagaatggagaattgcactaggcaatcacttcgcgtggctccagactcattggtggaggatgcatgaacgacaatcaattcatggggctccgaataaaagtggagaatggagaattgccctaggcaatcacttcgcgtggctccagactcattggtggaggatgcatgaacgaaaattaattcatggggctctaaataaaagtggagaatggagaattgcgctaggcaatcacttcgcgtggctccagactcattggtggaggatgcatgaacgacactcaattcatggggctccgaataaaagtggagaatggagaattgcgctaggcaatcacttcgcgtggctccagactcattggtggaggatgcatgaacgacactcaattcatggggctctgaataaaa

SEQ ID NO: 33888 - DNA, 482 bp, Glycine max
  Peptide Sequence Number=SeqID_150666
atggcagcaccggaccttgccgactataaaccgatcttttttagcgctgaggagtggcaatttattctggccgcgaccgatcgcctgatccccgccggtggcaacggcaaagcgccgggtgcgctggaaaccaacgtgccgatcttcattgaccagcagttgcacagcccggagttcggcgcagagatctacctgcaggggccgtttgatgtgcacgcgcccgccaccatgggctatcagatcccgttcacgccgcagcagatgtatcgcaccggcatcaaactggtggagcagtggacgcagagcacctaccacaaagcgttctcgcagctgacgctggcagagaaagacgcggtgctgaccaaagtgaataaaaacgacggtatcgatttcaccgcgctgggtgaaccgaacctgaaagcctcgcagttcttcagccagctgctttccgataccaaacacggctacctcgctgacccgat

SEQ ID NO: 33889 - DNA, 630 bp, Glycine max
  Peptide Sequence Number=SeqID_150667
atgaccaccctgactcagatctggatgactttgctgctcagcaacatccagcccagcgaccataattccgacctccccctgccgaagtgtcagctggtgtacgccatcctgacgcggatgagcattcacgtggctcagttaatcgctgatgccatctatatatttgcaggtatggcgcctaccaggcaccatctggacccggataagtccaacagggccctgggatttcccgccttgatcacaggactctgccagtcgttcggcgtccccgtcgcacctagcaaggccgcagacgcgccgccacctcatcaggctagcccagctagatcgtttgatacggagcagtatttgcggcatttggttcgccagcaggcggccaaccaccgggccaatgtacagacccatgattgtctttatcagatgagtctcagcctgcagagccagggctttacttcttttccgtgccctactccggaccagttcagggcagaagtcgcatggcctggagattggcctgaggcccgggcaggagaggcaccagcagaggctcccgacgaggcagatgaggcccgcgaggacgaggagatgaccgatttacttgatttcttaggaggaagcggggccacatga

SEQ ID NO: 33890 - DNA, 297 bp, Glycine max
  Peptide Sequence Number=SeqID_150668
gtgcaacatgagttagggcttactaacgtcacgccggtgcagagccgggtggaagagttcccggctgagccgccgtttgacggggtgatcagccgcgccttcgcgtcgctggaggacatgctgacctggtgtcatcatctgccgggcgcgacaggccacttctatgcactgaaaggcgtcaggccggatgacgaaattgccgcgctgcctgccggcttcgccatcgaaaaaattgagccactgcgggtgccggaactggaaggtgagcgtcatctggtggtgatcaggcggcaatag

SEQ ID NO: 33891 - DNA, 1110 bp, Glycine max
  Peptide Sequence Number=SeqID_150669
atggacgacgacttcaatacatcggaagccatcgccgtcttatttgaactcgccaacgacctaaacaaagacaaatccgccgccactgccgcattgttgaaacaattggctgcgatcatcggcctgttgcaacgcgccccggagagttttatgcaaggtgaaagcgatagcgcgcttgacgtcgaaagcctaattgcagcgcgcattgcggctaaaacagccaaaaactacgccgaagctgaccgcatccgcaaagagttggcggatgccggcattattctggaagatactccgcaaggaacacggatgcccgtcaaattgtctgcccctgctgccgaaacactactgcccgtcaaaggcgtacaactgggttttgcccaggcacatatccgcaaaccaaaccgcaaggacgtgttggtgatgactgtgcctgaaggcagcagtgtttctggcgtatttaccttgaaccgtttttgtgcagcacctgtgacggtgtgtaaagagcatttgaaactcggtaaaggtatccgtgccttgttggttaacacaggctgcgcgaatgccggcactggtcagcaaggcttggacgatgcgcgagccagctgcataggcttggcacaagcactgaacatcagccccgagcaagtgttacctttttctacaggcgtgattcttgaaacgctaccgatggaaaggctgctggcgggcattgccccagcggttgccaacctgcaggagaacaactggctgaatgcggctgaaaccatcatgaccaccgatatcgtggctaaaggggcctcgcgtacgctgatggtggatggaaagcaggtcacgatcactggcatcagtaaaggctccggcatgattcatcccaacatggcgaccatgctggggtacattgccacggatgcggcgatcagccaagcggcgcttgatagcatcatccagcatgccgtaaataaatccttcaattgtattaccgttgacggcgacaccagtaccaacgacagcttgatcctgatggccactggccaggcaggtggaagcaggcaaaaacgaagaagagtgccgcaaagtggcttacgctatcgcccactcgccgctgattaa

SEQ ID NO: 33892 - DNA, 219 bp, Glycine max
  Peptide Sequence Number=SeqID_150670
atgttgattgatgttggaaatgctttggcatgtgcatgttgtgtatgttcatggcgggcgaagtgcactgaccttctagggtctttggcacttgctttgggacacgttcatacgttggatgttgtgtatgttcgtgggggacgaagtgcactgatcttccaggtgtatgttcatggggtggagtgcactgaccttgtcagatggcccagacgtgggtga

SEQ ID NO: 33893 - DNA, 209 bp, Glycine max
  Peptide Sequence Number=SeqID_150671
atggctcctacagtaatggcagaatccgcgacattaaagatatatttgaaaaattcaatgtgctttccaccaataagagggaagctttccggtacattccagtctaccagtgggaagtggagcatatccactacacagcctctcatgaaagacgaatatccttgtcctgcagaagctattttcgaaatacctccgtatccgatccagcg

SEQ ID NO: 33894 - DNA, 789 bp, Glycine max
  Peptide Sequence Number=SeqID_150672
atgacagtcaccgctttaggagcgctgtacaccagcagggcttcgaggccatcaagggatggagtagatagggcgtcggcggtcgacatcactggttacccccatggtcagtggatcccgtttgatgccgacgctatcggccagctcctgggatatccgttggtgttggaagagggccaggaatgcgagtatggccagaggaggaaccagtctgatgggttcgatgaggaggccatcgcccagttactatgtataccggggcaggattttgcccggacttctgcagggaggcgagtgcgaatcatgcgcaccaacatgaccaccctgactcagatatggatgactctactgctcagcaacatcctgcccaccgatcataattccgacctccccatgccgaagtgtcagctggtgtacgccatcctgacgcggatgagcatccatgtggctcagttgatcgctgatgccatctatatttttgcaggtatggcgcctactaggcaccctttcgacccagataagtccaacagggccctgggatttccctcgctgatcacaggactctgccagtcgttcggagtccccgttgcacctaccaaggtaattcggccgcccatcacccgggcttttattgagaagtactgtactcagagacaggctcagggtgatgctccacaggccgcaggcgcgcccccaccacctcatcaggctggccaggctgggtcatttgacatggagcagtatttacggcatttggttcgccagcaggcggccaaccaccgggcacat

SEQ ID NO: 33895 - DNA, 259 bp, Glycine max
  Peptide Sequence Number=SeqID_150673
tttccagtttttgaagactcaacttgcaatatccatcaagggaactcaattagctacactattaaatcagacgagtctgatcatttgggatgaagcacccatgactcacaaattctattttgaggcacttgatcacagccttagagatatcatcaaacacaacttaaaggactgtaaaatctttggaggtaaagtaatggtctttggtggagatgtctggcagatcttgccagtcattcccaagaggcagccgctctga

SEQ ID NO: 33896 - DNA, 288 bp, Glycine max
  Peptide Sequence Number=SeqID_150674
atgactaaagcacgtcaaaagggggtacggaaagaaaatgggggagatgcttgccacccagctcgcccatgcgagcaagttacggaaacttacgaatttcgtaatgatacctgttttctttccgtaatgttacggaaccttgcggattacataatcatcccctttttgacttacggaatgttacggaacctcacaaattgtgcaacgatgcttccttttgagttccggcatgtcacggaacttcgcaaattgcctgacgatgggtgccaagtacctccaaatggttaa

SEQ ID NO: 33897 - DNA, 537 bp, Glycine max
  Peptide Sequence Number=SeqID_150675
atggatcaagttcattgaaggcaaggcatatgggaagatctgggatctagcaatgatagaagtgtccgttgaagcgatcgcatccctcactcaatactacgaccaatcactcagatgcttcacttttggggactttcagttggcaccaaccatagaagagtttgaagggatcttaggatgcccattagggggaagaaagtcatgcctctttgccagattctatccttctagggcaagaatagaaaaagtggtcaagatcttggaacaagagctagaccaagtgaagcaaaataggaatggagtggtagggataccaaggaagcgcttggaggagaaggcaaaagctttggcaaatcaaggggaatggacctcgttcattgacatcttagcactgttggtgtttggaactatactatttccgaatgtagatgggccagtggatctagctgcgatcaacgcctttcttgcttatcaccacagcaaggaaagccccgtcatcgctattttggcggatgcgtatgatacattcgacttgag

SEQ ID NO: 33898 - DNA, 210 bp, Glycine max
  Peptide Sequence Number=SeqID_150676
atggctcagtgtgtttgtctgtctctttatgtgtgtgtgattgtgtgtgtgtgtgtgtgtgtgtttgtctctttatctggtagcaaaggatcattaaattgtaaacatcatgagccacatgatgagggaagcagtatcaaatcaatgctttacaagcttttggtcaatctaaggagtggtgtcttcatgctgcaaattgatggtttctaa

SEQ ID NO: 33899 - DNA, 873 bp, Glycine max
  Peptide Sequence Number=SeqID_150677
atgacgcgattcggaatcgcgcacgcgaaacagatcgaggcacataccgccgatgttgccgccaatctgtaccgtgggtccttcgcgccccagcaccatgccagaacccagcgcgcccatgccgccgataaatttaaccggcagcacgcgccaccagcgcaccgggcgcagctcttccagcgcgccctcgatttccggaatgcccgagcctcctgcctccggcgcgaagcggcgcaccagaaaatagccgatgccgcccagcagcgccgagataaaaaacgcgctcagcaacgccatggccaggttatccgcacgctctgtcagccagccgatccgcaggtggagaataaaattgaccgcgcgatcgaaagccacccccaccagcccggtgaggataccgaccagcgcggccagcagcagcaatgccagcggggttttatcgcgtcgcagcagtttttgcagcagcataaagcgcccggcgcgcatcgcgttggcaggctcggtggcatcagtaatgcattgcttgaagagattgtcacggacgtacgccccctcacccgtcagggcaaagtggcagattacatcccggcgctggccggcgtggatgccgatcaactgggcatcgccattgccaccgccgatggacgcagctaccaggccggcgatgcgggcacgcgcttttcaatccagtccatctccaaagtcctgtcgcttaccgtcgcgctgacgctgtacgaggacgccgagatctggcagcgcgtaggcaaagagccatccggccaggcattcaattcactgccgactcaccgcgccacgccagcgcatgctggagtttgtgcgtcgtctggcacagcagccggacattcagtatga

SEQ ID NO: 33900 - DNA, 1076 bp, Glycine max
  Peptide Sequence Number=SeqID_150678
tggcgccggacagcgtgagacgcgcggcaccgtccttgatcagcccgccagcaccgaataccggaccggtgagcgtcaggtcattgctgcccagcacggagaggttggcaccggcggcaaggccgattgtgttgcctaccgcaatcgctgtcgtcgcatccagcgaagcgctaccgcctacgtccagctggccggtacccagtgcctgcgcattgcccagctgcaacaggcccgcgttgaggccgatccctccgctgaacgtattgggtccattcaatgccagcgtggccgtaccgttcttgaccaggctgccagtgccgctgatgagaccgcccagcgacacgttctggctgcccagcagatccagcgctgcgcctgccccgaggttgaggttgttggcgaggttcaacgctaccgaactgtccagcgtggtattggcacccaccgacagtgcaccggtgcccaatgcgctgatgttccccaagtacacgccgccgccgttggcggtcagcccaccaccgaagctgttggcgccgttgagggtcaacgtgctggcaccgttcttcaccagcctgccggcaccggacaccacgccacccagcgtgatcgcctgcgagcccggcagcgacagtgcggcacccgcgcccagggacacattgttgaccaggttcagcggggcgccgccatcgagcgtgacgctaccgccaatgcccaatactcccgtaccgagcgcgccgctgttgcccagcagcaggctgcccgcgttcgcgttgagtccaccgctgaaggtgttggtaccgttcaaggtcaatgtcaacgcaccgttcttgaccaagctgccggcgccggtgatgttgccggccagggtcaggttctggctgcccggcagggtcaacgccgcgccgaggttgatcgcattgcccaggttcagcgcatcagtggcgtccagcgaaccgttgccacttacggtcggcgaaccgcttcccagcgcaccggcgttgaccagcaccaagccaccggcggcaagatttaccccaccgctgaatgtgttggcgctggtcagcgtctgcacgccg

SEQ ID NO: 33901 - DNA, 507 bp, Glycine max
  Peptide Sequence Number=SeqID_150679
atgggaccagaaccatttaaattcataaatgactggttggagctaaaaggagttgatgattttgccaagcatacatatgaagcattgcaagttgaagggtgggttgcctttaagttggaggagaagttaaagaagttgaagtttcctttgaaggaatggagcaaatataactatggggaattgcagaagaagtgggatgatattaagaaggaaatagcactttccgataggaaagttgaacatggggtgttaacggttgaagaggtgcaagcgaaagcagatctagtgggtaacctaaaacaaacctcaactttgttggaatcgcaagtttaccaaaatgcaaggctgtcatgcatgaaggaaggtgactctaatactaggttctctgaagaagaagtgaggtttgctatttggagttgttttggggacaaaagcctcggacttgatggttttaactttaggtttgttaagaggttttggaatctgttgaaggctgatgttatacag

SEQ ID NO: 33902 - DNA, 391 bp, Glycine max
  Peptide Sequence Number=SeqID_150680
atgggtctgtcttccgtagctttcgctgccgaggctgccaccaccgcacctgcggctagcgcaaccaccgccaccgctgcgccggctaaagcccaggtgaaacaccacggcaagaaagccccggttcagaaagctcaggcggccaaaaagcatcacaaaaaagccggcttgacgtgtacgacacccggttcgccgggtgttttttcatcgggggttcgcattgatgctgcgccgctacttgttcgagatcgttctgaccgccctgatcctttgcggactgatcgccgcaagagatctatgcgcaaatccgttttactgttgctgtgctcactcccgctcatcgctgctcaggcggcacgcgccgacggcccgtccaaggccgagcaaacgc

SEQ ID NO: 33903 - DNA, 180 bp, Glycine max
  Peptide Sequence Number=SeqID_150681
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccctcctcctcccccgtga

SEQ ID NO: 33904 - DNA, 483 bp, Glycine max
  Peptide Sequence Number=SeqID_150682
atgggaggaaggaagccatatcttttctctaggttctatcctttccacgacaagagttgccaaggtagtgaaaatctcagcacaagagttggaccgggtaaagcaaaacaggaatggggtggtcggaataccgagaaaatattgggagcgatcgacgtttttctcgcctatcataaccacaaggaaagtccggttgtcgctatgctagccggcctatatgacaccttcgaccgaagatgtgaagaaagcaatgcaaggattgtttgttgtactccaactctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaggattctatcttcatgcgaaggatgtcccatga

SEQ ID NO: 33905 - DNA, 243 bp, Glycine max
  Peptide Sequence Number=SeqID_150683
atgactcaagaactggtagcccgcggagacaccttaaggttatccgcgcctcgtcattcagtgaccccaagtgtgattgacgagcagagaccaatatggtcatctgcgccctttccggagatgtcagcattttccgatggagacttttcaagtctcacaagttatctagaactacgtaggtctgagttcctcattggaggatacgtaggagcaagagccttgcttttgtcggccgccccataa

SEQ ID NO: 33906 - DNA, 447 bp, Glycine max
  Peptide Sequence Number=SeqID_150684
atttatgaatcagtaatcataaatttcctagcctatgactaccactcaaaatttgacctccacttcactccaccattacaccatcagacatgcaaaagacgccgtgcatcaaggaaacatatttggacctatgaaatcacccaatcaatgctaggggcaccatattcactgcaacttccaccctctgtcacacaatgtctaatccactgtggtgaccacatgacaattctgagaaaattcggacctccactacaatggaatgtaattgtgcttgacaaggggattagtgataagtatatcactcagccttggtataaattccttcaagaaggtgattttagccatggagatgaactgtcattctactataggcgtgccgaaaaaatctgggaagcactattagaaaatatgctttctacatcggttatttatgactttcaacattag

SEQ ID NO: 33907 - DNA, 258 bp, Glycine max
  Peptide Sequence Number=SeqID_150685
atgggtttttacgggaaaggaaaatgctacaatgcgaggggtatttctcttagctcagacatgatcccgtcggaattgggttatgaacgtgctgctcaaatttcacgacgatccaacggtgaacgaatccaagatcgtcgtttttctgagataggtttgttgacccaagagatggaggctttggaggaagactatggagatggaaatgggaaaaatgaatcaaggcaatttattgaggggttaatggatctagaatag

SEQ ID NO: 33908 - DNA, 315 bp, Glycine max
  Peptide Sequence Number=SeqID_150686
atgggtaaagaaatatcagagcaggagatggaattaacaaccttagccatggtattacaaacgcctggggagaaagagtttgaatatgtgatagaatgtctagtcaatgaagatggaggaagaatggtagcttgtattgaaaagctgggggatccagatgatgaatctattggtcatgtgatgtttgaagaattggaaaacaatagaccaaaagaaaagcccaaagtagaattaaagacccttccagcgcatctaaagtatgtattcttggaggacaatgagaccaaacctgttataattagcagctccttgtag

SEQ ID NO: 33909 - DNA, 138 bp, Glycine max
  Peptide Sequence Number=SeqID_150687
atggttgatcagcagttcacccaggtaagtaaagataaggacactaattttattgtagcgatcttgccatcatactggctactagcgaaaaacccaagcaatgaaacctgtcaaaagaaagaatgtaagaggtattag

SEQ ID NO: 33910 - DNA, 378 bp, Glycine max
  Peptide Sequence Number=SeqID_150688
atggtgaccaaaggttggagctttgttgggcaacaatggtgggtgagaaaagaaggagaaagctacgtgagagaggggagaaaagcttctgaaatttttctgctgatcattcaaaatgcaccgtttacaaaaattccgggtagaaatttccaggatgtcacaccgtctctggatgacaaaggtgaaaaaaggtgcaggaccatatggttcccccgtatgtcatcggactcgccgtctctggatgacaaaggtgaaaaaaggtgcgggaccatatggttcccccgcagaagaaagcgaaaagggaaaattcccaatcaaggaaaatgggggaaagcaaaaaagaaagagaattctcgatcaaagatcggaagagaatag

SEQ ID NO: 33911 - DNA, 369 bp, Glycine max
  Peptide Sequence Number=SeqID_150689
atgccaatatgcacaaatatcttgagagcagaaactcaaattaaaaatgtaaccaatattacaaatgagaagaacaagaatactcatagcacagcttatatgcttggtagaagggatttggagagtaaagaaggcaaagcattgatgaataacaacacatactcaccaacacacaattctccagccataaaaatcttaaggggtaaatatatatcagttatattagcactgtccaagatgtcaatatggtatggccataacatgcttaagtcccccaaagacccctacaataatgagtactctgaaccccttctactgatttatgcaaatttgacatcaacatcatttgtgcagctttggcaaagctaa

SEQ ID NO: 33912 - DNA, 222 bp, Glycine max
  Peptide Sequence Number=SeqID_150690
atggaggacatattaatgaaaacgcaattcatggggctccgaaaaggggttatgaatggagaattgcacagagcaatcactacggatggctccaaactcgaaggtggaggacacatgaacgaaaacgcaattcatggggctccgaaaaaggggttgagaatggagaattgcactaagcaatcactacgcatggctccaaacccaaaggtggaggacacttga

SEQ ID NO: 33913 - DNA, 836 bp, Glycine max
  Peptide Sequence Number=SeqID_150691
tgaaagaggctattaaaaaagagttgtcaaataaaggatccccagagctactccaaattcagccggacatacaacaagtagctgcgcgtgtcagcacacagggaagtaatgttgttaccaatgtccaggcttcacaagaacatcatgctgatgccataccattgatgggactgtatgtgcagcttaaggatggtacaacaaggttggtggccatggggaaaataatggagggggattcagtcatacacacagtggcatatgcagatgatgttgtcagggtaagtgtagaaacagttattgatcctgaggctgaggtcccctatgccacgtcagaaatacaatatgtgaagcaggccgtcgatacatttgtagcttggcccacacaccttgtgaaagctgtattagatgaggttccacaaagtattccacacaacgaggatgcacatgtgccgaagccgactaatgtggacgcagatgatccgttgcgtggattgataaagtatagtttcgatatttacgacaacccacttgaaatcaactttgatgggaggtttcttggaattgtagatgcatctgcatcgatattcattacatattcagatgttagtgaaataatagcaggagacaaaagtctgaacatatctgtcatacaattatggttaatgtatattcatgagtggagtcagatattcagtcaaggtttcatgtatgcattccttgagccacagtcgttggtttgttcaaaggaaagacgcagcgaatgcgaacaatatcttctaagatggcttaaggaatctgaccgagaggtgtacattggaccttacttccatcagtaa

SEQ ID NO: 33914 - DNA, 226 bp, Glycine max
  Peptide Sequence Number=SeqID_150692
aatgaccaaacttggtctctgcttgtcatcgggcccgccgcctcaggatgacaaaagggtgcgaataaccataagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgccgcctctggatga

SEQ ID NO: 33915 - DNA, 270 bp, Glycine max
  Peptide Sequence Number=SeqID_150693
atgacaattggttacccatgtatgcaagctttcacagtaatggacaaaaaaggcacagcaaacaaagaacaagctcaagaggttgctcttgtgtgtataaagaacaagctcaagaggttgctcaagaggttggcattaacaaatccacttaaagtgttacaagaacacaataagggattagaccaaacatacctacgtgaggtggcgaaggagaagaagcacagacttctgacgatgctcgagtgcgacgaacacgatgctcgaccttag

SEQ ID NO: 33916 - DNA, 186 bp, Glycine max
  Peptide Sequence Number=SeqID_150694
atgcccagtgcggcatcaatctgtcagctgatgagcagcaacagagaattaatgttcaaggacatgacggagatgatactgatgcaggcagaccacatagtggactttaagtgggagaaatgggatatgtacaagaacgtgagatacagagaagagagaaaggatatacaggaaccgagaacgtga

SEQ ID NO: 33917 - DNA, 120 bp, Glycine max
  Peptide Sequence Number=SeqID_150695
atggaggagaaattaatgctgaaaattagtggaggtttaaggagcacctacttgaagctcttccatggaattgcagcgaaagataaagcagaagaggttagaggagacgtcatcccctag

SEQ ID NO: 33918 - DNA, 269 bp, Glycine max
  Peptide Sequence Number=SeqID_150696
atggggattgcttgccccaagaatcatctgaaaatgtattgtccaaaaatgggggcgcacgcgaaagatgaaaatttgttgatgcatttctttcaagagagccttactggggcagccgtcacatggtacactaatattaaaccctcccgagtcgattcttggaaggacctaatggttgccttcgttaggcagtatcagtacaactctgatatggctctggataggatgcaactacagaacatgtgcaaaaagagcatgaatccttcaag

SEQ ID NO: 33919 - DNA, 387 bp, Glycine max
  Peptide Sequence Number=SeqID_150697
atggatatgaatgtggggtacctcatctcccaccagatctccctcactgctcagcatgacacatccagacttggattcctggccttgattatagctttatgtaaggctaggggagttcagtctgattcgagaggacctaggaaggctagaggaaagagatctgaggcctcttccacagcaccatcagagacaggaggtccttcttcttctacacttcctccttcttcctccatagagatcccagtgattcctcctgcacccacacagataccactaccagctcctctttatacaggtccaacatatttgattttcactcctcagatgcttcactccatgctccaaagcatccatagagggcagtccatcatcatgcagagcctttag

SEQ ID NO: 33920 - DNA, 537 bp, Glycine max
  Peptide Sequence Number=SeqID_150698
atgggtgaagtagaggagatgcaagagaagatggaggccataaaagagcaaatggccacaatgatgaaggccatgatgagcatgaagaagataatggaagccaatgcgattatagttgccgctattagtgttgtcgctaaagtgaacccgatgctcccatctggcctcaagcaaatgaatcatccaacctcaaatatggcacatatctctcaaaccatgggggagacacatgaaattccccaccacaatctagctgacttcgagccttggctcggatatgccactgaagggcaagcagttggtggtataccctttaaaaacactttggagggccctcagtttcgcccacaaccacaaccattgcattttgcggtgggaagagcccctcctgctatggccgaaaagggaaaggcggatcatctaaagggaaggctcagggccattgaaggaggtgaagattatgcctttgctaacctagaaaagttgttcctaatacccaaacatggtcattcccaagttcaaggtgctggactttga

SEQ ID NO: 33921 - DNA, 1140 bp, Glycine max
  Peptide Sequence Number=SeqID_150699
atggctaaatttgtatttgttgttccaccgttgacgggccatgtcaaccctaccctgagtatcggggctgaattattgaacagaggacatgaagtggcatggatcagtcttgacaaaaatcttaataccaaacttccggcaggaggagagctcctgcttatccaatacgatcaaactgatgaagaaaaaagagatagcgaacagtacctggatattatttccaaaaaagtagtatacggaatagacagcatcaaatttctttacgatgatgtacttatcccactgaacaggcattgctataatggtattgtccatttactcgattcttataaacctgaccttgtaatcggtgatcatcagctatttgcagctgctattgctgcaaaaaagctaaaccttccttacagcactactgttactgcacccgctgccatcaaaatcatggatgaattaccaaaggttcatgagtgggaagtaaataaaatcattgaactgcaaaaggaactgggaataatggaagactattctttggcttcctcagacctcttaacaatggttttaacgtccagatatttctttggtgaaatggaactaccttccaattaccggtttacaggtcctgttcttacggaacgccggatatcctgtgagttcgactgggaaaggtttaacagcagcactcaaaagaaaattcttgtaagcatcggtacgactttcgatcatgatcataaaaaagcttttttccaaaaagtaattgatgcatttaaagatgaagacctaacggttgtagttgtttcagatcctcagcttttcgacagctggccggaaaatttcatggtatatcagcaggttcctcaattggatctcttgccgcatcttgatggtgtcgtttgccatgggggacataatacggtatccgaaacgctttcaaacggactgccgttggttgttattccgattgcctatgaccagtcccatgtagcaggacgtgtagtacgtacaggagcgggtgagcgtcttaattttaaccggttcaaatcaaaccatttaaaagaggcggtacagcagatccttagcaattctgattatcgtaaagcagcagaagtcatccgtcagtcttttattgaggccggaggtacg

SEQ ID NO: 33922 - DNA, 799 bp, Glycine max
  Peptide Sequence Number=SeqID_150700
atggccttttactcttcccaaatattgacaacttcatcgatatcaatgccattaaaatctttcttacgaaagaaccccgtacccactctactcgccgatacctatcattctatccatgaccgtacccaggctggccgtggaaccatttcttgctgtgcacctttactctatcagtggtttaccttccacttacctcaatcccgtgccttcaagaccaatgatgataagctttcttggcctcgccgaatcatgactcttgacccatctgacattgtttggtaccaagcagctagtgatgttggagagattattgtgagttgtggtgaatatcccaacgtacctcttttgggtatgcgtggcggaattagctacaacccgcttctcgctcgacgacaatttgggtacccgataaagacaaaaccaaacaaccttgccttgactaatgaattctatcttaaccatggagatcattcgaacaaaagggaaagattcgcacaagcttggagcgctatccgcagactcaacagaagtcagttgggaaagaaatcagactatgtgcatgaatcttacacccagtgggttattgataggaccaagagctttggcctaccctaccgcttacctagatacctatcgtccaccatcccaccatcatccttgcctatcccctttgatactaaggaagagtttcatgaacaattaaccaaagaaaggcaagaaaaagaaacttggaagaggagatgccaggagctcgagcaagagaatgagactttgaaggggaagatagcccaacagagcc

SEQ ID NO: 33923 - DNA, 291 bp, Glycine max
  Peptide Sequence Number=SeqID_150701
atgtacatcagtatggcccaaaaatacattatgaagcatagccaacaaaacatgttatccaacaaaaacccccccacacttattcccaaaacaattccaaaattccttaaggttaaggtgatatatatcatggtttttcacttaaggcttgtagtgagcttcaaaacaaggaaagggaaacaaggctcaaaagggctatcaaaggaattaattcaaggaagcatcaacaagaatcaagccaaggcaactgtgcaagcaatcaatggggcaaaacacaccaaaagattatga

SEQ ID NO: 33924 - DNA, 216 bp, Glycine max
  Peptide Sequence Number=SeqID_150702
atgtggctgaaagaggataagacccctgaggttttgtctggaaatcgcgatgaacgcactaagcgcgcgtgtgcgcttagcctattcatcgcaattgtcaaaattttagatttccagatgaacacgctaagcggaccatcactaagccggacctgtacgactaagcgccactttgcttatgctaagcgcgcgctgtgggctaagcctgagtgttag

SEQ ID NO: 33925 - DNA, 255 bp, Glycine max
  Peptide Sequence Number=SeqID_150703
atgttgcgcttagcgccaccctcacgtttagcgcgacaagggaatgggggcaatgtggcatgcccaacctattcagaacacaacttaggcctaaggccattgcctacaaccttccaactcaacaaaaacaagcatcaattcaaggataaaatgcctcaaggatttgagcaagaatgtacaaatggagcattaaaatataccaatggaaacctagagagccaaagaatgaggtacttacttgttgggggtcaataa

SEQ ID NO: 33926 - DNA, 393 bp, Glycine max
  Peptide Sequence Number=SeqID_150704
atgcagggggaaattaatatccaccaattttttactggctatacaaatggtcgtagggattggcttgcttggccacagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtatgcaatatttgcttatttctttcctgggctgttattttcaaggatttcttctaa

SEQ ID NO: 33927 - DNA, 579 bp, Glycine max
  Peptide Sequence Number=SeqID_150705
atgaatactgactgtttaggtaggcggttgggaccgaggcttcttgggaaggttgatgattcaggggtaaataacagatttacatacaaaactacttcataccaggatcctgttgtagagattaactatgaacgtgctgatataatcatcttgaaattgaagatgaccatagcaagtttgagccctgattgtcttctccagcaaagctcaactgtagaagattcaatttcattcaaattttctgatggtataactgaatcagttccatgctcatacactgaatttgccgagcgactggtgctgcggcagtataaaaatttacctgacacagaggttaaagagttccatagaagagatggtttcgaggtagcaagtgctgacaagatggctaagtcatgcatgatatcgatagtattaggtggcctggttctgaatggagatgtctcaagaactaccaggaggattgttgttgttgaagatgacaagagagctgaaagaggaatgccgagcttcaattctgagttacccaattccaattcatgggttgaggatgttacaagagtttgggatccttgctga

SEQ ID NO: 33928 - DNA, 891 bp, Glycine max
  Peptide Sequence Number=SeqID_150706
atggatggcattacccacatgaagaatggagcacatgggtccatcaaaatccaacacaagtatgaagatgtgtggatgaaagctgggatagaccaagcaatcaaagctttaacttttcaaatccgtaggaatgatgagttgatcattgagcttgcacaaaggtggtgctcaaagaccaatgcgtttgtgtttccatggggagaagcaactataatattggaggaaatgaaggtttgttggcggtattttgttaagggagcacctatttctagccctcttgtgagtaatgcggaaaaggaaatagaacaagaacttatccgtgcttttaggatgtttttcaaatctaaggccaaaagggctgatcataatccacggatgaagcacttcatgagtaatgagagcctagtggagcatgaggccatcttgtcgttgtggttgtcgagagctggaaatggatacatttggcgcccatatgataattctccagctctccagctttacaatgaaaatgacaagtggtcagccagtaatggatacaaatttgtacactgcattatgtgcctgcattatgtggaagcaatcaaatccaaggaaagagacatgcatgatcattattttgaaaggagctcagaacatttgttaccgacatcatcatctgtgaagaaagagagcggaggattttatggcccaccacctagttttacttccaagattaacacagaacaagaggattttgatgaagagggaaaagtgtcaattattcaattatctgattcttctgatgagttagatgtcttggtgaggaagaagttggaaatggcaaggctttgtctagtcctctattggatgtttttccatcagcaagtgttgaaggagcaatacgtgtgttag

SEQ ID NO: 33929 - DNA, 1299 bp, Glycine max
  Peptide Sequence Number=SeqID_150707
atgccgaaagggaggagcaaaaggatcatttcagggagttttctggaccctgactcgcctaggcccccaaatagcttaggggtgaagctaagtaatgggttccaaggtccaacattgagagaaatcagagagaagaagaagaaagaagagaaaaacgaggctaaggcgctaccgaattgcgaccgtaatcgacttctacgtcgttcttcgttctccatccatggcaagcgaaatctcataacaaatgagctagcaaagcttgggaaaggaaacattacctctaagatatttccatatcgtgagctatgtgttgcaactcagaactttaaccctgccaatatgattggtgaaggaggctttgggagggttgttgctgtgaagcaacttgacaggaatggatttcaagggaacagagaatttcttgtagaggttttgattttgagtcttttgcaccaccctaaccttgtcaacttggtagggtattgtgctgaaggtgaacataggattttggtgtatgaatatatgatcaatggctctttagaagatcacttacttgaaataactccggatagaaaacctttggactggcagactagaatgaaaattgcagaaggtgcagcaaaaggacttgaatgtttgcatgaacaagcaaacccaccagtgatataccgcgatttcaaagcatcaaacatactgctagatgaaaacttcaatccaaagctctctgattttggacttgcaaagcttggtccaactggagacaaaacacatgtgtccacaagagtgatgggaacatatggctattgtgctcccgagtatgcatcaaccgggcaattgacttcaaaatcagatgtgtacagttttggagtagtgtttttggagatgatcactggaagaagagtaattgataatgcaagaccatcagaagagcaaaacttagtcctttgggcacaaccacttctaagagatagaatgaagtttacacaaatggcagatccattgctagaagataactaccccataaagagtctataccaagctctagcagtagcagcaatgtgtctccaagaggaagctgatactcgacctttgatcagtgatgtagttacagccattgagtttttagcaaggaagaaagtagaagtggatgaaccacgacatacaaaagaaacttcttccactcaagatggagatagtagtgaacacaatgaatctgatgaagaatctgatggcgaggaagacgatgagaatgaagatgaggagaaggataagaacgttgaaatcaacaaaaaagaatga

SEQ ID NO: 33930 - DNA, 462 bp, Glycine max
  Peptide Sequence Number=SeqID_150708
atggatagggatacactagggtatagtaggcgaagaggagtgaagggctcacccttacaaccaacaactttaaggttcaggagatgtagaggaagtcgcaccctctgcgagcttggcatagtagatagacaaaaagagtatggtcgtgttgggatacacatacgtcactttacacgtatcacactctggtgcacatggtgccaacagatagaacaaatgctacgcccatcaccatcaaacactctagatactgctacattcctcggagatttatgtcttgtctgcaactggagtggtttgaagacattaattttttatctaggcatgaaagtgtctcacgatactcaagaattcataatgaccccagactgggaagatcaccctgatatgacacctgaggacgaggaagagtatcgtgaacttctacaagacttggagccttcgtttgagagggaggattga

SEQ ID NO: 33931 - DNA, 1467 bp, Glycine max
  Peptide Sequence Number=SeqID_150709
atggagccatcagaggacaccatcattgaaatcaaagaagaacaactcatggtttctccattatccgaagctgggatagaccaagcaatcaaagcttcaacttttcaaatccgtaggaatgatgagttgattcttgagcctgcacaaaggtggtgttcaaagaccaacacgtttgtgtttccttgcggagaagcaaccataacattggaggatatgaagggcagatcatacgccacggatgaacatttcatgagtaacgagagccgagtggagcacgaggggttcttgtctttgtggttgtcgaggtttgtttttcctcctaaatcatacaacgccatttcgaaaaatgttttccctattgcggtacatctagctagagggagtaaaatcgctcttgcaccagctgttttagcaggcatttatagggatttgagattgttgaacaacaagatcagaacagccacaaaagtggaggttggagttaaattatggactccatttcagttggcccaagtttgggctttggagagatttccattgcttcactcgcgtcttcctcatggaattcgacaaggcaaactcatggtggctaaatggcacaaggtgaaaatgttgaaacatgacagcttcaaattgattttggattctcttagagctagaaatggttttatatggcgtccatataagaattctccgccccttgagctttacaatgaaaaagacatgtgggcgtgcaataatccaaattattttgatgaattagaatcctttgctcgctgcttgagggtctcggttggtatggagtgtgtagaacagtatggtgcaaatcgcattgctatgcagttcgggatggatcaggatattcctgataaaaatttgtacactgcattacgtgcttggcatgcttcccgtgcttgccatcagccaaatgttacctctgggtactatcattggtggaatcaatcaaatccaagtaaggaagaagacatacatgatggatgtgttgtaagtagttcagaacatttgttacaaacattatcatctgggaagaaagagggtggaggatctgatgatccaccacctgattttacttccaagtttaagagagagcaagaagaaaattttgatgaagtgggaaagttgtcgattattattttatccagcgattcctatctttctagtgatgctagatgttttggtgaagatgttggaaatggcgaggcttcgtctatagtcctctatatgttgtttcaccatcatcaagggttgaaggagcaaggagtgtcaatggcaatgacaatggaggacaaggaaggggaagatgccagccatcgtatagttggcatagcttctaattttgaaagtcggattgagaagcttgaaagagtgattgctaagcttgaagcagcaaaaaatggccaaagagttcaaaatactggagtcaaagcaaagccaagtgctccttaa

SEQ ID NO: 33932 - DNA, 225 bp, Glycine max
  Peptide Sequence Number=SeqID_150710
atgtcggctgaaagagatcagtcaggcgcatcacatatcgagacgctcgaagtagaacaacggatgctctcgagtaattcaaatggtcataacttttcactcggatgtccgattcagacgcttcatatatcgagatgctcgaaattgaacaacgaaagctatgaagaaattcaaatagtcataacttttcactcggatttccgattcaggtgtatcacagattga

SEQ ID NO: 33933 - DNA, 237 bp, Glycine max
  Peptide Sequence Number=SeqID_150711
atgaagagtgtgaatttcagagagcatagagtagagcaaggggacaagatttcatcttttagggagattaatgagtttttgagtgattgtgagattcctagaggtggaggagacatccccactcctttggactttagcattgggaaatgcactgtttccttagaacatgatagaacagggactgcattgctagggatagtgtgcagggttttatgctgtgagtataatactatttaa

SEQ ID NO: 33934 - DNA, 288 bp, Glycine max
  Peptide Sequence Number=SeqID_150712
atgaaatttccgcatgtaaatgactttgttgttcccggaggaacaaaaggtgcagaagactgtgtcagcccctgcatgctatcaagcgttctgtcatcgggacagcaaaagactctggatgatacaagggtgcgaataaccgtaagaatgaccaaacttggtctctgcttgtcatcgggcccgccgcctctggatgacaaaagggtgcgaataaccgtaagaatgaccaaacttggtctctgcttgtcatcgggcccgccgcctctggatgacaaaaggtgcggataa

SEQ ID NO: 33935 - DNA, 597 bp, Glycine max
  Peptide Sequence Number=SeqID_150713
atgcctcgccttcgtagggctacacgtcctcgccatcagaggactgcatgtcctcaccttcagagggctactagttaccctcaccatcagaggactatacgtcctcaccttgagaggactacacgtcctcaccatcagagggtttcactccctcacctccagaggactacatgtcctcgccttgagagggctacacgccctcaccttggggctacacgccctcaccattgggtactagttaccctcactgtcagaggactacgcgtcctcaccttgagaggactacacgtcctcaccatcagagggctgcacgccctcacctctagaggactacatgtccttgccttgagaaagctacacgccctcaccttgggtactagttaccctcactgtcagaggactacgcgtcctcaccttgagaggactacacgtcctcgccatcagagggctgcacgccctcaccttcagagggctacacgccctcgccatcagagggctgcacgccctcacctccagaggactacacctcctcaccttgagagggctacgtgtcctcattttcagtgtgctccacatccgcaccttaagagaatttaa

SEQ ID NO: 33936 - DNA, 285 bp, Glycine max
  Peptide Sequence Number=SeqID_150714
atggccacctcaaacactcctgctactgagattatcccaaccatggaaatctccaccatcctcatagacaatgagtcatccattcataaaaagatagcatccaaggttttgggaatcaaggttgtgttgtccagtgacattattgccaaggcaacaacatgtctatggaaagcagtacctattaggagggataggagaagagttatgtttcctatgttacaagggcactttaccgggagaatgctaaaaagattggtgatcagaaaaccattatgtacaaactga

SEQ ID NO: 33937 - DNA, 513 bp, Glycine max
  Peptide Sequence Number=SeqID_150715
atgccactctgccatggcacttggcaaaaactcaaccatggtattcaacacaaaaagatgcagagagagacacaatcgcaaaaaataagtagaaaaatacctatcatagtggcaagggcacggtggcgagggcacaatggcgataaggttgtagagagagacagagccacgaagacggagctaagatggagaagaggcaaaaccgcgaagacggagctgagtcaaagaagaagagagcgtaatgaaaataaaatgatgtacaagcataccaaacaaaaagtggcaacaagaaagaagaatgaaggaaaagtggaaaacatacaaatccagaacattgccaatcaaagacagctagtagaaaaaattaacgaagaaagaaaaacattgctaataaacagcttgctattgcttcatctattgaggttgatattaattcaggatcaacaggagagaacatggcattttttagggcttatactctccgaacagtttttctattttcttaaattttaa

SEQ ID NO: 33938 - DNA, 207 bp, Glycine max
  Peptide Sequence Number=SeqID_150716
atggaagatattcatatactcattgaacagttgattttagaaagaagagtggtattcaattaccagggctgggtacaaagcttaaacaaatctcctataccattcaaaaatccattgtatatcgtcgtgggtagaccaattgagctagagaaaaatccagaaccaacaatggagcaggttgccaatcagtttgttgaagcactttaa

SEQ ID NO: 33939 - DNA, 204 bp, Glycine max
  Peptide Sequence Number=SeqID_150717
atgattgttggtatgacggtgaaagtcattataagattgttaagcgcaaaagcaagagtttatatccacaaagaagcattgttgaaagatgaaaagagtggagatgaacaacgattggatcaaggtgaagccaacaatgacaacaggttgaacgaccaaagtgaggatggcggtgtgctcaacgacgtgggttggggtcaatga

SEQ ID NO: 33940 - DNA, 507 bp, Glycine max
  Peptide Sequence Number=SeqID_150718
atgtccaaatcttgtggatttgggatgaccggccctctcgatgagtcgatctcttgctttctcataagggtggacccttgggtacttgtacctatcgcctttagaggaatacacatcctcgccttcagaggactgcacgtcctcaccttgagaggactacacgtcctcgccttgagaggactacacgtcctcaccatcagagggctgcacgccctcacctccagaggactacacgccctcgccttgagagggctacccgccctcgccttggggctacacgccctcgccatcagaggactgcatgtcctcaccttcgtagggctacacgcgctcacctttagagaacctcaccatcaccttgagaggactacacgtcctcgccaacagagggctgcatgccttcaccttgagaggactacacgtcctcgccatcagagggctgcacgccctcacctccagaggactacacatcctcgcctagagagggctgcacgccctcacctttag

SEQ ID NO: 33941 - DNA, 162 bp, Glycine max
  Peptide Sequence Number=SeqID_150719
atgatattaaagagtatttacatcaaggctcagcagaaattcccaaccaagaacttagccttccatcgcaaggcagcacctttcagttacaataggaggttttggaagaaaaattcaaattacacaatggtagggatgtctcctccacctcttggaacctag

SEQ ID NO: 33942 - DNA, 273 bp, Glycine max
  Peptide Sequence Number=SeqID_150720
atgtctcagaaaaactatgatctcgaactcattcaccgttggattgtcgtgaaatttaagcaccaagttcacaacccaattgcgagaattcccaccgttgggaatgtcaaaagcatgtctgatcttagaggaaaacccttcgcattggagaaaaatgaatcgcatgaagacagtacaagtggaggcttcaatctcttctccgtctctctgacgttcgagaattctatcggagcagtcagaggaaaaactggaggaatctcagggaaccgctag

SEQ ID NO: 33943 - DNA, 387 bp, Glycine max
  Peptide Sequence Number=SeqID_150721
atgacaaccaaaagaaatcaaagaagatcaaacttaaatccaaagaagaaaggagaagatttctcattagttccaaaatgctacgaatgcgatcaatctgggcacttgagatttgattgtcctgtctttaaaagaagaatgaaaaaatccgacaagaaaaatttcaaagataagaaagaaaagaaagcatatatcacttgggatgataatgacatggattcatcaagtgattcagaaaatgaaatcataaatctgggcctcatggccaaagactatgaaagcgaagaagaggtaacgtcttctaactatgacttatttatttcttttgatgaactccaagatgaattcaatgattttcataaagaatcatcaaacttgccaaattag

SEQ ID NO: 33944 - DNA, 366 bp, Glycine max
  Peptide Sequence Number=SeqID_150722
atggatccaacaaaaaggcttaggaagacgatcaacaaattgaaaggacaaggtaggcagaggatgaagtcagaactgaccagtgaaagtacaagcacttacgaggaaggaaggtgtagcaagcctgctgctgaacatcaatatggatttcctttgagaagatggcgatctccagccaggaataattctcaatctctttctcaacaaggatgtcccaacggcataacccagctgagggacagaaaacgggaggcggcatcgatgctgaaaattgcaaaagatgtgggtgtgtcattccaagggagtgatgatgcggttatacgaaggttcttggagccagagcagaaggacaaggaattactatag

SEQ ID NO: 33945 - DNA, 1257 bp, Glycine max
  Peptide Sequence Number=SeqID_150723
gcacggcgagcagagtattacgactttttcgcttacggtacggcagcggtactgttctttggccatctgttctttcccagccacgatccgctggtcagcacacttgctgccttcgccacttatgcggttggcttcctcgcacgtcctattggcggcatggtgtttgggcacatcggcgacaaagtgggacgcaaaaaggcgctggtggcgaccatcctgatcgtgggccttggcacgttctgcattggcctgttgccaacttacgaaaaaattggcgtctgggccccggtattactgattgccatccgcttgctgcaggggtttggcgtcggcggcgaacaggcgggcgcggtattaatgacggccgaatatgcgcagccttcccggcgcggtttctttgccagctgggtgcagattggcgccccggtcgggttcctgctgccgctggcgctgttcgctgtgcttaatgccgcgctgagcgcggagcagatgatggactggggctggcgcgtgccttttctgctcagcgcgctgctggtgattgtcggcctgtttattcgcctgcgcattgatgaatcgccggtcttcgccgccattcgtgaaaccaaagcggcagaatccaggccgttaaaagaggtgctgcgtggtaatccgcggctggtggtcaacggcgtggcagcgaaactgatcgaagcctgcgccttcgccctgtttaccgtcatcatccttgcctggggtaaggctaatcagcttgatgccggcattttgatgaacagtatgatcgtcgcggtgatcctcgaagtactggcgatcccgctgatgggtgccctttccgaccgcatcggtcgcaagccggtttacctgatcggcacgctgctgatcatgctctcgatcgtgccattttttctcgcgctggcgcacaacagctactggctcacgcagctggcgatgatcgtggcgctgacgctgggtcacagcatgtgttatgccccacaggcgtcatggttccccgaactgtttcccacgcacattcgctgcagcggtatcgcggtgatctggcagatcggttcgctgatcggcagcggcgtactcggactggtggcggtgaagattctgcaggtgacccacggccactggtatggtctggcgctgtatgttgcagtgctgggggtgatttcattgttcggcctgctgcgtctgccggaaacggcgccagcccgccgccagggtgaatatcacccgtggcagcagcattaa

SEQ ID NO: 33946 - DNA, 976 bp, Glycine max
  Peptide Sequence Number=SeqID_150724
atggtcgcgaaaggcaagctcagcttgctgactatgatgctgatcttggccggctgcaccgttggtcccgattaccgggccaagcatgacgagccgctgatactatcgcagcctttagatcaaaagctttacagcaatgaaagattgcaacgtgaatggtggcgccagttccaggatcctcaactcaatcaggctatcgatcttgcattacgtaacaatcaggatattcaaatagcgcaagcgaggctgttggaggcccgagccgcgttggatgaaaggcagcttgataggttgccaagtatcaccagcggcatgtcgtatacgcgtagcctctctcaggaaaatccgggcgttgccggggagcctaacgtggcgaaaaactaccgtggcgcgttggacatgcaatgggaagtcgatttgtttggtcggttgcagcggatctctgaagcggcaatggcgcgcagccaggccagcgaagacgaccttgcgcaggtgcaaatcatcgtcactgccgacgtggcacgtaactattttcaaatgcgtggtgcgcaaaaaaaactggagatcgcccatgagcatttaaccaatcaacaacaaacggtgcgagtggttgaagcgatggttgccgctgggcgcgggcaagaagatgaactcgcgagcgcaagggctgaacgtgctcgcgtcgaggctagcttggcgccgatgacagagcaatattatcttgcgcgttataaattagccgtattgatggggttacgcccgaacgacgttgagcaaatcataccgaaaacgccattgccgacgttgagcgttcgtttacctatcggcgacgtgggcgagctgttacgccagcgcccggacgtagccagcgcggagcgttcgttggcggcttcaacggcggatgttggcgcagcgaccgccgacctgtatccgcgcattaatctgggcggatttatcgggtttgtcgctattcgag

SEQ ID NO: 33947 - DNA, 276 bp, Glycine max
  Peptide Sequence Number=SeqID_150725
atggggccgaaatctatcctaaggttcatgagaaccctagggccttctcctgtatctctggatcaatcttcttggaatcttctatccaatgcccttggggggggacagatgtcgtacaggatgtcacgacatcacgcttcagaacatgcagattatatgtgtccgtatgaacagattaaacaagtaaataacacaagagaattgtttacccagttcggtgctacctcacctacatctgggggctaccaagccagggaggaaatccactctcaatag

SEQ ID NO: 33948 - DNA, 396 bp, Glycine max
  Peptide Sequence Number=SeqID_150726
atgttgagtcagcatcccaatatgttaaactacactgactctgtgatgaaaagagaatctcctctatccctgcactataaactgtttgaggggacacatgtcccagacattgtctcgacatcagggaaagctgctgcttcaggtgctgtgtccaaggatgccttgattactgaactcaaggacacatgcaaggtgctggaagcaaccatcaaagccaacacagagaagaagatggagctggaacggctgatcaaaaggctctcagaaagtggcattgatggtgaagcagctgaggaagatggtgaagcagctgaagtagaagaagaagctgctgaggaagaggaagatgcagcagaagagacagaatcagatgatgattctgaagccaccccatga

SEQ ID NO: 33949 - DNA, 420 bp, Glycine max
  Peptide Sequence Number=SeqID_150727
cctgccccccctggaaacgggctcaacccggagggtagggtccagcggctggaagagcacccgcacgtcgcgtggtgtcccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 33950 - DNA, 143 bp, Glycine max
  Peptide Sequence Number=SeqID_150728
atgggtcataagcaccgctctaacctttttgtggatgagctgaggctgctgtggtgtttcgccctgcgcttgcctggggacgtagtacttcttgatgaaagctcgatcagtagggggcttgatgaccttgctgggggcgacag

SEQ ID NO: 33951 - DNA, 171 bp, Glycine max
  Peptide Sequence Number=SeqID_150729
atggctcaagacgaggagaattccacagatcagatcccagagccatccccagtacccgtacctgatgatgccataccatctgcactagcatatgagctagagcagcctatccctcaggattcaccagctactcagtggattgttttgcatgaaatgagtgtctatgaatga

SEQ ID NO: 33952 - DNA, 546 bp, Glycine max
  Peptide Sequence Number=SeqID_150730
atggaagggttagtggacctagcagcgattgacgctttcctcgcctttcatcatggcaaggaaagcccggtcgtcgccattttggccatgtatgacacgttcgaccggggatgtgaaaagagcggcgcaagaattgtaggaagaattaggattctatcttcattcgaaggatgtcccatgagaggaacgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagctttggaagaaagtgatgaggtacaagccctaaaggcagagcttgaaagagcctgggtagtcgaagagaagttcaagtccatagccatcaaaggcagcaattccgaagaggtgaaaggaatcatcacgggtcaaaggcatgatcttgaaggacgagctaaaggttttccttag

SEQ ID NO: 33953 - DNA, 166 bp, Glycine max
  Peptide Sequence Number=SeqID_150731
gcaactgagacatgagatcgtctatcccgatggttatatgctatttttcaaaggaggtcgtcatggcaacattttgtctattagtggttcatttgccatgacaaaagatataaggatttggttaggcatgttctgtattggttgggcaatagaaattgccaagtaa

SEQ ID NO: 33954 - DNA, 714 bp, Glycine max
  Peptide Sequence Number=SeqID_150732
atgggaagaccaagcttgaggttacctctccttccaattccaacttcaactctcataaccctaaatcagatacttcttaagcacgttgcaagaattagaatcttcagagacatggcaattgggttcatggaggtgcagcttgtgaaagcaaaaggcctgcgagacactgatatctttggtaaaatggatccctatgttctgatacaatacaaaggccaagagaagaggagtggtgtcgctaatggcaaaggcaaaaatccggtatggaatgagaaatttatcttcaaagtagaatatcctggatcaagcaatcaacacaagctcatcctcaaaattatggataaagacttatatacagacgacttcgtcggagaagcaataatccatgtaggggatttattggcccaaggagtagagaacggaggagccaaattacagactctcaagtatagagtggttcgtgctaacaagtcttattgtggtgaaattgatgttggtgttacttttacccgaaaggtggaagacaaatttgtggaagaagacataggaggatggaaagaaactgagaatatagcagcttccatgagtgtttgtcaaggtgtgtggcttgacactttgatgcaggagctgcaattgaagcaagctggacttgtgaaactgttagtggataataagtctataatcagtggtggatccaagatcctaaataagtag

SEQ ID NO: 33955 - DNA, 213 bp, Glycine max
  Peptide Sequence Number=SeqID_150733
atggaataccctggatcaggtgatcaatacaagctcaacctaagaatcatggacaaggacgtattttctgcaaatgactttgttggccaggctacaatctatgtgaaggatatattggcagaaggagcagctgagcttcgtcctcacaagtatagcgtggaagaggaatatattgaagatgatgttggagcatggaaggaaagttgcttttag

SEQ ID NO: 33956 - DNA, 888 bp, Glycine max
  Peptide Sequence Number=SeqID_150734
atgggatgcggcggaacagtccagcatactacagtcctccgcggcgaggatacggtggcggtggccgaggaggagggtccggcaggaggggattcggtggaggcaggcgcagggacagcaatgggagcctcttggcgtcgtgaggaggtttttttagtttgtggttgtgggagctttgtgctcaagtgcttcttagaacctcgaggctttgcatttgtgcagtttgtggatccttatgatgcctcagaggcacagtaccatatgaacagacagatttttgctggaagggaaatatctgtagttgtggctgaagagacaagaaaaagaccagaggagatgcgccacaggactagtaggttcagaggaccagcaagctatggaggccgaaggtcttctcattacggtaatgtcaattttaaaatatataaccgtgagttgaagactgtccttactcaagtgctggatcccatcaatgattgctatgacggggatccagacatggctaacttgccaaggtcctattctcctgctccaagacgacaaagcgattactctgtttcccctgggaggcaagctgagcaccccagatcaccaagaggtcctcccagggagaaggatggtgatcaaaagcgtaggtcttattctcctgcttatggcaatggaaatctatgtacaagtctgaggctgatgctgatcgtagccagtggaagtcatcgagatcaccccctggatctagatcaagatctgctgaattgtcaccaaggcgtggaagatgaggttgcaggtagctggcaatgtgctgctggggcttctgtacatttcctgcaacttatcgcaacatttgcaaaatcctgtattttgcttgaagtttgcgaatatgatggatga

SEQ ID NO: 33957 - DNA, 987 bp, Glycine max
  Peptide Sequence Number=SeqID_150735
ttgttgttgaagttggaggacaatagattggttgaaactgttggcataccggttatggttgataaaggcctgactcgcctcacagcatgtgtttcatctcaggttggttgccctttacgctgctctttttgtgccactggaaaaggggggttttcaaggaatcttcagagacatgaaatcattgaacaggtcttggccattgaggaggtcttcaagaatagggtgacaaatgtagtgtttatgggaatgggtgaaccaatgttaaacctgaaggcagtacttgaagcacaccgttgcttgaataaggatgtacaaattgggcaaagaatgataaccatctccactgtgggcgttccaaatacaataaagaaacttgcttctcacaaacttcaatccactctagctgtgagcctacatgctcctaaccagaaacttagggagacaattgttccaagtgcaaaatcctatccactggatgcacttatgagtgattgcagagaatactttcagcaaactagtaggcgggtttcctttgaatatgcacttttagctggagtcaatgactcggtagaccatgcattagaacttgctgagttacttcatcgatcgggcagtggatatcacgtcaacttgatacctttcaatccaatagaaggctctgagtatcagcgtccttccaagagagcagtgctaacattttctggtgctttggagtcctctaaaataactgttagtgtacgtcaaacaagaggactggatgcaaatgcagcttgtggtcagctacggaacaagttccagaaaactcctttagtcactgacccttttgatcttgcagtcaccgacacttctatgccatacaataacaattttgcagtgtttgctgttgctgtatcagttgtaatatcaacttgtcatctgagaaattgtggacagacacctaattgcttgttggcgattctgctggagcatgctgacctgggatattag

SEQ ID NO: 33958 - DNA, 3219 bp, Glycine max
  Peptide Sequence Number=SeqID_150736
atgatgttcccgcaattcggagcaacggcggaatccctgagcaaggcgtcgacggcggtgttccggatcggcaccgacgcgcacctctacgacgatcccgaagacgtcaacatcgcccctctcctcgacagcaagttcgattccgagaagtgcgaagctctcaagcgccttctcgctctcatcgctcagggcttcgacgtctccaacttcttccctcaggttgttaaaaatgttgcgtctcagtccttggaagtgaagaagctggtctacttgtaccttctgcattacgctgaaaagcgtccgaatgaggcgttgttgtcgattaattacttccagaaggacctcggggacacaaatccgttggtgagggcatgggcgctccgtgccatggctgggatccgccttcatgtaattgcgcctcttgttattgttgctgtgcaaaaatgtgcgagagatccttctgtctatgttagaaagtgtgcagctaatgctcttcccaagcttcatgatttgcggatggaggaacatgcttctgcaatcgaagagattgtgggactacttttaaatgaccattccccaggagttgttggagctgctgcatctgcatttacttcagtttgccctaacaatttttcattgattggaagaaattacagacggttgtgtgagattcttcctgatgtggaagagtggggtcaaataattctaattgggatccttctgcggtatgtaatagcgaggcacgggcttgtcaaagaatccatcatgttttctttgtacaataaagacattgacaatttagaggaagacgagtcctacattacttcaaaagaagatgctggctattccattgataagactgtatctgaattagccactatggtcttccagtgttacattgaagggccagatgagtacttatcacgctcaagttctacaaatagggttgctcctaaattagatgtatcacaatatacatcttgcagtaatgatgttgtgaagatcctgctgcactgtacatcaccgttgctatggagtaataacagtgcagttgttcttgcagctgctggtgtacactggataatggcttctaaggagcacatcaaaagaattgttaaaccactcttgtttgtcctgcgatcatcgtctgcctcaagatatgtgaaattcggaattgatggtttcacttttactcggaaattttattcagttgtgaaaaagattattaggagagatgaggtattgtgcaatatacaagtgtttgcaaaagcaatcccatctctctttgctccacactaccaagattttttcatatgctcttcagattcctatcagataaaggcgctgaagctagatgtactttcttctattgccacggattcatccatttcattcatttataaagagtttcaggattatatcagagatccaaataggagatttgctgctgacacagttgctgcccttggtctatgtgctcagcgacttccgaaaatggcaacttcatgcgtggaaggattgttgactctggttagacaagaatttttttgtggtgaaattagatccttggatggagaagagggtgtgctaactcaggcaattatatccatcaaatcaattataaaattagaaccatccagttatgagaaggttataattcagttagtctgtagcttggataaaatcaaggttccagctgcccgtgcaatgattatttggatattgggggagtattgttctttgggtgacataattccaaggatgttgagtacagtacttaagtatcttgcccggtgttttacttcagaagcattagaagctaagcttcagtttcttaataccactgcaaaggtcttactgtgcattaagggagaagatattttgaccgtgagaaaagtttggagttatgtaattgaattggccgagcgtgaccttaactatgatattcgtgatcgttcacgtttcttaaagaaacttctctctagtaatttggagtctcaacatggggaagaagaaaatagtgaatcacaaaaaagagaccaatcctatatacttgcagaatgcatatttggtggacagacaaaagccatgacagttccatctgaacccattgattaccggttttaccttcccgggtctctttcacagttagtattccatgcagctccaggctatgagcctctcccaaaaccttgtagcctgccatacactgatcttgatcagtatgatggagctgctaagagtgattcagatgaggaggatgatactggcacatctgggtctttggatgagggaagtgcttctgattatagttctgaacagtctattactgcttcaggcgaagccagtggcagtgatgaatctgtttctggcaatgaaggagaagataatgctgatccattgattcagatttcagacactggcaatgtctgtgaatatcagaacagtggggctccctctggcacagctggttttcgggacttgatgtcaacgaagtctcttgagtcttggttagatgaaccggccaggtcatctaaaggaagtgagatagagcaaagtcaagttcgtagatcatcagcaagaataaccattggaaatattggaaaccgggttaaacctaaatgctacactctcttagatcctgtaaatggaaatgggttaaaggtgaattattcattttcatctgagacttcaagcatatcctctcaccttgtatgtttggaagtattatttgaaaattgttctctggagcccatgttcgatatagtcttaatagaagaagattatagcaaaagctctgattctactgatcgaacatcatcaccaactgaaaataccttaaaatttcatgtcaataaaccagcactggtttccatggaggagattccttctctggagcctggtgagacagcaaaccggactctgcttgttcgtttccatcaccaccttttgccactgcatctggctttattttgcaatgacaagaaattccctgtcaagttaaagcctgacataggatactttataaaaccccttcccctcagtattgaagatttcagagataaggaatctcgccttccagggatgtttgaatatgtgagaaggattaagcatcagtcaaattcttatgaaatgccattcatatccgtattcaagatgagggtgtgtcagggaggaaaattaaaatttgaacttcaaagaataggaagcttcttataa

SEQ ID NO: 33959 - DNA, 2235 bp, Glycine max
  Peptide Sequence Number=SeqID_150737
atgaagatatctgataaagtaacatggcaacagtcagcactcagcgctaacattattttttgtctttcaggtgccaaattattaagcccaggagaaaccgtaatgcctcactgttctaataaggatactgatataagtgcatctcaaataagttggtggtatgttgatacatcttacgaagaactcaaaaagggaagccacagtgtgaaaacctcggacgtgactttcatctgtccatactgccctaggagaaaacaggattatttgtacagggaactcctagaacatgcttatatggtgggtcggagtagttctgaaaagagaagtgcgagagagagggccaatcatcttgctttagtgaaatatttggaaaatgatcttattattattatggatggcccgtcagaacctgtggataaaggtactaaattaagcctaggacaaactgtagtggctcaatgctctaacaaggagactggtatgagtgcatctccaataaattggtggtatgtagagaaattttacaaagaactcaaaaagggaaatcacatggtgcaaacctcagatctgactctctgttgtccatactgccctaaaaaaagaaaacaggattatgtgtacagggaacttcttgagcatgcttctggggtgggccagagtagttcagaaaagagacatgtcagagagaaggccactcatctggctttaatgaaatatttgaaaaatgatctcaagtatttgaatgatccatcaaaatctgtgaatgaaggtaacccccccgttaacagggtgcatcagattagttcacaagagagaagtgtcagagaagacgctactcatctgccttcagcgaaatacttcaaaaaggatcttacaaatgtgagtgatccatcatcaaaacctgtaaatgaaggaaccataacaggaagcccaggagaaactgtaattggttgctgctctaacaaagatagtaatataagttcatctcaaattgggcggtatgcagaaaaattttatgaagaactcaaaagggggatacacaatgtgaaaacctcagatgagactttcaggtgcccatactgctctaataaaaagataaatcgggattatgtttacagggaaatccttgaacatgcttcaggggtgggtcagagtaaatctcaaaaaagaagtttcatcgaaaaggccaatcatctggctttagtaaaatatttgaaaaaggatcttatgaatgtgggtgctccgtgtccatcaaaacctatggatcaaggtaccaaaacaataagcccaggagaaactgtaatgggtcactactctcataatgacaataatataagggcatctcaaataagtgggtggtatgtacataaatcctatgaagcactcaaaaagggaagccacaatgtgaaaacctcagaaatgactttctcttgtccatactgccccaataagaagagaaaacgggattatgtgtacagggaaatccttgaacatgcttctggggtgggtcagagtagctcagaaaagagaagtgccattgaaaaggctaatcatcttgctttaatgaaatatttggaaaaggatcttatgattgtggatggtccaccaaaaactgcagatgaaggcagtcctcctttcaattttgagaagcagtttgtgtggccatggactgggatcgtggttaatattcctactagactgacagaagagggatgttgtgttggggaaagtggttccaagctgagggatgaataccgaagtaggggatttaatccacaaagagtccgcattctttcaaatttctgtggtcattctggaactgcagttgtggaattcaataaaaattggacaggcttagataatgctttagcatttgaaagagcatatgaattagatcatcatgggaaaaaagactggtttgctaatacagagcataagtctggtatttatgcatggattgctcgagctgacgactacaaggtaaacaatatcattggggaacaactgcagaagatgggggatatcaaaacaatatctgaacttatggaagaagaagctcgaatgcaggataaacttttgtccagcttgaataatactcttcaggtcaagaagaagcgattaaaggagatggaagtaaaatattatgagacttcacatcgtatggacattgtaatgggggaaatagataagctcactcaaggtcacaatcaagtcgtaaaaggacctagtctatga

SEQ ID NO: 33960 - DNA, 267 bp, Glycine max
  Peptide Sequence Number=SeqID_150738
atgtgcagggtgccttgccgtaagcagggagggatgaggttcacgatcaacggcttccgttacttcaacctggttttgatcaccaacgtcgcgggcgcaggggatatcgtgaggacgagcgtgaaagggtcaaagactgggtggatgagcatgagccgcaactggggtcagaactggcagtcaaacgctgttctggttgttttgaatttaccttgggatgtggatataagggaaaccgcgagagagaaaataatggtgggaaagtaa

SEQ ID NO: 33961 - DNA, 663 bp, Glycine max
  Peptide Sequence Number=SeqID_150739
atgaggacaaatagagtttcaacgcgaaataataaaaagatgaatctgaattttggttggtttccagagtcgtgcaattacgcgccaaaagacggggacgatgccggcgcggtactgagcgattttgaggaacatgggcatggccaggtcgaagtggggccggggaggattgcaccaccctccattgtcgttcggaagggcgtagtttggggggcagaagtttgtggcggttacgaatatggaggggctgccagcgtggcaccagctggggtcgttcgcgcactttatctcgaagcaggcaccgcagctcagcccgttgttgaacagcgccgtgctcagcgccgccgtgttcacgccgtacccctggctgtacaggttcccgtacccgcacgcgccgcccattgtccccgacgcgtcgctgccgccgtagaacgtggcgtgcgcggtctcccacgcgccgccgctgtacacgcccgggaccctggcctcggtggaagccagaagggttataagggtcacaatgccgatgtaagaaaggttaaccaaagccatgctgagcgagaacacggaactcaactcagctcaggggtttgcgttctgagcagggaagagagaaaggggacaaaagaagttagggaccttagggcctcaaaattgatataa

SEQ ID NO: 33962 - DNA, 786 bp, Glycine max
  Peptide Sequence Number=SeqID_150740
atggctgttctggagcaacaaaaagctggtgaaaatgttttgaaactggctgcagatcaaaaggatagctggttgttaatgctatttgacaatctatttatccagcggcaaaaagaacaatttcatgctaaaatcatcctgcttgaaagacaactggaagtgaaacaaaaactagaattggagattcaacaactgaaaggaaaattaaatgtcatggcgtacatagaagatgatggggacacagaagttctgaataaggtggatgctttacataaggatttaagagaaaaggaacagtcactgcgagacttggattccctgaaccaaacactgattattaaagagcgtcagagcaatgatgagctacaggaagctcgaaaagaattgattaatggcattaaagagatatcttgtcgtgctaatgttggtgtaaagagaatgggggagcttgatattagaccattccttgaagctatgaagaaaaaatataatgatgaggatgcagaagatagagcttcagaactgtgttcgttgtgggaagagtatataaaggacccagactggcatccatttaaaattaccatgattgaagggaaacatcaggaaatcatagatgatgatgatgaaaagttgaagggactgaaaaatgagatgggtgaaggagtctacaaagctgtggtgacagctttgacagagataaatacatataatccaagtgggcgagggaaagagagctaccttgcaagagggagtaaaattgttattgatgcaatggaaactaactaa

SEQ ID NO: 33963 - DNA, 207 bp, Glycine max
  Peptide Sequence Number=SeqID_150741
atggtgaaggacatcgaagaaggttgccgcacgcccaaacgcagcgcttgtcggatacccgcggcgatggtgtgtcctccgccgccgaagaagaagtcggcggcttacacggcgagacagagggtcccacccaagaacggttactttgtgccgccggaccttgagctcattttcagagttgcgccaacaagagaagcttttacttag

SEQ ID NO: 33964 - DNA, 1620 bp, Glycine max
  Peptide Sequence Number=SeqID_150742
atgcctttcatttccaaaattcagcgtcaatctgatttcaacctcttcgattccaacactcctctcgtgatagacaatggcgcctcgtattttcgcatagggtgggcgggagagtctgaacctcgtgttgtttttcgccacattgtgcaaaggccgtgccataaagaaaccggggaaactgtcactattgtgggtgaccatgatccggcatttctgaaatactttgactgcactcactcagggccacactctgcatttgatagcaatgttgtgtaccagtttgaaacaatgcaatatattctagattttggatttgatcggatgggtgcaaatggaacagagattgatcatcctgtcctgatcacagaatgtgtatgcaacccggttcaatctcgtagtaaaatggcagaacttctttttgagacttatggagttccatcaattgcctttggtgttgatgtggcattcagctataaatataatcaacagcgaggagtttgtgctaaagattgtcttgctttgtgtcctggattcaacacaacccatgtgattccgtttgtagatggggagcctgtttacgaaggatgctgtcgtactaatattggtggattccatgtgactgatcatttgaagcaactcctttcacttaaatatccttatcatttggctagatttacatgggaaaaggttgaagacctgaagatggaacattgttacattgcaccagattatgtttctgaagctcggttgtttcagaaaggagccaaggaagctgaagaaaaaaccagatattggcagattccttgggttccacccccaattgaggagcctccttccgaggaagagattgcaagaaaggcagcaataaaagagaaacaaggtcaaagtcttcgagaaatggctgaggcaaagaggtcttctgagataaatgaactggaaaatgaattgcatggtttagagtttctttggcatcagcttgaacaagtggaagagagcaaggttccatctttcctggcagaaactggctatggctctaggcaggagattgaatctgcacgtaatatagttatgcaatctttacagaaagcaaaaggtgaaccaaagaatgaacaagatgcaactgaaaaggttgatcctgccaccaatgattctcttattaacattcctgatgaggtgccacatgctcgacctctgaccaaagaagattttcagattgttcttggggtcgaaaggttccgatgtcctgaactattgtttaatccaaactggattgcggttgatcaggtaggattagatgagatggttggggtttcaataaggaggttgccatacaaggatgaaagcttggaagagagactgactagttccatacttgttactggtggaagttctcttttccccggtataattgaacgcctggaagttggaattcggatgattagaccttgtggcacacctataaaaatagttagagcactggatccagtaatggatgcatggagaggggctgcttcatttgcctcggacccacagttccatcagcaaacttttagtatactggattatcatgaaaaaggagaagactggcttcgcaattatcaactgcagtatactttgtaa

SEQ ID NO: 33965 - DNA, 273 bp, Glycine max
  Peptide Sequence Number=SeqID_150743
atgattttcacccctctctctaaactccgtccaaaaaccctagaaactcctcttccaccacccatgaccatcgatgaccaccacaagccgccattgcttgccgctggaccaccacacgaagtggaacactttaatcaaagtgaaatttttagaatccatctcaaggattcggtagagaacaaagctcccaaccttttctttcatggtttctttgagaactctgcatttggacgtgaacgtgagaggcctctgagtgacgtagagagaagctga

SEQ ID NO: 33966 - DNA, 306 bp, Glycine max
  Peptide Sequence Number=SeqID_150744
atgaagacatggatcacaaatctacaggccaaatttgaaggggatccaacggttaacgattttggattgcagttttacttaaacaagtttggacctgaaactcacacatttcattctccacatagggaggcaaccataactttacaagatgtggccttgcagctgggcctcaagattgatgaactgctggtaactagtgtcattactggtaatgtatgtgttgcttgtcaagccttactaggggacactccacctgataagtatatcaagggaaaaatgataacctggttgcgacaaaatttttaa

SEQ ID NO: 33967 - DNA, 339 bp, Glycine max
  Peptide Sequence Number=SeqID_150745
atgttgactgttttgcagagaaaagcaagaaagagtgttaagactattcttagagaaaattttggtcatgaaagtgtcactttagagccattgcaatttagtttggctgtaattgaagcagcaaccaacaacttttcaaatgataataggatcggcaaaggcgggtttggagaagtttacaagggcattctttttgatggacgacaaatagctgtaaaaagactctcaaaaagttctaagcaaggcgcaaatgagtttaagaatgaagttttattaatagccaaacttcaacacagaaatcttgtgacatttatcggattttgtcttgaagaactctga

SEQ ID NO: 33968 - DNA, 309 bp, Glycine max
  Peptide Sequence Number=SeqID_150746
atggctttaacaataaagatgcttcaggtaatggcagcatcaatgagatggaggcagaggcagcaaatggaattcagtgctgtgaaccacaacaaatatatgctacacaaacatgacaagttctatgctatatgccaaagcatccatgttgctacagattggtgtggaattcaaacagcatataatcagtcagtggagaaattcttttgggttggtgcaaggaaaagaaacaaaactattgtggtggaagaatatgtggagaacacagttacagaggcacaaggaaaggaagttttctttggaggttag

SEQ ID NO: 33969 - DNA, 762 bp, Glycine max
  Peptide Sequence Number=SeqID_150747
atgttagctggtattttagttgataaatctatacagaaaggtggacaagttaaactgagaggtatagaggttgatgctcttttaaaagcactaaaaacattattcaagaggaaagcttcaaatctcgaagaggcagaagcattagtcttgaaatgggtccaccaagttctctccagggcttctggaataatagaaaaattcatttcagagaattcagaacaaaatgcagaaggtagcttcttcactccacctagaagtgagactagcaaaggcaggaaatcagtagcaaagtccaagtcattgtctaaagcagtaatagcgatttatacagttggaaatccaatatttacattatgcaaaatgcttaaattgaatgtaagcaaatatttgccttgctattctaacttctttttcatggaagttatcagttacataacaaagatcacaagatgtctcttagatccctgtgaacttgtgagaaggcaaacgttcatattgctttccagattgctgcagagggactatgtgaaatggaaaggagtgctatttcttctgttccttttgtcacttggtgatgaatcagaaaagataaggcagttagcggattttctctttggaaatattttgaaagtcaagtctcctcttttagcatacaatagttttgttgaggctgtttttggtctgaacaactgtcatgtccataatgggcatggtgagtctcaaggatcacaaaaggaaagccaaatcttttccatcaagtaa

SEQ ID NO: 33970 - DNA, 174 bp, Glycine max
  Peptide Sequence Number=SeqID_150748
atggaaaaattgatgccacgaatagaagggaagggagagtttggccagcctaggtggaggctactagcatctttacaagggcaacaacctatggatactctatcatggaagcaaaggttggagatttgcattggagctgcaaaagggcttcactaccttcacattggggcttag

SEQ ID NO: 33971 - DNA, 393 bp, Glycine max
  Peptide Sequence Number=SeqID_150749
atggattcattcagtggagtggttggtcttaaaggtgaaatcttgagtcttcactctcttagtggaagttcctcagtggagtggattcagggatctttagtttctcaaagacagccattgacttggtacaaaaggaagcagagaatgttccttatggaaaaaggacacatttcactttcttttaattcctcaaccccacactatcctttgtttttagcatgggtactcctaaagtcatgtcatgctcttactgggtatataccaatatctggaatacgaataggcaatgttaaagtgcgtaaaggaagcccacttgtcacttgtctcttggaaggttcccgtggcagtggtaaaactgcactttcagataccgtgggtattgacagccactga

SEQ ID NO: 33972 - DNA, 1080 bp, Glycine max
  Peptide Sequence Number=SeqID_150750
atgacagaggaaaaaattgtccaaggtggatattgggagaggttcattgaagagaatgttcttacaagagttgcaagagtattgaattccgcaacaatgtccactcctttcaattactcggggcttccaattggagcaaatgcaaggaagcttagcacatggcaaccggtgattgataaaatgagaagtaaattgacatcttggaggaggaggcaattatcatttggtgggaggatttgcttgagaggaaatgggtatagaggcttttcagtgagaatatgtctttggagagaggtccttatacaaaaatatgagcttgagaacttggattatcatatcaagggtgggggcgtggtgaagggaactcaatggtggtgcgatactttgacttcttgtgagatctttgaaaatgagcataggtggttccaatccgggttagggagaggagtgcgaggtggaaataatgtgagcttttgggaagcaaagtggttaggagacaaaaaaagcaagaacattagggaggctggtgattggtgtcgtggagtgtggtcatggcatttctcatggagacaattgtggttgcaatgggaaatcctcattgtgcaacaaatggatgaggctttggagggttgggagccaaatgtgggtgaaaaagatggatgggtgtggaaaaataatgctgcaaaaatcttcattgttaaagaggtttatgcatcattaattacatataggtttggagatgtttgttccttctttaaccaaatatggaatttacttgttccgtcaaaggttaaaggcttgttgtggagggtgggacataagattcaaactaaagataacttgaggagaatgatcatactacaagatggaactagtcttaattgggttttctgcaatctaggcatggaatttgcaaagtacttgttgtttgaatgctgcttttgtcatcaaatttggcaaagatgctatgtatggttagggaaaataagggtgctacatgtggagtgtaaggaacatttttctcaacatttcagaattttacctggggcaaaggctagatgtgtggaggggactgtgtga

SEQ ID NO: 33973 - DNA, 903 bp, Glycine max
  Peptide Sequence Number=SeqID_150751
atgagtgacaaaagcaccccatccccaaggaaccctcgcaaatcgcagcggcgctccgagctcgagattagagaagaaaaagattcaacctttgtggaagaggatggaaaacccagaacgagaagacaaatcgcgcgaactaagaaagagaaacctaactccgttccaccttcaaccccatctccaaagagtgaagaagagaatggtggtaatctggaccatgttggacaggtgtgttttgtcgaccttgtcgcaattgcggattctcttatcgggtgtttcgtttttctcgaattcggtatgcaactgccagtgcacgctctgatgggcttcttctgctttgtggagggagggacatcaatagtgttatacattgactatctattcctcggagattatgttgataggggccaacacagcctggaaactataagtcttctgcttgctctaaaggttgaaaatattcagcgtccaattacaatggaagcaggatcaattgtgcttatggatctattatgcatgaaatgtttctctaggtctgatcctacggagaatgatgacagtgttgaagggctgcggccaaatgctaggggtccaggattagtcacttttgggaatcagaaatcttacagattgaagaggcaattgcaattcaaggaaatagttcttttgaggagagagcaattgtactttacaagatttgcctgttttattggaagtgacctttactcttctttacttgggttttatgaacgcagagattggcagattatattggattgccctgtccgcatagctcgaggttgcaagtattgtgttgcagatcatagatcttcttgcctagtcaaaattaaagatgacaaacagctctcaagggtgtttcaggaagaagtgaaagaataa

SEQ ID NO: 33974 - DNA, 255 bp, Glycine max
  Peptide Sequence Number=SeqID_150752
atgaggggtaaccctgggaaaacaccttcatccggaggaaacaacacttctgatggtgtggtgatcagggaagatcagaacccaagaaacccctcctctgatgcaactgcatcaagggaacaagtgaatgctatgtatgacccggcatttgagagggctggcgttccaattgatcccattctcaggttgttcaacgcaaattcagcagagaaaccagctgaagaagggcgtgaaaatccgaattggaaatcttaa

SEQ ID NO: 33975 - DNA, 306 bp, Glycine max
  Peptide Sequence Number=SeqID_150753
atgaaaggaggtatgataaatctaacatgccataagtatggtcatttttcatggggatgcaaagccaatattgaatgctataattgccataagtatggtcatttttcttggaagtgtaaatccaatgttgaagaaaaattcaatggagcaagtaatagtgacaagaaagatgataagaacttatggtatcttgacaatggagcaagtaatcacatgggcggttacaaggagaaatttgtggagcttgaagaagaggccaagggaaatgtttcaagaagcatggagtggagtgaagccaagagttga

SEQ ID NO: 33976 - DNA, 297 bp, Glycine max
  Peptide Sequence Number=SeqID_150754
atggtgacactaagcaattcgtttaatttaatgttacccacaatgaaatttaaggcatttggtgtgcgtaataaacctccaagcctgaacccaactgacccctcacttccagttcaacagtttattctcttcactctcttccttcaccctacctctcctgctatgatcaaactattgtgtagggttatggtgattgacatgcttctcttcaagtatatcatgtttcccaatgttggcaatggacactcacctagatgccatgaatcccttcacagtgtggcgtggactagcttctag

SEQ ID NO: 33977 - DNA, 228 bp, Glycine max
  Peptide Sequence Number=SeqID_150755
atgggaaatacccattgtgcaacaattggaggaggcttccgagggttgggagccaaagggaaaataagggtgctacatgtggagtgtaaggaacatttttctcaacatttcagagttttacctggggcaaaggctagatgtgtgtcggggcctgtgatttgcaatgatatggtcgttgtggaagcatatgaaccatatcatcttcaacgaagtaagtctggaagctag

SEQ ID NO: 33978 - DNA, 837 bp, Glycine max
  Peptide Sequence Number=SeqID_150756
atggggctgccgcgtaaccggcttaaggcgcataagttgatcaccgacggcatggatgtcggcattgtcgaacgcgccgccacgattctgaaagcgacgccgatcgacatcgcgcaaatggtctcgattgaccgtaacacctaccggcgccgcgagaagtccggatcgcagctctcggtcgaacagggtgcacgcatctatcaggtgtttgaagtgctggatgcggtgatccaactgttcgctggcgatccggaagtggcgatgcactggatgtatcagcctgcactggcgctcgacaacgcgcagccgattaacatgctcagtacgcccgccggctgcgatgcggatccggccgcacccgtcagggtgttctatcgaattgtcaaagcggagtacgccagccaggcgtttaacggtgctggcgcagaaaaatggggtggccgctggaatccgcccgggatgaaagcggtttacctcagcagctccaaagcgctggcgacgctggaactggtggtgcacgccgggaaaacgctgctggagcaaagccgctttgtggtgtttaccgtggcggtaccggaatccgacatcatcgccctcgacagcagtaaactgccggccggctgggaaaaatatcagcagcaggaggagacgcaggccatcggcgcggcgtttctcgatccgcacaatggctttcccctgctgatgacggtgcctagcatcctcaccggcgaagataatgcgctgtttaaccccgatcacccggccgcggccgcgctgattgccacagcgacctccgctcccttcgccatcgatcgccgtatcaaagacgatccgtaa

SEQ ID NO: 33979 - DNA, 591 bp, Glycine max
  Peptide Sequence Number=SeqID_150757
atgcgtttacaaggaaatgcccaattaattgatgatcaagaaactactaaatttgcaaagtggattctagatattggagatggagttattgggaatcaaaatgatggatatgctaccattgaaattcctgagtacctactgattactgaatataatgaccccattgatgctatagtcaaatcaacatttccagatttatatcaacatcacagtaatcctgaattcttcaaatctagagcaatattagcttccaccaatgaaacagttgaagaggtcaatgattatatactttccttgattccaaaaaagtcagaaaccattggcagttggcatttccaatcaatcacaactgaatttctcaattcactaaacacatctggtctgccaaatcatcgtatcaagctaaaaatcgatagtcctataatgttgctaagaaacttagaccaaacgcaaggactttgtaatggtactagattaatagttactagactagccaaacatgtcattgcagctgaaatcatttctggcaaaaatcttggcgataatgtttacatcccaagaatgtcaatgtcaccttcacaatcaccatga

SEQ ID NO: 33980 - DNA, 279 bp, Glycine max
  Peptide Sequence Number=SeqID_150758
atggcctttgcatgtgatattgtgaagtttgaattatggaatgaatttgtgcatgtggatgtggagtttgatggacataggttccggagtgaggaacaccagtgccgatttgaggaaattaagggtcggtcgttcctcaaggagaggcgggtccaattgagggacagagagtatgccgagttccaggaggaaattgccaggaggcaacggactcagcttgcgacacccatggctaaatacgatcttgaaatagtcatggagttctacgccaatgcctag

SEQ ID NO: 33981 - DNA, 381 bp, Glycine max
  Peptide Sequence Number=SeqID_150759
atgatgaaggaaatgtgtgaggatttcaagatccaacaccataattctatgccttgcaggcccaagatgaatggggcagtagaggctgctaataaaaacatcaagaaaatagttcagaagatgattgtgtcatacaaggattggcacaagatgctcccttttgcgctgcatggttatcgaacctcggtacgcacgttaactgaggcaacctcattctctttggtgtacgggatggaggttgtgcttccatttgaagtaaaggttccttcattgaggattctagctgagtctgggttggaggaatcaaaatgggcccaaactcactttgatcagttgaatcttataaaaggtaaaagattggctgccatgagccatggatga

SEQ ID NO: 33982 - DNA, 125 bp, Glycine max
  Peptide Sequence Number=SeqID_150760
ttgttgcattgcgtgttggagagtcccagtcccagtctcaggattattttggagagtgcggctattatgtgatgcactggatgtccaccatcattataggaacttttaggaataattgggaagcg

SEQ ID NO: 33983 - DNA, 210 bp, Glycine max
  Peptide Sequence Number=SeqID_150761
atggaggcacagtcccagtcccagtctcaggattattttggagagtgcggctattatgtgatgcactggatgtccaccatcattataggaacttttaggaataattgggaagcgtattttaacgatcctagaccattggagccagagagattaaaagcattgcggatccagtgggcacagttttatctccgagttagagatcaggcctag

SEQ ID NO: 33984 - DNA, 234 bp, Glycine max
  Peptide Sequence Number=SeqID_150762
atgttccagatcaacttgatccgaaagatgcttacggatcacttgatccataacctactcgaagcttccctactccgacaacaatggcggaaacagaggacgatggcgcttacctcaacggtggacgctgacgacgctccctcgacggtggacgatggcgtagctcttcacggaaacctcctcaatgcacctcgcaacctcttcacagcaagctcctcttcacgacaacaatga

SEQ ID NO: 33985 - DNA, 2018 bp, Glycine max
  Peptide Sequence Number=SeqID_150763
aatttattgagatagaggagaaagttacaaatgcaattgcaagagggggcatatttgctactgaagagatgtctcctgcttccaaatctaagtccaaagacaaaaaggccgtcaaggaagctcaaaagtcttctgccaagtcttcaggatctggtaatgctgtggctggtgtaccagctagtgcatacaaccctttattgggaacatttcatactttggagacgtcaccaacatctacttctcaagtaaattctaatggtcgttttcggaacatagatgagacagatgaacatcctgcaggctcagtggtagctggtgtggagtatgattctgtttctaacaatggtagttggtctggtgagtcagaggaccataaagacaaagctgcttctaatcctcctgctcgactggaagcagtaccaggagctgataatgataaacgtgagaaaatccgccagaagaatgaaaagaagcaccaacgacagaaggaaaggcgggcacaagagttgcatgatcgttgcactggatatattatgtcaaggaaacttgaggcacttgctcaacagcttgtggcaatggggttttctcatgagcgtgcaacagtagcattgatactgaatgaaggaagggtggaggaatcagtagcatggctgtttgaaggtggtgaagaagcagataatcataaagaaacaaatataggtgggggtaatttgaaaatcgatatatcagaagaacttgctcgaattgcagacctagaaatcaggtacaattgctcaaaacaggaggttgaaagagcagttgttgcttgtgagggtgatcttgataaggctgcagagtctttgagagagttgaagctggatcgaccatctggtccaccaaagccagaggaaattggtgatcttccttccctcaccaataagcagtcagaagctgtgaatcagaatgctaggacacagacaaaacccatactttctccaaatcaacccaaaaaagatgaaaaggattttaactatgcaaagcaagcagttatgctaggaggatctacagaatccagcaacagacttgtgcagcctctcaagagaatcttacccaagtctgaatgggcaaagccccaacaagctgctgtaccagctgacaagaggtggccaggtgcaggatctaatccttcagtttctttttcattggcttcaccgttgcaagtgtcatccacacctgctaaaacagaagcttcttatatggctgtgggaggtgattacaagaaccttcaacctggagcaactagggagccagtaattgtgatgcagcgacctcaaactgtaaatgcaaagcagattccagctgccagcatgagttcatctcctcccggagtagctgccagttggtatccaactaatagtgttgaagtcatgaggtccaatggctttatgtctcatcctcctagcactagaagcctcagttcaaactatttcagttctaatcaactgtaccaccaacttcaatgtcaacctcctcagcagtttgtggctggcaacagcagttcagtagatctccaagcaaccaatcaagggaataacttatggaatagaacatctgcatctccaacgcttgccgctgcttcttctcttggactcttttccgggctaggatcagcagctacatcaggggcaacttctccggtagactggagcactggtggaacaatgcaatttgattataccaacatagactggtccttggatagaggtttatctccacccaggtctaatgcattattgtttgggctttctccttttacaaagagtagtagtactctatatggctcaaatgcttctggcacggttgctcagcaagcaattagatcattaccctctaatggtagcatggttcccttgcctggattgcaagaaggtggagtatcttctgctgaaccatcaggatctcgggattggagttctccatttgaaggaaaagacctttttagtttaccaagacagtttgtttcttctccttctctgtag

SEQ ID NO: 33986 - DNA, 399 bp, Glycine max
  Peptide Sequence Number=SeqID_150764
atggcttcgaagatacaaatattaccagtcgtaggcgtggtggccatgtatatcatgaattcaattattacagtcttgtatttcaacggaagagtatatgaagacaatgatggtgtaatatttgaaggcagaaaatatgttgcgttgcaaatttgtgatgacgaagatgttgaaactatgatcgaaagttttcaacaacaacaacaaatgtcagttctagaattgtacgtagaaaaggatgttgctgggggttctatgtttcatgctgcaaattctgttacgtcatgtggacgtaatgtatctcatcatgagtcggaactgccaagaaatataagcaatttacatgttgatgaagatgatgatgatgatgatgatgattatcttgcatctaactcatac

SEQ ID NO: 33987 - DNA, 486 bp, Glycine max
  Peptide Sequence Number=SeqID_150765
atgaatgctatgagaaaagagatcaactcaattgaaaagaaccagacttgggagttagttaatcctcttcaagataaaaagccaatagcattgaaatgggtgtacaaggtgaaggttaatactgaacaagaagtggtaaagtataaagcaagtttatgcaccaagcaagttgcaaggctagaaattgtgagattagtagctgcaactgaaagtctaagagactggtccattcatcaactagatgtcaaatctgcttttcttaatagaccactagaagaaaagtcatggaaggttggtaaaaatactgaaatgctaatagtttgtctttatgttcatgaccttctaacaataggaagcaatgagagtgaaattgagaaattcaagcaagacatgatgagtgagtttaagatgagtgatcttgggttcttatcctatttcctaggaattgaattcaagacaactcagtatgggattgtgatgcattag

SEQ ID NO: 33988 - DNA, 201 bp, Glycine max
  Peptide Sequence Number=SeqID_150766
atggatgagtttgacctgcaggtggcctggctaggagcccagccttctccttttggagggggtggggcctccgcagcccaggagcttgttcctgaggagccagcaacagcaacaacagagggggaggatgagctcacccttcctgagcccttttattttgatgtagatgcacacatggctcaagaggaggggaaaatttaa

SEQ ID NO: 33989 - DNA, 360 bp, Glycine max
  Peptide Sequence Number=SeqID_150767
atgtgtcggctaagcaaggaatgtgttaagggtctgccccaccaattgaacctctccaatgtgtacgatgacgttaaacttcctcaacacccacatttatcagatcattgcccaaagggacgtggtgcacggttgttgacccctcataaattcctccaagggtcctaccctgagggatcaatacagcttccctttatgctgacacaagcaccaaaaggagctacctcaggctcaatagaagatgtgcgagagcttgttgaagttggtccaaagtatttcctaattgtcacaccggctccaacggcatggacatggcaagggtgctctggttgcccaatggcaatagttagtacatcctaa

SEQ ID NO: 33990 - DNA, 627 bp, Glycine max
  Peptide Sequence Number=SeqID_150768
atggggtatggggtatggggtatggggtttggggtatggggtttggggtttggggtttggggtttggggtttggggtttcgggttcagggttcggggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggttcagggtttagggtttag

SEQ ID NO: 33991 - DNA, 550 bp, Glycine max
  Peptide Sequence Number=SeqID_150769
gcctaccgcatccgcacggaggcagcgagtccttgtgactgcggcacacgatgagctagtggtccctgcgccaaatgtagaggttgacgtatttctggatgacccgatggcaccagctgatgtagaggacactggggcagacattcccacagacacaggcgcccaggctgctgaggatgagcatgaaggattttcgggtggtccgagcgacctatctgtgctgacccaatatgcggatcactttgcttgcagccgtcctgagttgaagttatcctctcacgggaggaaggtccatagtttaggcaggcctatccctgccattaagggactagttgctgggataggactaagtcctctaatcgcgagaggtgacgatcacactggacgacgtctcctcgcttctgcatctggccgtgggctgagacagggcagtgtcgtggaccgtacatacgcctgcaatgggtacgtgatatctgcgagcgccgatgccagacaggcccttcgtgacctcagtcagaccgggaggtacgcctggggagtagctgcgctg

SEQ ID NO: 33992 - DNA, 642 bp, Glycine max
  Peptide Sequence Number=SeqID_150770
atgacaaaacatgtaattgcagctgaaattatctctggtaaaaacattgacctcgccgtttatattccaagaatgtcaatgtcgccttcacaatcaccctggccgtttaaactattgaaaagacaatttccgattatgctatcttatgcaatggcaattaacaagtcacagggactattgctatccatggttggactttatttgccaaaacctgtattcactcatggccaattatatgttgcattgttaagggtcaactcaacaaaaggattaaaaatcctgattcatgatgatgagcagaaaagcatgaattccactaccaatactcttcacatcaccactagctttcccattcaagaagcaactattgagttgcaccgtttccaacaaaaacctaccgccacttatggcatcgagaagataaatcaactaatcaagtccactcaactattaagccatattacaggttcctctggaaacttcatttcaacagtctatcaccatactttcacaacttcagacaaacccaaaatgagtatcgcatcttccaccgcttcaaccagaatgagatatccaattgtaagaccacctgcaatcatccaattcagagcgactttgcacaatgaccaggttatagtttaa

SEQ ID NO: 33993 - DNA, 411 bp, Glycine max
  Peptide Sequence Number=SeqID_150771
atgtatgaatctaatcggacaagagggtcctctaagccttgcaccacgggtgtgagggccttcagggagacaatagagttttatgacttaatagatgcggggtttgaagggccaaagtataactggaagagagaagggggccctttcaatttcaagaagcttggcatgcgcataaaggtttctagtctttggtgcatgaaaattggagacctcatgaggagtagaacaaccatttggggaggagttaggaagaagttggcagagatacttttccaagaggaattactatggttccaaaaattgagatgcaaatggttgaagtttagggatagcaactctcgctacttccactggaataccattgttcatcgtcaaaaaaaaatgttgtgggcaggctgttggatgacataa

SEQ ID NO: 33994 - DNA, 516 bp, Glycine max
  Peptide Sequence Number=SeqID_150772
atgtgtacattgctgaagtttgtctatctacttccctatcaggcgtggtacagtaatccatctcttagagattggttgaaggagcatgctgatacatcggagttaaataagttgaaatggtcatattatcagattaacaagagtccgcggtctagccttgacgaagacgaggcatttttgtcgactgcggattcagcaataaggatgctttctaaagcaactaggataatgaaagattggaagggtttggaatacagagcaacatttcccttgctgaaacctgctggtgctaatttctacccaccagacatggacaaaatggagtttgaattatggaaggacggtctagcaaagcatggacagaaagaagcaacaggttctcatgacctctatatagttccttactctgaagagtacaaatctcttctcgcaaaagctgttgttttattgcataaagctggagatgttagcgactcaccgaggtatgttggttttcatccatgttctcattattaa

SEQ ID NO: 33995 - DNA, 591 bp, Glycine max
  Peptide Sequence Number=SeqID_150773
atgattctgaatctgaaaagaggaccaagcttcccagataattggaaggttaattttggacttattatggacctcttgtggcagcaaagaaccaaaagtcttcaactgaaaggtgtggagcattcaagaggtgttttccaaattgcggaagatggagttggcatggtccgcaacctctactttttttatgtcggtccttgtttctctataaacaaggagttacgcaattctatgttctggaagctgacactgggaaatagagtaatcgtgaactgcgatagagctagattgaggcatttgttggatatgacttcacgtgtcgggttaataaagaatggagctggcgtgttcttgggaggcttgctcgtgaaagaagattcttcaatgttgaaatccaatcggattctcaagaggctatccttttttatcttggatgggtgtgagaggaagcacgaatgtgtttacacactgtctatgctatcaaggagtgttgtagtcctcccatgcaagttctgtttaatcatgttctctgggagtgtaatggggctattgatattttggccaaaggggtatccatgcaacaaggtttag

SEQ ID NO: 33996 - DNA, 462 bp, Glycine max
  Peptide Sequence Number=SeqID_150774
atgggcttacctattattgaagcatatacggatatggaagctgttgagtttgtccagaaactcaagacaaccaaggagataaacaatggtggggctaaaaaaaaggaatctaaggatataaaaaggaaagggctgaaaggaataaggggtaacagattttctaagcttatgaatgatcttgttcaggagtatcatctttctttatgcttccttttagagatgcatgcttcttttgttaaggcggaggccattgttaggaggtttggctttgactctcaccatattgaagggtcaaatggccaattaggaggcttgtggtgtctttggaagtcaagggtcgcaacctacccttcgacgggagggcgaggcgaaaagccaaaggtgcgtcttcccatgaagaaaacgcgtggagtcgccaccaacgtttattcggggaaaatgctagaaaaaccaaaaagatga

SEQ ID NO: 33997 - DNA, 807 bp, Glycine max
  Peptide Sequence Number=SeqID_150775
atgaaactaaaattgcaaaagtggacttggacatgcgtactcgcactaagcttgcattgctcgcttagtacgagtgcttgtattcgcacatcctctcgcttagcatcaatgcatgtgttcgcgcttaatgtgcctcttcacgctcaacgaacgaaggtgagcaatgaaaagacaaggattttcttttccaagtatgtaggagggaacattagggaggagatttctcaagctattgggttccaacgtacagcggacttaggcaaatacttgggaattaatctccaccacagacggatatcaaggaattcgcatcaaggaattaagctaaaaaaaggacgattaacgctcactaaaccggtgttgagtgctcttccaacttataacatgcagtctgaattcttgccgagggagattcagagaagagggtgcattgggtggcttggcaagcgctttgagttatggaagaagccagtgtattcgtgggtgagtatggttcaagggaagtataggtgtggtgaacacgagtttcccattataaataagaagagagttggatctaacttatggtcagatatcaaggtagtgtgggagaaggttgtggcaaattgtgacttgattgatggcgctagaaggtggaacttatcatcggatggcaggttttccactaagaagagatgtagatcctttctaaagagagtgtttgaaggggtgttggctactaaccaagccaaatgggagagaaggttcgctaattcatgggattgtcctatgtgttgtatggagaaggagtcgcctttgcactattag

SEQ ID NO: 33998 - DNA, 453 bp, Glycine max
  Peptide Sequence Number=SeqID_150776
atggtgtctgctagggtttacggagatgatgttagtgaaggggcaacttatgcccaagaagaggatttgttggataaaattaagaaaaaaattaaagagagtgaaacactattgagtgagggtgtcgtgggtgtgaatgaaggtgttgtgggtgcaaatgagggtgattccccgtatagagagaagcttttgacagagattggaggagatgagattgattttgtggagaaccatgatgaaaacgattgtgatatgatggaaattcattcgttgggagttgagaaaaagaaggagtttgtgcatgtcaaggatggtgtggaaattcctgtgtctgatgaagatcatttaggccataagaaggatggttgcagtgaacctatcatgggtatgaagaaggtgactagaaaggtagctaacgtcactaaagacatgaaagaggtcaacgttcaatag

SEQ ID NO: 33999 - DNA, 195 bp, Glycine max
  Peptide Sequence Number=SeqID_150777
atggaatgcagtgtcataaatgatcgaaaatacataaataacgagtataatgatgtgtatctggtaacaactcttgatccaatacctctggaagcctttgcacttcaggtgaggatgtcttgttttacaagtgctagaactcagtatgaagagttagtgttcggttggggtgaaagaaaaggaaagaaagtgtga

SEQ ID NO: 34000 - DNA, 165 bp, Glycine max
  Peptide Sequence Number=SeqID_150778
atgcggaaattgattaaggaaaggatggaaaataaggtggttaatttcgtgggtcttaataaggtggttcttggcataaaatggatgaatgggatgaacaagggtgaagatgaaaggaaggaaagaatcactctttccagcgagggcaacacacaaaggttgtga

SEQ ID NO: 34001 - DNA, 405 bp, Glycine max
  Peptide Sequence Number=SeqID_150779
atgaccaagagcaagggcaaggatccacttgaaggacttggaggacctatgacaagggctagagcaaggaaagccaaggaagctcttcaacaaggcccaattggcaacctaggcatcagccttttgggagaccaaatggtggctgacttgttggctgttgggggattcatatcagcactagactttcccaaaaccatcaccaacaacggagaattccacgacggcggcggtggtggcgacaacaacaaccccgcaccgaaatcgttgtggctccacggctatgttgaggattcaagaaaggattcagactacaagaaactgtggaagcctccatcaaatcatgggtttataccctgtacaaagcctactcctaattactcaagtaagaaacttgaacttgtgtag

SEQ ID NO: 34002 - DNA, 186 bp, Glycine max
  Peptide Sequence Number=SeqID_150780
atgttgatagaacataccgaggagttgtataggagaattgaacaagtagagaatcaaggaaatggtgatgatggtggatgtagaaggaagagatggagaaataatgagggtgatgctagagaggacaaaattgaagaagagacggaggtttccatgattagagctaatgttatggaggatcgggag

SEQ ID NO: 34003 - DNA, 3777 bp, Glycine max
  Peptide Sequence Number=SeqID_150781
atggcttttgctatggtgggagaggcacttatctctgcttctgtggagatcttgttggataggataacttctgcggagtttcgagatttctttgccaatagaaagctgaatgtttctctcttggacgagctgaagataaagctgttggaactcaatgctgtgctcaatgatgctgaggagaaacagatcactaatgaagcagtgaaggcatggcttgatgagttgaaagatgctgttctagacgctgaggatttgttggacgaaatcaacacagattctctgaggtgcaaggtggagggacaatgtaaaacctttactagccaggtgtggtcatcactttcttctccctttaatcaattctataagagcatgaattccaagcttgaagcaatatctagaaggcttgaaaattttcttaaacggatagatagtctcggtttgaaaattgttgctggcagagtctcttacagaaaagatacagatcgatcggtggaatatgtcgttgcaagagacgatgacaaaaagaagctgttgagcatgcttctctctgatgaagatgagaataataatcacatacaagtgctgacaatatggggcatgggaggtcttggaaaaacaacccttgctcagagccttttaaatgatgatgcagtgcagaaccattttgatctcaaagcttgggcatgggtatctgatccttttgatgtgtttaaggcaacaaaggcaattgttgaatctgccacttctaaaacttgtgatattactaattttgatgctcttcgtgttgaattgaagaccacctttaaagataaattttttttgcttgtgctcgatgacctttggaatatgcagtatcatgattgggatcaactaataaccccttttagctgtgggaaaaagggaagtaaaatcattgtgacaacccgacaacacagaattgcagaaatcactcgtacatttcccattcatgagctgaagattcttacggatgacaactgttggtgtatacttgctaaacatgcatttggaaatcaaggatatgacaaatatccaatcctagcagaaattggtagacaaattgcaacaaaatgcaagggtctaccattagcagccaaaacattgggaggtcttttgcgatcaaatgttgatgcagagtattggaaaggaattctgaacagcaacatgtgggcaaataatgaagttttaccggctttatgcataagttatcttcatcttccaccacatctgaaaagatgttttgcctattgctcaatttttcctagacaacatttgttggataggaaggaattgattctgttatggatggctgaaggctttcttacacaaatccacggagagaaagcaatggaatcagtaggtgaagactacttcaatgaattgttatctagatctttaattgaaaaagacaaaaatgagggaaaggaacaacttcgaatgcatgaccttatttacgatttagccaggctagtttctgggaagagatcttgttactttgaaggaggagaagtcccattaaatgttcgccatttgacatatcgtcaaagagactatgatgtctctaaaagatttgagggcttgtatgagctgaaggttttgcgcagctttttaccactgtgtggatataaattttttggttattgtgtatccaaaaaggtgacccatgattggctgccaaaagtaacatatctgcgaacattgtccttgtttggctacagaaatatcactgagctgcctgattcaataagcaatttggtactattgcggtatcttgacctttcccatacttccatcaaaagtttgcctgatgcagcctttaggctttacaatttgcagactttgaaattatcaagttgttattatcttacggagttgcctgaacagataggagatttgttactcttacgatatcttgacctttctcatactcccatcaatcggctgcctgaacagataggaaatttggtcaatctatgccaccttgatattagaggcacaaatttgtcggagatgccatcacaaataagcaagctacaagatctccgtgtgttgacttcttttgttgtaggcagagaaggtggagtaactataagagaattaagaaagtttccttacttgcaaggtacgctttccattttgaggctacaaaatgttgttgatcccaaggatgctgttcaagctgacttaaagaagaaagagcacattgaggagcttatgctggagtggggcagtgaaccacaagattcacaaattgagaaagatgtacttcagaacctgcaatcgtcgacaaatttaaagaaactcagcataagctactacagtggcacaagctttcctaaatggttgggtgactctacatattctaatgttatagaccttcgcatcactgattgcaactattgcttttcacttccaccattaggacaactaccttctctcaaggagcttgtgataggaaggatgaaaatggtgaagacagttggtgaagaattctactgcaacaatgggggttccctttcatttcaaccatttccattgttggagagtatccggttcaaagagatgtcagagtgggaagagtggctaccatttgaaggtggaggcagaaaatttccttttccttgccttaagcgtttgagtttatcagaatgccccaagttgagaggaaacttgcccaaccatctaccttcattgacagaggttagtatatcagagtgcaaccagctagaggcaaaatcacatgatctacattggaacacatcaattgaagacataaatattaaagaagcaggagaagacttgttgtctttgcttgacaacttttcttataggaatctacggattgaaaaatgtgagagcttgtcatcttttccaagaataatactagctgccaattgtctccaaaggttgactcttgtggatatccccaatttgatttccttctcagctgatggcttgccaacgtcattgcaatcacttcaaatttacaactgtgagaacttagaatttctgtctcccgaatcatgcctcaaatacatatcacttgaatctctggcaatttgcggaagctgtcattccctggcgtccttaccattagatggtttctcttccctgcaatttcttcgtatcgaggaatgtcccaacatggaagcaattactactcatggtggaacgaatgctctccaattaactacacttactgtttggaattgtaagaaacttaggtcacttccagagcagattgatcttcctgccctttgtcggttataccttaatgggcttccagagctaacatcattgcccccaaggtgtttgccttccagtttacaaacacttgaagttgatgttggaatgctatcatcgatgtctaaacacgagttaggtttcttattccaacgcctcacttctctgtttcgtctttccattgctggttttggggaggaagatgttgttaacaccctgttgaaggagtgcttactgcccacttccctgcaatatctgtccctacgatttttagatgatttaaagttgttggaaggaaaagggcttcaacatctcacttccctcacagagcttgccatctggcattgtaaaagcctagagtccttgcccgaagatcagcttccatcctctcttgaattactggagataggtagttgtcctttactagaagcaaggtatcaaagtcggaaagggaaacactggtctaagattgctcacattcctgctatcaagataaatggtaaagtgataatatga

SEQ ID NO: 34004 - DNA, 177 bp, Glycine max
  Peptide Sequence Number=SeqID_150782
atgacctctcagtccatcatgggttgctcaatcaagcccccagaatcactaccacctatgtcgatggcggaatcaaacaagaatgaaaacattgtggaaggtggaaaggctataacagtccctaaaaacatggacacgcagctacgcttcactcctataaatactgggttccattga

SEQ ID NO: 34005 - DNA, 1854 bp, Glycine max
  Peptide Sequence Number=SeqID_150783
atgtttgagtttgacttaaacatcttttgccactttaaggaccgtttctttaaggtcctagctactggtgtcgtggctgatggtttgccattgatattaaatagggacaaggagccccgcttctcgttctactggtctgaccttatcaggttcaagttatttgatgaggatttattgaccttagtggaaagggtcgataaagctattttggagcaactgccaacttcactggaggccattccctctcttccttcggcgagcgatcctcttgctgccttggatggtattatgggtgacttcgcctggagaccactcgtgaagcaggtcagacctacaggtgggattattccactgtttgttgctgtttctactgttagagaaaggggtcaacatgttggtgaggttggccctatttctattgttgctaaggttgaccctagtgctcattcctctattttggcaaagtggaagtgggatgatggtgctgggccatctggctgtagggttgatgcccagtgtgggtcgccctacgatcatgtaggatatgcctccggctccccagccatcgaggcttctgctctttcacctcgtcttgctgttgctgttcaagaggccaatcctgctattgctgaatgtgcgaccactaatgctcctatggtgctgccttcaatggtccctcctccctccactgttttggtggcgatgccaccttttttgtcttctcgccctcgcgtctccttggatcatttgtacacctctagtgatattgactcactatgggatgcaacttacaagccaaagcagaatgccccagttggctttgtgttaggctgtgataagaactttattaggtcagctggggagaatgaacaacggcaccaagaggttttgcacaaggtggcatccttggaggcagaggtcaccaaatggagggctattgctcgcactatttggagagtaaagtgccttaaggtagctaacgccatcatcgcctttcctgaggccataaggtcaaaccacctactgtcttccaaagttggtgttatgttggccaagttgctgcgcaccaggttggatggtgatgaattgttcaaacgctgcaaggacttgcaagtggagaaaaaggacctagttggcaaggtggagaacattgcgactgagaagggcaagcttgcaaaggtggttgctaatttagaggcccgacttaaggattcggagtccaggctaaaggagtctgagttgcgggctaccaaggagagggaggccaacaaagagcttgaggaggagcttctcatttacaagaaggaggatgtgaaagatggtgtcttgcttgatgaggaaaaaattcctccaaaggaggaagctgttgatgaggagcagggcgctacaaagtttgatttcaacctggttaaagatcttgccatccatctagtggggcttccatctgctttacggagcttctcccctaatgcttgtgaggagagtatgtttgacttgcccctagttgaaggtcttgccaaccagtctgggggtaggtcgcttgacctgcaaagtttctcctctgatggttatgatgaggcggaccttcggttttgcaagaatgttagcaagggtggaccttgggtttttgatagacttgtattcttgcatagatacaagcgtaatggtgtactcttgcatacgtgctttttacaagtggcacgtattggagccatggtgccctttggaggatcgactagggaattgtttgacctgagttttgggcgtcgtgctgttgcatacatgtcactcgctatgggttgcacatattggagacggggtggtgtgctcttgcatatatgtcacttgccatag

SEQ ID NO: 34006 - DNA, 258 bp, Glycine max
  Peptide Sequence Number=SeqID_150784
atgctcgcccaccttatcgacggcaaagttccgacatcgtcgttgtcgtttcgtgaccacgagagccacctcttcaatgctcaagttggatcagcattcggatcaacaacgacacggaccgtcgtcattgtcaatgaagaggaaccatttgttcctagtgtccttggtattaaatccggacaacctatgttggatctagtgatggtgctttgcgatggtgtgggtggtgtcgaagaaagaggggtggttggagactaa

SEQ ID NO: 34007 - DNA, 3760 bp, Glycine max
  Peptide Sequence Number=SeqID_150785
atggccttagctatggtgggagaggcacttatctctgcttctgtggagatcttgttggataggataacttctgcggagtttcgagatttctttgccaatagaaagctgaatgtgtctctcttggacgagctgaagataaagctgttgacactcaatgctgtgctcaatgatgctgaggagaaacagatcactaattcagcagtgaaggcatggcttaatgagttgaaagatgctgttctagacgctgaggatttgttggatgaaatcaacacagattctctgaggtgcaaggtggagggagaatttaaaacctttactagccaggtgaggtcattactttcttctccctttaatcaattctataggagcatgaattccaagcttgaagcaatatctagaaggctagaaaattttcttaaacagatagatagtctcggtttgaaaattgtcgctggcagagtctcttacagaaaagatacagatcgatcggtggaatatgttgttgcaagagacgatgacaaaaagaagctgttgagcatgcttttctctgatgaagatgagaataataatcacatacaagtgctgacaatatggggcatgggaggtcttggaaaaacaacccttgctcagagccttttaaatgatgatgcagtgcagaaccatttcgatctcaaagcttgggcatgggtatctgatccttttgatgtgtttaaggcaacaaaggcaattgttgaatctgccacttctaaaacttgtgatattactaattttgatgctcttcgtgttgaattgaagaacacctttaaagataaaaaatttttgcttgtgctcgatgacctttggaatatgcagtatcatgattgggatcaactaatagccccttttagctgtgggaaaaagggaagcaaaatcattgtgacaacccgacatcacagaattgcagaaatcactcgtacatttcccattcatgagctgaagattcttacggatgacaactgttggtgtatacttgctaaacatgcatttggaaatcaaggatatgacaaatatccaatcctagcagaaattggtagacaaattgcaacaaaatgcaagggtctaccattagcagccaaaacattgggaggtcttttgcgatcaaatgttgatgcagagtattggaatggaattctgaacagcaacatgtgggcaaataatgaagttttagcagctttatgcataagttatcttcatcttccaccacatctgaaaagatgttttgcctattgctcaatttttccaagacaatatttgttggataggaaggaattgattctgttatggatggctgaaggctttcttccacaaatccacggagagaaagcaatggaatcaataggtgaagattactttaatgaattgttatctagatctttaattgaaaaagacaaaaatgagggaaaggaacaatttcaaatgcatgaccttatttacaatttagccagactagtctctggtaagagatcttgttactttgaaggaggagaagtcccattaaatgttcgccatttgacatatcctcaaagagagcatgatgcctctaaaagatttgagtgtttgtatgagctaaagtttttgcgcagctttttaccactatatggatatggatcttatccttattgtgtatccaaaaaggtgactcatgattggctgccaaaactaacatatctgcgaacattgtccttgtttagctacagaaatatcactgagctgcctgattcaataagcaatttggtactattgcagtatcttgacctttcctatacttccatcaaaagtttgcctgatgcagcctttaggctttacaatttgcagactttgaaattatcaaattgtgaatctcttacggagttgcctgaacagataggagatttgttactcttacggtatcttgacttttcctatacttccatcaatcggctgcctgaacagataggaaatttggtcaatctacgccaccttgatattagaggcacaaatttgtgggagatgccatcacaaataagcaagctacaagatctccgtgtgttgacttcttttgttgtaggcagagaaaatggagtaactataagagaattaagaaagtttccttacttgcaaggtacgctttccattttgaggctacaaaatgttgttgatcccaaggatgctgttcaagctgacttaaagaagaaagagcacattgaggagcttacgctggagtggggcagtgagccacaagattcacaaattgagaaagacgtacttcagaacctgcaaccatcgacaaatttaaagaaactcagcataagatactacagtggcacaagctttcctaaatggttgagttactattcgtattcttatgttatagtcctttgcatcactgattgcaactattgtttttcacttccaccatttggacaactaccttctctcaaggagcttgtgatagaaaggatgaaaatggtgaagacagttggtgaggaattctactgcaacaatgggggttctctttcatttcaaccatttccattgttggagagtatccagttcgaagagatgtcagagtgggaagagtggctaccatttgaaggtgaaggccgcaaatttccttttccttgccttaagcgtttgagtttatcagaatgccccaagttgagaggaaacttgcccaaccatctaccttcattgacagaggttagtatatcagagtgtaaccagctagaggcaaaatcgcatgatctacattggaacacatcaattgaaaaaataaagattagagaagcaggagaaggcttgttgtccttgcttggcaacttttcttataggaatattcggattgaaaactgtgacagcttgtcatctttgccaagaataatactagctgccaattgtctccaaagtttgactctttttgatatccccaatttgatttccttctcagctgatggtttgccaacgtcattgcaatcgcttcacatttcccactgtgagaacttagaatttctgtctcccgaatcatcgcacaaatacacatcacttgaatctctggtaattggcagaagctgtcattccctggcgtccttaccattagatggtttctcttccctgcaatttcttcgtatcgaggaatgtcccaacatggaagcaattactactcatggtggaacgaatgctctccaattaactacacttgatgtttggaattgtaagaaacttaggtcacttccagagcagattgatcttcctgccctttgtcggttataccttaatgagcttccagagctaacatcattgcccccaaggtgtttgccttccagtttacaaacacttgaagttgatgttggaatgctatcatcaatgtctaaacacgagttaggtttcttattccaacgcctcacttctctgtttcgtctttccattactggttttggggaggaagatgttgttaacaccctgttgaaggagtgcttactgcccacttccctgcaatatctgtccctacggaatttatatgatttaaagttgttggaaggaaaagggcttcaacatctcacttccctcacagagcttgccatctggaattgtaaaagcctagagtccttgctcgaagatcagcttccatcctctcttgaattactggagataagtagttgtcctttactagaagcaaggtatcaaagtcggaaagggaaacactggtctaagattgctcacattcctgctatcaagataaatg

SEQ ID NO: 34008 - DNA, 411 bp, Glycine max
  Peptide Sequence Number=SeqID_150786
ttcgttaacaacgatatttgggcaattatcgtgcctttcctcaaaacccttgaacaaaacttctctaaccagccctccattgctggtgcaacccatttggcttatgatgcacagttgcttaggaaactaagcaacttgcacatgcttggaggaaaagctgttgatgattgggcccaagttcgaaatgaagagatagggtacatgcttcgtgcaatgcatgattgtagcaagagaggttcggagtcgaacgagttcaaggacatggtggttgagctcatgaccgttgctgggtacttcaacattggtgacttcataccctttttggcaaagttggacttgcaaggcatagagcgtgggatgaagcagctgcacaagaagtttaatttgatgcgttgtgttgcaatgttctaa

SEQ ID NO: 34009 - DNA, 633 bp, Glycine max
  Peptide Sequence Number=SeqID_150787
gaaggaagcatagatgtggcagtggttaaggaattctatgccaatttctatagtccagcagatcaagctcctaaatatgctagaataagaggccaattaatcaagatagatgcagacagcttaaatgagttcctccagactccaggccaaccatggaagctcctcagaaaatatcttaccaccctggctcagacatggagcatcttcttgtactcaaaccaagctcctacctcccgcacttcagatttgaacacagacagagctaggttggtctatggcttaatcacaaggatgaacatgaacattggcggtttgatctctggacaaatgaccatgatggctcagtctaactcttctcgcttaggcttcccagctttaatcatagccttttgtagatcgaggggagtgggatctgatgcccttacctcctatgaaaacctaaggccggccattgacttagcttatatcataaggaactgttggaatgtgaatgaccaaatagttaattttccagaggcaaggaagaccaagctcagagcagctgatgttccctcttcctttgcaccaatagttggcatccctacatcttctacttcagccctacttccagctttagcagacttatctgcctag

SEQ ID NO: 34010 - DNA, 324 bp, Glycine max
  Peptide Sequence Number=SeqID_150788
atgattatgaggagccaaaacatttatagtagccaagatgaggctactacttcaccttcctctagtgaaagtgaagaagcagaagaggaagaatctagtgaagaaatctacccccaagaagaaggacaacctttaatggttaaggaggagtgtaaggaggtaagtgtctcctccacgaggttagctatgaaggaaaggcattttgaaataatgacaaatattaaagaaacttcccctcttagacaaccgccacattttatcctttgtataaagatacttgttagcattgtcacacctcttggcttgagtttcttcctcaagtaa

SEQ ID NO: 34011 - DNA, 936 bp, Glycine max
  Peptide Sequence Number=SeqID_150789
atggggtttgttacctggtgggaaaaatattacttgacccgttcggttggagacactactatcatgatctccaggcttgagagtggctttgtgcaaccaacggtcgagaatattcgctcaagccttcaagctcgaggcaaagcacctatgacgaagaggagtgctgaaacgtctcgagctgacatgagacccaagaaacccactggggtgaaaatccaagaagggaaacaagaagagaaggaagaagaggagagacctcttataagaaaaagaaagttacctacgacttcgaccaagtttgctgaacaaacagaggcaggcaattcccaggctcaaatgcctaagaagaaaaagaaagtgaagcaggtcgagcctgaaccttctgtggctgtcgagggtggtgagccagccaagaagaaaaagaaaaagaccaagtcttcaaaagaacaaggtgaccatcaacctgttgacgtccaaccaccttcgaccgatattgacggcactgaggtaaaagctgctccttctattgctgagatgggcaaccctgtcgagcaaccgaactcaccacgagaacaacctaccgtcgaggtgcaacaaaatgtttctgcagaagaaataccctcatgtgcgcgaacatctcccgctcctgaggcggatgcagtgaatgttgaggaatggggtgaaggtcaaggcattggatccagtagtcctcatggttgggcagaggtcgatgaccctcatgagccgaaccagtcagataataccattcctcatgaatcgagtcagaaaagttcatccgaagaaaactttttcgatgaagacgccataaaagaggctgaagctggaggctcagacatttacccggtgtcctcaacatctaaactttccgctagcttagggatcgcagaagatacatttattcaaatgcaaaattaa

SEQ ID NO: 34012 - DNA, 691 bp, Glycine max
  Peptide Sequence Number=SeqID_150790
cggtcatcgggtcgttgccggcgaaggcgctctggatcatcttcgggccgttcaccgagtaggtgtagaaggccacggtgccaccggcggtgatcaggaagcacagcagcagcggccgccactggtgcacgaacagctcgtacatcgaaccggacttctgtgccttgccttcgcgtgcggcttcgatggacgactccgacagcgattcgtccatgccgcggcgcagccagaacaccaccaccgcggcgatgccaccgatgccgaaggcgatgcgccagccccactcggagatctccggcttgccccagaaggtcagcatcagcagcagggtcagctgggccagcacatggccgccaaccagggtgacgtggcgctggcaccgtactcgccaccggtggcgaagccctgcagcaggcgtgcgaacagcaggatgaccgcggcccagatgccgatgctggcggcggtgggagtgatggcgatgaggaacgagcacagcgccatcagggtgaccgagacggtcagcgccaggcggcggccgtggcggtcggcgaagcggccgaagaaccaggcgccgatcgggcgcatcaggaacgttgcggcgaagatcgcccacacgtacatcgtggagttcttgtcgtccggcgagaagaactgcgattcgaagtacacggcgaacaccgagtacacgtag

SEQ ID NO: 34013 - DNA, 237 bp, Glycine max
  Peptide Sequence Number=SeqID_150791
atggctgaattagtggcccgaacaggtcgacatcagcagcgatacgaacacggttatcgccttattgccgggtgtgttccatttaggtataaagatgactgtggagactcttgttccgagaagattgttgaagtgcttatgattaattcaactagtatcgggtcttttgtttccaaaggtacattaactttgaatttatatcctctcttgctcaaaagcaggatacagtcctgttag

SEQ ID NO: 34014 - DNA, 267 bp, Glycine max
  Peptide Sequence Number=SeqID_150792
atggaagcacctcttattggagatgctctaccagcgagactctatgctagtgatgatcgtgtgtatgtgcaacgtgtttcaaaattggggtttgatggtgatcgactgttgaagcagatacttgaaaaagggggatacacgaccacatggaaaaagttgaagcatcacggggtaccttcctcacttttgagcataaaccaaactcagaagcaatccatgcatcttctgaattcgaagaagctttaccccattattttgaatgattag

SEQ ID NO: 34015 - DNA, 628 bp, Glycine max
  Peptide Sequence Number=SeqID_150793
atggcttccagaaaaagaaagagtattggtacaagacccatagctcagtatgatacaaggaggttccactcttttgaggcttggacccgatacacagataatgttcttggaagacatatactacctaagaggaaggtagaaatataccatactgagctgggcgagtttaaggctgaattggagaggcgtaacttccataaacgcctcaccaatttagttgacaacatcatagatctagctttggtgaaggagttttatgccaacctttacagctccgaagggccttcaccaaagcaagtcagggtcagaggccacttggtgaggattgacgcagacaacctcaacacctttctggagacacctgtggtactagctgaggaaggccaccctgggaagattctcaggaaagatttaacaactcttgctcaggtgtggactgttctctcatactccaacctggctcctacttcccacaccttagacctgatagtagatcgagctaggttgatctttggcctagtctctcagatggacatgaatgtgggaactctcatctttggtcagattacatctatggaccagtctaactcttctagacttgggttccctacttttatcatcgctttat

SEQ ID NO: 34016 - DNA, 213 bp, Glycine max
  Peptide Sequence Number=SeqID_150794
atggagggtcttattccttttgtttacaaggctatcatgcaatccaagggcgacaaagagggtcatcctataggatcatggctttgtgagtctccttactcatacatgagacttcctggtgactcggtccccacatcagtgtttaacacatcgtcgaattgcagcatgaaaatgaacaagtttgtgcctgaagaaaaagccgaaggtgcttaa

SEQ ID NO: 34017 - DNA, 474 bp, Glycine max
  Peptide Sequence Number=SeqID_150795
atgattcagtgtggcaaggactacacttccaagatgaggttcgttgacattttcaaatgttggtcattcgctgcctttggactcagttgcgatgaggtcgagtcttggcttcctccgatgagtattccagagtcagggcggtggttcaatgaccttgtcagactgagatctaaccttgtcgatgccgacggagagggagaaaggttgaatcaaccgaatgggatgatttcccatgagagtgaatcagagaaagaggataagttagttaccggtggatgtgcggcagatttggtgttggaggaagaggagaaggtgctcaagagatgctccatctcagagattttcgagatgaaagaggatgttgaagaggagaagtcatcgccggagatcgagatggtgttgaaacgtttgtcgtttgacactagcgaggtttcgattaaggtcacgaagtttcagagcaactcgaggccttaa

SEQ ID NO: 34018 - DNA, 246 bp, Glycine max
  Peptide Sequence Number=SeqID_150796
atggccccgaaatctaccctaaggctcatgagaaccctagggccttctcttgcatctttggcccaaactttttggagtcttctatctaatgcccttgggggatgcttgtttattgtcacacttgttcttagttttgatggtgttggcaagaagctagggctggttcttggttttgatgatgttggtaatgcttgtttatgtttgtatgtgcttgttaatgggacttttgctggtgtgaaaaattaa

SEQ ID NO: 34019 - DNA, 402 bp, Glycine max
  misc_feature (348)..(348): n is a, c, g, or t
  Peptide Sequence Number=SeqID_150797
atggatgagtttgacttgcaggtggcctggctaggagcccagccttctccttctggagggggtggggcctccacagcccaagagcctactcttgaggagccagaagcagtagcagagggggaggatgagctcacccctcctaagccattttattttgatgcagatgcacgcatggctcagaaggaggggacttccacagatcagatacatgagccatctcctacacctattcctgatgatgccataccatctgcaccagcatctgagttagagcatcctatctctcaggattcaccagctgctcagccattagaagagaacgagcatgtgattggaagcatgactganaatgttagtcagtttgtcagattgattgtgaaggaatgcattaaccgtatcctg

SEQ ID NO: 34020 - DNA, 243 bp, Glycine max
  Peptide Sequence Number=SeqID_150798
atggattgccccctgtatgtaggaggaataactggagctgaggaaggtactggagctgtggaagaagaaggagctggtgtctcaggtggtgctgaagtagtggggacctcttatctcttacccctggccttccttggccctctaaatgtcactgttggatcatcaagattccaacatttctttttaatatatgccaagttaatgtcaaggctcaagttctccagggatctagaatctgattag

SEQ ID NO: 34021 - DNA, 1413 bp, Glycine max
  Peptide Sequence Number=SeqID_150799
atggcacaacctccaccccgtgagaggactctaagggaaatggctgcacctgatttcacctacaaaagcttgtgcatccaataccctgatgaggatgtcccatatgttctaaaaattggactgatccatttgcttccaaagtttcatgaccttgcaggtgaagacccgtacaaacatctgaaagaattccatattgtctgctccaccatgaaacccccatatggaattcaatatcgcgccggagctcataaccaagctgcagatgctctttcccatgtgactgcagatgctctcttgagcctctttgtcccttgtcctctttttatggaggagttgtgccatcaattggaggccaatgcaggataccatcgtctccggcaagccattcaatcaagtcccgcaaaacaccctgagttcacttgggatgttataaactttgtatcccaatgtctcaattgccagcatgttaagtatgaaaccaaacgtgtcaccggtctgctctgccccttaccagttccccatcgaccctgggaagacttgtccctggactttatcacagggttgccaccatttcttggcaatacggtaacattggtggtggtaaatagatttttcaaagggattcatcttggtatgcttctggcagcgcacacagcccgtaccgtagctttcttgttcatggacataagtggaacacaactgaggatgagcttcgcttatcacccacagagcgatgtccaaacagaggtgctaaacagggtcattgagcaatgcttgtgtgcttttgtccataatcgaccgcgagaatggggcaagttccttccctgggtggagtggtcacataacacttcctggaacgcggccaccaacatcacccctttcaagactacctttgggcataaaccctttaacttccttgagtatatagcagaatcatcgactttggatgctatggacgaaatgctgagcaaaagggaggaagcattccaggtgatgctcaagctgcgcccatatcgacaagtctcggcaaagggggcccaaacaactagaggcaaattggcgaaaaggttctatggaccctttcaggtgcttgaatgcataggaccaatgacctatcgtttgcaattactgaaagaagctccatcagagaacgcacccagggaagtgttggtgcaatgggacgagctaccgctagatgatacttcgtgggagaagaattgggagcaattatgtgaagactatcaccttgaggacaaggtgaatctccatggaccaacggatgatacgaagaaaggagcaagtagcagtagagacacacaatcaggggtgcagaaccagaaccaagaggtgcagataccagttaagacaaagaggaccctcacaaggtcttcttaccgcaatgactatgtctaa

SEQ ID NO: 34022 - DNA, 702 bp, Glycine max
  Peptide Sequence Number=SeqID_150800
atggttagaactagaggtttgggtcgatctttaagcagggttataggaagagccctaaggagagaagttagttgtgattcggatgaagcccccgagcggcgaaggcccacagcatctgcactccatgaacaacatgaagaagcaactaatgatgatgtagtcattgatatcaagggtttttcaagcgggccccacaacacatcaattttgagtggctatgttcatcatgttgcagtgactatttggaatggagaggaacatcctgagttgaagttatcctttcatggaaggaaggttaagaaatttaataggcctcctccagagattaaagacttagtggttgtcacaggattaagtcctctgatcgcatgttccttggagactagcaatcggggacttatatcggcttttgcagagagcttcgaggctcttcatatggacaaagtcgtcttcctgttagttgaattgcttgaagttagttcaaaagaagtaagagctgagacagtacaatgccatggcccatatgttaggctattgtggctgcaagacacttatcgtagcaaatgtgacgtagcacagtggactatagcagctcgagcatatctcttgcatctggtaggttgcacactatttgctaacaagagtgccacacacgtgtatgtggtattcttggatgcctttcgtgacctcacccagagttga

SEQ ID NO: 34023 - DNA, 1125 bp, Glycine max
  Peptide Sequence Number=SeqID_150801
atgggtttcgagctacgaccgtcgttacaaggcatcaaaagtggttgcacgcgcagtcgcgcagtcgacgaacatgttcgtcgcctgcggatcacgggggtggggctctgtgagaggcttcaaaccattggagaagaactctccgtttatgcaaacaatttgggcgtcaacttggagttctgggtggtggagaagaatttggaaaatatgaaaccagaggacataaaagtgagggaagaagaggttcttgtggtgaatagcattctgcagctgcattgcgtggtgaaggaaagtcatagggctttgaattcggtgctgcagatgattcacgggctaggaattttggttgttcttacccgtagttttctttcacagccacaaacagagatggaagctgaacaagttgaccagacttacataatggtcaagcccgacggcatgcaacgtggcctcgggtttaagttaaccgacttgaagctcttcaagtgctcaaaggaattagctgaggagcattacaaggacctaaaacaaaagtcattcttccccaagctgattgactatattacttcaggtcctgttgtgtgtatgggtgttggggtagtcgcatcggcccgtaaacttataggtgctacatatcctcttcaagctgaaccagacacaataagaggagaccttactgttcagacacgaaagaatgttgttcatggcagtgacaatcctgagaatggcaagcatgaaatagacaatatgttcggcatatttgatgtggtggaagctattgtagttgctcccgggaaaattatcctaaccggcgaacatgctgtggttcatggatccaccgctgttgcttcttctattgacttgtatacctatgtttctctctgcttctccactccttccgacaacgaggattcgttgaaactgaagctgaaggaggcagcgttggagttctcgtggtcaatcacgaaaataagagcagcatttcctgaatccacgactcagctatcttccccgccaaactcatgctctgtggaaaatgccaaggtaattgccacactcgttgaagagcttaacattccagaggccaaactcggactcgcctatggagtttctgcctttctctag

SEQ ID NO: 34024 - DNA, 1154 bp, Glycine max
  Peptide Sequence Number=SeqID_150802
acatcaagtgtgaacatggaagaggatgcaagcgtcgtaacaagaaaacttcgcttatcggaggcacaacattgtttgcaatcgccacgctaacaacggccatgatcacaacattggtgttataccttcgtaggcaaaggatcaaaggagaaaccgaacaaagcctaagcagggcacgcgacatattaaacgcaaacaatagtggcggcagatccgcaaagatcttcaccatgaaagagctcacaaaggcaacaagcaacttctccaaagccaacctcctaggtttcggcggcttcggtgaggtcttcaaaggaaccctagacgacggaaccatcacagccatcaagagagccaaacccggcaacataagaggcatagaccaaatcctcaacgaggtcaaaatcctctgccaagtcaaccacagaagcctcgtgagactgttagggtgttgtgttgaacttcccgagccccttcttgtgtacgaatacgtccccaatggaacccttttcgagcaccttcaccaccaccaccacaacaacaactctagtaaagggattcgactcgggtggcattcgagattgcgaatcgcgcaccaaaccgctgaaggaattgcatatcttcacaatgcagctgtgccaagaatttaccatagagatataaaatctagtaacattcttttggatgataaccttgatgccaaggtttctgactttggtctttctaggttggttgtgagtgatgcaacacacataaccacgtgtgctaaggggacattagggtatcttgacccggaatactatgtgaactttcagctcacggataagagtgatgtgtatagctttggcgtggttttgttggagcttttgacttcgaagaaggcgattgatttcaatagggaagaggaggatgtgaacttggtggttttgattaagagggctttgagggaagggaggttgatggataatgttgatcctatgctgaagagtggtgatagtaggttggagttggaaactatgaaggcgtttggggctcttgctattgcgtgcttggatgatcggaggaagaatagacctacgatgaaagatattgctgatgagattgagtgcattattggcattcttgttggtgctaaggttgatggtttgggggtttag

SEQ ID NO: 34025 - DNA, 1887 bp, Glycine max
  Peptide Sequence Number=SeqID_150803
atggcctcctctgataaacttgatgaaattctccttcgattatccaacaatcagctcaccctgggtgaatccatgaacaacctgactcagaaaattgatgctctccttaacagagtcacccccatcctgtccccctcaccttcacccacttcatcaccattttcgccggcttaccatagcttcgttttacatggaaggccgcgtgctcgcttggttccagtggatgactggaaatgtccaatttacgtcgtggtcggtgttcctgtaggccctgcaaacacgattcgcaccatcacgttgttttttctccggcctaacaccagagataagcgtgaagtccaagcgcaccaacccccgacattaacccaggtcacaggtttggcgcgtttgcaagaagagaaacttctcgacgtctgccatccaccccggtcacgcgccccaccgatgacagttgtaccaccacccactctagcaaagcttcccagaactagacccctttcgcccttgttacctccaccaggccgccagactctatcagtccaagtggcaccctcagacccggactcagcccaaatcaatttccaatccttggcgggtcaacttgctctgaatacattgcgcatgctaggctcgcttttcagccaccaagtggttgtgttggtggatggcagaagcacccacaacttcatccaacaagaattggtgactctcttgcaattaccgtgccacgcaacctcaagccctttacaggtcatggtgggaaatgggcaacaccttcagtgcacaaattggtgcgaagccattaccattgatattcagtcctcgaagttcattgtggatctccatgtccttccaatcttcagtgccaatgtggtgttaggaattccatggctcaaatccttaggtcatgtccttacggactataacactttgaccatgcaattcatccatgaaggcagagtggtagagctcaagggagatacagatgtagtgaccattccccatgatattcctctgcccatccaacccattctgaatcagttcgcgtacctgtttcaacaaccctggtgcctaccgtcggagcgtgacactgaccatcatatccaccttctttcgcaatcaacttcgaaaggcctcatacagcctagcacgagccctttctcttctccggtattgttggtgaagaagagtgatgggtcatggcaattctgtgtcgactactgtgccctgaatgccattacggttcatgatcatttcccaattcccaccattgacgagcttctggatgagctcggcggcgctagatgtttctctaagcttgacctccttcagggttaccaccagatacgaatgcattccgaggacatgcccaaaacggcatttcgcacacaccatgggcattacaagttccgcgtattatctgataatcaattcgttttgaaaataaccaagtacttctttgcccaaaaccaggttgagtatctgggtcacttggtcttgcacaaaggggtggaaccactagcctctaaggttgaagccattcaacaatggccaacatcgaggacggtgaggactgttcgcagtttcttggggatggtcggattctatcgatgttttattcgtggatacggttcgatagcagctcccctggtccatgtcaccactttggcggaattcaattggtcaccacagtcccaggctgcctttgaccaactcaagcaagcattatctcaggctcttgtccttgccctgccggactttgaccttcccttcaccattgaaatggacgcgtcgagggttggtatggatattcgtgattatagcggcgatgaagaaatggaggcagtacttgcttgggcgttgctttacaataattacagaccataa

SEQ ID NO: 34026 - DNA, 645 bp, Glycine max
  Peptide Sequence Number=SeqID_150804
atggctgacaatgctgtttttaataatgaagcttttgcaaaattgttgaatccctattatactcatcccaatgaaaatcctgcaggtgttgctattgttgctcaagttctcaatggtggaaattaccactcgtggtcgcgtgctatgctccttgtcttaaagaccaagaaaaaggtccagtttgtggatgattctttgcctcgtcctgctcttaatgatcttaatttcactatatgggatcattgtttaatccaagaattagacaactttcgccctattccttcatgcacatgtgctgttgtttgtgcttgtgatatcattcctgttattaagagggataccagccatggtacttatggcagaggcagaggtcgtggaggccatacatcaggtggaacaggtagaggtagaagctcaaagatatgcacttattgtaacaaaacaagtcatatggtagacacttgttacaaaaaacatggttaccctcctcacttgcatagaggaggtgttatcaatcagtactttatggatgatcaagaaattgaagatgatctacaatctctcagacagaaagaggtgtctgcagatgcttcatctgtagctttcacaccaaagcaacatcaggcacgtctttccttgttgtag

SEQ ID NO: 34027 - DNA, 898 bp, Glycine max
  Peptide Sequence Number=SeqID_150805
atgcctcatcccccacacccttccccacctgagatatcaagctctctaattgattcacaccatcaatcagccttacctcaaccctctcctcgcaaatcacaaagacagaaacaacctccttcttaccttaaagattaccactgctctcttctttctgccacagctcacaattcagtttctccaatctcctctaacataagggttggcatctccatcaacttgatgttaacattgcattttttgcatggtgatttgaatgaggaggtatatatgaaggttccaccaggattccaacaatccaaggcagattattctcttttcactaaaaggtctcccactagccttaccattgtccttgtttatgttgatgatttggtgcttattggcactaatctttctgaaatccaacaattgaagcactccttggatgcaaaattcagcattaaagatcttggaatgctcaagtacttgcttggttttgaagtagcccgatccaactcaagtattgccttgcatcaaagaaaatattgccttgatctccttcaagacaccggtctacttgctgcaaaaccctgttccctacctatggatcctacactaaaacttcacaaatcttctggtgttcctctttctgatcctattgtttacagaagacttgtgggacgattattgtatcttactcacacaaggcctgatatttgctatgttgttggcaaattgagccaatatttacaatctccaacagacattcacatgcaggctgcacaacatactctcaaatatctcaaaggaaatcctggaagaggcctatttttctcctcttcatcttccacttctttaactggattcagtgactcagattggggagcttatcttgacactcgaagatccatcacag

SEQ ID NO: 34028 - DNA, 705 bp, Glycine max
  Peptide Sequence Number=SeqID_150806
atggctaaaaaagctgttgtcaataatgcagctcttacaaacttgttgaatccctattatactcatccaaatgagaatcccggtgtggtacttgttgctcaggttctcagtggtggaaattaccactcatggtcgcgtgttatgcttcttgctttgaagaccaagaaaaagtctcttgatccagaaatcttgcaaaccatcatgtggatggagaatgcatcggatagctggaatactctcaagaaacattattaccaaggagatgtatttcggatcagtgacttacaagaagaaatttatctacttaaacaaggtgatgccaatatcactacttactttacaaaattgaaaggtttaatccaagaattggacaattttcgccctattccttcatgcacatgtgctattgtttgttcctgtgaactcattcctattgttaagagtcacagagaaggtgattatgtgattagattcttaaggggcctcaatgaccaatactctacagtaagaggtagaggtcatggaagctatacatcaggtggaagaggtagaggcagaagcacaaaaatatgcacttattgtaacaaatcaggtcatatggtagacacttgctacaagaaacatggttatcctcctcacttgcatagaggaggagctgtcaaccagtattctatggatgatcaagaaattgaagatgatctataa

SEQ ID NO: 34029 - DNA, 180 bp, Glycine max
  Peptide Sequence Number=SeqID_150807
atggatccttatccctcgggatcccttttatcgaaagtcttcctagcggtgagtggtccaggcagtgtgtcctgcagatggagcaacggtgcaaagggggaggctatcatgtggaagagactcacacttgaggggagattgctggagtacaagtgtgagttcaagtttcacattgggtag

SEQ ID NO: 34030 - DNA, 465 bp, Glycine max
  Peptide Sequence Number=SeqID_150808
atggagatctacatcgagtcgagtcaatatagaatttttctcatcatcaccaatggggatattcccattactagacctgaagctgaatggataaatgacgatctggccattatggagctcaacacaaaagccaaatatactctgacatgtgccctatcaaaaaacgagtccaacaagatctgcaaaataagaattgctgaagagacgtattgcaaagctcaaataaagttgaaggtgttggacagctttctcaaggtgtggaaacccaagaccacaaccatccaagaagcaagagatttgaaaaatcttgcatgggatgagttgttgggaatcttgagagttcatgaagtccaccttcaaaacagggagcatctgcaaaagaaaaactctattgccctcaagtatgaagaaacaatcttcaaaagagaagaaaatgcaagcttgtctaaagctctgaaagtgtag

SEQ ID NO: 34031 - DNA, 426 bp, Glycine max
  Peptide Sequence Number=SeqID_150809
atgaagaagaaaggaaaatttcaacattcctctaaacacaaagattccattttcaaaaagaaaaacaaggaggaaagcaatgagatcatctggtttgagtgtagaaagcctacatacatgaaggttgaatgtccttggctgaagaaaaagagatattttggggacaagaagaagaaaagtttgatggtcacttgggatgactcagacaatgataagagtggcagtttagatgatgaactagccaacatttgtcccgtggtagataaagacgataaggtcaagattaaaacatgttctaaatttgctacctcttcttttgcttcattagacgatgaagagggggaagaagtagcatgtcttactaatgactttgggaagttcttggaaagttcaaagactctcaccactcctttgaaagtccattaa

SEQ ID NO: 34032 - DNA, 228 bp, Glycine max
  Peptide Sequence Number=SeqID_150810
atgaggaaggatcttggatcaagagtccctttcatgcttttggattacaagtgtagcccggtagggtgcatatttgtgcctgggcccttggaacaaaaatcaaacatcttgaataggggacttttttctatcaaagaaagtataattataaggagatccgaaagaagtttaggttggaggagtatatcctatgaagtattcgaacacgtctatgtattggatgtataa

SEQ ID NO: 34033 - DNA, 2013 bp, Glycine max
  Peptide Sequence Number=SeqID_150811
atggaccaacttaacattgcaatgctaatattcacaactatagcattgtttctatcacgtgccgaggccatgcgtaagtgcgggaattgcggtttgaacccggttccgtatccgttaagcactggacccgattgtggtgacccgtggtacaagattcggtgcaccgcgggtacactgtggttggatgcactcgccgggtcagcctacctgatcagctccattgacccgttaacccgtagtatcataacccgacccgcttcaattacaccaaagacatgcgtgtccacggacttccacagcgaaggcatgcacctgaacgaaacccttcctttcagtgtggcttcaggaaacaccgtttttctcttcaactgcaccacccacgcgccttcgatgaactgcgccgcaagcggcacgtgccacaggtatgttaaggagcacgcggatttcggcgcgtgcgggcgcgtgggagtgtgctgcgagtacaagagtgctggatccctcaaagaatacgtggttcgggtacacggcggaggatgcgcggcgtatcagagttttgtggattttaacggcacggcggcgggaaagcggtggccggagcctggggtagggatcaagtgggtggcaccacaggaaccggtttgtaaggcgccaatagattgcaaggaattgttgaactcgaaatgtggagtgggccccgctggtggtgttgtgcaaaggtgcttgtgcaatgttgggtttaagtggacccgatcaatgatacaaagggcaaaggacatggaaaagatagcaacggcaaagttcggaagaaaaagaaaatgcttctggctggtttcttctgctatatgccaacaattaacagttcggatcactggcgctataatggttgcttccttaggaggaatattctctattgtaacagttataggagtcattttctacaagaagcataatcaagcaaagcaggccaaaatcaaaaagaggaaagaaatctcaagtgccaaagccaatgctttatcatcaagaatcttcactggtagagagataagaaaagcaaccaacaatttctcccaagaaaacctcgttggcactggtggctttggtgaagtcttcaagggaacatttgacgatggaaccgtctttgccatcaaacgtgccaagcttggatgcaccaaaggcattgatcaaatgcaaaacgaggtccgaattctctgccaagtaaaccacagaagcctagttagactccttggttgttgcttggaacttgaaaaccctttgctaatatacgagtacgtctcaaatgggacccttttcgactaccttcatcgctactcttctggctctagggaacccctcaaatggcatcaaagactcaaaattgcacaccaaacagctgaagggctttgctatctgcattcagcagccgtgccaccaatttaccaccgcgacgtgaaatcaagcaacatacttcttgatgacaagcttgatgcaaaagtttctgattttgggctatctaggcttgttgaattggctgaagagaacaagagccatattttcactagtgctcaagggacactggggtatctagaccccgagtattatcgtaactttcagttgacggataagagcgatgtttatagctttggagtggtgttgatggagttgctcactgctcagaaggctattgatttcaatagggaagaagagagtgtgaacttggccatgtatgggaagaggaaaatggttgaggacaagttgatggatgtggttgatcctctgcttaaagagggagctagtgcgttggaattggaaactatgaagtcattggggtatcttgcaactgcatgcgtggatgaccagaggcaaaaacggccttcaatgaaagaagtagctgatgatattgaatatatgattaaaattgttaagggtcaggaaagattactcgaggctagcttctttcatgaaccaaatgggggttacttaccggaggatgaattgtgggatggtgatatatga

SEQ ID NO: 34034 - DNA, 366 bp, Glycine max
  Peptide Sequence Number=SeqID_150812
atgaaaacaataaattctcgttttcagttgagaacaaaaatctcatttcgggtaagattactcaaggctaacttcttaatccatgaaacaaacaacggggcattgtctagaggaaggagaagtcgtagcaaggtttccataagtgaacatgcggaaggatcattgtcgatgtctcacaatcagattgacccgcgaatttgtttatccatctaccggcgggagggaatgaccacgacgccccgtgctcccgaccaatcggacggtaaattccgtccaaggctaaatactgacgagagaccgatagcgaacaagtaccgcgaggcaaagatgaaaaagactctgaaaagagagtcaaagaggacttga

SEQ ID NO: 34035 - DNA, 543 bp, Glycine max
  Peptide Sequence Number=SeqID_150813
atggtcgtcttcgagggcgcattggatctcagactgaagcacttgagcgagatattcgtcggcgctggacttggtagcgaaggcgttggcgaagcgaagagagggtgcgatagtagtagtcgctgtctctctgcggagaacagagagagcaatgtggaaggttctggaagaagacgatgccatggccgtgcggcgcgccagctgaggcagcacggcggaggagacgcggcgaagcatcgcgtacatggccatttctgtgtgtgtgctgaacagagagggagactcgaggcgcagagcaaagggtttaagcagtctttttcatctttgcctcgcggtacttgttcgctatcggtctctcgtcagtatttagccttggacggaatttaccgtccgattggtcgggagcacggggcgtcgtggtcattccctcccgccggtagatggataaacaaattcgcgggtcaatctgattgtgagacatcgacaatgatccttccgcatgttcacttatggaaaccttgctacgacttctccttcctctag

SEQ ID NO: 34036 - DNA, 531 bp, Glycine max
  Peptide Sequence Number=SeqID_150814
atgaatgctaagattgcagattttggcatgatgatactctgtatccctcgcatttggtcttgcaaaaagcatgtgctaaaaaatatcaaagacctgaagcttgagcatggtggttttatcagcagcactgagcacactaagatgagaaagaaacttgagtcagcacccactccaacccccacaacgaggagcttgaactcgaagtcttcgacactgaataactccttgaagacagtgtatgtcaatctgagaaagttctcgttcctcgcaagttcgattgaagccaatggtgagcgtttgtacaatggtgaggtgagaagcagcgagagagagggatgggctacattggcttacctgtcagtgacgtgggctgacagcggaggtgcaatagaggcatggtgctcgcagaggcacaacgtgtttccttatcaagttgcaaaggggagtgacagaggactagagttgcaaacattttatttggggataatttttaattccgacagatttgattccttcgataaaatctgttag

SEQ ID NO: 34037 - DNA, 669 bp, Glycine max
  Peptide Sequence Number=SeqID_150815
atgcaaaacgacgtcgtttattgcataaagcttgattttgtacttcttgttgttggtggtggtggtggttgtagaagttttagaaaatatcttagcattgttaaattgtgtaaggtatctttcggagtaaggcaatatccggtaataacagctttgaagccaatcttcaaggtcgaagttcctgttgattttccttttgacattgaggacaatcctggagaaagaaccatacaactaaaaggaaaatttggagatgaaactatcaaagttcaagttgacatccctaatgtagcacctggagaagaaaatgaggatgacgaaaatggtgacaatgagaagaatgatagtgaatctagcattcctttagttgtgagtgttttcaaagaaaatggagtgtctctagagtttggtgtgactgcttttcccgatgagatttccattgatagcttgtcaataaagcagtgtgaggaatctgaagaccagttggcatacgaggggcctgagttcattgatttggatgaaaatctgcaaaaggcttttcacaagtatcttgagatcaggggaatcaagcctagcacaaccaatttcttgcaggaatacatgtttgctaaagacaacaaggaatatttgatgtggctgaagaacctgaagaacttcgtcgagaaatga

SEQ ID NO: 34038 - DNA, 861 bp, Glycine max
  Peptide Sequence Number=SeqID_150816
atggacaaagaagctacaaatgttcccctacattttgatctgaatacaggtgcaaagatcccatcagttggtcttggaacatgggaagctcgtcgaggtgttgtgggtgatgctgttattgctgctgtcaaggctggttacaggcacatagattgtgctaggatatatgataatgaaaaagagtttgcatctgatgcagataggggaggctctgaaaacactgttttctactggggtagtacatcgatcagtgactgtgcacctgaagatgtctcaaaggcactaactaggactcttgcggacatgcagcttgactacattgatttatatcttatgcattggccttttaggacaaagttgggttcaagaggttggaaccctgagaatatggctcccttgtgtcttccagagacatggaatgcaatggaaggtttgtttgcctcgggtcaggcacgcgcaatcggggtgagcaacttttcaactaagaagctacaagacttgcttggatatgctaagattccgccagcagttaaccaagttgaatgccacccagtgtggcagcaaccggctcttcacaatttgtgcaagtctaccggtgttcatctcacagcatattgtcctttaggctctcctgggtcatgggtaaaggggcaagtcttgaaggaaccactgttgaaggaaattgctgaaaagcttcacaagtctccagcgcaagtggcattgcgttgggggactccaaagtgcaaaggttacttcgaaatgaatctgctgtccatgaaacttgtagtccttacaaaaatcttgaagaattgtgggatggagaaatatgaaatgcagattacttttgatgaagctcgggat

SEQ ID NO: 34039 - DNA, 1848 bp, Glycine max
  Peptide Sequence Number=SeqID_150817
atgtgtttgtgcaaaccgttaagcggtatagcattgagatggaacttcttttcggatcttcaaaatccacaaggagatcttgatgggaaagcatgtgcagctgttgggcagagtagtctcatggctctctatgatctcatgtttagtcagcttgatgttacttcatcccaacttcttgtgaatgatgggttttttagggatacagctttcagaaaacaactttcagacaccgtgagctcgttactagatttaagggttattcccattttcaatgaaaatgatgctgttagtactaggaaggcaccctatgagggcaagaactgtctgcaggattcttctggtatattctgggacaatgacagtttggctggtctattggctctggaacttaaagctgacctccttgttctattgagtgatgttgagggtctttatagtggtcctccatctgatcccaagtcaaagttaattcatacatatgtaaaagaaaagcatcaaagcgaaattacttttggagaaaaatcaagattgggaagagggggtatgactgctaaagttaatgctgctgtttgtgctgcttatgctggcacacctgtgattattactagtggctatgctacagacaacatcatccgagtgcttcgaggagaaagaatcggtactgtctttcacaaagatgctcatttgtggaccagcataaaggaagtgagtgctcatgaaatggcagtggcagcacgtaatagttctagacgactccaggcaagtaaagtcctaaattctgaagaaaggaggaaaatattgctggcaatggctgatgcattagagataaatgaaagtgtgataaggcttgagaacggagctgatgttgctgatgcagaggagatgggatatgagaaagcactcatatcacgtttaaccctgagacctgagaagatctctagtcttgtaaagtctgttcgcatgctagctgacatggaagaacccattggtcagattttaaagaggactgagctagcagataaactcatcctggagaaaatatcatgtcctttgggtgtcctcctggttatattcgagtctcgaccagatgcccttgttcagatagctgcattggcaattcgaagtggaaatggtctactgcttaaaggagggaaggaagccaaacgatcaaatgcaatcttacacaaggtcattacttcaattattccagatacagtgggtgacaaactcattgggcttgtgacttcaagagaagatattccagatctgctcaaggcaaatcttgtggtccccagaggcagtaataagcttgtctctcaaatcaagggtacaacaaagattcctgttcttggtcatgctgatggaatatgtcatgtatatgtagacaaaacagctaatattgatatggcaaagaagattattagggatgcaaagattgattaccctgcagcctgcaatgcaatggaaacacttcttgtacacgtagatctgtcaaggaatggtggacttgatgaacttgttgctgaactccaacgtgaagaccatgctgttaaactggaaaacatgtacaatagggataacatgactgctatgatgtatttgctgccattgaccacatacatcaccatggaaggcaaattcaagttcccctacaaaatctatgttttgattctctatatcataaacattataatcttaaaaatctatttctttctgtcctgtttctgcagtgctcatactgaatgcattgttgcagaagactctgaagtcgccgaagctttcttaagtcaggttgacagtgtcaagttccaagagatactaatgtggcaaattggtatggtagtttaa

SEQ ID NO: 34040 - DNA, 180 bp, Glycine max
  Peptide Sequence Number=SeqID_150818
atgcagatccaaacggcgattccacgaactgtgtggctcgattttactgggagacaattggtgcaatggcctgttgaagagttaaacagtctcagaggcaaagaagttaacacagacaatcaaaggcttgagaagggagattatagtgaagtaaaaggaatcactgcagcccaggtctaa

SEQ ID NO: 34041 - DNA, 237 bp, Glycine max
  Peptide Sequence Number=SeqID_150819
atggatgcccctgacttaccagaggatgatgaggacccgctccctgatgttgattctccagaggatattatgccagcatctgaggcagactctacggaggagagtggccctggagggacagcgaatacctccacagttgttacctttgctctggatgtcactgtgctattttgcaaactcccatgttttggacagtttttgatgatgaaaactattatgttttatcttgttatttga

SEQ ID NO: 34042 - DNA, 264 bp, Glycine max
  Peptide Sequence Number=SeqID_150820
atggaaccaggagaaagcacgaccatccatataaaacgacgcgacggtaagcctctcgttctccggagtgcgatgatactcaaaaaattgggtgatcttgaagatccagcccaatgggtcagtaccatcgaaacgaggtggaggtccagaggatggggaaggagaggaagtgtgtgggtcagtgagggcgggtggaaggtgatggaggaggtcatcaagcttataaaggccatggcttggagggtctccccaagggaaagctaa

SEQ ID NO: 34043 - DNA, 564 bp, Glycine max
  Peptide Sequence Number=SeqID_150821
atggctttcgcgcactacggtcccttctggcgccagatgcgcaagatctgcgtcatgaagctcttcagccgcaagcgcgccgagtcatggaacaccgtcagagacgaagtcgacttcatcatccgttctgttacgaacaacctcggaagccccgtcaatgtcggagaactcgtcttcaacctaacgaagaacatcatctaccgcgccgcgttcgggtctagttcccaggaggggcaggacgagttcatttcgattcttcaggagttctcgaagctcttcggggcttttaatgttgcagatttcgttccgtttcttgggtgggttgatcctcaggggctcaacaagaggcttgtgaaggcacgtgcctcgctggatagcttcattgacaagatcatcgacgagcacgtgcagaagaggaggagtggccacgacggcgatgaggaaagtgacatggttgatgagttactgaatttttatagccatgaggcgaagctgaatgatgagtccgacgagttgctcaactccatcagcctcaccagggacaacatcaaagccatcatcatg

SEQ ID NO: 34044 - DNA, 1536 bp, Glycine max
  Peptide Sequence Number=SeqID_150822
atggccttagctatggtaggagaggcacttatttctgcttctgttgagatcttaacaaaaaggatagcttcaagagagtttcgagatttcttctccagcagaaagctgaatatttctgtgttggatgagttgatgaagttgttggcacttaatgctgtgctaaatgatgctgaggagaaacaaatcactgatcttgcagtgaaggaatggcttgaagaattgaaagatgctgtcttggatgcagaagatttgttggatgaaatcaacacagatgctttgagatgcgaggtggaggatgaaactaaaacatctactacaaaggtcagatcaatgttttcttctagctttaaaaatttctataagaggatgaattccaagcttgaagcaatatctggaaggctagaacattttgttagacaaaaagatattcttggcttgcaaaaggatgacaaggagaagctattgagcatgcttctatctgatgatgatgccatgtctaatgatatagcagtgatcacagtattgggcatgggaggtctaggaaaaacaacccttgttcaatccctttacaatgatagtgaagtgcagaaacattttgatttgacagcttgggcatgggtgtcggatgattttaatattctgaaggtcacaaagaaaattgttgagtctttcacatcaaaagattgtcatattctgaaggtcattgtgacaacccgacaacaaaaggttgcacaggtcacacatacatttcctacttacgagcttcaacatcttagtgatgaaaactgttggcaaatactagccagacatgcatttgggcatgaaggttatgataaatatccaagtctagaaaaaatgggtaggaaaattgcaagaaaatgcaatggcctaccattagctgctaaaacattgggaggtcttttgcgatcaaatgttgatgctgcggaatggaatagaactctgaacagcaacttgtgggcacatgatgatgttttaccagctttgcgcataagttattttcatcttccagcacatttgaaaagatgttctgcttattgctctatttttccaaaacaatctttgttggataggaaggaattgattttgttatggatggctgaaggctttcttcaacataacaaagagaaagcaatagaatcagtaggtgatgactgcttcaatgaattatcatccagatccttaattcaaaaagacagtgctattgcagaggaaaactttcaaatgcatgacctcatctatgatttagctagacttgtgtctggaagaagttcttgctacttcgaaggcggtgaaatctcaagaactgttcgccatttatcatttctcagagagatgtttgatgtctctgaaaagtttgaggccttctcatcaaataaaggggatatcatatcaagcaaagatgaagatgtcacaatagcaacaacaggggtacaccaagcaaacaaagaggtgcaagtagtgagtaaaaccaaaaggaggattgtgaggcccacataccttaaggacttcgtctga

SEQ ID NO: 34045 - DNA, 267 bp, Glycine max
  Peptide Sequence Number=SeqID_150823
atgagtagggaacatgtatacgcgatctccaatggaaatgagaatggagaaaaaattccattccaaccaaagaaggagatgattttggagaaatgggtaaaggtacgaaaaaccacatacttgtccttgcgccggcctgttgctctatcatgtgccctatgtactaccatctttgtgctatggtgtgtccttcggactggcacctccatatcatggctcagtcatgagcccttagcaatgccacctctagtccttatgactgcttaa

SEQ ID NO: 34046 - DNA, 237 bp, Glycine max
  Peptide Sequence Number=SeqID_150824
atggagagaaatgacatcgtcatggaggcgtataatgttgctagtggtgcagggatgcagagcaacacaacagcacatgacggttggtctaccgacaccgagctctggccacacgagcgtgaccatggaagaggggcatgccaacgtgacaactacacaaaacatgaagggcgatcccatgaaggagggtttcagaggatgttgttcttccaatggttgatgggattgttgatctag

SEQ ID NO: 34047 - DNA, 123 bp, Glycine max
  Peptide Sequence Number=SeqID_150825
atggcatattctgttcctatactccttcccttggatctactagtgtatgtggtaaagattgccattgtggatcaagattgccactatggtgctgttgagtgtaggcgtaagttaggtgcctga

SEQ ID NO: 34048 - DNA, 201 bp, Glycine max
  Peptide Sequence Number=SeqID_150826
atggaagtacagtgcatcgacagagtagtggaattgaaaattccagcaatcctccaaagcttcgtaggaatgcctctactacatgtgatacaattagcacttcccaatatggtccttcagatccagtattctatatgtgcttccttacaatataatgcttttacggtagtgagtttagtaatagccatgttttcagggtga

SEQ ID NO: 34049 - DNA, 237 bp, Glycine max
  Peptide Sequence Number=SeqID_150827
atgacaaaaggtgcagaagacgacgaaacgaagttagtctctgcgtgctaccagactctgagtttgacggatagcaaaagagtgtgtgcgggttaccgtatagggtgtctccgcatgtcaacggactcacaggtcacgatagcaaaaggtggggtggttgacaaaagtggggcttttgctcctacgtatcctcaattcatgatgaggaactcaaacctacgtagttctttcttgtga

SEQ ID NO: 34050 - DNA, 558 bp, Glycine max
  Peptide Sequence Number=SeqID_150828
atgtggaactccgccgagaacgccttcgccagatcgtcgtcgttcagggaggaaactgaggacgaggaagcgttgcgctgggcggcgctcgagaggcttcccacgtacaagcgagcgcgccgcggaatcttcaagaatgtcattggcgacatcaaggagatcgacgtcagagatctccaggcgcaggagcagcgccttcttcttgaaaggctcgttgactgtgtcgacaatgatcctgagagagtaggtttgcattttccgaaaatcgaagttcgatttcaggacttgaccgttgagacttacgtacatgtcggtagcagagctctgccaacgattcccaatttcatttgtaatatgactgaggctcttttaagacagttgcggatgtacagaagaaagagaagcaaattgacaattctagcagatatcagtgggattattaaaccttcaaggctaacgttgctgttgggtccgccaagctctggaaaaacaacactactattagctcttgctggtaggctaggacctgggttgcagaagtcgacaatggctttgtaa

SEQ ID NO: 34051 - DNA, 3297 bp, Glycine max
  Peptide Sequence Number=SeqID_150829
atgctcaagggcatctcaggggggcaaaagaagcggcttacaacaggtgaattattaattggtccagcaagagtgctgttcatggatgagatatcaactggtcttgatagttcaactacttatcaaattatcagatatcttaagcattcaacccgtgcacttgatgggaccacaattgtatcccttcttcaaccagctccagagacctatgaattgtttgatgatgttattcttttgtgcgagggtcagattgtatatcagggtccccgtgaagctgctgttgattttttcaaacaaatgggattcagttgtcctgagcgaaaaaatgtagcagatttcttacaagaagtgagtagccataatggaatttatgtttccactatagttggttttagtgacggttcacctgatacttcaaattcttgtcaacaggttacgtctaagaaggaccaagagcagtactggtccgttcccgatcgcccttaccgatacgtacctgttgggaaattcgctgaagcattttccttgtatcgtgagggaaggattttgtctgagcaactaaatttacctttcgatagacgctataatcatccagctgccttggcaactgttagctatggcgcgaaaaggctcgaacttctcaagactaattaccagtggcagaagcttcttatgaagcggaactcatttatctatgtttttaaatttgttcagctgcttttggttgccttaattacaatgagtgttttcttccgaacaacgatgcaccataatacaattgacgatggaggcttatatcttggggcactgtacttctctatggttattattcttttcaatggttttaccgaggtgtcaatgttagttgcaaagcttccagttctttacaagcacagagatttgcatttctatcctagctgggcatatacacttccttcttggttccttagtatcccaacttccctgatagaggctggatgctgggtgacggtctcttactatgcaagtggatatgatcctgcatttactagatttttgcggcagttcttgctttttttcttcctgcaccagatgtctatagaccgtatacctgtttggtggatatggggtttttggatttctccattgatgtatgcacaaaactcagcttctgtgaacgagttccttggacattcttgggataagaaagctggaaatcagactacctattcattgggtgaggcagtattaaaagagcgaagtttgtatgcagaaaactattggtattggattggtcttggggcaatggttggatacacaattttgttcaacattctatttacaatcttcttggcttaccttaatcccttgggaagacaacaagctgtagtttcaaaggatgagctgcaagaaagagaaaagagaagaaaaggtgaaagtgttgttatagagctgagagagtacttgcagcgttcggcatcaagtggaaagcattttaagcaaaggggaatggttctcccatttcaaccactttccatggctttcagcaatatcaattactatgtggatgtccctttggaattgaaacaacaagggatagtagaggacaagctacagcttcttgttaatgttaccggagcctttagacctggtgtgttgacagcattggttggagtaagtggtgccggaaaaacgacgctgatggatgtgttagctggcagaaaaactggtggagtcatagaagggagtgtatatatatctggctatcccaaaaggcaagactcttttgcaagaatttccggttactgtgagcaaactgacgttcattccccttgtttgactgtctgggaatccttactgttctctgcttggcttcgattatcttcagacgttgacttcgagacacaaaaggccttcgttgaggaggtaatggagcttgtggagctcactccgttaagtggagcactagtgggcctacctggaattgatggtctgtcaactgaacagcgaaaaagattgactatagctgttgaattggttgccaatccttctatagtcttcatggatgaacccacttctggattggatgcccgggctgcagccattgtgatgagaactgtgaggaatatagtgaatactgggcgaacaattgtgtgcacgatccatcagcctagcatagacatatttgaatcctttgatgagcttctgtttatgaaaaggggaggagagctcatttatgctggtccacttggccctaaatcgagtgaactaattagttatttcgaggcaatcgaaggagttccaaagatcaggtctggatataaccctgctacgtggatgctggaggctacttcttcagttgaagaaaacagattgggagtggactttgcagaaatctacagaaaatcaagtttatatcaatataaccaagagttggttgaaaggttgagcaagcctagtggtaattcaaaagaattgcattttccaaccaagtattgccggtcatcttttgagcagttcctaacttgtctatggaagcaaaatctttgttactggcgtaaccctcagtacactgctgttcgctttttttacactgtcataatctcattgatgcttgggtcaatatgctggagatttggtgctaaaagggaaacgcagcaagatctattcaatgccatgggatcgatgtattcggcaatcctcttcattggtataacaaatggcacagctgttcagcctgttgtttctgtggaaagatttgtttcttatagagaaagagctgcagggatgtattcggctttatcatttgcatttgctcaggttgtgattgagttcccttatgtgttcgcacaagctattatatactcttcaatattctattccatggcttcctttctctggacttttgatcggttcatttggtacttattcttcatgtattttacgatgttatattttaccttctatggaatgatgacaacggctgtcacaccaaatcataacgttgctgccatcattgctgctccattttatatgttgtggaaccttttcagtggttttatgattcctcacaagaggatccctatttggtggagatggtattactgggcaaaccctgtagcatggagtctgtatggtctgctaacttcacagtatggtggcgatactcatttagtgaagctctctgatggaaactcgatgactataagagagggacaaattagttgtaaggtgacgtattattggtttatagggattctgttagatatgaagtcagattactggttagtaatgacagattttggtgaaagtgaataa

SEQ ID NO: 34052 - DNA, 2490 bp, Glycine max
  Peptide Sequence Number=SeqID_150830
atgcatataggctttcttaggggaaagaaattagttatagatgcacctagtggttttctttttgagtggtggtctgtcttctgggacatatatattgccagggcaaatcagaagctccaagatacagctcagaagcaccaagaagcagcagtatcttacagtaagagtcaacaaattaaggctcgactaatgcagaagcaactggagcaagagcttcagaatacaaaccagaatcagcaaatgcaattcttattgcaaagacatgctcagcagcagcagcaacgtctgcgtggaactcaacttattagtggcagtgctagctgtcctattagcagtgatcctttgatgaggcagaaccgggcaacttctaatgctaatacaacaaaaacttatgaagacaggttgaagcttccacttcagaaagatgccttagatgacacaagcattcagcaaaaagtaattgatgatgttgctcagcttctaaacccaaaccatgccttattgttgaaagcagcagcaacaactggtgaacaggctacaggacagacattgctcagtgcacctagtattttacagggggatattcagcatgtccaaaatctgaaccagaagcttccagggtctacacaatcttggctcctgaaacaggacttaaacagtgatatgaatgcaatgatgaggtctcaagctgttgtttcagaaggatcctttatcagttgtcatgaatttgcatttgatttttggtcgacaattattctcattttaggttcaaatcaaggtggtagcaatttgactcttaaaggatggcctctagcaggactggatgagctccgctcaggatttctccagccgaataatttgatgcagtcttcacaatctttccatcaactttctgtacggcagcaacttatgcttcaggcacaacaaaatttgatttctccttctgccagtgattttgagagcagaagactcaggatgcttgttaatgatcaaaacatggctcttttgaaagatggccaatcaaattctttaggtgatttaattcctgataacaggtcacccgctcaagttggttcctcagtgctgcctcatcctgactcagatatgttccttaagcaacaaattcaaaagagtagtcagcagcatcaacaatgttcacagcaccctctttcaagccatcagtctgaatctctccagaagcaagaaaaaaatggtcctggaaccatgactgtagagggcaatgtgtccaataccttacaaggaaacaaccaggtttccataagtaaaacagggcggaagagaaaaccagcatcatcttctggtcctgccaatagttctggaactgcaaacactacaggaccacctatcagttcacctaaaacaccatctacacaaacacctgcagacatgatgacagtgtcaactctgcaacagaatgttccttcctctaagtcatcatttatgtttggtactgatggtttgggcccacttacgtcagcacagaatcaattggctgatatggatcaccttgtgggtgatggatgtttgggcgacaatgttgagtcattcttatctcctgatgatacagatgttagcaaaaaaattggcaaagaaatctcattcaaggatatcaagcatataggggcaagtttgcataaagttgagtgttgtcacttctcatcagatggaaaacttcttgctacaggtggccacgataataaggcttctttgtggtgcacagaattgtttaacctgaaatctacacttgaagagcacagtgaatggataactgatgttcgattttgtccaagcatgttgcgtgttgctacatcctcagcagacaaaactgttagggtttgggatgttgataatccaagttattctcttcgtacattcacaggacatgcaacaactgtgatgtcactagattttcaccctagcaaagatgaccttatttgctcttgtgacaatagtgagataagatactggagtattaaaaatggtagttgtactggggttttcaagggtggtgcaactcagatgagatttcaaccttgcttgggaaggcttcttgcagctgcagtggataatttcgtatccatttttgatgtggaaaccctgggttgcagacttaaattacagggccataataatcttgtccgatctgtgtgctgggatttgtctggaaaatttttggcttctctcagtgatgatatggttagagtatggaatgttgcgtccggtggcaaaggggaatgcattcacgagttgaaagattgtaggaacaaattcagcacctgtgttttccatcccttctatcctttgctggtcattggctgccatgagactattgagctgtgggacttcggtgataacaagacaatgactctgcatgcacatgacgatgttgtatcttccttggcagtatcgaatgttactggattggtggcttcaactagtcatgacaagcatttcaagatctggaagtga

SEQ ID NO: 34053 - DNA, 369 bp, Glycine max
  Peptide Sequence Number=SeqID_150831
atgtggttggtacgtaaggaagatgtgtttagagtgcaaaaagggattaagggaacaagaagctctgcgaaggaaaggattttacgcccaagggatagattagattatttagaggggtccataatctcatgcatcgacggctctcaaaccatggttgggtcaaacgctcttctttatttgtcagaactcccactccagccagcctgttctccaccctttttcctcacaaatggacacccacaccaagggcaaccatgtaatttctcactaaatttctttcccaccacttccggtgcccatgtgagttaccaacacgtgaattcagaccacactcgcaccaccatagccacaatcccatcaatcatctga

SEQ ID NO: 34054 - DNA, 1953 bp, Glycine max
  Peptide Sequence Number=SeqID_150832
atggcgttgttcattactgttgttgttgttttgttcctgctgcagctgagttcgagtgtccgagtgaactcggagccgactcaggacaagcaagccctcctctctttcctctcccaaaccccacactcgaaccgtctccaatggaacgcttcggaatccgcgtgcgactgggtgggcgtgaaatgcgacgcgtcacgctccttcgtctactcgctccgtttacccgccgtcgatttagtgggtcgggtcccacccggtacactcggccgcttaacccagcttcggatcctcagcctccgctccaacgccctcaccggcgagatcccttccgatttctccaacctcattttcctccgcagcctctacctccagaagaaccaattctccggcgagttccctccgagtctcactcgcctcactcgcttggctcgcttggatctttcctccaacaatttcaccggccaaatccctttctctgttaacaacttaacccacctcactggcctcttcttagaacgcaaccatttctccggtaaaatccctagcatcactctcaggcttgttaacttcaatgtttcatataacaatctcaacggttcaatccccgagacactctctgcgtttccggaaacttccttcgtcggaaacatagatctctgcggaccgccgttgaaggactgtactcctttcttcccggcgccggcgccgtctccgtcggagaattcaaccccggtgaagacacgtaagaagtccaagaagctctccaccggcgccattgttgcaatcgttgtggggtccgttcttggcttggcgttgttgctgctgctgctgttgctgtgtctccggcggcggcgaagacagcccgcgaagccgccgaaggcggtggtggaggagcatagcgtgccggcggaggcggggacgtcgtcgtcgaaggatgatatcaccgggggttcggcggaggtggagaggaacaagcttgtgttcttcgaagggggaatttacagtttcgatttggaggatttgttgagggcttcggcggaggtgttggggaagggtagcgtggggacttcgtataaggcggtgctggaggaaggaaccaccgtggtggtgaagaggctgaaggatgttgtggtgacgaagaaagagttcgagacgcaaatggaggttctggggaatattaagcacgagaatgtggttcctctcagagccttctacttctccaaggacgagaaattgctcgtttatgattacatgtccgctgggagcttgtctgcgctgctacacgggagcagagggtctgggcgaacaccactcgactgggacagccgaatgaaaatagccctaggagcagcaagagggctgacatgcctccatgtggcaggcaaggtggtccacggcaacatcaaatcttccaacatcctcctccggggacccgaccatgatgccggcgtttcggacttcggcctcaaccccttgttcggaaacggagccccgtcaaaccgtgtggcgggataccgggcacccgaagtggtcgaaacccggaaggtgagcttcaagtccgacgtgtacagcttgggagtgttgctgctggagcttctaacgggaaaagcgccaaaccaagcctcgctcggggaagagggcattgatcttcccaggtgggttcagtcagttgtgcgtgaagaatggaccgcagaagtgttcgatgcggagctcatgaggttccaaaacatcgaggaggagatggttcaactgttgcaaattgctatggcgtgcgtttccgttgtgccggatcagaggcctagcatgcaagacgtggtgcgtatgattgaggacattaaccgtggcgagacagatgatggcttgagacaatcttctgatgacccttccaaaggatccgagggtcacacaccacccccagagtcaaggactccacctaggtcactcacaccttaa

SEQ ID NO: 34055 - DNA, 732 bp, Glycine max
  Peptide Sequence Number=SeqID_150833
atgtatatcatgcataatcctctaacatcaatctttgattcccagactctaaaactttcagctcctcttgcaactggtcttattttggtcgcatgttgtcctggatgtcaggcatcaaatgttgcaacattcatagccaagggaaatgttgcactctctgttcttatgacaacgtgttcaactattggagctattataatgaccccactccttacaaagcttcttgccggtcaactcgttccagttgatgctgttggcctggcacttagtacctttcaggttgttttagtcccaacgattgtgggagttttggcaaatgagctttttcccaagttcacttcaaagataatcaccgttactcctttgataggagtcattttgaccactctcctttgtgcaagcccaattgggctagcttcagacgtattaaaagctcaaggagcacaactagtattgccagttgttttcctacatgctgcttcatttgctcttggatattgggtttcaagaatatcatttggtgaatcctcgtcacgcactgtatctatagagtgtgggatggagagctctgcatttggatttttgcttgctcagaggcactttacaaaccctcttgtagctgttccttcagctgttagtgttgtctgcatggcgcttggtgggagtgctcttgctgtgttttggacgaacagaccaattcccctcgatgacaaagatgacttcaagaaatga

SEQ ID NO: 34056 - DNA, 243 bp, Glycine max
  Peptide Sequence Number=SeqID_150834
atggaagaggaatgggacactgcttacccggcgaaatgccataagaaaaggagtggtggggaattctggagtttgggaaaaaaggctaaagagttttacaacgcttttcttttcttctttttttttttcaccgctcctgttatatcccaggcgcttttgtctcccgtgtatacacggttattttttcttaccaaggttaattatggtggattgagaaaagaggaggggaaggaaaattcctaa

SEQ ID NO: 34057 - DNA, 654 bp, Glycine max
  Peptide Sequence Number=SeqID_150835
atggtttctcttgtctctttccttcccattttgataagtttcgtattcctttttgtctttatggaagtgaaaggccacttttatctaaccaagagtggaggaagctgtgcaattcgaagaaagttgcggggtccagttgttgctgttttagaacttcccttaagccttcaagcgtccagaagaagtgagagtcatggagatggaggtgttgtgttgacttctgaggacggatttgaaggaatggaatcaatattgtcacttctacattacttgcgggctatgatgaaatttaaattcttttcagagaagccactgagtgatgaagctacaatttctatgaagaagaaatggaactctaaaatattgtgcaatgctacaacagacatttctggtgatattcctgaaagtgctggtgagctgagccagtacgagaaagtgattgaaatattaacagctctttttcctgtgtggctacgtacatggttgattggaaatatgttcattaactgctgtcaagttatgtctctattccaggtgggtgtagggtttcttgcacaatatttaattaaacccatgctaggctttgccattgcaatggtacttttgtcattgcctgagcacttccatgcttcactgtctctttgctttgtttag

SEQ ID NO: 34058 - DNA, 240 bp, Glycine max
  Peptide Sequence Number=SeqID_150836
atgagtttctccgccgtggtgggacctaacgggagcgggaagagcaacgtcatcgatgcgatgctgtttgtgttcgggaagcgagccaagcagatgcggctgaacaaagtttcggagttaatacacaattccaccaatcaccagaatttggatagtgcaggggtttcagttcattttcaagagattgtggattcgatgtattggctatatggtgaaatcaagtttacaagtgcaatttaa

SEQ ID NO: 34059 - DNA, 202 bp, Glycine max
  Peptide Sequence Number=SeqID_150837
gtgctcctctcctcatttagttctcgttcgttctcgttccgagggagacgtcgatttgttctccatggagaggtcgacaaaggaagatttcatcgggaagcagttgaagcagcaacttacgagaaccgccacagagctggccttcctgcgcggaggaaacggaaccaaaggcagagcgggagcacgcgcggcagctagctag

SEQ ID NO: 34060 - DNA, 99 bp, Glycine max
  Peptide Sequence Number=SeqID_150838
atggaggtagtccctaccgccacaacgttgatatcaaagggaatgatatctctagaaaccattgagagagatataaccgccttgggaagttatcactaa

SEQ ID NO: 34061 - DNA, 616 bp, Glycine max
  Peptide Sequence Number=SeqID_150839
tgacctcaacgcaaggatacttcaaggagttcacaaggcatgggatgcagtgcaaaggaaggacaaagagcttaagggaagtagtaatgggatcatcgacggctatcgtcaggctgcaagagaggaagaggccgaagctccggaagaaagtgaggaggtacaagccctaaaggcgaaacttgagaaaggccaagcaatcaaggagaagttcaagtcaacagccatcaaagtccgaagggagtgtgatgaactgaaggatatcaacatggccactgccgaagacttggaacgggaaaccaagagggcccggaagaaagaacatggccgaaacaacaatagtgagcttaagctccaaagagacgagagggatcagtcacgggtcgaaggcatgatcttgaaggacgagttaaaggcttgccttagaagatctaaacctagcggcaactatgaggataggctagtggatgagtacaccaaggtatcagtggaaaaggaagcaagggggagggccaaagcaatggcagacatgtactcggccctcaaagaaattcacgggctcctcaactattgccagcacatgattgatctaatggctcacataattaggagtcgttaa

SEQ ID NO: 34062 - DNA, 312 bp, Glycine max
  Peptide Sequence Number=SeqID_150840
atgccccggtgttcccccatgatacgtgtaggtcgcgttggggttgtaccactttgggaagggagactggtaaatccttccaagggtcacaactgccaattagttggcgatcagcgatggcaacaggtctccatatgtcaatgggattggggcaaactccaaaagcttattcgtcagaggacgtccttggttggatgggagttgagccagaagagtttccggcatgggccaaaaaacttgggtggtgttgagcatactgatgagtaccatgcgaagcttattgaggcttcgaccaagcaggtgctgaggtga

SEQ ID NO: 34063 - DNA, 318 bp, Glycine max
  Peptide Sequence Number=SeqID_150841
atggttatctgcaccttcatcaaccagaggcaaacaagcccattgacatgcagagaccgatatggtcatctgcatcctttcgtcgaagattcaacatctattgacagagactactttagcctcacctttgtcatccagagacgtcggaggcaagtgagcccgttgacacgcaaagacgagtatggtcgtctgccccctttggtcgaggactcaatgttgttcgacctatacagttacagtctacccttcactatccagagacagacgagtccgatagcatgtggggactgtaatggtcactcgcttttgttgttctga

SEQ ID NO: 34064 - DNA, 1218 bp, Glycine max
  Peptide Sequence Number=SeqID_150842
atgaaggctcacgggatttgcatttttctagccctagatcaccattttgtgcatttttggttccatttggcgttggtgttcactccatacaagaaatttcctcaagaaagcttccaacaaaaaggtccaggaaggacaccaccgaagaaggctctagcgctgcccagccagctgacacagattttaacaggcaccgattcaggagcaccgagcattagcagcacttcgagaccatcaagggatggtcattcctcagagagaggcgggcgctgggcaccactggtgaccaccatggctaaatttgacccagagataggagcttgggatatgcgctcctgggtgaggggccaatggatcccctttaacgcagatgccctcagccagttcttgggccacccgctaattttggaagaaggtcagctatgtgaatacatttggaggaggattcaggtctctggctttgacgaggaggccattgctcagcttttgtgcataccggggcaggatttcgctcgaaccattgtagggagacgggtgaggatcatgcgcaccagcatgaccaccctgacccagatatggatgacgttgctactcagcaacattgatgcaatcctccctaggacgggaccagtcactagagccatgagcaagaggctccaagatgattgggctagagctgctgaagaaggccctaaggttctcatcaaccttaggactcatcttctccttgaagtggcatctccaatcatctttctacttctccattccgctgcaatcagacctcaagaagcaaaggaccccattgatgaagaagatccaaggcctacaagctccacatggagctacatcaaacatcctacccagaacggcacctacgaggcaccttatggacccgaaaaagtccaacagggccctgggtttcctcgctctgatcacagggcgaggcaccacaatagcttggagatgcccagtcgcaggaagttgatgcaccgctgtcttctcagagtccacctcagctcacttgcggaggatcctaacacttatgcatggcctacccatgagcagttcgaccccacagtggcatggcctggagattggcccgatgctcagacaggggcagggcatgcaggcacctctggagatggatacggaactgaagaagatgatgacatggctaacgtgatggacttcttccttggaggaggcggagatgtatga

SEQ ID NO: 34065 - DNA, 942 bp, Glycine max
  Peptide Sequence Number=SeqID_150843
agagggctccacgtcctcgcctctagagggctgcacgtcctcgacttcagaaggctgtacgtcctcaccttcagagggctacacgttctcacctccagagggctgcacgtcctcgcctctagagggctgtacatcctcgccttcaaagggctacacgtcctcgtcttcagagggctacacgtcttcaacttcagaggtctgtatgtcctcgcctttagagggttacatgtcctcgccttcagagggctacacgtcctcacctccagagagctgcatgtcctcacctccagaaggttgtacgtcctcgccttcagagggctacacgtcctcgccttcagagggctacacgtcctcaacttcagaggtctgtatgtcctcgcctttagagggttacatgtcctcgccttcggagggctgcacgtcctcgcctatagagggctatacattctcgcctcgagagggctacaaatcctcacctccagagggttgtacgtccttgccttcagagggctacgcgtcctcgacctcagagggctacacgtccttgccttcagagggctgtacgttcttgcctctagagggctgcacatcctcaccttcagagggatacacgtcctcgacttcagagggctacacgtcctcaccatcagagggttgtacgtcctcgccttcagagggcttcacgtcctcacctccatagggctgctcgcctccagagggctgtacatcctcgccttcagagggctacatgtccttgacttcagagggttgcacgtcctcacctttagagggctacacgtcctcgcctacggagggctgcacgtccttgcctctatagggttattaattaggcaagtttgtgaagtgctaatttttaccttatcgctaagccaatctgctggcttagcgagtcatccgctgagcgcaaccctcctcgactga

SEQ ID NO: 34066 - DNA, 579 bp, Glycine max
  Peptide Sequence Number=SeqID_150844
atggtggcccgggagatgttggggaatggttacgagcccggaatgggtttaggcaaaaacaacggcggcagaaccagcctgataagcaccagaggaaaccgtgggaagtttgggagctttataagcgtgagactaagacacgaaggccaagtcgttgcaatatgcgaggatgactttccgaatgggtcagatctggtaataatacctgggaaccgatcatcgatttcaagcaagaaacggatcagacggagagtgaagaggacgaagatgtgggacttccccggagaagtaaagataagcacgggtatgatcgcacccatccgtgaagaattgatggccctgctaaaaaactaccaagacatctttgcctggtcataccaagatatacccgtgtcgcaacgtgcccttcacgggcgagcgaaggcgaggctcacgggtgagctttccaaaggaggaaagatgcgcggagtcgccaccaacgaaggtattagcacctctcacgtcgacaaaagcggggctcttgctcctacgtacccttcatcgaagaggaaatcagacctacgtagttctttcttaagc

SEQ ID NO: 34067 - DNA, 312 bp, Glycine max
  Peptide Sequence Number=SeqID_150845
atgaacggtaagtggcgggcaaagaagaaaaaggagctggaagggccaagattcagtgctctcatattcatgacgcatcgatctgattatagacaaatagtgccatggcaacaagaacccaattttcagtccaatcatgtacgcacaaaagatcaaaatggtgtgggggatgctgttgttggggctaacaccaccaatgttttggtgagaaacggaggatttgaaaacgacaaggataaaattgcggacaatgatcctccctcataccctcatttaacaaggatggcttcaggcactgccgcattgggatat

SEQ ID NO: 34068 - DNA, 291 bp, Glycine max
  Peptide Sequence Number=SeqID_150846
atgggaaagaatgagatgaaaattattggaatgacgatcatggttatgttgatcttcgtacaagctgattactgttatgcatcaatgaaaactcagccagacaagcttacatgtcctgcacaatgtggcatagattgtttagtagctaacattggctatccaatatgttttgctatttgtgttgcaaaatgccgtaaaacagcgacaatcgataaatacgattgtattactggttgtggtgtgaacaaatctattaccgtcaatattggtattctttatcttccaacatag

SEQ ID NO: 34069 - DNA, 360 bp, Glycine max
  Peptide Sequence Number=SeqID_150847
atgtttgtgagaataatcaaaccctccttgaaaggctgctctggcatcagatttgagatagtactagaagtagaaggcattgtaaaactgctgaatcacaacatgcgtgtttgcccttcagcctcagctggactccgatccatacaggaaggtaccccagttgataaccctttgattgaggtatctaggaacaaagctttgcatggtgacagttttcaagattgcttttttgaagaggcactgaaggttgtcttgcacaaagttgagtgtacaaggaatgaccttgagactgggagtttacctagtcctaataaaattaaggagtgcagatcgtatccactttataaatttgtcaattga

SEQ ID NO: 34070 - DNA, 393 bp, Glycine max
  Peptide Sequence Number=SeqID_150848
atggcctgcccccccctggaaacggctcagcccggaggtagggtccagcggctggaaagagcaccgcacgtcgcgtggtgtccgggtgcgccccccggcggccccttgaaaaatccggaggaccgagtgcctccccacgcccgggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctggcttccgcggcgagagcgggtcgtcgcgtgccggtcgggggacggattgggaacgggcccttcggggcctcttccccgggcgtcgaacagtcaactcagaactg

SEQ ID NO: 34071 - DNA, 276 bp, Glycine max
  Peptide Sequence Number=SeqID_150849
atgagtttcttgagagtttggagagcaaggagttgtgacgtaggagttatggcaacgaagtcactacaacgaagatctggtgaggggagtgctagatctggatctgtaatgtttagtatgcaacaacaatgggttttggcgattggtagtgtcttcgatgagggtggcgaacctaatgccgaaggcactacgggatgctccattggggcggtcttagaggtgatgaggttgtctggatcatcaaggggttctttcgacgatggtacacaacaatga

SEQ ID NO: 34072 - DNA, 675 bp, Glycine max
  Peptide Sequence Number=SeqID_150850
atggattctgttacaattgtgacagattcacaatctcaaggaagccagccaaatgtcccaactgcattgaaaaatttcagtttgtctcaaaaggaaaaaaccctgcatgagctcgtgcgggaccagtggcttgatctgacaacagatggtgttataagacttggcctaaagtcattccttgatcttcgcagttggtttcgaaataatgatcttccatcctgtcatgtttgcaatgaagctggaataaaggcagaattatgccaaaatgaaaattgtactgtacgaattcatcattactgcttgaagcaacttttcttgcagagaaaggttgccgaagtttgcccaagttgtggcacttcatggccatatacagtacccaaggcagaggccgagcagactgaagatgacaatgaacctagaggaagcaaacaggtgattaaatctgaacgaaagaggcgaagagccaatagggttgttgacgatgaagttggaagcaacaatcaggatgagctgaatgaaagtagagaaagccaacatggtaatggtttagtacagaaaagaggcagaccacgtagatctgatgatgcagatataggaggatctgatgcatctcaatctttgacagctatttctgatgcgagacgagtaactcgaagttctgctcgtctgtcgtaa

SEQ ID NO: 34073 - DNA, 507 bp, Glycine max
  Peptide Sequence Number=SeqID_150851
atgtcgagcgcgttaaactggagacaccatgtcgtgattcaatctctgttgtcgcggggcccactcagcgagaaggacttgcacgccatgtttcaagacctcacaaagcgaaacccaggattgacacaagtggtagggcttgtgtcttttaaccaagtggtccaggattggcatcctggttggttcttaagcactgagcggcaactgtttgatagttttattctgaaaataaacaaggcgcttagttgtgctaattttgagttgcgtgcttgcatagatcaatatgatggccaagtttactatggagtggtgaatactgtttctgacgaacattccaagttagggacgaagtataccgttccgcaaattgccttttataaggccattattgaagcaatagtacaagatgcctctgcaaacgctgctatcttcagcattcatgctctcaatcttagtttggatagtcagatgatcagggctaaatgtccaaaacttataattgtatag

SEQ ID NO: 34074 - DNA, 849 bp, Glycine max
  Peptide Sequence Number=SeqID_150852
atggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagatttcttgggatcctgcagagctactcgttcttttttctctgacagatggtcagacttcatctga

SEQ ID NO: 34075 - DNA, 411 bp, Glycine max
  Peptide Sequence Number=SeqID_150853
atggcatatccatggtgggatgataacaaggttaagagcaatgaagatcacaagggtaagatgaaggagcagaaccaaccaggaaaaagccataatgaacatggatatatcagtggctatgtaaagggctatgtcagttgttatgaacatgggtataagcatggtaagagtgaatgtggtgatgatctacttgagagtcacattggttatgagcttagccatggccacaacagtgatgatggctatgaatatgactattattctgattatagtgaagatgactatgaatatgactctgaatctgattacaatgaatctagtgactatagtgaagtagctatgaagatgaccttgaatctgattatggtggctctaacagcagtggtagtagcagtgaatgtgatgatgtag

SEQ ID NO: 34076 - DNA, 393 bp, Glycine max
  Peptide Sequence Number=SeqID_150854
atgcagatgatcaagggcggcggcgcagcgctgacgcgtgagaaaattgttgcggcggtggcgcagaaatttatctgcatcgctgatgcgtccaagcaggtcgatgtgctgggcaacttcccgcttccggtggaggtgattccgatggcgcgcgcttatgtggcgcgggagctggtgaagctgggcggcctgccggagtatcgtcagcacgtggttacggataacggcaacattattctcgatgtacataatctgcgcatccttgacccgattgcgctggaaaaaaccatcaatgcgctgccgggcgtcgtcaccgtggggctgtttgccgcacgcggagcggatattgcgctgattggcacgccggacggcgtgaaaaccatcaccaattga

SEQ ID NO: 34077 - DNA, 342 bp, Glycine max
  Peptide Sequence Number=SeqID_150855
atggaaagcaatgacagctcgtggcagtcactagtggttgtgggtggtggtggaggaggtttagggtgctgggagaggttttgggggagaagaggggagaaaaacatgtatctttacactgttggatgtaatagcataggattcaaatgttatttcacaaatcccaacagttattacgtgcagacgtgggttgccagctcacaatccaaatttgtaggtgatccaatggttaacgggtctgacattgaggttttaccaaaacaggttttgggtcaaacttggaatcacatagttccaacacagatcaatcaaactccacaccaagcaattgcacaagaataa

SEQ ID NO: 34078 - DNA, 372 bp, Glycine max
  Peptide Sequence Number=SeqID_150856
atggcgctgaccggctggccgcgccctgggggccgttcaacaagagctgggtgcaccagcatcatcaggcgctgctcagcgccatcgagtaagcggccccggcggatcggccggggcggggcgatcagtggcttttgtactccaggtacatcaccgtcgccgccccgcgagaacgcacgtccagcttgcgcagtatgttgcggatgtgcaccttcacggtttcttcacatatatgcaactgcgccgccacctgcttgttggacaggccgagcgccacctcttgcaggacgtcccgttcgcgttcggtcaaggcggctaaggggtcccgctgctcgctgcgcgccagcaaatagtcggccatggcgtcgctga

SEQ ID NO: 34079 - DNA, 216 bp, Glycine max
  Peptide Sequence Number=SeqID_150857
atggagtgcacgaactgtgaaaaagattttggatttgtgagtctcaccagtacccaaggggttaccgacaagttgaaacaaatcaagcaggagaaagaggagaagaaagaagagaaaaagaaaagagaaggaaatgatgagatgaaaggaataaaggggtacccaaaggttcctccccctttcctaactgtagtgccaaacgatgctatgcagtga

SEQ ID NO: 34080 - DNA, 153 bp, Glycine max
  Peptide Sequence Number=SeqID_150858
atgagccattgcgagagagaagaacccaccacggagagagcaaaccgagtgagggagaacgaggctagaagggagaacgagagtcacgtgagagaaagggtcgttggagaggaagtgagttattgcattgatcccaaagaaaacaattggtaa

SEQ ID NO: 34081 - DNA, 315 bp, Glycine max
  Peptide Sequence Number=SeqID_150859
atgagggttcaggaggagtttctagagataattgttacctcatgtgagacaaggtatagaaaaatgttctctctaacccctagtcatcacgaacgtagagagacggaaagaatagtcaagaaagagaaattttgtttcaagaaagcgaaattttgtctcattttccaaggaatcaaagtacaccggggagaagtctcattatggagaaaatcaattacatcgaagcaccacgaccaagagctaatagtagcggcaccaccacaaccactggtgacattgaaggaagccaacaacaacaacatcgaagcacaatga

SEQ ID NO: 34082 - DNA, 2190 bp, Glycine max
  Peptide Sequence Number=SeqID_150860
atgcatgcaccaccttttgcgtctggctgccactcagttgactctgctatcagtcttgctgatcaaccattagattttgcacctaggtttaatcgtgatagtgacttgcaaatgcaatcaacttatagtcatcatgattccagctcttcaatgaataactgggtttctccagtggcacctggtgttggttatccaccaataccaccaattctttcttctgggcaacagcatgacccttctatcaccactcctggtcatgtggcaccaccatttggaaggtttcctggacctggcctcccttcaaccatacaaccaactggtgcaccctttactcttagcacaggaaccacaattcatcctactgtggctttctctgctgatgtgtatggggtatctggtattcctgatcgtcctaagaaggcttcagtccctaactggctgaaagatgaaataaagaaaaaagtcatccctgctcctgcagggaatctgaaggaggaaacatttgtaaatgatggcattgacaaatcatatgcgagaggtgatgaggcagatagtaaaagcattgattcgtctagatcagctgaggatgaagaagacgaagaggatcaagttgaagcagctagaactgcagcaatcaacctagaaataaaaagagttctgactgaagttcttttgaaggttactgatgaattgtttgatgaaattgcaaccaaagttcttgctgaagatgattttactgctgaaggttataacaatgtgttttctgtagtgggtcacaaggttgccacctcaaaccataaggcatcagcatctcctccctcagctacagttcctaaggcatctgcaaaagtttttgttccaatcaaagagaaggtagaaaatgttgatgccagtgaaaaatctaattccagctctcctggagatgttttaggtcttggaaattatggttctgatgctgatgatggagacaatgaaattgagagttccagtgtgccaactcctgcaaaagatgctgcctataagtcagggattaagaaacctttgtcagatacacatgatctatctgttaatggcatttcacaacttgatgagcatgctataagtgaaactaatttggtgaataatcaggtcaaaactatctctttaccatccagaagtagcaatggtgctgctactgatcagttgcatgatgacaaggtgaccaaggaatccaatcattcacattcttccaaggtggtgtctgaagatctgagggataatgggcttaatttcattgaaagaaaccatgatagatttaatggttttagttctaaagatacttcagggataccacgatctgaactgcctggaaagaacattagtgtggaaaaagcaatggatgatcattcaggtagggaaagcagaaaaaaatcagaaaaaaatgatcgacctgacaggagtacttctgagaaagactttgtaaaggaggtacacagtagtaagactaagatagatgaaaaaggtaatgagaatcaaagaagaaaggatgaaaggaatcagaaaagggacaaaacagattatggcagtgaagcaaaagaaagagtgaaacagcacagtttaaggcacggggagaaggcaaaggaatcagactcaaggaaaagatcctctcatgttgatgtcaaggatgataaaaaggaagcagaaaaatcccatagaggtagtgccactgacgatactagccggaaaagggagcatgcaaaggataagggggaacataaatcaaggcaaaaagatgcaagtaataatgacaggcatagaagaaggcgttcatcttcagtaagcagtagaggtagaaccaagaaggattgtattaatcatgctggtgattcaagtggtgaaggatcagatggctcaaaaaggaagctgcattcaagaaagcgtgacttatcaccgtctccagtcagatctaaaagaaggtattatttattaagagatccttacattgttcaggttgtagacaacttttgcggtctcctcatagcaagcgttctcagcgcaggcattctccctatacttctcttgattcttccaggggaaggaggtcaagatccagatcacctgttcggcggcagagatgaatggatggggacagagatggttgactttgcatctacggtgttcattcaagagaacataaatttggaggcgtag

SEQ ID NO: 34083 - DNA, 1479 bp, Glycine max
  Peptide Sequence Number=SeqID_150861
atgaagaccttggaggaagccaacgtgcttgtgacgtcagactactccacatgtctcaatagtggcttagtgggtttgttagagttgcatttctttctttcagggatctcaggtggagctatgagattatcttcactaaaggatcacaccagaactttcaaaaatgctatcttggattccacaagtctaagtaatattaccatattcacagctcctaaaccctttaagggctctattaggaccagacaaacactagctattcggtcatggttggctctgtctccatatgttacagttgttttgttcagtcaagatccttctgtttcctcttttgcagatgcttttgattccagggttttagttgacactaacattgatttcaccttccttggtactccttttttccattccatggttgcaaaatcacgctcatacacatcagagatatctgtcatcattgattctgaaaccgttatcctttctggattcatctccactctaaaccatgtgtatcaacttgaccatgattggcttcttgttgcttcggctcaaaatgtttcttcctttccattccatttggatgagtctgggaaacattggcagacggataataggaaacggatgaatgtccaggagctgcagaaaatacttcagcacaattggcaggggaaacattgttgttattcaagaatgctcatggtgtggaacaacaaggatgcgcctctacatagtggagttcttcctccattcttgtacggtaagggtacacacaacaattggctgattcatgaggccatgtcatctgagttcagatttgtgtttgatgctagtttgaccatcacaagtttccatctgaatgaagaggatgatttcagtcctacacatgggaattctagtgctgtagatattgaaaatagaagttgggagtacattggcaattcccacataggggcaaactatggctcattcttctatagtgaagctaatttcactagccttgtcaaacttttgaagtgtaataaacaatacattatggttgataccaagaaaaacattgtttatcctattggacaccaaggtgcaatgaacttgatgaaggaaaaggttattccatcttggttaaaggaaaatacagtgtattgcatcgatcgtctgaactcacatacaaaatcattagattgctctgtgaaggatcagacgaaaattccatcaatactggagcttccattctccttagaatcacttctttctatcacttcagacaaaactaaaacagttatacttactgttgctggatatagctacaaggatatgctcatgagttgggtttgcagattacgaaaactttccattgaaaattttgttgtgtgtgcccttgataaggaaacttctcaattctccatcttgcagcaaattcttattaagagtgttctgtacaagcttccaaataatttcgttaactctctaaaatacttctag

SEQ ID NO: 34084 - DNA, 267 bp, Glycine max
  Peptide Sequence Number=SeqID_150862
atgttcctgggagcggaggacaagacagtcgttttcaagagttgtgggccccaccatggagttcggatcgggttagatggatgcgggttggtgggttcgggtggatattttcgggtttgcgggttaggggaggtgaggggtgtggcgtactgttgtggggatttgagtttcgcaaagtgtcagtgttacgctagattctccatcaatggggctcatgcttacaattacaacaataaggctcatgatttttttgaacatgaggaatga

SEQ ID NO: 34085 - DNA, 192 bp, Glycine max
  Peptide Sequence Number=SeqID_150863
atggactctaaatttggttttgggtgtttacggaaaaaggaaaagctcaatgcgagggacatttcttccaccagacattatcttagaaatcccaacggtgggtctgtaaggaaacacattcggaacctcctgttcaactttcacaattatccaacggttaataagtctgagatcgtcattttactgagatag

SEQ ID NO: 34086 - DNA, 675 bp, Glycine max
  Peptide Sequence Number=SeqID_150864
atgttagcaggaaatgtaactatagaaaaacctagagatcaatgggatgaagatgaaagaaaaagagttcagaataacttaaaagccaagaatataatcacttctacattaggcatggatgagtacattagagtttcaaacaatctcaccaacacatctcttgccactctctttgggaatcatcaagaacatgaaatagaacttatgagactcaaccaacatgaagagaatgacaaaaagaagaaaggaattgcactcaaagcctcatcttctattcatgaagaaagtggcaaagaagatatgaatgaacaaaataatttagaagaagatgatgatttgagtctctttgtaaaaagattcaataaatttctgaggaacaaaggaaatcgaaggagatcaaacttcaatccaaagaagaaaggagaagattcctcctcagttccaaaatgctatgaatgtgatcaacctaggcacctgagatttgattgtcctatctttaaaagaagaatggaaaaatccaacaagaaaactttcaaagataagaaagaaaagaaagcatatatcacttgggaagataatgacatggattcatcaagtgattcaaaaaatgaaatcgtaaatcgaagcctcatggtcaaagactatgaaagcgaagaagagggtaacatcttctaa

SEQ ID NO: 34087 - DNA, 375 bp, Glycine max
  Peptide Sequence Number=SeqID_150865
ggttatccggttcgggttctcgtggataaaggcaaccggggcgagttacaatgcgcatggtgcgaatggaaggaggtatctcgtgccagcgatgtgggacccgcagacttcgacatgcaagaccctcgtctgaagactgccacgtggcgaggttgtgtaatggttgtagatattggtcgatgggaacggaagcagggaatggataatagaggtggtgatggatttggttcggacttcggagtgtttctaaattttctatattctgtaagcctgcttttgtcgtttagtgtgacgtggctaggagaccattatggcgaggtatctatcggtaatgatgattttggctggggtggtgaagtgaacgaatttcactag

SEQ ID NO: 34088 - DNA, 561 bp, Glycine max
  Peptide Sequence Number=SeqID_150866
atgacggaacaaaaaagggcaaatccagcccccttaggactttctggtttcgcactaactacactcgtgttatctaccttcaatgcagggttaataacacaaggagcatctgtggtgttgggactagcagcgttttatggaggattggctcaactactagccggaatattggaatggagggcagggaacacttttggctatactgccttctttacttatggtgcattttgggagtggtatttcctaactgcgggaggattttttggaggagtcacacctcaagctataggcttggtattaattgcgtttggaatctttacactagcaatgtggtttggcacgtttaaggcaaatctaggattattcatgacatttctattactgtggataacgttcttcctacttggagtgggagctatgactggaaatgttggattatcccatgccggtggatatgtaggaatattaacggcaattgcagcgtggtatactggactggctattgtagtagctgagggcttaggcaagagtcctccagtaggaagaccaataatgaaataa

SEQ ID NO: 34089 - DNA, 505 bp, Glycine max
  Peptide Sequence Number=SeqID_150867
atgacagaccagtctcgtttcactaaggaggatcacatgcgtcaacacaaaacccgtcagctgggcgacagcggtatcagcgtgccgctgctgacgtttggcggcaacgtttttggctggaccgtcgatgaaaaaacctcgttttcactgctcgacgcgctggtggaaaaggggctgttcttcattgataccgcagacgtttactcacgctgggcgccgggcaacgctggcggtgaatcggaaactatcatcggtaagtggctgaaaaaaagcggtaagcgcgacagtatcgtgctcgccaccaaggtaggcatggaactgacgccggagaaaaccgggctgaaaccggcctatatccgccaggccgtggaagattcgctgcgccgcctgcagacggatgtcatcgatctctaccaggcgcaccgtgatgacgacagcacgccgctggtggagacgctgaaagccttcgactcgctgatcaaagagggcaaagtgcgggcaatcg

SEQ ID NO: 34090 - DNA, 240 bp, Glycine max
  Peptide Sequence Number=SeqID_150868
atgggacctctccaaatgcaagccttccgcaaggcgtacggaaagatcttagattttaccatagcagagatatccacagaagccattgcatcactcgcccaatactatgaccagcctttgagatgcttcacgtttggagacttccaattagtaccgaccgttgaagaatttgaggagattctaggatgtccttttgggggaagtaaccgtatcttttctccgggttccttccctccttga

SEQ ID NO: 34091 - DNA, 849 bp, Glycine max
  Peptide Sequence Number=SeqID_150869
atggcgaatcaagatgagtgggtcccattcatggatgtattagcattgttaatctttggggttgtcctctttccaaacgtggatggtttggtggacctagctgcaattgatgctttccttgcatatcaccatagcaaagaaagcccggtggtagctgtcttggcagacttatttgacacatttgaccgaaggtgcgaaaaaagtagtgcacggatcatctgttgtttacccgctctttgtgtatggttggtttcgcacttattccaacaagacataaggcatccatgtccgctccgaagccatcgctcgtgtgtcaaaaagagaagagtagattgggaccaacacttggttgggataggaggcagaacaatcaactggtttcctcgatggaaggaaggaaaggagggagttctcttctcatgtagggactacccaaacatcccgttgataggaacaaggggttgcattaactacaatcccgcacttgctataagacagttagggtaccccatgaggggagcaccgacggaaaaaagcctctctccttttcttgtgagagatttcggtgcgcaaagtttcaagattatacaaagagttcataaggcgtgggaaagcccgttaaggaaagataaagaacttaggggcattcgtaatggcatcatcagtggttatcatgaatggctgaaagttcgtacacgagggttagattggctctccaagttaaagattatcaacgaagagaacttcgaagctccggaagaggatgaagaagtccgagctctaaaaacagaactaggaaaagcaagacttgccaaagaaaaattcaagttggtcgctacagacgtctag

SEQ ID NO: 34092 - DNA, 249 bp, Glycine max
  Peptide Sequence Number=SeqID_150870
atggctacagccaggggggcactcaagcatcccgtttatggcattgtgacactacggacaacgttcctaaatgaaaaactccacacgactccggaatttcaacaaacactattgacaacaacgaatcatgtggctttgcatgccaccagacccttgggtcacggtaacaaaaagtggggtggtcgacaaaagcagagcttttgctcctacgtatcctcaatttgtgatgaggaactcagacctacgtag

SEQ ID NO: 34093 - DNA, 417 bp, Glycine max
  Peptide Sequence Number=SeqID_150871
atgaatttattgcctagcgctgttcatgcatcctccacccacgagtctggagccccgcgaatttattgcctagcgttgttcgccaattctccattctccacttttatctggagccccatgaatttattgcctagcgctgttcatgtgtcctccaccatcgagtctggagccccgcgaatttattgcctagcgctgttcgccaattctccattctccacttttatccggagccccatgaatttattgcctagcgctgttcatgtgtcctccaccatcgagtctggagccccgcgaatttattgccaagcgctgttcgccaattcaccattctccactttttttcgaagacccatgaattcattgcctagcgctgttcatgtgtcctccaccatcgagtctggagccccgcgaaattaa

SEQ ID NO: 34094 - DNA, 1305 bp, Glycine max
  Peptide Sequence Number=SeqID_150872
atgagagctgttaaagtggattatctgactcaaaaaggaacatacccccattccataatagcaaaggcatgttgggtccatgtccttcttgcagatggcgacttgacagtgaagatgaaattgcattctttaaaaattaaggatgaacttcagggtcgtctatctgtagctccgcgttatcttgctgtttctgtcttgcagagtgaaacttcatcctctgacatgtatgattcccatgggaaggaagtgtctcatgatgatgatgacagctttacggatgcattatctgaattcatttctcaaactgatggaggatattgtttacataatatggatttggatcatcagggattggtggggattgcttctgatttcgagtctctagaaaacataatgcatgaaaagggcactcctcgtgaggtatattatgaggcacagggaagtgatacttcaaattttgtatctgtctcctttacaacaagaagttcttgttcacctgattatgatggcatagatacacagatgtgtgttcgtatgtccaaactggaatttttctgcaaccgaccgactattgttgctttgataagttttggtttggatataagctctggaaataaagtgacaagtcccacggacactttggcaacttcttcagagaaacttgtggtaaaggagagaactgatgaagaggggcccgttagtggattgttgggatttggtaaagaacgtgtagtattttatttgaacatgaatgtggacagtgtaactatttttcttaacaaggaggatggttctcagcttgctacattagttcaagaaagcttcttactggatcttaaggttcacccaagttctctttccattgatggaacattagggaattttagactttgtgatacatcccttggatcagatcagtgttgggattggctttgtgacattcgtaatcctggtgttgattcccttataaagttcaaatttaattcttatagtgctggagacgatgactatgaaggatatgattatagcttgcaaggccatctttcagctgttcgcattgttttcctttatagatttgtgcaagagataatgatgtacttcatggaacttgcctccccgcacactgaagaagcaataaaacttgtggataaagttggaggatttgaatggttgattcagaaatatgaaatagatggagctactgcactcaagctggatcttgcactcgacactccaattatcattgttccaaggaattcaatgagcaaagagttagtgatctttaaatctgtttgtggagtctaa

SEQ ID NO: 34095 - DNA, 1619 bp, Glycine max
  Peptide Sequence Number=SeqID_150873
atgtctgataaagaatataaggtgattttggattgtacatacatgaatttatctgaagaaccaaggctccctgctagctttcgtggtggaaaatctggttcaagggatactattaggcttcttgttgataaggttaacttgaacagtcaacttttgttgtcccgaacagttacaatcatagctgttacagtgaaccatgccttgctggagctttgtaatggcactgatggggagtctccattggctcatattgctatggaaggtctttgggtttcttatcgtatgacatctttatcagagacagacctttttgtgactattccaaaattctctgtactagatgtccgccctgatacaaaaccagaaatgcgtctgatgcttggatcatctgccgatgcttccaaacaaactgttactggaaatgttccctttttatttaacccgggtagttttagaaggacaaccagtgaagttgaaattgatgatatgcccatttcaacaatgttcttgatggactacaggtggcgggtgtcatcccaatcatatgtgattcgtgtgcagcaacctcgagtccttgttgtgccagattttcttcttgcagtggctgagttttttgtgccttctttgggagcactaactggaagagaagaaaaaatggatccaaagaacgatcctatcagcagaaacagtagcatagtgctgatggaatcaatttacaagcaggaagaagatgtggttcacctctccccatctaaacagctagttgctgattcggtaggcattgatgaatatacgtatgatggttgtggaaaggttatttgtttatctgttgaaacagatgcaaaggaagttcgaagcacaaggtttagaccaattattgtcattggacatggcaaaaaattgcgatttgttaatgtaaaaattgagaatggttctcttctaaggaagtatacataccttagtaatgatagcagctactcaatctctagtgaagatggtgttgatatggtggtttcaggcaatttgccatctagtgatgagaaaagccttgacaatgtgaatcaaacatcaggcacttctatagattctcaaagtggttcaaatgcaactcaaagtttttcctttgagacccaggttgtttcttctgaattcaccttctatgatggcactaagtcatttcttgatgattcattttatggcgagaagcttgttcgtgcaaagttggatctaagtttcatgtatgcctccaaggaaaaagacacttggattagagccttggtgaaggatttttctgttgaggctggttctggtcttatcattctagatccagtggatatatcagggggatatacttctgtgaaagacaaaacaaatatatctttgctatcaacggacatctgtatacatctttcacttagtgctctgtctcttatgctgaatctgcaaagtcaggcctctgctgcattaagttttggaaatgcaattcctcttgttcaatgtaccaactatgaccgaatttgggtgtctgagaaagaaactggtcacaacaacaacattactttttggagacctcgagctcctgcaaattatgttatattaggagattgtgtaacatcaag

SEQ ID NO: 34096 - DNA, 165 bp, Glycine max
  Peptide Sequence Number=SeqID_150874
atggcaaattgcaacccttggatgaaaactaagagttcctttttccaaagctttctcgtgttgcctgcacattatatgaatccagggaagggcatctgggccatcaacttccaggccgacatagtccacagatgggtttttctttgcaaacccaggaaattgcag

SEQ ID NO: 34097 - DNA, 99 bp, Glycine max
  Peptide Sequence Number=SeqID_150875
atggcttccttagactctctcgatttctccctcttccgtctcagcactgacttctgctctccttttgccattttcgttcaggcgcaggtggataactaa

SEQ ID NO: 34098 - DNA, 588 bp, Glycine max
  Peptide Sequence Number=SeqID_150876
atgggttgcaatagctccaaggctgaaccaccgttggaaaactccaatcatcatcatcatcatcatcatcatgcagagttccaaaaacccaaaactctcaaacaagaagtagtgctgcagattccaggatgcaaagttcatctgatggacgaaggcgaagccatagaactggcacaaggtcacttcacaatcatgaagatcatggacaagaacgtgccactagcaaccaccataaaagttggaaacagtgttcagtggcctctaacgaaagatgagccagtggtgaaggtggatgctcttcactacctgttctctctgcctgtaaaagatggtggtgagcctctaagctatggtgtcacctttccagaacagtgctatgggaacatggggatgttagattcttttctgaaggatcaatcttgcttttctggtttggaaaggaataagaagagtgatcttaattgggagaagtttgctccaagggttgaagattacaatcattttctggctagggcaattgcaggagggactggccagattgttaagggtatcttcatgtgcagcaatgcttacaccaaccaggtttag

SEQ ID NO: 34099 - DNA, 420 bp, Glycine max
  Peptide Sequence Number=SeqID_150877
atggtgtggatcctagccacatgcactcttatttcacttttctcaatgtggaacttgacaaggatagaagttctactttgcaacatattgtccccagaggcacctcgactttctctggcttcttataattggtttaaagtattcgttgcaatgctggtgggcaactttttataccctatatctgcaattcgttctcattttactcagtctatcaattggtctggcattatataccatttgaaagatggaaaaatcaacaagatacatagaataccaagaaggcaggatgtggctccagttttcactgacttgggaggaaaacatttgtatggaaagaaagggatgcctaccaagggctcattccttagttctttgtccaaacgtttgttccaatggcgtcaacctaagaaatctgagtaa

SEQ ID NO: 34100 - DNA, 501 bp, Glycine max
  Peptide Sequence Number=SeqID_150878
atggcgacagaggagaggaaacccatggaggacgacaaggaactgttggagaaaaaactagggaggagccacgggcagcaaacacacaccatgaataataccaacatcagcttcgcggaggagaaggaggagaccaacgaatctcattcatctttggtgagtggcgacataaataagcatttgcctacgttgttcgtgttggatgcttcccacctctcattgttctttgcatcattctcagggcataaggcaaaagctcaagccagtttaaacgttgataaggcatcaaaatcctacagtaaaacagaagtttcgttgcataacaagagaacagactgttggataatcatcaagaacaaggtatatgatgttacctcatatgtggaagaacatccaggtggtgattccattcttgtacatgcaggagatgattcaactgaagggttttttgggtatgcattcattcctatttgcccattgctgattgcttatctctactga

SEQ ID NO: 34101 - DNA, 1098 bp, Glycine max
  Peptide Sequence Number=SeqID_150879
atgcagggatgtataataaacctaatccttgcttttgggtgggcttgtgctgcatttgtcaggaaccgagaaataaatagaataaagaagagtatgcggaatggcaataactttgcattcctttgtcatgatattagtgaacttgagcactccaatcaggctgatcttccaagtgtaacagtaattatgcccctaaaaggatttggagaacacaatctccataactggaagactcagttaacatcgctttatggtggccctcaagaatatcttttagtagttgaaagtacagaggatcctgcataccatgctgtagcaaaactaataacagaattagaggattctgttaaagctaggattataatagctggtttatcaacaacttgtagtcaaaaaattcacaatcaattggttggagtggaggcaatgcataaagatagcaagtatgtattatttttagatgatgatgttaggctacatcctggatcaattggagcactcgttcgtgaaatggaaaagaatcctaagatatttattcaaaccggataccctcttgatttgccatctggaagtctagggagttactgcatctatgaataccatatgccttgttcaatgggctttgccactggtggacaaacattctttttgtggggagggtgcatgatggcaatttttctccagatgcattctgaagacttcaggcaagataattgtggtgtagtctcgggacttcgagatggtggatattctgatgatatgactcttgcagccatagctggggctcacaaaaagctcattagttctcctgcggttgccgtctttcctcatccccttgcaagtgatcttaattttggaaggtactggaattatttgaggaaacaaacatttgttttggagtcatatgtaaccaaagttaatcaagtaatgaaccgtgcattatttgctgttcactgttatttttcatggggatttgttgcaccatactgcatggcagtgattcatgttgccgcagcactaagatttcgcgctagggagtactcacttgaagaaatggattactcttctggaggtgagaacactactttccctttgtag

SEQ ID NO: 34102 - DNA, 1242 bp, Glycine max
  Peptide Sequence Number=SeqID_150880
atggcacatgttgctgataaaataaaattgatagatggatcaagggaagctcttaagctttctataaggatcactgatctttggttcattgggattcccggaaagactgaacaagccgaaatggtggttgttgattctgatgatcagctgaagtctcgcaagactgatttgaaagagaatttgacttatgtgatgcataattttaaagttatcaagaatgatgggaaattcagagtttgtgatcatgaatataaattatgttttactggagttactgttgttaggcaatgtgatatggagcagttaccttttaggaaattcagatttgttgctttttccagtgtcattgctggtgattttaaaattagactcttggttggatcatatccggcatcggtcagtaattctttcaaggcgtccaaactcatgatcaatgacctcgtgctggaaattcaagaatttagagaaagtcttttagatttagggatcgaggttagatcaatttttgcgcctattggacaagggagttcacaggtttcaggctcatctcaattatcatcaaaagatgtgtttctgtcaaagactgaagtaaaaaatatctctgagattaatgccagttcagaggagtttgtttgtgttactgtcgccaagattacaaccatagtgatgaacaactattcatggtgctatccggcttgtggtcaatgttataaaaaagttgacatgcaaagtgtgtcgttcacatgtccgtgtggcaaagagaacaatcaacatgtactgaggtatcgggttgaggtgatggttagtcacaagggtgaacaaaccaaatttttgatctgggattgtgaatgtgcacagttaattggtcagtcagcggatgaagtcaacatgctcaaaatagaagatggggatgttgatttaaatgcctctcctcaagcactagataggctattgggttgtttccttgcattcaaagtgaaggtgcaaccaaggttcaggaattctgttgttcttaaatattcagatgaaccagagttgatcaatgttatgctagatatgattcccgatagtgagcaatctctgtctattacagctgatcatgatcgatcaatgcttggctcaagtgagcctacagagtttgaatctcaatctgtgtctgttaccggggatcatgaccctcttctcaggattccattgacaccaactaagcgcgtatcttctgatgagttggataatgagtga

SEQ ID NO: 34103 - DNA, 3604 bp, Glycine max
  Peptide Sequence Number=SeqID_150881
atggatgaggctgagacacgtaagttagagatggaaagaaaagagagagcttccatagcaactattttgagatatgctgattggattgatgttgtgctcatgttaatgggtgctgtgggagcaataggagatggcatgtccacaaatgttttgttgctctttgctagccgtatcatgaacagcttaggttacagtaataacctacaaagtaccaagacttacatggctgaggttgaaaagtgcagcttatattttgtctacttgggattagcagcaatggtggtggccttcatggaagggtattgctggagcaagacaagtgagaggcaggtactgaaaattcgttacaagtacttggaagctgtcctaagacaagaagtagggtttttcgattcacaagaagcaaccacttctgaaatcattaatagcatatcaacggacacttctctcatccaagaagttctaagtgaaaaggtgcccctatttttaatgcactcatcatcattcatctctggggttgcgtttgccacgtacttctcttggaggttggcattagtagcatttccaacgctgcttttgctcataatccctggaatgatatatgggaaataccttatctatttgtcaaagtccacagtgaaagaatatggcaaagcaaacagcatagtagaacaggcacttagctccatcaaaaccgtttattcattcactgcggagaagagaataatagggagatattcagacatattgtgtagaacttcaaggcttggaatcaagcaaggcatagcaaagggcattgcagtgggaagcacaggtctatcttttgcaatatgggcttttcttgcttggtatggaagccgtttggttatgtacaaagtggtacttcctgatttgaagtacttcactgaagcatctgttgctgcttcacgaatatttgacatgattgacagaacaccattaattgatggtgaagacacaaaagggcttgtgttagagagcattagtggcaggctagactttgagcatgtcaaattcacatacccttctcgtccagatatggttgtgctcaatgatttcaatctccaagtggaagcagggaaaacggttgctttagttggtgcaagtggaagtggtaagtccacagcaatagcattagtgcaaagattttatgatgctgatgaaggtgttgtgagggttgatggtgtagacataaaaagtctacagttgaaatggataagagggaaaatgggacttgtgagtcaagaacatgcaatgtttgggacatccataaaggagaatattatgtttgggaaatcagatgctaccatggatgaaatagttgctgctgcctcagcagccaatgctcacaacttcataaggcagcttcctgaaggttatgaaaccaagattggagaaaggggggcacttctttcaggaggacaaaagcaacgaatagccattgcaagagccatcataaagaatcctgtaattctcctacttgatgaagcaactagtgctcttgactctgaatcagaattactggttcagaatgccctcgatcaggcctccatggggagaactacattggttgttgcacacaagctatcaactatccgaaatgcagacctcatagcagttgttaatagtggacacatcattgaaacaggcacacaccatgaactcatcaacagaccaaatggccactatgcaaaactggcaaagttacagacacaattgagcatggatgaccaagatcaaaatcaagaacttggtgctctttctgcagcaagaagcagtgcaggtagaccaagcacagccaggtcaagccctgccatatttccaaagtcaccattgcctgatgatcaagccactccatctcaagtttctcaccctccaccttctttcactaggcttctttctctgaatgctcctgaatggaaacaaggtctaattggaaccctctcagccatagcctttggctcggttcaacccttatatgctttaaccattgggggtatgatttctgctttttttgctgaaagccatcaagaaatgaggcacagaatcaggacttattcttttattttctgttcactttcccttgcttcaatcatcctcaatctgttgcaacactacaattttgcttatatgggagccaagttaaccaaaaggataagactgtgcatgctggagaatatcttaacctttgaaactgcttggtttgatgaggaacaaaactccagtggagcattatgctcaaggttaagcaacgaggcttccatggttaagtcccttgtagcagacaggctctctttattagttcaaaccacttctgctgtcatcattgcaatgatcataggccttgctgtggcttggaagctagctcttgttatgatagcagtgcaaccactcacaatcctttgcttttatacaagaaaagtgttgctctctacactctcaacaaaatttgttaaggcacagaatcaaagtacacaaattgcagtggaggcagtttataatcacagaattgtgacatcatttgggagcattacaaaagtgctacggctatttgatgaggcgcaagaggcgccgaggaaggaggcgaggaagaagtcatggctagctggcataggaatgggttctgctcagtgtcttacgttcatgtcatgggctttggatttctggtatggtggtactttggtggaaaacagagaaatatcagctggggatgtgttcaaaacattttttgtgttggtgagcactggcaaggtcatagctgatgctggaagcatgacttctgaccttgccaaaagttcaacagcagtagcatctgtgtttgaaattctggaccggaaatcgctaattcccaaggctggagataacactaacggcatcaagttggaaaagatgagtggaaaaatagagttgaagaatgttgattttgcttatccaagcagggcagggaccccaattttgcgcaagttttgcttggaggtgaagccaggaaaaagtgttgggctggttggaagaagtggctgtggaaaatcaacagtgattgccttaattcaaagattctatgatgttgagagaggttcagttaaagtggacaatgtagacataagggaattagacattcactggtacaggcagcacatggcacttgttagccaagaacctgtgatatattctggcagcatacgtgacaacattttgtttgggaagcaagatgctacagagaacgaagtaattgaggctgcaagagctgccaatgctcatgagttcatatcatcactgaaagatggatatgaaactgaatgtggagaaaggggagtgcagctatcaggaggacaaaagcagagaattgcaattgcaagggccataattcgcaacccaaagatactacttcttgatgaggcaacaagtgccctggatgtgcaatcagaacaagttgtgcaagaagcacttgataggactatggtaggaagaaccaccattgttgtggcacataggcttaacaccatcaaagagcttgattcaattgcttatgtgtctgagggcaaggttctggagcaaggaacctatgctcaacttaggcacaagagag

SEQ ID NO: 34104 - DNA, 290 bp, Glycine max
  Peptide Sequence Number=SeqID_150882
atggataaccaattgggtatctccgcctgccacctaacttcacgggttaggattaacagaaatcgtttgtgcggacaaccacttgggtatctccgcatgtcatcggacttcacgggttacgatagcaaaaaggtgcagatgaccacattggcctctgcttgtcaatcgaacttgcggtctccgaatgacgatgtgcggataaccgaaaggtgtctccgcatgctaccagactcttgggtcatgagagcaaaaggtggggtggtcgacaaaagcgaggcttttgctcctac

SEQ ID NO: 34105 - DNA, 594 bp, Glycine max
  Peptide Sequence Number=SeqID_150883
atgggaaaacagagcacaccccaattctctgccctcaactgcatcgatctctccaaccccgacatcaaccaatccgtcaacttactcaaagaggcatgtttggattccggttttttctacgttgtcaatcatggaataagccaggaattcatggacgaggtttttgcgcagagcaagaagttcttctctcttcctcacaacgagaagatgaagactctcaggaatgaacaacacaggggatacacccctgttcttgatgagttgcttgatcctgaaaaccaagagattacaaagaggggtattatattggagttgaaaaaggtgaagatgatccacaatcgaagaaacctttttatggaccgaataactggcccgcaccagatgttctgcccgggtggagggagaccatggaaaagttccatcaagagacatttttttaatatggacaaggttttaaattgcaattgggatcgtggctttgtgactttccttgatatgacgggaaaattggagacaaatgtagctgatgcagccataattgcagtcgcaaacacactaacaacctggatgttgcaaccgcgaatcgttttttaa

SEQ ID NO: 34106 - DNA, 423 bp, Glycine max
  Peptide Sequence Number=SeqID_150884
atggagagttccgatgagatgcacagcaaaattataacgatgaaacaatctttcttcgatgagggatttctgattccaacccagtttcaagagctggagctgctacaagacagagacaatatgaactttgttagggatgttttttgtttgttcttcacggatatgactagacagttttctgagattgagcaaattcttcgagaagaaattgatggtcagccaagggaagacatgaataggttacttcaacgactcaagggaagtgtgttaagcattggtgctctcaagattttgaacggagtcaataagatgatacaacttttcgaagaaggcaacttggaaaggatcatggctgcttttgaacaggtgaagatggagagtgtaaatcttagggcgaaagttgagccttactttcagaattag

SEQ ID NO: 34107 - DNA, 957 bp, Glycine max
  Peptide Sequence Number=SeqID_150885
atggatgccacatatgtgaaggagttagagtcatatgttggacatagcaagtatggaatttttttcccacgtgttggaactcgctctgtggcagatgagattgctggaggtgattttgatggtgacacatactgggtttctaaccatcctcagggtgacccttggatcgaaaattcggttccattggattctagtgttaaaaagccaagtgaattttctcccgaggaactcgaggaagaactttttagactattcctcaaaactcggtttcaaccaagttacgcaatgggcatgtcagaaaatagctggatggcactcatggatcgtcttttgacactaaataactgcactaatgagaatgagaaggaacgtgtgaaagaaaatatgctcaaattgattgatatatactatgaggcattagatgctcctaaaagtggaagaaaggtccaagttccaaatgatttaattgcagaattgttcccgcactatatggaaaaggataaatcattcacttcaacctctatcttaggtttaatttatgatgaagttgaaatctggctagaaaacgacatggtaggagtacctcccagctgtttggaaaagtggaaaacaaaatacgaagaatataggaaggatatgactgatgccttgaacttgaaggacaaatctaaatcccacgaagaggcagctgaagtcaatagaaaatataaggaggaattctatggtccaactcttgagatggagggttgtctgaagagtattggtgatatttttaacgaggctctggctgtgtataacgttagttatgaatacgccatgctaaagaaagaagtcaaaagatgtggctttgcatggaagattgcaggttcagctttgactaggctttatatcataaaacaaaatgagaaggctctgaattgtgatccatctgtagtgcgtgagatttttcgtttatga

SEQ ID NO: 34108 - DNA, 2106 bp, Glycine max
  Peptide Sequence Number=SeqID_150886
atggccactctgaaagagcttcttcctcctgcaaaatcctcctccaccgcctactacgaccacaccaacgatccatggttcaagcagcgtttctcctcagaagaggaggagaaatccgccgccgccgccgccgccaagcagaagcccgttcccccctacctgaagcgcgccggcttcgttcctcggaaaatcgaggacttcggagacggcggcgccttccctgagatccacgttgcacagtatcctctcgacatgggaagagaaaagtccggcgccaaacctggatccaaaatcctccctgtcaccgtcgacgctaacggcaacgttgcctacgatgccatcgtgaggcaaaacgagaacgcaagaaaaattgtctacacgcagcagaaggatcttatccctaagtttctcaagaacgacgaagatgacgacgacgtcgtttccgacgacgaagcacagaaacagatcgaggaaacgatgcaggagaccaaggccgctttggagaaaatcgtgaacgttaggttaagcgctgcgcaaccgaagaatgttccgaagcagaactccgatgcgaagtatataaagtacaaaccctcgcagcaatccgatgcgttcaattcgggtgctaaggagagggttattaggatggttgagatgccggtggatccgcttgagcctccgaagttcaagcacaagcgtgttccaaaggcttcggggtctccgccggtgccggtgatgcactccccgccgaggccggtgacggtgaaggaccagcaggattggaagattcctccttgcatctcgaattggaagaatcctaagggttatactattcctcttgataagaggcttgctgctgatgggagaggccttcaggaggttcagattaatgacaatttcgcgaaattatcggaggcactgtatgtggcggagcagaaggcgagggaggctgttgcaatgaggtccaaggtgcagaaggagatgatgttgaaggagaaggagaggaaggagcaggaattgagggcattggcgcagaaggcacggtctgaaagaattggaggggagagaattggggttgtaccagccgcgccaccagctgtggcggtggatgaggacgatatgagagttgattatgagcatgagaaggagaatccgagggagagggatagggagaggagttttgtgaaggagagtagggaggagaaggaggagaggatgcagcgcgagaaaattcgtgaggagaggaggaaggagagggagagggagaggaggttggaggccaaggatgctgctatggggaagaggagtaagattacgcgggatagggatcgtgatattagtgaaaaggttgctcttggtatggcctctactaaaccagggactgaggttatgtatgatgagagactgtttaaccaggataagggaattgcgtctgggtttgccaccgatgatcagtacaatgtgtatgagcatgggctgtttactgcccagccaacgctgtccactttgtataggccaaagaagaatcttgatgatgagacttatggaggtgctgatgagcagttggagaagattatgaagactgataggtttaagcccgataaagggtttgctggggcttctgagagggctggtccgagggataggccggtcgagtttgagaatgaagaggctgatccgtttggtttggatcagttcttgactgaggtgaagaagggtaagaaggccatggagaaagtgggtggtggagggactatgagggcaagtgctggatcatctatgcgggatggtaacgagggaggttcagtgatattcggtacttggtttagagctgaaattgctgttgtagacaactgcatttgttttctctggcagtcattatttccactttttgatgagacccttgagtccaataatttcttggacaaagaactattaccggttcagcagtacgttcaattagtggttaggaaatttggcattaggcttgggcaaggaagcaagagaggattctgttatgatgagtgggcaaggtttggggaacccatgatggtgggggagagacgtttctgttttagagagattgaggagtcaaggggaggttgttaa

SEQ ID NO: 34109 - DNA, 363 bp, Glycine max
  Peptide Sequence Number=SeqID_150887
atggttgataatgagaaaccacgtattctcacggatggaactggcttcatctctagagatttggcgttgctctgccccaacaatgtttacaaaggaagcaacttggagaacaactgtattcaggaaattaacaatcttgttgaacttgaggatatgagtaatgcaatgggagaagcagagcagctgagcacacatgaaccgcctttgctgattcagtgccgtctctttcacatgggtcatgcaattaagggtactcttttggttaacagaaagcttcctcctaggacaatacaggttcgaccttcaatgattaacgttgagaaagacccaagtgtgcatatgcaaagcataaattcattggag

SEQ ID NO: 34110 - DNA, 309 bp, Glycine max
  Peptide Sequence Number=SeqID_150888
gtgtgcaatatatatccatgcattggatatgctaacggccaaaccaaatacaccaaatacagtgattcaaaaagcattcaaatgcctaagctgcaccgcatttcacggatgacgagagtgatgagcaaaatgacggcaatagcgacgaagtctatttcgttgaagcctttgggaagagatggcaccaaagcacggaccaaaggtgacgcggaggtagctgaaggcgtcgccggtgtcgggcatgtcgacgacaaactcagtgtatcagaaggcgaagaggagggtgtagaagccgacaatggcaattaa

SEQ ID NO: 34111 - DNA, 846 bp, Glycine max
  Peptide Sequence Number=SeqID_150889
atggcagaaaatcacaaccaccgtgacctgcttattcttccgccctcggtggaggctctgatcgagagcatctgccgcgaccagaaccggcctccgctcgattacagcacccgccaccgtctcaaactacagggcgaggaacaatcccttcgcattctcaacaaaatcgccgccacccgtatccgattatctttcgcaggcttcgtcaaccacatgctcgacgacatcaaccaccaaaacaataataataataacaacaacaacaacaataacaacaataataacaattctcactctcaacctgagccctccacgcgacaacaaacctctcccacgcgccctccccgacccacgccctcctcgctattgcacgcgctcggagaattggagttccgaaaagcctttctcattctcagttacatcggacgagagagtcttgagaattgtattactgatgctaaaattagaagcctcaaagacttgccgatggcaaagttcgagaaaacaatatgggaagattttggggaaaaatgcatctacgatcaaagtgatcgccaattgcatcgtgactggaattctggccgcacacatgtatatcaatgttttgtttttccagatgggaacttaaggttcaagggccctatattacaaagcacgcgaacacatttgcagaaaactctcggtgatgacaatgttttgctagttaaatttgctgaggatgggagtggaaagaattttaggacccatgctgaagaagcaaatgccctctatggaaagtttggaaaagaagggattcgtgttggtctgcgtttgtatcgcttttttggtaatcctgcttcttgttag

SEQ ID NO: 34112 - DNA, 285 bp, Glycine max
  Peptide Sequence Number=SeqID_150890
atgattcacaccacctttggacccattctaatcaattttgctccgctagaagtcgtgactaaagttgaagttaagcagatgattggattggccatggacaactttgctgagaagcaaacgacagaggatgaagagtttagacgcatcatgcaacaagctattgctactcagttcagtagccttggtgaatctctcattttgaatctccaacaggccgaaatgcatctgttcaacattgttgctactaccccaatgctacttccactcgtccaacctcaaccacca

SEQ ID NO: 34113 - DNA, 279 bp, Glycine max
  Peptide Sequence Number=SeqID_150891
atggagaattggcgaacagcgttacgttataacttcgcggggctccagactcgcagctccgaaaaaagtggagaatggagaattggcgaacatctctacgcaatcacttcacggggctccagatttgaaggtggggggcacatgaacagcgctaggcaaataaattcatggggctccgaaaaaagtggagaatggagaattggcgaacagtgctacgcaataacttcgcggggcttcggactcgatggtggaggacacatgaacagcgctaggcaataa

SEQ ID NO: 34114 - DNA, 3762 bp, Glycine max
  Peptide Sequence Number=SeqID_150892
atgggttgtattttacagcaatggaaaaacaaatgggatgcgccctcctctgtaattctgcagaaaggacattgcatatctgtgagctgtcctgttgagaatatgccattaactagatctttactttctaacttgtttaggttcgaaacttttgacaccaacgcaccatcaggacttgggaagagagttcgaatttctgctaccagtatcttgaatgtaaatgtcagtgcagcaaatcttgaatcctttgtgggaagcattctttcgtggagacaacagttagatcttgaacagaaagcattgaagctaaatgcggaggctggtggtcaacaaggcaaaggagaaaatacaactttttctgcactagatgaggatgacttgcagactgtggtagttgaaaataaacttggctgtgatatttttgtcaaaaaagtagagcatgatgtagatacagttgacaagctacagaatggcgattgtgtttctgtctggattccacctccaaggttttcaaataggttaaatgttgcaaatgaatccagggaagcacgttattatgttgctgtgcagatactcgaagccaagggcttacctattattaatgatggtaacagccataacttcttctgtgctttgcgtcttgttgttgatagccaagcatcagaacagcaaaagctttttccccagagtgcaagaacaaagtgtgtgaagcctgttgtatcaagaaccaaagatcaggttgaaggcacagtaaagtggaatgaacttttcatatttgaagttccccgaaaggcccctgctaagttggaaatagaggttacaaatctcgccgcaaaagctggaaaaggggaagttgtggctgcactttctttttctgtcggacatggtgcaaacattctaaagaaggttgcttccgtgagaatgtttcatcaaccaaatgatgttccaaatattagatcatatccacttaatagattggttcagcaaaatgttgaagccatgcatgatggatgcctctttgcttcaacctcttattttgaaagaaacaaaattgctaaccttcagaatgatatagaaagtgagaacgttggtgatagagacatgggtttttgggtggggcttggcccagagagtgagtgggagagtattcgatcgttgcttccactatcagtggctccaatatcattacagaatgagtatatcggtatggaagttgtgatgaaaaatggaaagaagcatgtaattttcaggggtcttgttacagtagtgaatgattcagatgttattttgaatattttgacttgtcatgcatctcatggttgtgattccttgcttggagtaaacagttctaacactgtaacagcagaagtctttcaaaatcagtattatcagccatcatctggttggggtaacaattggccagctgtgcacaatgataatcctggacattggagcacaagggacttctcatactcatctaaggatttctttgagcctccacttcctcctgggtggaaatgggcttcgggttggtccatagataagtctcaatatgttgacaaggaaggctgggcatatggacctgacattaaaagcctaagatggcctcctatttcttcacatttttcaaccaaatcagcctctgatgttgtgcgtcgaaggcgatggattcgtacaagacaatctttgtctgagcaaggtacagaaagcttgcagggtggagcaagtactgtgcaacctggagcttctgctgttttatcatggagaagctcatcaaagaattctgaccaatgtttgcaagttcgacctaaatttgataattctcagccctcatactcatggggttgtgctattgctgttggttcaagttatatatatagcaaagaccaactattagatccaggttctactagactgacttctgtaacacccacttgctcattgaagcttaatgagcttgagaaaaaagatatacttgtgtgctgcaatcctagtagtggaagtaaacagttgtggtttagtgtgtgtacagatgcctcagttctcaatactgaactaaacgtacctgtatatgattggagaatatctattaactctcctttgaaattggagaaccgacttccttgtcctgctgaattttcaatctcagagaaaacaaaggaaggaaattgcattgagcggcatcatggtgtcgtatcttctcgtcagagtgtacatatctattcagctgatattcagaaacccttgtatcttactttgtttgtgcagggtggctgggttatggaaaaggacccaactattgtactggatccttctttctcgaaccatgtctcatctttctggatgattcaccggcaaagtaaaaggaaattacgtgtgagcattgaacatgatatgggcgggacaagtgctgccccaaaaacattaagactctttgtcccttactggattgtcgacgatttttctttatctttggcataccgtgtggtggaagtggaacctttggaaaatgtagagatggattctgtcctactctctagggcagttaagtctgccaaaactgccttgaaaaaccccataggctcattggatagaaggcattctaattcaaggagaagcctgcaagtacttgaagtaattgaagacaacagtccatttccgagcatgctttctccacaagattatgctggtcgtagtggagtttcaatgtttcaatctcctaaagatactaggctgggcatttctgtttctatgcagtcttctgaagtttacagctctgggatttctctgcttgaactggaaaaaaaggaacgtattgatgtcaaggctttcaattctgatggatcttactacaagctttcggcattgttgaacatgacttcagacagaacaaaggtggttcatttccagccgcacacattgttcattaatagatttggatgtagtctctgcctgcagcaatgtgatactcagtcagctgtatggattcatcccacggattctccaaagccttttgcttggcagttatcagccaaagttgaacttctgaagttgcgcattgatggctacaaatggagtacaccatttagtgtaagctatgaaggtgtaatgcgcattagcttgaaaaaagatgttggagatgaacctatgcaaataagggtagcagtaagaagtggtgccaagaaatcacgctttgaagttgttttccgtccagattcactatcaagtccttacaggattgaaaatcgctccatgttcttgcccattcactttcgtcaagttgatggtatccctgattcctggcagctacttgttccaaattctgctgcttcatttctgtgggaagatcttggtagaagacgcttattggaactcttggtagatggaactgacccaatgaaatcactcaagtttgatattgatgaaatttttgatcaccaatccatccatgtaaatgatggaccaaccagagccttgcgtgttactattgtaaaggaagaaaaaaccaatgttgttaagatcagtgattggatgcctgaaaatgaacctactggagttccaagaagacatttatcatcaacgaatgattctcaaaagcaacaactgacgtcaattacagattgtgaattccacatcaactttgatcttgctgagcttgggatatctattattgatcatacacctgaggaaattttgtatctctctgttcagaatcttgttttggcatattcaactggtttgggctctggaattagtcggtaa

SEQ ID NO: 34115 - DNA, 1026 bp, Glycine max
  Peptide Sequence Number=SeqID_150893
atggctcgggtaacactattcatatcttaccaggcaagcatggaatcaatgatgagaaatcgagaactaagtgaaacaaggatgatgcaggctctaagagaggagctagcatctgctgagcgaagagcagaagaggagcgtgctgcacataatgctaccaaaatggctgctatggaaagagaagtggaattggagcacagagcagttgagtcatccactgcacttgcaaggatacagagagtagcggacgagaggacagcaaaagccacagaacttgagcagaaagtggcacttctcgaggttgaatgcgcatctttaaatcaagaactacaagatatggaagcccgtgtgcgccgggaacaaaaaaaggcaccagaagaggcaaatcaagtaattcaggcatggcaggaagaattggagcgtgcacgtcaaggtcagagggaagctgaaaacaagctatcatccttggaggcaagattcatttttttttttcttgctgaaatgcaaaaaatgagagttgaaatggctgccatgaagagggatgctgagcattactcacgtcaggagcatatggagttagagaaacgctatcgggaactgactgaccttttgtactacaaacaaactcaattagaaaccatggtcagtgaaaaagctgctgcagagtttcaattggaaaaggaaattaagcgtcttcaggaagcaaaggcagaggcagaaagaagtagagtttctcgtcgagcatcatcatcttgggaagatgagactgaaataaaatcccttgagtatgtttcctcttactgtcttaaattgcaaaaggcagtgaaactattagattctggggctgtcagggccacaagatttctctggcagtatccaacagctcgagttattttatttttctacttggtgtttgtacatctcttcttgatgtatctcttgcatcgccttcaggtacaagctgacacattggccgctagagaagttgcagaatctatgggactttctaaccagaatttaccgtga

SEQ ID NO: 34116 - DNA, 267 bp, Glycine max
  Peptide Sequence Number=SeqID_150894
atggaaatggaagcaagcccaaagcaaatagtggcaaggaagctatggaacataggacgcatagtgttcctgatgttgagaaagagcaaactcgccgctgacttcaacctcaacttgttgctcaaacgcggcaagctcgccgccacaaaggccatagccaacaccatcctcacgctccacctccaccgctcccaaaacgacgacgacgccgtttattacccgcgcgactacgagttcagctgcagcaacagccccgcgctcttccac

SEQ ID NO: 34117 - DNA, 1062 bp, Glycine max
  Peptide Sequence Number=SeqID_150895
atgtgtgggctacaagtggacaaccaactgccactaactccaatgccagttctctttaggccacagagagctgtatcagaaactgactatatcctgaaatgctccattacaatgcaatcaaatggatcattggatctttgtgtctatccatatattggtctacatgggccagaaagttcttctgcctttctgataaacattcacgaacctattatttggcgccttcatgaaatgatccagcaggtgaagctcagtaggctgtatgattctaaaacaactgctgcatcagttgatccaataattcaaattgggtatggtttgcttgaaactgcttatgacattacattgaattacagtgtccttaatatttcggaagttcgattcagagtgtctatggctatgtcaccaagtcaaagacccaggggtgtgcttgggttctgggcatccttaatgactgcattgggtaacacagaaaatatgcctgtcaggataaaccagaggtttaatgagaatgtatgcatgaggaagagttctatgattaccatggctatctcaaatgtccgaaaggatctactaggccaaccacttcagcttctctcaggagtcgatatattgggcaatgcaagtagcgcacttggacacatgagtaaaggtgtagctgcattgtctatggataaaaaatttattcaaagtcgacagagacaggaaaacaaaggtgtggaggatttgggtgatgttataagagagggaggtggagcattagctaaaggtttattcagaggggtgactggcattttaacaaagcctcttgaaggagcaaaatcttctggtgttgagggttttgttcagggtgttgggaagggaattattggtgccgctgcacaaccagtgagtggagttttggatcttctgtcaaaaacaaccgaaggtgctaatgctatgagaatgaaaattgcatctgctataacatctgatgaacaacttctcaggaggagactgcctcgtgttataggtggtgataatctgctaaaactatacgatgagtacaaagctcaaggacag

SEQ ID NO: 34118 - DNA, 186 bp, Glycine max
  Peptide Sequence Number=SeqID_150896
gttcagtgttttcagtcaaagaacatgaacctgagagcgttttctctggtggggatgcctgtggcggttgggcttgcgttctggctcgaggcctgtcgggcccagttactcacggcccttgatgaaggatccgacggccacaaacaaccgttgattgccactttggacaacaacaactactcttga

SEQ ID NO: 34119 - DNA, 732 bp, Glycine max
  Peptide Sequence Number=SeqID_150897
atgtcttggtctgcttccgtggagttatggtttctcggccaaggatatcatgatcacttggaaaagggagttgatgctgttccgaatgacaagagagctgaatgggaaaagctggattttcagttgtgtgcagtgctatggcaatctgttgaaccggatgttttggagatccttagatcattcaaaacatgttgctctttttggaagaaagcacaagagatatttgccaacgacattcaaagtttgtttgatgcaacccagaaagttgctgctctcaaacaaaccagccatgatatgattgcgcatgtagggaaagctagagcagcagtggaagaactgaagagatttcttgcagcaaaatcgttggaggaagtgaataggaagctggacaagttctacatggtccttatcttgagaagtgaccaagtcccgtcaatggactccctcattactagacttcttcgcgtgcctcaagccttgaaagaagaaaatttagctgaaagtgtggaaacatcagctatggctgcatctcgtggaagagggggaggtcgcaacaatagaggaggtcgtggtggaaggagtggacgtcctcaatgcacatattgcaagaggatgggtcacactcaagagaattgttattccctgcatggcttccctgacaaagtagctcagctaatggttccaaagttgcagctcaaggaagtggtcaagtatctttatcttcctcattga

SEQ ID NO: 34120 - DNA, 138 bp, Glycine max
  Peptide Sequence Number=SeqID_150898
atggctgaaaagaacagcgatgctagcagtgcagctgcagctgagcaaatatcacaggcacagaacatttccgttattgggaattgttcctttcagcatttcacacctttcggatgtgagaaaacaattaccctttaa

SEQ ID NO: 34121 - DNA, 147 bp, Glycine max
  Peptide Sequence Number=SeqID_150899
atgtttgagttggactttagacagagttattggaagagccctgaaaagagaaaacatcttgagttgaagttatcctcccatggaaggaaggttgagaaatttgacagacttgctccagagattgaagacttagtcattgccacatga

SEQ ID NO: 34122 - DNA, 783 bp, Glycine max
  Peptide Sequence Number=SeqID_150900
atgaccttgccgccaacttcagaatcgaagtcgtacttggcaagagctgcagtgaagcatcgaggcctcgttctctctttgttctgtgcattggctattgctattgagttcactatggtaattgaaacgcgcttttgggattgttgggtccaaaaggaaggtttggagaaaagagaagaagatgagaataccgtcaatgcgagttctgctgagtctgtcaaagaacctgtcatagggtcaagtctggaagcaaaacaggatgatactggtgaggcaactgaatcccttgggcaaggtgcttccaagaatggacctggcattctgcagagcagtacaagtgatgaagccaagaagcttgctgctgctgctcttgcagcagtgaaagatgatgctgccatggctgcctcaagcagggggaaacttgtggttcgggactttgctggtcaagaaattgaagttaaaaagcttgtagattctgactcaaaggaggcaatggaaagagccaaagctcctccaccttctgcagtggatactgtccttgaacaaatcaagaagaaacagaagctcagtgtactggataagaccaaaaaggactggggtgaatttaaggaagaaaagagactggaagaagagcttgatgcttataagaagagttctaaccagtatttggacaaggtttctttcttacagcgagcagattaccgtgagtttgagcgtgagagagatgcgcgactggctttgcaatccaggaagcgaccagataatatgcaagaggatgactga

SEQ ID NO: 34123 - DNA, 300 bp, Glycine max
  Peptide Sequence Number=SeqID_150901
atggaagctcatagcatagggacatttgagactaatgaagtgactgcacttctggtgctcttgggaggttctttggatatgtttgttgtcaattccttcggatctgcattccaggcactattcatttgccttctcctccccttcttatcaaaattatggggcatcccctttggacaactaccaaactatcttaaagatggtgctgcctgctttctgaatgttggtactctgtcaagagctgttattaaatgtgaaattctaaagatggaatacactatacaaaatctagagttgtggtag

SEQ ID NO: 34124 - DNA, 114 bp, Glycine max
  Peptide Sequence Number=SeqID_150902
atggagaaaaccctaggaaaagtgtcaggggtcccaaagaaccgcactaggatccattgtgaacatgtgaatgtcatgttcaatgttgagattgattgtatgcatgtccgatga

SEQ ID NO: 34125 - DNA, 246 bp, Glycine max
  Peptide Sequence Number=SeqID_150903
atggagagtgaagaggacgaggatgtgggacttcccccagagctggagaggataatcgctcaggaagacagagagatgaggcctcatcaagaagagacaaaactagtagacttaggaaccggctgtgggaaaaaggaaataaagataggcacaggtatgaccgcacccatctgtgaagaattaatggccctgctaaaaaactaccaagacatctttgcctggtcataccaagatatgctcggttga

SEQ ID NO: 34126 - DNA, 189 bp, Glycine max
  Peptide Sequence Number=SeqID_150904
atggtggcccgagtgatgttggggtacggctacgaccccggaatgggtttgggcaggaacaacgggcagcagaaccagcctggtctaagacacgaaggccaagtcaccgcgatatgcgaggatgactccccgaggaggtcggatttggtatggctatgtcctcctagtttccaactaggaaattggtga

SEQ ID NO: 34127 - DNA, 255 bp, Glycine max
  Peptide Sequence Number=SeqID_150905
atggtaagcgacaaagaagacgtcggaactgaagtaggaggagacggtagagagctcatcacagaggaagatgatagagcaactgtgggtggcaatgtcgacgaaggagacaacattggagattgtgcaatgacaacgaacacaaccatttccatgagcatcaaaaccagtgatcatcgccatgggaaaaagaagagaaacatgatggggaagatgagaaaaaggggccaccaaagaaagagaataaaggggtaa

SEQ ID NO: 34128 - DNA, 1462 bp, Glycine max
  Peptide Sequence Number=SeqID_150906
atgccaatcctctctcttctctccttcttcctctttctcacctatgcaaactctcagtctcagtactctttgctgtatgatcaagaacatgcagtcctattgaggataaagcaacacctgcaaaatccaccgttcctcaatcactggaccccatcaaactcttcacattgcacttggccagagatcagctgcaccaatggctcagtcacttcactgactatgatcaacaccaacatcactcaaacactgccacctttcctatgtgacctcacaaacctcacacatgttgattttcagtggaatttcattcctggtgaattcccaaaatatctctacaactgctccaagcttgagtaccttgacctctcacaaaactactttgtcggtaagattcctgatgatattgaccacttggctagcctgagttttcttagccttggtggcaacaacttctctggtgacattccagccagcattgggaggttaaaggagctaagaagtcttcaactttatcagtgtcttctcaatggtactttccctgccgaaattggcaacttgtccaaccttgagtccttgtatgtgttctcaaaccacatgctccctcccacaaagttgccatcaagcttgacccagttgaacaaattgaaggtctttcatatgtatgaatccagcttggtaggggaaatccctgaagccattggacacatggtggcattggaggaattggatttgtcaaaaaatgatttaagtggacaaattcccaatgatttgttcatgctgaaaaatctgagcatactgtatctttaccggaacagcctttctggggagatacctggagtggttgaagcattccacttgacagaccttgatctttcagagaataaacttagtgggaaaataccagatgatttgggaaggctcaataacttaaaatacttgaatttgtatagcaatcagttatctgggaaggtaccagaaagcattgctcgtctgcgggctctgaccgattttgttgtttttatcaacaatttatcaggtactcttcctttagacttcggtctgttctcaaagcttgaaacatttcaggttgcatctaatagtttcacaggaaggttgccagagaacttgtgctaccatggaagtttagttggtttaactgcttatgacaataacctgagtggggagttgccagaatctttaggaagttgcagtagcctgcaaattctgagggttgaaaacaataatctttctggcaacattcccagtggtctatggacatctatgaacttgacaaaaattatgataaatgaaaacaagttcactggtcaacttcctgaaagatttcattgtaatctttcagtcctgtccataagttacaatcagttttctggtagaattccgctcggagtgtcttccttgaagaatgttgtgatcttcaatgccagtaacaacctcttcaatg

SEQ ID NO: 34129 - DNA, 3033 bp, Glycine max
  Peptide Sequence Number=SeqID_150907
atggaactattcacctcatcatgtcttaaatttctatttcactctcttgtgatcttattcgtcctctttaaccatgcaaactctcagtctcagttgcatgatcaagaacgtgcaactttactgaagataaaggaataccttgaaaaccctgaattccttagtcactggactccatcaagctcctctcactgctcatggccagagataaaatgcacctccgatggctcagtcactggattgactttgtccaacagcagcatcactcaaaccataccctctttcatatgtgacctcaaaaacctcacagttgttgatttctacaacaattacattcccggggagttcccaacaactctctacaattgctccaagttggagtacctagacctgtcccagaacaactttgttggtagcatccctcatgacattgacagactctctaatttacagtatctcagccttggttacaccaatttctctggtgacattcctgcaagcattggaaggctaaaggaactcagaaatcttcaatttcaaaacagtcttttgaatggaacattccctgctgagattggcaacttgtccaatcttgacaccttggacttgtcctctaacaacatgctccctccttcgaggttgcacgatgactggacccggctgaacaagttgaagtttttttttatgtttcagtccaacttggttggggagatccctgaaaccattgtaaacatggtggctttggagagattggatctatcgcaaaacaatttgagtggaccgattcctggcggtttgttcatgctggagaatctgagcataatgtttctttctagaaacaatctttcaggggaaatacctgatgtggttgaagcattgaatttgaccatcattgatctcactcggaatttcatctcaggaaaaataccagatggttttggaaagctccaaaagttaactggtttggctttgtctattaataacttggaaggggagataccagcaagcataggacttcttccatctctggtagattttaaagtgtttttcaacaatttatcaggtattcttcctcctgattttggtcgctactcaaagcttgaaacatttttggttgcaaataatagttttagtggaaagctaccagagaacttatgctataacggtcacttgcttaatatatctgtgtatgaaaattatctgagtggggaattgccacaatcacttgggaattgtagtagcctcatggaactgaaaatctatagcaatgagttttctggtagcattcctagtggtctttggactttaaacttgtcaaatttcatggtgagtcataataagttcaccggtgagcttcctgagagattgtcctcaagtatttcgcgcttggagatagattacaatcaattttctggtagaattccaactggggtatcttcatggactaatgtggtagtgtttaaagccagtgagaactaccttaatgggagtattccaaaagagttaacagctcttcccaagctaaatattttattgcttgatcagaaccagctcacagggtcacttccgtcagatataatatcatggcagtcccttgtaactctaaatttgagccaaaaccaactctctggacatatcccagattcaattggtctgttacctgtccttacgatacttgacctgtcagaaaatcaattgtctggtgatgttccttctatacttcccagactcaccaatctcaatctatcctccaattatttgacagggagggttccaagtgaatttgacaatcctgcttatgacaccagctttttggacaattctggcctctgtgctgataccccggcactgagcctcagattgtgcaattctagccctcaaagccaaagcaaggactcatcttggtctcctgctttgattataagccttgtggcagtggcctgcttgctggctttgttgacatcactcttgatcatcagattttacagaaaaagaaagcaagtattggatagatcatggaagctcatttccttccaaaggctgagtttcactgaatcaaacatagtgtcatcactgacagaaaataatattattggcagtggcggatatggtgcagtataccgtgttgcagttgatggtttaggctatattgctgtgaagaagatttgggaaaacaagaagttagataaaaatcttgagagctcatttcacactgaagttaagatattgagcaacattcgccacagaaacattgtgaaattgatgtgctgtatctctaatgaggactctatgctccttgtctatgagtatgtggaaaaccgtagccttgacaggtggctgcaccggaagaataagtcatcagctgtgtcaggttcagtccatcatgttgtccttgattggccaaagagattgcatatagccattggagctgcacaaggtttgagctacatgcatcatgattgctcaccacctattgttcatcgagatgtgaaaacaagtaacattcttttggattctcaattcaatgcaaaagttgctgattttggtctggctaggatgttaatgaagccaggggaacttgccaccatgtcatctgtgatcggctcatttggctatatagctccagaatatgctaaaacaactcgagtcagcgaaaagattgatgtgttcagctttggagttatcctattagaactgacaactggtaaggaagctaattatggtgatgagcactcatctcttgcagagtgggcgtggcgccaccagcagttaggaagcaacatagaagagctgctagacaaggatgtcatggaaaccagttacttggatggaatgtgtaaggttttcaaactagggatcatgtgctctgcaacacttccttctagtagaccttccatgaaagaggttctacaaatattgctttcttgtgaagattcattttccaaaggagagagcattattggccactatgatgatgttccccttctcaaaaattcaaaaagagagcataagttggatattgataatgatagctag

SEQ ID NO: 34130 - DNA, 1446 bp, Glycine max
  Peptide Sequence Number=SeqID_150908
atggccagatgggatgcaatcctatctcttccagtacaaaatcctcccacattggaaatttcttctgctgagctagtgtggtcaaaagtggaaggttggcatgataaattagatagagtagctctaatcccatatgctagagttgatgattttgtgaggggtgaatcaaataacaaagaatgtcctacaagatttcatgttgaagcaaggcgtcgacggtctccatcaacacctttcaagcaaaaggttgatggcatactagagtatattttgtattggtgttcctttggtcctgatgaccatagaaaaggtggcattgtccgaccaagtcgtaccacatatgttccaaagaagaaaaatgcaggtagaccaaatactaagagaggttgtatttgtcactttattgtgaaacgcctcattgctgaaccttcagttgccctgatcatatataatgatgataagcatgtggataaaaagggtttgccatgccatggtccacaggacaaaaaggctgctggaacacgtgctatgtttgccccatatatctcagaagatctccgtctacgggttttgtctcttctatatgttggagtctctgtggaaactattatgcagagacacaatgaatcagttgagagacaaggtggtccatgtaaccgtgatgaccttttgactcatcgttatgttcgacgacaagagagggcaattcgccgttctacatatgagctagatgatgatgatgctgttagtatcagcatgtgggtagaaagccaccaaaatctggttttcttctatgaagatttctctgattccaatccatttactctgggcattcaaactgagtggcaattgcaacaaatgattagatttggaaactctggtatgcttgcctcagattcaagatttggtacaaataaattacagtaccccattcatagtcttctagtgttcaacttggacaagaaggccattccagtggcttggataatagcaccaaagttttcaagtttggatgcacatcgatggatgagggctctttacaatagagttcacaccaaagatcctacatggaagttggctggcttcatagtagatgatccatcatatgatgttctcgcaatcagggtgtttgtttggggaccaattaaattttgggaaatgattgatctcttagaaagagtcttcgatcctggtcatgagcttattgggtgcttgcctgtgatgataagtttctggcggattcgccatttatggcataaaaacatagtaaagtgtttggaaactgatatgcaaataaagatatccagacggcttggatggatagtggataatatttgtcgccatcaagggagcatgtcactctttgaagaattcatggaagactttattgatgaatccaaatttatggactatttcaaggccacatggcatccaagaataggttag

SEQ ID NO: 34131 - DNA, 699 bp, Glycine max
  Peptide Sequence Number=SeqID_150909
atgcctagcaagcgcaagaccagatcctccgcctctcccgctgccgcgccgccgagcaagcgcgcctccagatcctccgcctctcgcgtcgccgattccgcaccggtcaaatctgaagccgaggaagttgtggcagcttcctctgtcgtcaaagaagaggcgcaagcaagcttcacggacgttactgacggcaacgttagcgatggcgaggggactaacgccagattcgtcggagagcctgttcccgacgaggaagcccggcgccgctggccgaaacggtaccaggaaaaggaaaagaagcaatccgctgggccaaaatcaaacagaaacgatgaagacgaggagattcaacaagctcgacgtcactacactcaggcagaagtagatgggtgcatgctttacaaactttacgatgatgcccatgttaaagcagaagaaggagaagacaattacatttgtaaaattgttgagatatttgaggccattgatggggcactgtattttacggcacaatggtattatagggctaaagacactgtcattaaaaaacttgcatatctcattgaaccaaagcgagttttcttttctgaagtccaggatgacaaccctttggattgtctagttgaaaagctgaacatcgccagaataacattaaatgtgagagttagaagcaaagaaggaaaccattccaccttgtga

SEQ ID NO: 34132 - DNA, 450 bp, Glycine max
  Peptide Sequence Number=SeqID_150910
atggaactccaacgtcttaatcaaaatgaagaaatcaacaaaaagaaaagaagtatagcacttaaagcctcctcatcaatgcattctgaaaatgaagaagaagaatcagaagatgaagaagacttctcactttttgtgcagaagtttcaaaaatttgtcaagaaaagaagaatcgagaagcgtcaaaacttcaacaatggaagaagatctcaagaagactatcaaattcttagatgctacaaatgcaaccaacttggtcacatcaaagcaaattgtccttcaaatgaggaatggcctgagaaaagtgataggaaaaggtatgaagaaagaaggaccaagaagtcctacattgcatgggatgacaatgactcatccaacggtttagagaaggagatcaaccttctaaccaaggactatgagagtaatgagaacatctctctagaagattaa

SEQ ID NO: 34133 - DNA, 372 bp, Glycine max
  Peptide Sequence Number=SeqID_150911
atggcaaggaaaagtgtgattcagagggagaagaagagacaaaaattggaacagaaatatcatttgattcgccgatcctcaaaaaaagaaataagcaaagttccgtcgttaagtgataaatggaaaattcatggaaaattagaatcactaccgcgtaatagtgcacctatacgtcttcatcgacgttgtttttcgaccggaagaccgcgagctaattatcgagactttggattatccggacacatacttcgtgaaatggttcatgctatgtttattgcccggtgcaacaagatccagttgagcaacttggtagctcgcaaggctcataaccttgaggtcacgggttcaaatcccgtctccgcaacattttga

SEQ ID NO: 34134 - DNA, 254 bp, Glycine max
  Peptide Sequence Number=SeqID_150912
tgcctatacccgcgggagtcgctgtatttgctagagcaaggttgttcgctagctcgagccaggatccggattttgaatcctctttcttcccaatagagttgcagattcggctcaaactgctcaatgcgggcaatctttctacctatttggcttcggttgagttctgtttcgacggctttagtttggaggatctgaaagacttctgccggtgcaagcgatctcatagatggatcacagggaataactcaagatag

SEQ ID NO: 34135 - DNA, 393 bp, Glycine max
  Peptide Sequence Number=SeqID_150913
atggctaaggaggatcgagagatgaagctataccaagaagagatagagctcgtagacttaggtgccaacagtgaaaggaaggaagtaaaagtaggcacgggtatgactccacccatccgtgaggaattagtggccctactgagggactaccaagacgtctttgcttggtcgtaccaacacatgcctggtttaagccacgacattgtgcaacacaggttacctttgaactccgattgttctctggtgaaacaaaagctaagtagaatgaaacccgaaatgtcattgaagatcaaggaggaggtgaaaaagcagttcaatgccggtttcttggcggtagctcgataccccgagtgggtggccaacattgtgccggtctctatgaaagatgggaag

SEQ ID NO: 34136 - DNA, 258 bp, Glycine max
  Peptide Sequence Number=SeqID_150914
atgctgtggaactttacggattatgcaacgatgctcttcttgacttccggaatgctacggaactttaaggattacgcaacaatgctctttttgacttccggaatgttgtggaactttatagattacgcatcaatgctcttcttgagggtcctgaagggaacaaacaagcttcaaagggagtttagagcaacaaaacttcttcttcttcttgctcttgagggatggtctagaaaccttgaagcctggaagtgttggtaa

SEQ ID NO: 34137 - DNA, 565 bp, Glycine max
  Peptide Sequence Number=SeqID_150915
ggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatgctacagcagcggtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaag

SEQ ID NO: 34138 - DNA, 330 bp, Glycine max
  Peptide Sequence Number=SeqID_150916
atggcatctaagaaaaggaaggcaccttctacacctacccaggccagatttgatagatccagtagcatagacattgctattgtgaaggaattttatgcgaacctctatgaccccgaggataaatcacctaagcaagtgagcgtgagaggtcacttagtgaaatttgatgagaataccttgaacacatttctgaagacctcggtaattttggaggagggagagaatttgtgtacttattctaggtttgcactcctgaggcctaatcctcaggagttggctgctaagctctgtatcccagggaaaggatttgagctaaatgctgatgggtaa

SEQ ID NO: 34139 - DNA, 360 bp, Glycine max
  Peptide Sequence Number=SeqID_150917
atgtcatcaagtcaatcaatatcgatcaatacacaagcgttatgcaacatatacactaagactcaatcctatatgcaatatggtatcatgtcagtgaaaaaccatgtcgggcgcctaggagtacatgacaagacaaaccacacactagcaagtcaggtcactctcattgggcttaaaggaacactcaaaccgggtgacccccaaggcctacactccgaagagtctgtcaagtttatctcgtcgcccttaaagagtcttagcattaactcgtcgcctttaaagggacttagcattaactcgccgcccttaaagggacttaacattaactcgtcgtccttaaagggacttagcattaactag

SEQ ID NO: 34140 - DNA, 282 bp, Glycine max
  Peptide Sequence Number=SeqID_150918
atgtcgctgcatgttctttatctttatgtgttttctggatttcccccagggattccccgtctactgtatctctcgttacaatctttcaaagaaatgaacgggcaggatcatcttgagctaccttctgggtggggacaaaacatgaacagcagaaaccaatcaaggtacttaggaacggatgcaagtggggatggggtcacaaccgaccgatcgttgccccttctctgcgctaaacaagcagagaacgccgcgcaaggcggcccagtatcctttggagtcgca

SEQ ID NO: 34141 - DNA, 441 bp, Glycine max
  Peptide Sequence Number=SeqID_150919
atggttatgggagattcatcagcagactctccttccctggtagacgcattgtttctcactcaaaaaagcatatgctgctctaaatcagttggaatatttgtctctttgctaaagcatgtttgcattttagtggagaaaacactgaggactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacgaggcagcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 34142 - DNA, 442 bp, Glycine max
  Peptide Sequence Number=SeqID_150920
atggaagaatcatcaaagaagcgtaagggctcatccacctccgcttcggcttcaagagctcatcgttccagagccaccagcgcatccacaacaccaattccaccctccttatcctcttccacactgttttcttccgaagaacagcagatacgatactcaaaccttttctcatctcgttccattatcgaccctaagttcatagatatggatttcttttctgctgaaagttttgattgcattcaagcatttcagaacttaggtctcatacctttcatgtcattacaattgcctgtttattctgaattggttaaagctttttattgtaaccttaaaattcaggaaagcactttgatttctgaggtttttgggataaaaatggtcattgaccaatctcttttccataacttaacccaattgtccagtggcggtgtaccatttgaag

SEQ ID NO: 34143 - DNA, 717 bp, Glycine max
  Peptide Sequence Number=SeqID_150921
atgcaatcacagggactcgcactgcctcctgaacctgatgttggtccttcagctgctcgtgtcagcacaaaggagagttgtgttgatccctcagggaacgatctagacaccggtgactcatacaaatgtgggttgtatattgaagaatatccttctcgcctggttgccctgggaagagtttatgagggatctacaacaattcacaacattcctttgctgcatgatcaagttaaggttagtgttgaggagattagagatgtagatgctcccattcctgtacccactaaagaggttaaggtcgtgggacaggctcttaacacattccttgcttggccgacacatctagtcaagcgtttatcagaacagggagctgtgagacccgcgaaacctgcagataggccggatgatgaggtcgatgatccgctatatctaatgacattgaccattccacagctttttctgaagccattgcagcatgaagatctgtctgaaattgcacatggtggtcaatgtctcagcatatctgttatacagttgtggattctgcatatgactgagacaagtatgcgagctgggaatatcgatgtgtatggattcctcgagccacagtctatccagagatctggccaatcacaatttgaatcagaaaattacattaagaactggatgcaaaattcaaaacgagatgtgtacctaggagcctacttgaatgggtaa

SEQ ID NO: 34144 - DNA, 759 bp, Glycine max
  Peptide Sequence Number=SeqID_150922
atgaccatgcaacatggaattaagcctactgtgacacattatggatgcatggttgatctccttggttgtgttgggtgtttagaagaagcccttgaagtcattgtgaatatgcctgtaaaaccaaattcaattgtttggggatcacctcttggtgcttgtagagttcacaaaaatgtgcaactagcagatatggcagctaaacaaattcttgagttagagcctgaaaatggggctgtttatgtcttgttatgtaatatatatgcagcctccaagaaatgggaaaacttgtgtcaggtcaggaaattgatgatggagaggggaattaagaaaacaccaggttgcagtttgatggaactgaatggcaatgtttatgaatttgttgctggggaccagtcacatcctcaatctaaagagatatatgcaaagttagaaaacatgatgcaaggcttgataaaagcagggtactcacctgatacatcagaggttttccttgatctaggggaagaggataaggagactgcactttaccggcacagcgagaagttggctattgcctatgctcttattagttcagggcctggagttaccataagaatagtgaagaaccttagaatgtgcgtggattgtcaccatatggcaaagcttgtgtcacaagcttacaatagggaactaatagttaaggataaaaccagattccatcatttcaggcatggcaagtcatatgccaattttgatcctcattcaaatcataggaactag

SEQ ID NO: 34145 - DNA, 186 bp, Glycine max
  Peptide Sequence Number=SeqID_150923
atggcggtttatggtggctactggtggctaaagaaggagaagaaaatggcgtttttcctaagctacttggactacaaggctcaaaacgcacaagcgagcaatgctctcagaaatggaaacgtcgcgcacactccagatatcttctcaaagatcccaacggtcacatcgtggacaagtgttttgtga

SEQ ID NO: 34146 - DNA, 614 bp, Glycine max
  Peptide Sequence Number=SeqID_150924
atggcgttggccttcgtgcgtcaacagccgttcgtcgcctgcaccctgctgggcgccaccacggtggatcagttgaaaatcaacatcgacagcctcgatgtggtattggatgaagacgtgctgcaggcgctcgaagaaatccatacccgcgcaaacaccacgccaaaccctacgccgacgcccaccaccggcacgcccagcttcaccaccagcgaatacagcgccagcatcagcaacatggcggcgttttcacccagcgcgaataccgcgaccgcaacgccgatcaggatcccggccggcatgcagcgcttcaccgtcttcagcgtgacaaagcgcgcggcggcgccggctcccaccacgataccgacggctaccatggcgttcagcagcgtcggcgtggcgttatcggcgatgccgagcgctaccggcacccacagcaccagcagaaaacgcagcgtcacgccggccccccagaacaggctggtgccgatcaaggaaaaacgcgtctgcccatcgcgccataacgtgacgcaggcggtaaagaagctgttcgtcatggcccgcgggcgccaggaagcccccgggcgcgccgccgcgaggcgcggaatatacag

SEQ ID NO: 34147 - DNA, 525 bp, Glycine max
  Peptide Sequence Number=SeqID_150925
atgacaaggagtaagaggtttgtggaggcggaggatgaggatagtgtcgtgtccaagaagaaagctgctgaaaagaaaggtattgatgaaaggaaaaatgaggtgatagagaggagtagaagtggacaagctagagagaagaaaagagaaaaagctgtgattgaaggtccagaagtaccatatcctgtggtaccttccaagaagaagaaggaccaccatttggcgagattcttagatattttcaggaaactggaaataaccatgccctttggacagatgccactctactccaagttcttaaaggatatgttgaaaaggaaacataagtatattcaccaagaaaacattgttgtggaaggaaattgtagtgttgtgattcaaaagatccttccacctaagcataaagaccctgggagtgtaaccattccttgttcaattggagaagtcactgtgggaaagactcttattgacctgggagccagtattaatttaatgccactctccatgtgcagaaggttgggatag

SEQ ID NO: 34148 - DNA, 456 bp, Glycine max
  Peptide Sequence Number=SeqID_150926
atgactaaccgcctgagatatcttttgtttctctttacaaagattcaagggactaatcgcctaacaattctttgtcttaacacattggagggtacatcctttgtggtacaagtagattgtacatctacttgggttgtaatactgagaacaagagagggattttacaaggttattggaaatctcaagaaccggtggttgcttggtgtcgcaacatgcccttttgcgggcgagcgaggcgaggctcacaggtgcgctttccaaagaaggaaagatgcgcggagtcgccaccaacgtttatttgtggaaaacgtcggaaaaaccgaagaaaaccagtcaaaacgaaaattccaagttcgggagttgtatttacgtttgaggaaggtattagcacctctcacgtttgtctcaaaggacaacagcctattttttagaattgtggaaattgtgttaccttaa

SEQ ID NO: 34149 - DNA, 222 bp, Glycine max
  Peptide Sequence Number=SeqID_150927
atggaacataggaatttggggatcccacggtcatgtggctcagcatgccaccggactcttgggtcacgcatttcgtttctaaacgaccatttagaggaaacattgggtccaacaaaaataggagaaaatcactcaaagtgtatcaatctcacacagtgcgtggtgagaaagtcgctagcgcacaggattttgtcggcaatcaaagggagaggaccactttag

SEQ ID NO: 34150 - DNA, 273 bp, Glycine max
  Peptide Sequence Number=SeqID_150928
atggtgagcaatgggacaaaggttgtggttcttcccttcaacacaagtgtagaactagtgatgcaggacaccagcattcttggtgctgaaagtcaccctctccatttgcatggctttaacttctttgttgttggtcaaggttttggtaactttgatccaaagaaggaccctgcaaacttgaatcctgttgatcctgttgaaaggaacacagttggtgtcccatctggtggatgggttgctatcagattccttgctgataatccagtgttatag

SEQ ID NO: 34151 - DNA, 627 bp, Glycine max
  Peptide Sequence Number=SeqID_150929
ctggttgacgaaaccgcggtcgattttcagttcggtcgcgggaagtcgcttgaggtacagcaggctggagtagccggtgccgaagtcgtcgatcgaaatggtcacgcccagtcccgacaggcgcttgagcaccgtcaggctggcttcggcgtcgcgcatggcggtcgattcggtcacttccagcgtcaggcaggacggcggcacatcgtgccgcgccaacgcggcgcgcacggtctcgaccaggctggcgtgggcgaactgcagcgcggaaatgttgaccgcaatggtccagtgcccctgcccggcgttgatccattcgcgcatctggcggcaggcttcattgatgacccattcgccgatcgacaggatcagcccggtcttttccgccgtggggatgaactggtccggacccaccaggccgcgcgtcgggtggttccagcgcagcaaggcctcggcgcccatgatggggccggccggcgcctcgtacttgggctggtagtgcagcacgaactggttgcgttcctgcgccaggcgcaggtcgtgcagcagctcgatctgttcgtgcgcgtcggcgttcatcgacggctcgaagaagctgtagccggtgccgcccaggcgcttggcgtg

SEQ ID NO: 34152 - DNA, 1170 bp, Glycine max
  Peptide Sequence Number=SeqID_150930
atggaaaaaaaggtccttttttttgtctccattctcttattcattgctctgctatttcatggaggaaaggttttagctttcaagagccaagacggatcagaggaatggggatacgttcaagtcagacccaaagcgcacatgttttggtggcattataaaagtccatatagagtggaagatccttctaagccgtggccaattgttctatggttgcaaggaggacctggtgcttcaggagttgggattggaaattttgaggaggttgggcctttagacacaagcttgaagccaaggaactccacatggttgaaaaaagctgatctcttgtttgtggacaatccagttggaaccgggtacagttttgtggaggataaaaaactctttgtcaaaacagatgatgaagcagccaccgacttgactacgttgttgattgagttattcaatagggatgagaagctgcaaaagagtcctctgttcatcgtggcagagtcatatggtggtaaatttgctgtcactgttgggttatctgctctgaaagctataggagatgggaaattgaagcttagacttggaggtgtggcattaggagacagttggatctccccagaagattttgtgttctcatggggtcctctccttaaagacctctcacgacttgacgataatggactgcaaagatcaaacagtatagctgagaggatcaagcagcaaattgaggatggtaaatttgttgaagccaccgaatcatggagtaaacttgaggatgtgatttcctccagcagcaacaatgtggacttctacaacttattggaggatgcgggaggtgataacatagcagcaatggagttagggttatacgaaaaattatcaatgaagaggtattctagatatctttcttccatgaggtcaaggtcatctcctggtggtgatgatgatcttgacaagttattaaacggtgtcataaagaaaaaattgaagatcatccctgagaatgtcacatggggagggcagtcaggtgatgttttcgactatcttgcaggtgattttatgagaccaagaattaatgaggttgatgaactgctgacaaaaggggtcaatgtgactgtatacaatggacaagtgccacaattattttatttaacaagtggacctgttcccgaattaatctga

SEQ ID NO: 34153 - DNA, 408 bp, Glycine max
  Peptide Sequence Number=SeqID_150931
atgcagcgcacggcggcggcgacagatgaaccacggcggcgctccggcgacgcggagggggagaaggtgttcaaggggagcgaggtgttcggcgacacgtcaccaaattacttgaagaccattttggccctggcgttgtggctcggaaccattcatttcaacgtcgcgttggtgctcttcgcaatcttcttcctctctctccacaaagcacttttgcttttcggtttgcttttcgtgctcatggtaattcctgttgatgaaaagagcaaattcggtcgaaaattatccaggtacatatgcaagcacgtttgcgcttactttcccatcacgcttcatgtggaggacatgaaggcctttcatcccaatcgtgcttatggtttctggcagcaagctgttaaggagcattaa

SEQ ID NO: 34154 - DNA, 525 bp, Glycine max
  Peptide Sequence Number=SeqID_150932
atgcggaacctgcgcgcagctgcaccagatctaagcccagatagtgtgacccacgtaatccagggcaacgattacgtcaccccgagtttcgtcacagcatgggcgcgcctcagcggaattcgccacgttccgagggtacgcccaagccgagtgccacctcgacgtggtcgtttcgttcgcgcgcatgcaccgcgccggcgcgttcccgaactgcttctagttccccatggtagtctagtcttgcgcctatgcgaacgcgccaaacgcgggtttaagtcgaacacgcttgtgcggtgtgcgttgattcatatgtattcgttgagagggggagtgtttattggggacgcttacaaggtgtttgctgaaatgcgcgagaagaatgttttcgcttggactgctattattgccgcacacgtggcgtgcagcgacatgctttccgcccggaggctctttgacctcgggccgcagcggggcgtggtgctgtggaacgtcgtcgtttcggggtacatcgagttgggagcgtga

SEQ ID NO: 34155 - DNA, 216 bp, Glycine max
  Peptide Sequence Number=SeqID_150933
atggatgatttagcccaaattcctctccttactccatgtgaacccctccctttggtggcggaggtttggtcgaaggagcccatggttgtagcaggtggcggcggcgacgttgagggtctcgacttggagcaaaatcggggtttaaagaactacgactcgggaattgtagggctagaggtggttgcaactggcaaaagcgaaggagctattaattag

SEQ ID NO: 34156 - DNA, 471 bp, Glycine max
  Peptide Sequence Number=SeqID_150934
gtgaaggtgagagaatgtggtgatggtgaggttgttcctaatgattacaccgttgtgacggttttgtccgtgtgttcgagattaggggaccttgagatggctcttgatgtgtttaatggcttggatgtaataacatggaacactataattaacggcctcgccatgcatggccacatggctaatgctttgagtttgtttgagcagatgaagagcacaggagagaggccggacggtgttactttggttgggattttgtcagcctgcacacagatggggttggcgagagacaggtttatgcatttccgatcgatggttgatgattactcgatcgtacctcagattgagcattatggatctcgggcatgtaggatgtacaagaatgttgaaatggcagagctggcgcttcaacggctcattgaacttgaacccaacaaccctgcaaactttgtcatgctttcaaacatatactag

SEQ ID NO: 34157 - DNA, 849 bp, Glycine max
  Peptide Sequence Number=SeqID_150935
atgccgcttcatagtctctatcttattcttggagctcacatattgatatggacaggaaatttagggaacctgcctatgatcattattgcagctatatgtaaacaggaaggcagcccttttggagaacctgatctctgcaatcaatatgggatggcttatgctgcactttctatggcgattggagcagtttttctatggtcatatgtttacaacttaatgcggatttcctcaagtagaatccaaaatgaagaccgtacaagcaatgacagcagcatgttgaaggcttcagcagacatatcagtttcacacccacacaatttttcaaaaacacttaatactacaaaaggcaccgtggataatgcatataccatactgctacctgaaacaaattcggaggaaaaagtttcattcccaagtaaaattaagcactacgttaggatgatctcaagccacttaaatttcaaatccatgtttgcgccatcaaccctcggagcaattgctggttttatcattggtgtagtcccccaaatacgtaatttcatgataggcaataatgccccgcttcatgtggtcgaagactcagcttccatgttaggtgaggcagccatccctactgtcactctaataatgggtgcaaacctacttaaaggtttgaaaggaacaactgctccagtgtggaccattgtgggaattgtagtggtcagatatattttcctgcctcttttgggtattgcagttgtcaaaggtgctatgcacttgagtttggtgcattcagatgccttgtatcagtttgtgcttctacttcaatatgcacttccaccagccatgaatatagatgtaatgttataa

SEQ ID NO: 34158 - DNA, 319 bp, Glycine max
  Peptide Sequence Number=SeqID_150936
gggatggtgggtttatgcgcgatttgtggatgtggaaaacttgttgtggaccatcgcccgaccgccacctagtaccacatgtgatggagtggtacctggagatatgtcccgggggtcaggagaccttggggacgtcaggcgagctcctggcagtcaacagataaaaggaacaaagaccacaaagcaaggaggcttgtgtggtggctggccagctgtgaatcttgaagctaggagagcttctagtaatcgattaccaaggggtgtaatcgattaccaggcttcaaaaagggaactggaagactatggaggcctctggtaa

SEQ ID NO: 34159 - DNA, 372 bp, Glycine max
  Peptide Sequence Number=SeqID_150937
atggggtttataaagctgttttctgttgcctctttcccggttatcaaggtcttattgattactgcacttggcttgtttcttgcactggataacatatcaatattgggagaagatgcaaggaagaaagtgaatcagcttgtgttttatgtgtttaatccatcgctggtgggtagcaatctggccaaaaccattacttttgagagtgttgttaagttgtggttcatgccggtgaatattcttggaacattcatattaggctcggccttgggatggattttgattaagatgacaaggcctcccaaacgcatggaaggtctaatcttgggttgttgttctgctggtatgaactcctcttcacaaataattgaatga

SEQ ID NO: 34160 - DNA, 639 bp, Glycine max
  Peptide Sequence Number=SeqID_150938
atgggagatacaacatctagagatcaaggatttcaaagcatcctgcattcccatgacaatggcattccagaaattagcattcaagatagcagggtatctgaggtggttttggttacctcatataaattgtggcggcaagtgggagagtctttcaaacctccaaagacatgcacaacagtttcatggacttttcgggttttttatgagaaggcacttcttgactatgaaaggcatacaacaaaaggtggtgagctgaatgtgcctattactcctcatgctgagccaataaatattgaaaatcagtgtgtccagggttcagcatcattgggtagggcgcggagagatgctgcagcaagggctatgcagggttggcactcacaacgtctccttagcaatggtgaatttagtgatcctattattaaggataggaactctttgtctacacaaaagcgtgaaaagcagcttaaaaacatcagtatggtccttcatcatattgctattatttttaactataaagtgctgcatgattctaaagactctcccctcttattggctcagatttacttaaacgcaagaaatcatcagacacagttaatgctgtcaaagtggcacacagccaaccatctagaccacagttaa

SEQ ID NO: 34161 - DNA, 414 bp, Glycine max
  Peptide Sequence Number=SeqID_150939
atgtcgcagaggagcaatgcatcatcatctcgaacaagagtttcatcacaagttgttcttttttgtggttgtggtagaagggctgttaggcatgttgctggaacaaatattaacagaggaagggcgtttttcacttgttcaattaataaggatgaagttggatattgtgggtactttatttgggttgatcaattgattgaagcacttggagttgatgattcagttgggacattttccatggaaaaaagaagacaatttggaagagaggaagataagacaatgtggaaggctcaagttaactcaaagcttgattgtatggggattgaaatgaagatgtttagaacaattgtctatggactgttcttaatccaattgttgtcaatggtggtgtttgtatgtattcacaagtactag

SEQ ID NO: 34162 - DNA, 1631 bp, Glycine max
  Peptide Sequence Number=SeqID_150940
ctcagatgggtgattaacatccgcaaaactcttgaagaagaggttgaggaggatggtgaatttgctgtgtccatcttcagcgtgccaaagctccttatggcaagtgatccagactcttatgtccctcaacaggttgcaattggtccctaccattattggcgtccagagctatatgagatgcaaaggtacaagattgctgcagcaaaaagattccagaaacaccaacaaagctgcaagttagagaatctagttgaccagttgaacaagttggagcaaagggttcgagcatgctaccacaagttcttggacttcaacggggaaacgttggtgtggatgatgacagttgatgccgcattcttgcttgagttccttcaagtttttgccatgcaagaaggagcaaaggtacaaagggtttcctccagcatgtctcatttggtggactatgctgggaagaaatcagctcataatgcaattttgagggacattgtaatgcttgagaatcaaatcccattgtttgtgctgagaaagatgctggacctcaaattctcatcacttgaagctgcagatgacatgctcagcttgatgttcatagggctgttcaaagagatttctcctttcaagatgatggaggagtatccaaacattgatgtctcggagagtgtgcatttgctagatttcttgtatgatctgatagtacccaaattagaacaacagccagacacaattgaagttgagcttcaacaagaagaacaaaaggaaggaaataatgaagaagcaacctcagactccagccatgttaagcaattcttatgtgaagtatggaagctgctttcaaaactaaacaaaggaccagtgaagatggtcaaaaaggtaattgtgtctaaacctctcaaagtctttgttcagttgccttggaaaatcgtgtccaaccttccaggacttaaggttctgaagcaacctcttgaacatttcttattctctcaagaaaaagcagatgaaaagggagaaagtgtgaattcaagctctaatactctcatgaaaaaaccaccctcagtggaggaaatcactattccttctgtcacagaactcttgaattgtggtattcgtttggtacctactaagggaagcatatcaaacatcagttttgacgtgaaaacaagcacggtttaccttcccacaattggtttggatgttaacactgaagttttcctgagaaatttggttgcatatgaagcatcagttgcatcggggccattggttataacccgttacactgagttgatgaacgggattatagactcggaggaagatgcaaaggttctcagagaaaaagggatcattctgaaccacttgaagagtgataaagaagtggctaacctgtggaatgggatgagcaagtccttgagattatcaagggtgccattattggataaggtcattgaagatgttaacaagtattacaatggtagaacgaaggtcaaaatttggaaattcatgaaggtttatgtgttcagttcttggcagtttttgacattcctagctgccatatgcctcttgctcttgatggctttgcaagctttctgctctgtctacacttgtagtcgctttttccgatctgcactagattccca

SEQ ID NO: 34163 - DNA, 381 bp, Glycine max
  Peptide Sequence Number=SeqID_150941
atgaatgtggtggaaaatggagattatattccatatgatgatcagtttaatgagattcatagaggtcaatggatgaaggagcaaaaactcaaattcatgttcaactctaaggcttggaatgtaatgttgtgtgctttatccgaagaagaatacaccaaggagctccacaggttcatgaacaagactcccaaaagccccctttcacacttcagcaggatgaaggaaccaaaagagaaaagttttttggctctcaacagtctaaagaacatgaagacatcattgtccagagaaccagtcttaagaagttcgttcatagctcttaaggttgatgatgaatctgaggaagattctgatgaagatgagctcgccttcatttcatga

SEQ ID NO: 34164 - DNA, 405 bp, Glycine max
  Peptide Sequence Number=SeqID_150942
atgggtcgcatgagctacaacaaagttagcactagcactagcagtggcaaggcatcatcaaggtgcagcagagggtttagattgaaccccagaaagctttatgttctcaggctacgcaagaggttcaacttcttccttgggctctttgatagttggaaactttcatatggtgaggctattcaactgctgaagaaagtggtttgcagaaaaagtggcctcaaaagaaacaacagcaacaacagcaccagaagttttgtaagggaggaaaaaatcaagggccaagatgattgcaagatgagatcatttgttttaggattgcatgaaaagtatatcggtattgctcttgctgtaaaaatttcatctcttgctagttttgcatcggtaatggatcatcattctctgtaa

SEQ ID NO: 34165 - DNA, 285 bp, Glycine max
  Peptide Sequence Number=SeqID_150943
ccccgagtcatccttcgggtcccagagacagatatccctcacgtgccggagccaagagaaccatcgacatctgcaaggcccgctgtggacgagcctagacatgcagtggaagtttgctatgggattgttgagaggttggagcaccatctaagcctaggggtggtcacgccaggctcatcgacacatgaggttatcgaagaatgcctcaggatggtcaggagtgtcacacaggaccagctagtatatgttaggtctcaacgtaggaggtacacagatcaggcgtag

SEQ ID NO: 34166 - DNA, 2074 bp, Glycine max
  Peptide Sequence Number=SeqID_150944
atggaagagtacccggaagagttgcgcactccgccggtgacgctagcgtctctggtggggtgcccggagctccaccctctgatctccacccacttcctatcggcgcagcctcccatcaacaccctcgccctccccgatttctccaaaatcaacctcttcaacaacaagaagaaaaacacagacccctctgattcaactgctgccacctcaccctcccccatcatcgccgccggcattctcaaacgcgattggctgctcaaacaccgcaccaaactcccctccgtcctcgccgccctcttcccctcccaccacctcctcggcgacccagcccactggctccaactatgctccgatcttgattccatcaagactgtgatccgcgggaggaacatcaagttcgcggtggttgtcgtcgttcagaacaatgcggatgagatcagcgaagatagaatgattgccttgcggaagcgagcggaagtggatgccaaacacgtcgtcgttttgaacccgaacgacactgcggatctcaaacagctggcgagtacgttttctgaattggctggcacgtattatagagaagaagggaggaggattaagcagcggattgagaagaagaatgttagctcggttgagttgattgttcgctactgcttcaaagttgctgtatatgcagaattccgaagtgactggactgaagcactgaaattttatgaggaggcctatcatacactgcgagagattgttggggtgacaacaaggttgccagcagtgcaacgcttagttgagataaaatccatatctgaacatttgcatttcaaaatatcaaccttgttactgcacagtgggaaggttatggaagcagtgacgtggtttcgccagcacaagaatgcatataaaaggcttgttggtgcaccagatggaatatttcttcactgggagtggatgagtaggcagtttttggtattcggtgaattgttggagacaagttcaaaaataactcaaggcatttcacctattgtcctaggcaattcatccaaacctctgtccgagtgggaatattattctgcttattactaccaattagcagctcactacttgagtgagaagagatcagcactggaacttgcaatctcaatgtcagaaacttccgatgagattgataatgttgctgattcagtagttccttcagtgtatgtgggccaatttgcccgattacttgagcaaggagatgatgttgatatgctacctctcactgatgaagaattcatctgctacgccgtttctgaaggaaaaaggttccgagattcacttgaaattattgctctacttaaaaaagcttatgaatcctacaacagtatgaatattcagaggatgagctctttttgtggattccagatgtccagagaatattttgctgaaggtgatatcagtaatgcaaaaaagacttttgatagtatagctagcctatacagaaaagagggatgggtaactttattatgggatgtcttgggatatttgcgagaatgcgccaggaaaaatggtactattaaagattttgtggagtattcccttgaaatggctgcgctgccaatatcatctgatactggtgtccagagagacattggtccagctggtcctgcaaatctactgcaaagagaaattgtacagaatgaggtttttgagcttgtcagtggagcttcaggaaaggaaacaaatgaacaccccggtaatctcaagatcatgggagatgaatcacttcaacttgaggttgatcttgttagtcctcttaggttggtgatgcttgcttcagttgctttccacgaacagacaatcaagcctggggcatcaactttgattacagtatcacttctttcccacttaccccatactgttgagattgatcgattagaaatccagttcaaccaatctaattgtaatttcttcattacaaatgcccaaaaacctcaatcagtagaagttagtaatggaattcaacagcatcgaaccgaggcagaaccttctctttcacttgaatcaaacaaatggctaaggttgacctatgacatccaatctg

SEQ ID NO: 34167 - DNA, 276 bp, Glycine max
  Peptide Sequence Number=SeqID_150945
atggagaacccagaagctgaagagaaattaggagattggaagggaaatgggaagagaagaagaggaagtggatatccgttggaatttggagttgaaaggaagagcgagaaattacaagtctcaacctttagtcgaaagagcaaggatctgaggaatcctgtggtagtgcgattatctactccacaccccctcactccttcatggcacgcccacccgccgccaccatctcctccttctccgacgttgtcgcctgcatctcctttcgctccgacgtga

SEQ ID NO: 34168 - DNA, 1875 bp, Glycine max
  Peptide Sequence Number=SeqID_150946
atggacgttcgccgaagacccattcctccctccggcgatcgccgacaaacccagaagctgaagaacaccgccaccaccgattcgcagactcttctgcctctctacctcaccaacgccctcttcttcgcggtgttcttctccgtggcctacttcctcctccaccgctggcgcgagaagatccgcaccgccactcccctccacgccgtcacccccgccgagaccgccgccatcgtctccctcgtcgcctccgccgtctatctcctcggcttcttcggcgtcgcctcccgcgcctccctcgacgagctctccgacgacgagatcatcctcaaggaagactcccgcgccccgggcccgtgcgccgcggcgctgtcggactcctgctcactccccaacaacaaaatccaagaccaattccctctgccacccagggctgtccacagtttggcgaaggaaaaacaacatattccttcgccaccacaagtggacagtcctgtctctgtctcagtctcggtctcttcctcctcggacgacgaggacgaggagatcgtgcaagccgtagtgtcgggctccatcccgtcctactcactcgagtcgcggctcggtgacacccgtcgggccgccaccatccgccacgaggtggtgcagagactgacttcccgatccctgtcaggtttacctctggaaggtttcaactacgactcgatattggggcagtgctgcgagatgccgatagggttcgtgcagatccccgtgggagtagcggggccattattgttggatggaaaagaattcaccgtgcccatggccaccactgaagggtgtctggttgcgagcaccaacagaggttgcaaagctatatacgtctccggtggggcctcctcggtgttgcttagggatggggcaagctgtgttggtttaaagttggctgagagagtgtttggtaacacattgagaatccacattcactgtaaaatcgcactgaaatcaacccaaaagcaactatttgttacttcaagaaaccaccttgagtgcaaatcaaggtcaagcagatttgccaggttgcagaatattcagtgtgctattgcgggcaagaatttgtacatgagattccgatgcagcactggtgatgcaatggggatgaacatggtgtcaaaaggtgttcaaaatgtccttgattttcttcagagtgacttccctgacatggatgttattggaatttctgaattttctttgctatggttcaaagctgttgctgaaattggcataccctgttgcttttcgccaggaaatttctgttcggacaagaaagctgcagccgtgaattggattgaagggcgtggcaagtctgtggtgtgtgaggccataattaaggaggatgtggtgaagaaggtgttgaagaccagtgtggaggccatggtcaagcttaatatgctcaaaaaccttacgggttcagccatggctggtgctcttggtgggttcaatgctcatgctagcaatattgtgtctgctatctacattgccactggtcaggatcctgcccagaatgtggagagttctcactgcatcaccatgatggaagctatcaatgatggcaaggaccttcatgtttccgtgaccatgccctccattgaggttggtactgttggaggtggcacacaactcgcatctcagtcagcatgtcttaatttacttggtgtcaagggtgccaacaaagaatctccgggtgcaaattctaggctactggccaccattgtagccggttcagtccttgccggggagctatcgctcatgtctgctattgcagctggacaacttgttaagagccacatgaaatacaacagatctagcagggatatatctacaattgtccaatga

SEQ ID NO: 34169 - DNA, 1470 bp, Glycine max
  Peptide Sequence Number=SeqID_150947
atgggcagcaccttggaatatcagactcaagaacaggcaccaaccaacctcaacactctctttcctcatgtttgggttcttctctatgtgtctctcgttttcctcactctggcaggagaggtttgggtgctgcgagagaccttgggaggggagagattgttctcagagtttccaaaatctgctttaatgacaagagagagtgttatggaagatgaaaagctctgtgatgctgtcaatagacactcttctctctccccggctcagacttctaggtggcatccttaccttgtgcatatgccgcaaacttatgacatactagccatgtttggtgaatttgagaagcgtgctctgcaagttcagtttctgttagaaatttttgtttatcttgtggatgaggcgatgtgggtcacagaaaaagctatgcttaaagccaaatcagagtggaaagaagctcatgctttgatggaggacctcatgtttaagccccagtttttaacatttaaggcttgggtttgggctgctgcaacgacgatgcatataccgtgggatgaagctgggtgtttatgccttgtgggtgacttgtttaattatgatgcacctggaatggagccatctggcattgaggatttagagcattttctatctaactcttccatccatgatactagcttattaaatggagataataatataatggtagatgcagaccaccttgattctcactcagagattaacagatgggcacattacaagaaaggagatcagacgatgcatataccgtgggatgaagctgggtgtttatgccttgtgggtgacttgtttaattatgatgcacctggaatggagccatctggcattgaggatttagagcattttctatctaactcttccatccatgatactagcttattaaatggagataataatataatggtagatgcagaccaccttgattctcactcagagattaacagatggttggttctattatgctatggaatttacacaaatttggagcttgttgaacactatggatttctcctacaagaaaatccaaatgacaaagtttttatccctttggaacctgctgtatattcttccacttcatggtctaaggaatcactctatgtccatcacaacgggaagccttcctatgctctactagctgcactgcggttgtgggcaacccctcaaaacaagaggaggtctgttggacatcttgtgcattctggttctcaactgtcggcagacaatgaaattttcatcatgaaatggctgtcaaaaacttgtgatgctgtgttaaagaatctgccaacatctattgaggaagacaccttacttctcaatgcaatggataatagtcaagatttttctactttcattgagatcacaaagctaatgtcttccagggatgagattcatacttgcttagaagcacataaaatgaaggatgctcatagttttaatgat

SEQ ID NO: 34170 - DNA, 1248 bp, Glycine max
  Peptide Sequence Number=SeqID_150948
atgtctgtgacatttttatggtttgtttcctcccctggtttagaggtttcccattccaccgggttacttgattctgttcggcatgtgaagttcttagattcttcaaaggtcatgtctagggattttgggtcgattagagtggagaaggataaggaaaagggatggagattgtgctctttgagtacagatatgaagtatgcatgtgttggtcggtctggcttagaaagtgctagcaacttccctctgatagcgaatgtgcttgctaacccagcagcaggagaagtggctgtttcatcagagcagaaggtctatgatgtggtgttgaagcaggcatctttggttaagaggaagttgggcgctacgggtgaacttgatgcaaagccagatattgctctgcctgggaatttgagtttgttgaatgaagcatatgaccgttgtggagaaatttgtgctgaatatgcgaaaacattttacctgggaactctcctaatgactcccgaaaggcgaagagctatctgggcaatatatgatgactgtgcaagagtgctatatgaagtaagaccaatttatctgatcaattctcaattgccttatagcgctccctgttattcagtgtggtgtaggagaacggatgaacttgttgatggccctaatgcttcacaaattacaccaactgctttggataggtgggaatcaagattggaagaacttttccaaggtcgtccatttgatatgcttgatgctgctttagcagatacagttgccaaatttcctgttgacatccagccatttaaagatatgatagaaggaatgagattggatcttaagaagccaagatacaaaaactttgatgaactatatctttactgttactatgttgctgggacagttggtataatgagtgttccaatcatgggcatttcaccaaattcagaagccacaacagagagtgtatacaatgctgccttggccctaggaattgcaaatcagctaaccaacatactcagagatgttggagaggatgctagcagaggaagagtgtatcttccacaagatgagttggctcaagcagggctttcagatgaagacatatttgctggtaaggtgacagacaagtggaggaacttcatgaagagccaaatcaaaagggcaagaatgttttttgatgaggcagaaaagggagtgaccgagcttaatgaagctagcagatggccggtaagaaattccaaaaatttatcaattctataa

SEQ ID NO: 34171 - DNA, 258 bp, Glycine max
  Peptide Sequence Number=SeqID_150949
atgaagaagatcctaggcctacaagctccaatggagcttacatcaatagggatggagattgggtcacatatgtatgagttttccttcgatgagataatagaaggtatgaacggggaaagagacaaagtacaaaaggaagaccaagcaccacaacaaaggatttcactagaggaggagacagtgcaaaacacgatgggcaataaccaacaagttttggaaagtacaagtatgacacgtagggagtccatgaatgtctaa

SEQ ID NO: 34172 - DNA, 1062 bp, Glycine max
  Peptide Sequence Number=SeqID_150950
atgcttgaacacactaccaggcaaaccacactcaaatgtctcaaggaagttgttgcccggttaacccaagcccaagccaccttgacccaaggccaagccaccctcacccaaaaccacgccacccttgctcagtcacagtcctccatgaacaccaaaatggatcgagcaccttgcagtgctcactgtccacccttcatcccctcacccgccaccttcacctaccttaacacccataccacaaactgccaagcctcatatgaagctcgatttgtggcgctcgccaagcttcaggaggaaaagctacacgaccggcgccgccatgtccgacaaccagcttcgccttctatgcctcctcctcccatttcaccatcaccaccgtccacggcacgccctctggttaaacgcctctccacggaggaactctccattcgtcgcgacaaaggcttgtgttaccattgcgatgagaagttggttatcggtcaccggtgccgaccacgccttcaccttctcatcacggatgaggatgccgattgttctgatatttctgcaccaccctcaccagttgcggttagtgaccctctccatcaccaggaccaactcaacgttccacagatcagtctcaccgcatggtcgggaatgccggcaccagagacattccgcatctatggcactattgctcgccaccaagtcgtgatcctagttgacgacaacagcactcataacttcattcaggccagacttgcggctttccttcatctagatcaagtcccaaccacaacgatgcatgtcatgattggcaacgggggcactattgaatgcaataccaaatgcccctctattcccatcctcattcaaggctactctttttcaattgacctctaccagttacccatcgggggcgcgaacatcatcctcgaagtacagtggctgaagctacttggaccagtcaccactgactatgcttcgttgacaatgcgcttcaattatttgggccagtccatatccctgcatgtcgacgttcctttttgcccgagtccggcttcggcccaacaactgaagtga

SEQ ID NO: 34173 - DNA, 367 bp, Glycine max
  Peptide Sequence Number=SeqID_150951
atgggtgttaaggtaggtgaaggtggcggggtggcgtggttttgggtgagggtggcttggccttgggtcaaggtggcttgggcttgggttaaccgggcaacaacttccttgagacatttgagtgtggtttgcctggtagtgtgttcaagcatggtggctggtaggaaaggcgcaaagaaagacgaagaaatagggagaatgcatgaaggaatgtcaagaaggttgccatcaaaagaagaattgcttgaaggaatccacaaacaagtagaccaaagcacgccttctaattcacatctaaggccatctctagcccaagcttgttcaaattcaaggagaagaaaaggggtacctcatagggcaccttcag

SEQ ID NO: 34174 - DNA, 1206 bp, Glycine max
  Peptide Sequence Number=SeqID_150952
atgcccatggttacagaaaacatctacctacgtctgagagcttcatgccatcacctcggccgtgcgaaagtggcgccattatctactaagaactccttcaccaagtctgaacttgtccccacaatcacccaggcttcacctgtaagcagaatttgcttttcttcaaggacaaaatttggttaccttccggccacaagctttcgaaagtgctcatggatgaattccaccagacacccttcggaggccatatggatgttactaaaacactccattgaatccaacaacacttcttttggccacttatgcctgaggatatttgaagatatgttgctcagtgcattctttgccaacaggttaagtatgagacccataaacccgtcgaactcctgcaacccttaccaattccctcttccctctaggaagacttatccatggacttcatcaccggtctcccagcttctcacgactacaccgctatcatgtggcaccgggttttcaccgttcgaggttacattcgacaagccacctacagcactcccactgtactcaaccggcgcatcctcaatggaggcatttgatacactattaacctcccggatggccattcacaccacccttcagcgtcgcttacaaaagtaccagtcgctcatgaaatgcatggccgatactcattgccgggacctcaactttgtcgtcgatgactgggtgtacgtcaaactccgcccttatcgtcaaaccttcgtccaaccaacctactccaagatgtccaagaggttttacgacccattccaagtccaggatcgtgtaggtgttgtggcatatcgcttacagttgccaatagcttccaggatatacaatgttttccatgtatcacaccatggacctattctgacagaggcaccagtgcttccatctttcagcacggacaatcatcccatcattcaccctcttcgcattctggactggaaaactgatgacattactgaccctcctacccaacatgctttggtgcagtggcacggtttgccactaaaagataccacatgggaactctggctcgagttgaaggctctttacgaccttgaggacaaggtatgttttccgggggagggtattgatagcaacaatagacccatcagccaagcaccatgcaacagacccacacgtgttatcactaagcctaagtatctagaagattacgtataa

SEQ ID NO: 34175 - DNA, 681 bp, Glycine max
  Peptide Sequence Number=SeqID_150953
atggcacatcctctctccagaacttgccattcacttttaaccccacgtatttacttggttcctaggaatttgacacttggtgccacacgtcaacctctagaatcccctgaagatactcaaacaactgaggaagaagaagtaggtagccaagagcatgtggtgatcattcccattcaagaagtgattcctcaagcacagaaggtttcacctaattctgacatcaccactgaaaacaaagctgagcaagagaataatactcatcaagatggtggagtccaaaatcaagaggaagagcaaaagggagtagtgaatgaggaagccaaagaggagaagaataagagtaagaccgcaaaagagcaaaatggaaaggagaaaaaaagagggagaaaaaagagaaatattgaagggtaccagaggtatgtgtatggggtgttgaagcaagtgcaccctgaaatgggaatttcttccaagtgcatgactgctctgaacaacttgatgaatgacatgtttgagaggctgacttttgaggtttctaagctgacggactacactggacacatgacattgtcttcaagggagattcaaggagtagtgaggctggttctcccaggagagcttgaaaagcatgctattgctgaaggggtcaaagctgttaacaactacacatcctatgatgcatga

SEQ ID NO: 34176 - DNA, 375 bp, Glycine max
  Peptide Sequence Number=SeqID_150954
atgtctactactactaaagggtcaacaacagagcaaccaattcctccacaagtggaagaagaatcaagtgtttgtaaacaagaagaggaaggagaagatgcaaagataagggtggttatagcacaagagggaattgaagagtttgaagagtgcaaaactccaactgggtcaggttacaagattcccatagttaaaaaatgcccacttgctccaagaaagaaaagaattaaaagggcaatgccaccgttttcttcacgcgtgaaaagatcatcatcaagtgggttgagctatttagtaaggcatgaagaggtagagtctttcttccaatccatgttcgagcttactagagttaacaagagatgtaggagtgtatga

SEQ ID NO: 34177 - DNA, 306 bp, Glycine max
  Peptide Sequence Number=SeqID_150955
atgaagcaattaagactgtgggaaacattgaatatccaactttcaaggaaacatgttttgctatgggtttcattggagatgataaggaatacattgaggcaaatagagaagcttagcattggggttcagtctagtatggacaacttatcttcaagtgaactcaacagcttttcccaatggatacttgatattggagatggaaaaatttctgaaccaaatgatggtaatgctataatagagatctcgcaagagcttatcatctcagattttaatgaccctatacatggcattgtcagtagcacctag

SEQ ID NO: 34178 - DNA, 251 bp, Glycine max
  Peptide Sequence Number=SeqID_150956
agtgcgcgatatgtcttgaggagctgcgagagggggacgcggtgaaggtgattccgtactgcaagcacgtgttccacccgcactgcattgacacgtggctcgataagcaagtcacgtgccccgtgtgccggtgcagtgagctttgtggagcggcgcaacagagtggagaagaggtggggtcggtgtcagcgacaagacaacaagtagaacaagaagaacaagaagtggttccaattccaaatttggattag

SEQ ID NO: 34179 - DNA, 2577 bp, Glycine max
  Peptide Sequence Number=SeqID_150957
atggctattgctggtctacacagtgtgtctgtgctcgactcttctttcttgagggactcccattcccagtcgtctgggagagggggagatggaagacggggaagcacccggtcatcttcgctcttgcaaatgtggcgagagattgaagatgaacatgtggtgaatcaagttcaaggaagatctggtgaagtacctcttgaacaaaggagggatgggttggttgcggacctttcacgagaagatagactggatatccaagaaagagggcagcgacatgttatagaagataccgttttgggtgagaatgaatctgaaacatggtcacagtcgcaaagtcagaatgaatcccatgatggaaacgaggacttaaacaattccagctgtgagaactcttctgacttgggagaagttgaaagggaaagagtgaggcaaattttcagggaatggatgaatagtggtgctagggatcatgtatcaaacatttctgaaagaaataacggttcaaggggagaatggcttggggaaaccgagcaggaaagggtgagagttattagggagtgggtacaaatgagtagccagcagagaagtgtttcgtctggggaaaacagggaagaaccatctgctgaaattgacacacagattgaacgtgtgcgtgatggactcattgttaaccagattgggggccaaactgagcatacacggaggggaatacgtaaattatgtggccgacaagctatgcttgatatgcctaagaaggctgagagggaaaggcaaagagaaattcatgagttattggaccatcgggcagtgtcgcaattcccctatcgaaatcgcattcaggcattgcttagaggcagattcttgagaaatgatagacctgttgataataacaggcccctttctgttgcagaaagtgaattgggcttcttgaggcgaagacaaactgtatcaggtctaagggagggatttttcgctagaagggagaatagtggttgcagtcaagcaaccagcaatgcatctgatacgtcatctaatgttgaaattgattttaatacgaatgaacaaatgggatcaagcagttcacatatagtcccaagtgtacattctgaagagtctgaccctaatgacagaggaagcaatggacttggggtatcaggcagccagaactgggtacgaggtaccacatgtgagaatttacattggcaagaatctactgctcaagtagatgagttgcagcatttgccaattgaatcactagattgtcaatcgtcattaagtgctgatgttgaaagaggggacaacactgagcaaaatcttgatgtgatgccaactgaagataatgctaatgaaattacccaacaaagcttgcgaattgaagattcagagcattgtaataatgaagaattcagtgaggtgcataatgagcaatctgagttaggtgatataaataatagtgaaaactattcttcaaattacaatattcatatggaggataatgttgttaatggtgtaaattggaatgaatctggtgctctagaaggagagcagccagaagaagtttctgaaaatgaaggaagtgagtggtatcagaataataccgaatggagaaatagcactgaggaaaatgttgatgataatcatctcagtaatacaccaaatgagtggcctgaaaacagtttgggaaacgaagatggagaaaattctcgtctgcaagaatcccatgaagtgtggcaagaagatggtggcttccaaggggctgtggaaaattggttgggaggaacttctgatcatgaaagtgctccagttggtagaattcgtggattttattttcctgaagatgacaatgtgtacagtgttgaactcagagaacttcttagtaggagaagtgtctctaacctccttggcagcagtttccgtgagagtcttgatcagttgatacagtcatatgttgaaaggcaaggtcatgctaacattgactgggagttgcaagaaacaaccccttcttctgcctcagtagagcaggaccttgagcagcagagtagggatcaaattgttggtcaggaggagggtactgttaatagtccacttaacctgccctctttacctataccgcctcctctgcctatttgggaccagcaccaccatcgtgacaactggtcacagaatgacataaataatcagcatctagatttggagattattaacgacttgagaattgacatggctcgattacagcaaaggatgaataacatgcagagaatgctggaggcttgtatggatatgcagcttgagttgcaacgatctataaggcaagaagtttctgcagctctaaatcgctctgctggttcatcaggaatacatgattgcgagtcaccagaagataaatctaaatgggaatgtgtaagaaagggactttgctgcatatgctgtgaaagcaatatcgattctttgttgtacagatgtggtcatttgtgtacatgttcaaaatgtgcgaatgagttgcttcaaagcagaaggaagtgcccaatgtgtcaagctcctgtggtggaggtgatacgtgcttattctatacaataa

SEQ ID NO: 34180 - DNA, 765 bp, Glycine max
  Peptide Sequence Number=SeqID_150958
atggatgatatcaagctcgtgaagaatgaaatgaaaacgacaatcaatgatgttttattgggagtaacacaagccgctctcactcgctacttgaatcgagcatatgttgttttcgttaacgctttgttactcgatctcaaagcagatgtaggcgcaaatagcaacggtgtgaaacagagatctagtgtcctcaagaagattcgccttagggcatcaattcttgttaacattagacctgttggtggaatacaggaactagcagatatgatggcagagaaatcaaaagtcaaatggggtaattgcatgggatacatcatcctccctttctctattgttttgtataaagatccattggaatatgtacgtcatgctaaggccacaatagaccgaaagaagcactcattagaagcaatttgctcttatgcttgtgcaaagctggtactcaatttattaggtgtaaaggttgctgctgccataacacgaagagttctctttaacactactgtagccttctccaatgtgcctggtcctgtggaagaaattagcttctatggtcatcccgtggcatacattgctcctagtgtatatggacacccacttgcactgaccatccattttcaaagctatgctaacaacatgaccatttctctagcagtggacccacttgttatttcggatccttaccttctttgtgatgatttagaacaatcactcaaactcattcgtgatgctattcagaaaaagcacactgtcgatgctgtctaa

SEQ ID NO: 34181 - DNA, 1899 bp, Glycine max
  Peptide Sequence Number=SeqID_150959
atgcaaggggaaggggtgtggggatttggtgagttggcaaagggggatttcacaagtgtgagaccctcgttgctgttccctcttcgtagccgcaattgctcttccttcgcgaagaagagcatgggaagggttcaggtgagtgacaaggaagaattctctcaaatggagaacaacgatttcagtgattcgcagttagttcatcacttcagaggtgtgcttgttgcagtgacaacgggtgatcgagagaattacgatgagctcgttggttatttgcacccgaagaagcatcttaatcctgatgaggttgctatacttgtgacaactttgaaggcgctttctggagcagtgtcctatatagattctgttcatcatgaatccctgctctttgctgtttcgagaatgagcctctggaattgtggaattgatattatggatgcactgctggaactcatcatatctttggctgtttccaatggaaaatatatcgattggtgtttggagatgcttgtgaaaaattttgtgccgcctttttacctcttagattctctgagacaggagaacggaattgacagaaaaaataaagttctgtcacgggtacatgcagcattgaaagaaatagctgatttggtgcctcttgcacccttgcgactatctccaatagttatccagaaaatgccgagtgtcttcagtaaggaaactgagattgtcatgtatgtcgagaatatgttgaggctggagagtggtgcacttggagaaactgttggttctaccatgctgcctgctcttgtggataggttgctagagttggatgtggaaattggatgggatggaatcctgcaagaagatgctaaaggcatatttgaaatggagttagaagatgttactgaatttactgatgaggatgagaattgtgatagtatgctttcgtcagagttgttaaataggaaaaatttgcaaggcaacttggtggttgagaaattagatagcctaatggtgctggcatttttgcatcttgaatcctgtcaaaacagtggccgtttggctgagtttgtgatgttctatgcatgtgcactggaccctgaaggatgtggtgtgaaatttgcgatggttcttgcagatatgtttggaggtgatgctaatccccctattactaggatgagtgctgttgcttatctggctagttatttgactcgtgcaaagttcctttcagctgcattggtcactagcatcatacaaagcttggttgattggtgttatgcttattgcaagttccgtgattttgacatgaacccacgagcacatcaagttttttattctggctgccaggccatcatgtatattatgtgttttcgcatgagatctttgatggatgttcctaggcttaagttgcagctgcttaatatgcccatggaggcaatcttgaaacataaattgagtcccttgaaggcaaaggctgctcaacttttcatggcatcagagtcatttgttttcgatgatatgcttgagtctgatctttccaaggcttttggcgggatggatagacttgacatgtttttcccatttgatccatgtttgttgaagagaagtgaaagctacataaggccacattttgttcgctggtcaaaagtcagaactacatatgatgacgatgacgacaatgatgaagtcagtgatagtggcagtgaattatcagatgatgattttattgacaggaacgccaaggatatgattgacgatgatatgatggtgagcgttgaaggcgctgattttaaccctgacttgaacaaaatgtctattactcccagaaaatcttttaaacatgggtttgagacaccgttgaatcaatgtacgcgaatgccagcaagaatcagaccgtccactagtccggagtctctgtga

SEQ ID NO: 34182 - DNA, 1686 bp, Glycine max
  Peptide Sequence Number=SeqID_150960
atggacctgttaccggcgcgatccgtggacgaaacagtggaggagataatgaggctgcaccggtcgctaccggctcggccgggaatcgaggaagtggaggcggcgaggactctagtcgagaacgtggagcgtgaggaccaggcgaagctcgaggccgtggcacgtgcaagggagcgcaagggcccgcacgtgccggaggagctcttcgcggtgttgcaggagatgcagaagaatgtggtactattccagagcaaggagcagaggcgtgaggcgctcaaactcctcgatctcgaaaacgtccacgtgctgttcgacgaattgatccagagagcttccaattgcgtctccgcgcgctcctctggttcgaagaactcagtttctaaacgggaaacttctttttccactgcttctgtttctgcgttcaagaaagagcctgtgaagagttcggagatattgttcacgagagatgatagttatatgaataagaccaaacccaatttctactctgatgggtatacaattgggcccagtgtctcatccaaaccgccgatactcgattcctcgctaataccagcgtccacttcaggtgaacagagtggtgataagttgagtttgataaaactggctagcttaattgaagtttctgcgaagaaaggtacacgcgaactcatactacagaacaagttgatggaccaagttgattggcttcctgattcgatagggaagttatctagtttgatcaaattggatttatctgagaatcgaattatggttctaccttccacgatcggaagcctttcttccttgacaagtttggatttgcattcgaataagatcgcggagcttccagagtgtgttggggatctcttaagtctcgtgtatctcaacgttgggggaaaccagttatcatcattacctgcttctttgggcagattggtgcatcttgaggaacttgatttgagctccaaccagctttcagtgcttcctgatgccatagggtctcttgtaagcctaaaaatactgaatgtggagacaaatgacatagaagaaattccgcattcaattggtcgttgtgttgcacttaaggagctttgtgcagattataacaggctcaaggccctgcctgaggctgtggggaagattgagagtcttgaggtattgtctgtgaggtacaacaatgttaaacagctacctacgacgatgtcgtctctgtcgaacttgaaggagctgaatgtgagtttcaatgagcttgagtacgtgcctgagagcctgtgttttgctacctcgcttgtgaagatgaacatagggaacaactttgctgacatgcgatccttgccgaggtccattgggaaccttgaaatgcttgaggagttggatatcagcaacaatcagattcgtgtccttcctgactcttttgggatgctcactcggttacgggtcctgaaagtggaagagaatcctcttgaaatccctccaagacatgtagctgaaaagggagcacaggctgttgtcaagtacatggctgatcttgttgagaagaaggatgttaaatcgcagccacttattaagaagaaaaagggtttcatagttcaccaatcaccagtagctttggtggccttaattgacctagaatcagcacttgtggcaaggctagattccattagagcaagtagtggcatagagtga

SEQ ID NO: 34183 - DNA, 654 bp, Glycine max
  Peptide Sequence Number=SeqID_150961
atgagtcatcattcatctagtgttaatggtgagggtactagtcataaggatcctctatctagaatcttagatgagttgagttccctcatgttatggaaagaaaaactagaaggaaaagaaaaaggaaaagggagggtagaaataaatcaagatgagagagaacaaataagaaatgaagaaagaagaaaaagaatgaaagaaatgaaaagagaaaaacatgtctcctatagagggcttagcaactattatagagggcgccatagttcacatactaagcatcattcccaaagaatagaaaaggatagaaggcctcaagaggccaacattagactcccatatttccatggaaaagataatgttgaggcctacttagattgggaaatgaagattgagcaactctttgcttgccatcatattagcgaagagataaaagtttcattggctacccttagctttcaagggtatgccctctattggtggactttccttgttagggaacaaaggattcatagggatcctctagtagagtattggaatgatcttaagagtgcccttaggaagaggcacattccctcctactatgaaagggagcttatggacaagctccaaaggcttagacaaggcagtataagtgttgaagaatatagacaataa

SEQ ID NO: 34184 - DNA, 1224 bp, Glycine max
  Peptide Sequence Number=SeqID_150962
atgaaaggacttaagaagaaggttgatagtcaacacacgaaatatgaaactaagaagactgcgagtttattgtgcccattaccagtgccctgtcggtcatgggaggacttatctctcgacttcatcacggggttacctatgtttcgtggctataccaccattcttgtgattgtcaaccgcttctcgaaagggattcatctgggtatgctcccaacccaacacacttcgtacacagtgacagtcttattcaaggaccttgtagggaaaattcatgaaatgtcgcaatgcttggtctcggattgtgatcccctatttcttagccgattttggcaggaactctttcgcttaagtggcactaagttatgcctgagatttgtgtatcatcctcgatccgatggacaaacagaggtcctaaatcgagttatcgaacagtatcttcgagcctttgtccataagaagccttcatcgtgggaaaagctgttacactggtatttggtaggagattttaacatcgttgctattgatgacatactcattgctcgagaggcagtttttgcggaagttaagaagaaactagagaaggcgcaggtgtttcatgggataaacgactcgttgggcgagcttgcggcgcgctgggcgtgggcatcggagacaaatcctcttctagggtttccccatgcgctaagctggctaagtgcctcgcttagcggatgtaactcgctaagcgcatatgcctcgcttagtgagacactagctgcttcaccttcttctacttttagcctgaaactgaaccaacccattgggtattccaagcttgccaaaagattttatgggcctttccgagtcatcaaaaggattgggctgtctgccaacaagcttcaattacccgtagacgcgcgtatacacccagtctttcactgttccctactcaaatcctttcattctgcacaccccgatgacaaccttcatagcataaccttaccagtgctcactaaggatgatcaccttttaattcaacctctagctatattgaacacgcgccagacaactgactcgaagctagaagtccttgttcaatggcaaggattgttgccggatgacacgacatgggaagactggcaccaacttcaaactgattatcaccttgaagacaaggtgcttttggaaggcatgaggaatgatagcaatacagaaaaaccagaaacaacagaagcaagaccatga

SEQ ID NO: 34185 - DNA, 525 bp, Glycine max
  Peptide Sequence Number=SeqID_150963
atggaacagctaaagtataaggttgtccaaggtgatgataacaacaacaaaggaccagttgttcgttcttttttttcttcttcttcttctgagtctggaatttcaagtggttcatcattggattctgattcatttgaagaagttacatcccctgcttcttcttcttcatcagcagctgatcaaccagcaactgaaccgttgagtgatatgtcttctttgtttcaacaacttcccatcaagagggggctttccaagtattacgaggggaaggcacagtctttcacttcaatagcaaaagtgaacagcttggaggatcttgtcaagcctgagaatccatacaataagaagttgaagacttgtagtagctatggaggggtaatgggtgagacttctcaaaggggttcatgttcttctctaagtgcaaataggggcactgagaacttcatggatagaagacccccaattccacctcatagatctaccactactagctccattcctaatcaaactgctttgtttgtttga

SEQ ID NO: 34186 - DNA, 1041 bp, Glycine max
  Peptide Sequence Number=SeqID_150964
atggaaaacaacagcagcacaaatgccacgtcaaaactaccccaaaaagcaaaaagaaaaaagaagggtctgggagtaaatgttgctcaagtagcagacaacacatcagaattctcatttgctgtagccaaaattgcagttgctcaaatctgccaatcagctggatacaaaagctccaaacacaatgctcttgaagccttaactaatgtttccacaagatatatggaagccattgtgagatcagctgccacttttgccaatgcctccaatcgtaccgactccaacctctttgacctcaccaatggcattcacgatgtgtgttctgttcaaggatttcctggtggttcaataatacacaaaagcaacttgctggggtcttcagctctaaaagaaattatgaattttgtcaacctttctaacaaagttccatttgctaaaccaattccatttagaaatgtttctgaagtaaccattgattccggtacatcaatgtgcttatctaagcaagtgaaaactcacataccaagatggctcccacattttcctaaggaaaactgtgctcaggttttggttaaggagaggaaatgtgatgagaaattgtgggaacattcactcactagggaggaaaacagtggcttattaccaagcaatggcattgatggaaaagaagagaaagaggcaaggatggaactgccaaagggaagagaaagaataaagtttagaattagaggtgagaaggagatgcatgttgaattgggtgtgaatatgatgaatgggcacttctctttcccaccatggacgatttgcattgaccaacaactccttttgccacctccactgcaagtgcaaagtagcgtcatgttgtcgctatccctaatagatctggtaatgactgtgcttgatgtaggtggaagcatgacctgtgtgaagcttcccatgacagacccaccacataagactccctggaaactcctgtcgaagtcagatttcagaagaacaatgaggatgtggttgaaggggggtagtagattgagaagctag

SEQ ID NO: 34187 - DNA, 3879 bp, Glycine max
  Peptide Sequence Number=SeqID_150965
atgatcactgatgtgcccccatctatgtctcaaaacggtaggtcaagcagatattcctttggctctagcaatggcaatggtgatacccctgcacaaaatggtgctgctgttatcaatgttgatgactatgatagtgatagctccaattttgcaccacccacgccatcaactatgtcaatggctgttccagcagaacttgctggagctgtacccttgatcaacagattccaggtggatggatttttaaaattaatgcagaaacaaattcaatctgctgggaaacgtggatttttttctaaaagatctgtagggccccaagttcgagaaaaaattacatttgaggacatgttgagttttcaaaaggatccaattccaacatcactgctcaagttaaatgttgatttagtaagtcgggcaacaaaattattccaaataattttgaaatatatgggaattgatccatcagatcgtgtaactccaataagcttagatgaacgagttgagcttgtagggaaactgtacaagcaaagtttgaaacgaccagaactccgagatgaactttttgttcagatatcaaagcaaacaagaaataaccccgagaggcaatacttgattaaagcatgggagctcatgtatttgtgtgcatcctcaatgtctcctagtaaagacattagcagttatctatcagaatacattcataacatagcaaatggtgtgggtactgattctgagatccaagtccttgcattaaatacattaaatgctctaaagcattctgtcaaggctggtcccagacatataattcctgggcgtgaggagattgaagctctgttgacagggagaaagcttacaactatagtgttcttcctagatgaaacatttgaagaaattacatatgacatgtcaaccacagttgccgatgctgttgaggttcttgaatcccttatatacttctctttgcatttgcatgctttcctaactcatgtatgctgtgcttgcagtgatcaatatgaggagtacattgggttagatgaaaacaaatatattggggatctcctggtggaattcaaagctgcaaaggatcgaagtaaaggagaaatcttgcactgtaaactgatattcaagaaaaagttatttcgcgagtcagatgaagctgtgacagagcctatgtttgtgcaattgtcttatgtacaaatgcaacatgattatattttgggaaattaccctattggaagggatgatgctgctcagctctctgcattacaaattttggctgagattggatttctcaacacaccagaatcatgcactgactggaattcacttctggagtgtttcctgcctagacaaatttcaatgacacgagcaaaacgcgaatgggagtatgacattctttctcgttatcgttcattggagaatctgacaaaagatgatgcgcggcaacaatttctgcgtatattgagagcacttccttatggaaattctgttttcttcaatgttcgcaagattgatgatcctattggacttttacctggtcggataattttgggaattaataaaagagggattcattttttccgtccagttcctaaggaatatttgcactcagctgagttgagagacataatgcaatttggaagcagtaatactgcagtcttctttaaaatgcgagttgcaggtgttctccacatattccagtttgaaaccaagcagggagaagaaatttgtgtagctcttcagacacatataaatgatgtaatgctgcgccgttattcgaaagcacgatcagctgctgctggtggtggttctctgaacggagacatttctagtaattctaaacctcctaatatggaattatacgagaagcgtgttcaagaattatcaaaacttattgaagaatctcaaaaaaatgctgatcaactgcttgaagaattacgtgtgaagcaaaaacaagaagagaaaatgcaagaagaattggatgatttgaaagaatccttaaaagctgataagcaaaatctggatgcagttacaagtgaccgtaatagacttttatcattatgcaatgaaaaagataaggaactacaggctgctattctagacaaaaggaatatggaatctaggatgtccaagttaaataatgcggtgatagagaacactgccaaaaaggatcttgctaatgctggaaatagacaagtgactcaaaagcttgaagatgagctaaaagtttgcaaatatgagctgctatcagccaatgaaactatcaaaagcttgaaaagtgaaaaattggttttggaacagaagttatctgcacttcaaacgaggaatgctggagagattagttcccttcaatggaaacttgagcaagaacgcaaagttgtgaagtctgaagcatatgagcttgaaagaaagatagaaggttgtaggcaagaattattggttgctaaggctaccatttcaatgaaggactctgagttggctgcattgcagaataatttgaaggaattggaagaattgagagaaatgaaagaggatatcgacagaaagaatgaacaaacagctgccatactgaaaatgcaaggggctcaattagctgaaatggaaacactttataaggaagaacaggttttaaggaagcgctattttaatgtaatagaagacatgaagggcaagatcagagtttactgtcgactaagacctcttagtgaaaaagagattgctgagaaagaaagagaagttcttactgccactgatgagtttacagttgaatacccatggaaagatgataaactgaagcagtacatatatgaccgagtttttgatgccgatgcaactcaagaaagcgtatttgaggatacaaaggcaagtcatttatcatatttatttcttgtttatgggaacatatataacttacactcattatcaatttctcgtggatttgcaatgcagtatttggtgcagtctgctgtagatggttataatgtttgcatatttgcctatggtcaaactggctctggaaagacatttacaatctatggatctgacaacaaccctggacttacccctcgtgcaattgcagaactttttagaattttaagaagagataataacaagtattctttttccttaaaggcatacatggtggagttgtatcaggatacccttatagatctgttaccaaagaatggaaagcatttaaaattggatatcaagaaggattcaacgggaatggtagttgtggaaaatgtgacagttatgtctatttctacaattgaagaattgaatagtataatacaaagaggatctgaacgacgacatatatctggaacccaaatgaacgatgaaagttcaagatctcatctcattctatcgattgtaattgaaagtaccaaccttcaaagtcagtcagttgcaaggggaaagctgagttttgtggatcttgctggttcagaaagagtgaaaaagtcaggttctactgggagtcagcttaaggaagctcaaagcattaacaagtcattatcagcacttggagatgttattagttctttgtcttctggtggtcaacacacaccatacaggaatcacaagttaaccatgttgatgagtgattcacttggtggtaatgccaaaactctcatgtttgtgaatgtttctcctgcagaatcaaatttggacgagacaaataactctcttatgtacgcctcacgagtgagatccattgtgaatgaccccagcaaaaatgtttcctcaaaagaggtagcacgactgaagaagttggttgcatattggaaacaacaagctggtagaggacttgagtatgatgatttagaagaaattcaagatgaaagaccaactaaggagaatggtaatggcaataggtaa

SEQ ID NO: 34188 - DNA, 924 bp, Glycine max
  Peptide Sequence Number=SeqID_150966
atgttcaacattctctcaggaacttcgatggcttgtcctcatgtaacaggaattgcaaccttggtcaaagctgtccatccttcatggtctccatctgctatcaaatctgccatcatgaccactgctacagttctggataagcaccacagacccatcactgcagatccagaacaaagaagggctaatgcatttgattacggatcggggtttgtgaaccctgcaagagttcttgatcctggtctcatctatgactcaaagccagcagattttgttgcattcctgtgttcacttggctatgatcagaggtcactccatcaagttacaagagacaacagcacatgtgatagggcattcagcacagcatctgatctcaactacccatctattgcagttcccaatcttaaagacaacttttcagtcactaggattgtgaccaatgttggcaaagcaagaagtgtttataaagctgtagtgtcttctccgcctggtgttagagtcagcgttatacctaaccggttaatcttcacgagaattggccagaaaatcaatttcactgtgaatttcaaattaagtgctccctcaaagggatatgcatttgggttcttgtcatggaggaatagaatatcacaagtcactagtcctttggttgtccgggttgcccctggaaaaaatgggttgttgcaacatactcatactttatttgaactgaaaaaccagcaaaacagtcacatccacatgcagataaatgagataggccaagttactcaaatatttgtaaaattgaagccccagtggatgggattcttgacattcttgttatttctagttctgcccagtagtatggatagtaccgctagccctcgctttgtggtgacgagccctggctcgagggggcatgttgcgagtcccacatcgggtggttaa

SEQ ID NO: 34189 - DNA, 744 bp, Glycine max
  Peptide Sequence Number=SeqID_150967
atggagtgggcggcgagggcggagcacctccgcggcattcccagaaaactcgtgattgcggcggtgggcggattcgccaaaacggtgtcgtctttcctcaacaccgccgatgttcacaacggcgacactctcctccgcctcgtccgctccagaccccaccgcgtccccctcattaccgttagcaatcacatgtccactttggatgatccggttatgtgggggttcaagggttttcctatcttcgacaccaacttagctcgctgggttctcgctgccgaagatatttgcttcaggaatgccctctattcctatatttttcggctgcatacttttccagaaggaaaagtgtatcaagaagatgcacctataaggcaattgaaatggggaactgctagtctaattgttcgagcacctataactccaattgtattgccaattgtccatcatggttttcatgaggtgatgccagagaattacatgtttggtaaacgacctcctataccattatggaataagaaaattcacatagttattggtgatccaattgaatttgatcttccagcaatgaggcaaaaggctatttcccagtctcgtaatgagtcattccctactattgggtggcccagcactcctgatggtttggatgaagcagcacaaagatatctctacaccacaatttcagagcaaatccgtgctgcaatggagagattaaggtgtttgggtaaaagttttatgaagtcatag

SEQ ID NO: 34190 - DNA, 328 bp, Glycine max
  Peptide Sequence Number=SeqID_150968
atactttggcggtgccagtttgagtgccgaagaggatggtgacctttttggtgtcatcgtcaacgtcgatttcgggaagcttctcgatgacgtgtttaggaggctcgagaggcttgaccttgggggaggagggtctgcgccagatgaagacgacaatgcagccgatgaggacggcgacggaggtggtgatgagcatgaggaagtcgcagttctcgaggaggaaggagcagctggacaatcgacgatggggtctttgaggtgtgtggtggcgtcgtggtttggaggggaggagttgggtgcgacagggggtggagtggttgagagatga

SEQ ID NO: 34191 - DNA, 402 bp, Glycine max
  Peptide Sequence Number=SeqID_150969
atggcttccactcacaacctctatatctttgtttctcttgtgactataactgcattggtctcatcaatggttgagtccagatcactccctaacgcttcttcgagcctcacggttcggttgaagctcgagggcgaaccctccaactgttgggactcactatggcaactccaagcatgcagtggtgaaattgtaacgttttttgtcaatggtgagacttaccttggacatggttgctgccaagcaattagggttattggacacgattgttggcccaacattgttgcgtctctaggattcaccaatgaagagactgatgtgttggagggttattgtgatcaagctgttgattctccttcaccaccatctatagtagttgactcaaaagatgacattgttccataa

SEQ ID NO: 34192 - DNA, 495 bp, Glycine max
  Peptide Sequence Number=SeqID_150970
atgtttacttccattgtcggtaatgtatttgggttcaaggccctgcgtgctctacgtctggaggatttgcgaatccctactgcttatattaaaactttccaaggtccgcctcatggcatccaagttgagagagataaattgaacaagtatggtcgtcccctattaggatgtactattaaacctaaattggggttatccgctaagaattatggtagagctgtttatgaatgtcttcgtgggggacttgattttaccaaagatgatgaaaatgtgaattcccaaccatttatgcgttggagagaccgtttcttattttgtgccgaagccatttttaaatcacaggctgaaacaggtgaaatcaaagggcattacttgaatgcaactgcggcttggctcattattgccgagataatggtctacttcttcatatacaccgtgcaatgcatgcagttatcgacagacaaaagaatcatggtatgcactttcgtgtactag

SEQ ID NO: 34193 - DNA, 198 bp, Glycine max
  Peptide Sequence Number=SeqID_150971
atgatcatgcaaatcgtagaaggcattgacgagttcggactgggggtgacatgtgacactggtctcgccagtaccacccacgatttgagctccatgagactcgccagttggactggcgagttgagcaggctgggaattgccaactctactggcgagttgtgcagcagattgggagtgctttataatgccattaattaa

SEQ ID NO: 34194 - DNA, 108 bp, Glycine max
  Peptide Sequence Number=SeqID_150972
atgtgggacaaaggaactaagaccacaaactctaacagttttctccactgtgtaagctacactgcttcttcatcaagcttcctcatgaactcatcaccagaatcataa

SEQ ID NO: 34195 - DNA, 732 bp, Glycine max
  Peptide Sequence Number=SeqID_150973
atggcgatacaaagccaaaatgcatttactagatcacggggtggtcttccaattggagatggaatatctttgaattctggtgtgcatcctgttgcagatattccactacatgatcagttttcttgtggaaatgactatgccttgaaggtaaggaaaccatatactatcacaaagcaaagagagaggtggacagatgaagaacataagaagttccttgaagccttaaagttatatggcagggcctggcgacggattgaagaacatgttggtacaaagactgctgttcagattcgaagtcatgctcagaagtttttttctaagattcttcgagagtctagtagaaacagtacaaccttggaggagtcaattgaaatcccccctccacgaccgaaacggaagccaattcatccttaccctcgtaaactagttgagattccaaagacagaaatttccaactcagaactcccactgaggtcgaattctcttaagccatcagactttggtcaagaaaacaattctcccaagtcagtgttatctacagttgtttcagaaacccttggttcctccgattcagatacacctactagatgtttgtcaccaacctcatccattagtgatgtccccacaaacagatttccactcgctgagcccaaaacatcatttgaggaagaagggtctccaccaagttcagctcatgataagcaacctcctgtggtacaacttaaatcctaa

SEQ ID NO: 34196 - DNA, 378 bp, Glycine max
  Peptide Sequence Number=SeqID_150974
atggcttacactcacattccgcattgtaactgtggtttatggcataaacttggaaaccctgatgagtcattagagacacctaacaacagccttcaaaattgccccatgtgtggcatctcttgtcaatgtcaggatttacacgcgattctcctcaaatttcagccagcccgcatcaatttgaccttgcaccttacgcttcagagccctacaatgctcaatggaacggcccggggcttctccgtgacaagcacacgttgcatttcgagtcgtattctcggagaaatggaggttgatgaaccttggctagggttatggctaccattgaattatcaagtagatatgggagcaagtcagcataggacactggaattggggtga

SEQ ID NO: 34197 - DNA, 426 bp, Glycine max
  Peptide Sequence Number=SeqID_150975
atgcagtcccatttgcaatcacagatccaatcacagggacttgcactgcctccaaagcctgaggttggtccctcagctgctcgtgtcagcacaaaggggagttgtgttgatccctcaacgaccaatctagacacgggtgactcagacaaatgcgggttgtacattgaaaaaaatccttcccgcctggttgccctaggaagagtttatgagggatccacaatcgttcacaacatccctttgttgaatggccaagtgaaggtttttgttgaggaggttaaacatgcatatgctcctgttcctgtacccactagcgaggtagctatgtatccagcaaaacctgcaaatgggtcggatcctcaggttacgtgggatgctaccgtgtttgaggtgtttgatgaagacttccgccttgtacataaagcatga

SEQ ID NO: 34198 - DNA, 832 bp, Glycine max
  Peptide Sequence Number=SeqID_150976
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaagggacggggaagcccgtctgatagcgctctgtgcgcgtactccgaaaggaatcgggttaaaattcctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 34199 - DNA, 135 bp, Glycine max
  Peptide Sequence Number=SeqID_150977
atggcagagagagaaagcaagtactcatcaatatgttacgaggagagggaagagcaagcttcccttttacagatcattttcactcctgtgagtggaatggaactttacatcgccaagcctttcgcagctggataa

SEQ ID NO: 34200 - DNA, 992 bp, Glycine max
  Peptide Sequence Number=SeqID_150978
ttggtgttcatctcacaccttatttcccttcggtctctgatttcgtcacatcggtttcctcgtcttccgttaacgttgtcgtggacgatcgcgatttgtgtgtttccttgcttcacgatattgtctgggaggtgagaccaagaagggtgtttgactttgagttaaataataacaacaacaattccgtgaattacgacaagtcttggtcttggaagagatcgggttccgtggagtcgtgtgagtttcagaggcttaaacggcacgacgtttcggttttgcttaatgggtcttgggttgtggtcgctggagactcgcaagctcgaatctttacgttgtctttgctgagtttggttctggactcggagggtatggaatctgttaaagggtcattgttcaagaggcacagtgattatcacactgtggttgatgagattgggatgaagttggatttcatgtgggcaccttatgtaaccaatttgactagtttggttgctgggtttaagaggaatcgcgtttatcccgatcttttggtgatgggttctggattgtggcacatgctgcacttcaccaatgcttcggattatggtttctctttgggggttttgaggagttcagtgaattcattgctgccggtgtcatcggaatttggcaacgatgaggcagatgtggcggtttctgcatcggtcagatctccgtctccgcacttgttttggctggggatgccaactttggtgaactcaatgttgaacacgaatgagaagagggagaagatgactgatctaatgtggggagaatatgaaagagaggttcagggaagtggcatgttgaggcaatttggtggtccacttcaactggtggatatagggtcattgagttggacttgtgggatcaagtgtacagatgatgggatgcattatgatggtgttgtttatgaggctggggttcagattatgttgaatgcattgcttattgaatctcatcagaggctatga

SEQ ID NO: 34201 - DNA, 369 bp, Glycine max
  Peptide Sequence Number=SeqID_150979
atgcaacagggacaggcatacatccccatagttaggttccctgaccccaactatggtatcaaaatggtaaattataagaaactcccatcacctatcgtgagctctccgttagttcctctttacgtcactcagaggtctctctcgttcatgcttgtcagtccaaacacaagtctctatatgccaaattcaaggaaatttaatatagatttcataaacaaagtaatgacaaacattcagagtcaaatacccctgtcaaaatggtttttcaaaggaagtgtaaaaacatccaatgacggtccccaagtcagaaaagatgtaaagataggcttaaactaccaaggagcaggcttagaatcacagttaccttga

SEQ ID NO: 34202 - DNA, 684 bp, Glycine max
  Peptide Sequence Number=SeqID_150980
atgagcaagccattgctgttgaattttttgagtgttgacatatcatttgtgcagtttcacttgtgttatggtccagttatcagtgtgggagttaagggagtgggtaactttgaaacttatcgacgggtggcatctaagcttaagcttggaacttttgaagatgaatatatggaaaatgttagttcagtcttggttaaatcttcacaaagtacaggggatactgatgttactggacaattgaaaactggtaggattcctgttcgtttatatctgtggactgtcaatgaggagtttgatgattttgaagatgctccacaaattgataattgggacaaagtctcatatatcaatcgacctgttgagatttataaggaagatggtaaatattttagcttaaatgatgcggttaaaagaatattgcccgagtttttcctggaaaattcctttgtaactgatggagatgcaaacattaaccaaagtggagaagagggagaaagttcatctgatccagggtcatgttgcaacacacttgagattgctgaaatcaaacttgtacgcattcaaggaatagaaccaattttagacatacctttctcttgggtggttaacaacttgatgaatcccgagtattttcttcatatgtgtgtttgcttaaaagtttcaaaggccaatgctgtacaatag

SEQ ID NO: 34203 - DNA, 666 bp, Glycine max
  Peptide Sequence Number=SeqID_150981
atgtcaaagggtgacaaggttgaggttttggacttttgggctagcccattttgtgcaagagtgaaagttgctttggaagagaagggggtgaattatgtagccagtgaagaggatttgtttggaggcaagagtgagcttctccttaagtcaaatcctattcatcaaaaagttcctgtgctcttgcacaatgacaagcctctagccgagtcttctatcattgttagctacattgatgaagtctggtcttccaacccactgcttccaactcttgcttatgatcgtgcacaagccagattctggactgattacattgacaaaaaggtatttgaaaccgggaggagtatctggggaagcaatggagaagagagagaagtgggcactagggacttcattgaagttttaaagcatcttgaggaagctctaggggagaaggactactttggaggtgatgcctttggttatgttgacatcatagccattggtcattcagcttggtttttggcctatgagaagcttggtggcttcaaagttgaagaccactcgccaaaaatctcagcttggattaagaggagcttgcaaagggaatctgttgccaaagttctgccagaccctgagaaggtctaccagtttgtccttcatttcaggaagatgttaggacttgaataa

SEQ ID NO: 34204 - DNA, 1953 bp, Glycine max
  Peptide Sequence Number=SeqID_150982
atggcacctgttttgcctcccggtttcagattccaccctacagacgaagaacttgttgcttattaccttaaaagaaagatcaatggccgaaagattgagttagagatcatacctgaagttgatctctataagtgtgaaccatgggacttgccagggaaatcattgttaccaggaaaggatttggagtggtatttctatagccctcgagataggaagtacccaaatggatcaagaacaaaccgtgcaaccaaatctggatattggaaggccacggggaaggatagaaaagtaaattcccaggctcgggctgtgggcatgaagaaaaccctagtttactatcgaggaagagcaccccatggctctcgtacaaattgggttatgcatgaataccgtcttgatgagagagaatgcgaaaccaattcaggcttgcaggattcatatgctctttgccgtgtggtcaagaagactgcagtgattcctccaaaagttggggagcatcactatgttaatgttcccaatgccaaccaaattacaagtgatcattcatcaagtattgaaatataccctgaaggaaggggcgaagatttagatagcacaaattattttatgccggtggatgcttgctcaccacacaacatgggaaacgagacttctctcacaatcaatagtgggatcatgacaagggatcatgagaaatggtcacacttctcatcacaagaccctttatttagtcttccaacttcttcattttccaaatttggagccatagcataccctccatctaaggtggatatagcactagagtatgcaaggatgcagcataggtttgttttgcctcctttggaggtggatgacttccctcaagttggaatctcagagctgaaaatgacacaagcctccggttccatgcaaggaagcagaactgaaacagatatcttgcaggaaattctttcagttgctcaagtttctcaggaattaataaatcaatccaactactcgcaggaatggggtggcaataatgataattatgctcctcgtgaagatgattttaccttcatggttggcactaattacaatcattcaaatcatggaatgagctcaatgaggtatgctgacaaaacatgggaagatgcaaacacaaggacaatagagatcggagatgtggatgaagaatttaaggcagagaggatggtggagaatttaagatgggttggaatgtcaagtgaagatttacaaaagtctgaccaattggacgtacagatggaagaacaaaagattgtcccaatagaagatatttcaagcttccaaactaatgaggtgcaagaatctgagcaacatagcaacaaggagcacaatgacgacactgaaatcaacgatttctcattgggcttcatcaatgacaatgatggccctaacgagaacttcatagaagatggtaacatagatgattattcaagttctcctagctttgaggtcgttgaggaaataaaggtcaatcatggaatgttagtttcgactcatcaagtagtggagacattctttcaccaaatagttccttcacaaactgttcaagttcacctcatcaattcagtgatggcacataacaatcattatgtagagaatgcagaggcaatgctaatgataatggagaacaaagggtcttcattaaggaataaggttaaggcctatgtgatggggaagcttataaaaccttcaaagacaattgcaagtgcaattgtattcgtctttgcacttgtgttgatgcattgtgtttatttgaaggaagaagtggaaatttggaatgagtcaaataatgaggttaattggtttgttggtgtcaaaagtcatgagaaagaattaagtgcagtcttgaagaaaataggcatttttctcaccatatctttggctttttgtaccatgtgggctagccagaatatggtagttaacccttga

SEQ ID NO: 34205 - DNA, 2649 bp, Glycine max
  Peptide Sequence Number=SeqID_150983
atggcttctgcaccagccttaaaacgcacagattctgtcgttgataatatgcctgatgcattgcggcagagccggtaccatatgaagaggtgcttcgctaagtaccttgaaaagggtaggaggattatgaaacttcatcatttgatggaagaaatggaactagttatagatgacaaaagtgaaagaagtcaagttttggagggcattcttggcttcatattgagctccacacaggaagctgttgttgatccaccatatgttgcctttgcaataaggcctaatccaggagtttgggaatttgtaaaggtgagctctgaggacctttctgttgaggctattacccccacagactacctcaaattcaaggaaagggtacacgatgaaaaatgggcaaccgatgagaactcatttgaagcagactttggagcatttgattcccaaattcctctgttaaccctctcttcttcaattggaaatggactggaatttacttccaagttcttaacttcaaagttaactgggaaattggagaaaacacaggctatagtggactacttgttaacattaaatcatcagggagaaagcctgatgataaatgacagccttaactctgctgcaaagctccagatggcacttgtagtggctgatgcattcctctcgggactttccaaagacactgcatatcagaattttgaactaaggtttaaggaatgggggtttgagagaggatggggagatactgcaggaagagtgaaggagacaatgagaactctatcagaagtactccaagcaccagacccgatgaacttggagaaatttttaagcaacttaccaataatattcaatgttgtcatcttctctgttcatggttattttgggcaagcagatgttcttggcttgccagacaccggtggccaggtagtttacatattggaccaagtcaagtctctggaagcagagttgcttctgagaatcaggcaacaagggctaaatgtgaaacctcaaattcttgtggtaacaaggctcattcctgatgctcggggaaccaagtgccaccatgagttggaaccaatcagtgataccaagcactcccacattctacgtgtgccgtttcagacagataaaggaatcctgcgtcagtggatttctcgctttgacatttacccctatcttgagaggtttactcaggcatgtatagatgcaacagccaagattcttgagttcatggaagggaaaccagatcttgttattggaaattacactgatggaaatttggtagcatcactaatggctagaaaacttgggataactcagggaactatagcacatgctttagagaagaccaagtatgaagactcagatgtcaagtggaaagagttggaccccaagtaccacttctcgtgtcaattcatggcggatacagtggcaatgaatgcatctgatttcatcataaccagcacataccaggaaattgctggaagcaaagatagacctggacaatatgaaagtcatgctgcatttaccctcccagggctgtgtagggttgtttcagggataaacgtgtttgatccgaagttcaacatagtcgcaccaggagctgaccagtctgtgtatttcccttacacagagaaagaaaaaaggctctctcaatttcaccctgccattgaggaccttctctttagtaaagtggataacattgagcatattggatatctagctgataggaggaagccaatcatcttctcaatggcaaggcttgatgttgtgaagaacttgagcgggttagttgaatggtatggcaagaacaagagactgagaaatttggtgaaccttgtaatagtaggaggcttctttgacccttcaaaatcaaaagatagggaggaaatggcagaaataaaaaagatgcatgacttaattgataagtaccaactcaagggtcaatttagatggattgctgcacagacgaataggtatcgcaatggagagctctaccgttgcatcgctgacacaaggggagcctttgtgcagcctgctttgtatgaagcatttggattaactgtcattgaagcaatgaactgtggcttgcccacttttgccaccaaccaaggaggtccagcagaaattattgttgatggggtctccggcttccacattgaccccctcaatggagaggaatcaagcaacaaaatcgctgatttctttgagaaatgcaaagtgaatcaatcacaatggaatgtcatttctgaggctggattgcagcgcataaatgaatgctatacctggaagatttatgcaaacaagatggtaaacatggggaacatttacaccttttggaggcaagtgaataaggagcaaaaggaggcaaagcagagatacattcagatgttctataatcttatattcaagaatttggttaagactgtacctgctcctagtgatgaacctcaacaaccagtaggcaagcagccgagtctcaaatcgcgtagcacgggcatgcacctttgtgcagttaagaaaatggttttccatttgatccatgctaacatcttttttctttttccttcttggtttgctgaatcagacgttcacagtccagattgcaaaggttatttggaaattaatatctcaaccatgaagcaagtcaattag

SEQ ID NO: 34206 - DNA, 486 bp, Glycine max
  Peptide Sequence Number=SeqID_150984
atgatcatcgagatcggccattacgtactcgtgctggcgctggcgacggcgatcattctctcagtcgtccccgtcatcggtgcccgccgccgcgaccaggcgatgatggacgtcgcgccgctcggctcgatcgttctcttcggcctcgtcgccttctccttcggtgtgctgacctatgcgcatgtcgtctccgacttctcggtcgagaacgtttgggagaactcgcactcgctggtgccgctgatctacaaatattccggcgtatggggcaatcacgagggatcgatgatgctctggctgctgattctggcgctgttcagcgccatggtggcgctgttcggccgcaatttgccggatacgctgcgggccaatgtgctggcggtgcaggcctgggtctcggttgccttcatcctcttcatcctgctgacctcgaaccccttcgtgcgcctcgatccggcgccggccgaggggcgtgacctgaacccg

SEQ ID NO: 34207 - DNA, 399 bp, Glycine max
  Peptide Sequence Number=SeqID_150985
atggagggacgtctgttaattggttccctcgctagaaggaaggaagaatcaggattgtatcttcatgcgaaggatgtccaaatgttccctggatgggaacatggggacagagagcttaggggaagcagtaatgggatcatcggtggctatcataagtggctgagagtccggacacaaggattggattggctcccaaatctaaagactgtgggagacaatgaggttaaagcttcggaagaaagtgatgaggtgcaagcgctaaaggcaaagcttgaaagagcccgggtagtcaaagagaagttcaaggcagcaatagtgagctcaaactccgaagaggtgaaaggaatcatcacgggtcaaaggcatgatctggaaggacgagctaaaggcttgccttag

SEQ ID NO: 34208 - DNA, 369 bp, Glycine max
  Peptide Sequence Number=SeqID_150986
atgggcgcagaagacgatgttagtctctgcgtgctatcaggcttttcgtcttacagacatcaaaagaaagtttatacggataaccactcgggtatttccgcctcaaaaaggaatgtttatacggataaccactcgggtatttccgcccgtcaacgtgactcaaatgtcagtatgatagatcttgtgagcgcggatgatgacgtaaatctcggcgtgttaatgggcttgtcggccgcgattgacaaagggcgcagaagacgagataaccatttgggtatttccgcccgtcagcgtgactataatgtcaatatgacagatcttgtgagcgcggaagatgacataaatctccgcgtgtcaccaagcttgtag

SEQ ID NO: 34209 - DNA, 476 bp, Glycine max
  Peptide Sequence Number=SeqID_150987
gtctcctttgtatgtgttgtctggaaagaggaggactcaatgattattcgttcaccggaaccagaagtgaaaattttggtagatagagatcccataaaaacttctttcgaggaatgggcaaaaccagccatactaatgattttgaggagatttccccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggg

SEQ ID NO: 34210 - DNA, 1356 bp, Glycine max
  Peptide Sequence Number=SeqID_150988
atggccaccggcacgtccggcgcggcgccgtgttcgcgcgcctgggcggcccaggcctcggcctcctcgcgcagttgcgcccaggtcaggctgcggtcggcgccgaccaccgcgagcgcgtcgggcgcgcgcgcggagtcaatgaactggaaagtcttcaggtcgaaacgcatgccgaaactcccggcgtcagatggggctgcggccgctgaacacgtagagcgccagggcggccaggatcagggtgagcacgcgtccgaggaaacgcatgacgggccgcgccagcgtggcctgcagcgccggccgggtgcgggcggcgttgatcagcaggttgtgaccgaccgaataggcgccgaacatcaggccgctgacgatgtagtgcaccgacagcccgttccatacgcccatggccaacagcgtggcgaagatgccgatgttctgcgccgccagacggtggcgcgagaagaacgaggtcttgctcagcgccttgtagatcggcatgaacacgacgtcgcgcagccattcggacaggctgatgtgccagcggcgccagaagtcctggggattcagcgtcgccagcgggttgcggaagttgatcggcaaggtgaagccgaacagcatgccgatgccgatggccatggtggaatagccggcgaaatcgaagaacaggtaggcgctgtagagcgaggcgttcagcgccacgccggtgaacgaataatcgtgggcgtccagggtcgacaggccgtagcgccagatcagctcggccaggccgaacttctggatcacgcccagcatgatcagttccaggccggtcagccaggtgttcaggttgacgccttcatagccgcgcttgaggtcggcctggaaattgcgccagcggtacatcgggccggccagcagcgtcagggggaagaacaggtagatgaagtagtccagtggcgacacgcgctcgttgcgcggcgcgaacagcagcacgtcgatggcgcggaaggtggcgaacgacaggcccagcatcgcgcccaggtgcgacacgcccgtcttgaccagcagcagcggcgtcatggtgatgacaacggccagccaggtcgggatgtagttgcggcgcatggcccacagcgcgctgcccgagatggccagcagcgcgatgggctggtagggacgcgcccagaacaccgccatccacacgcccaggcagatcacgccgatgatgtggcgataaccgatgcgcagcggcatgccgaccgaacggtatgccaacaggcccagcccgccgaacaaggcgccgccgaaaaagctcaaacttgcgaacaattccatgctgcggtcagaactgttgatattggaattcgaccttga

SEQ ID NO: 34211 - DNA, 183 bp, Glycine max
  Peptide Sequence Number=SeqID_150989
atgacgatgttggtggtaatagaagtgatgaaggtggtggtgatcgttgtaacaattgatagtgataacaaaggtgacattgttggtagtggtagtgataacaatgataatggtgataatgatattggtgtgaaggtgatggtgacaatgttgatgatagatagttgttatgccaggaagtaa

SEQ ID NO: 34212 - DNA, 221 bp, Glycine max
  Peptide Sequence Number=SeqID_150990
gacaggaccttggccttcttgcatagacttgggcttgctttgatgatgggtaggcttgtcgtgcttttgcccccctatctaatcaaggggctttcatcgaggctggaagaccaagatgcgaattacatgcttatcaaatcaaaaatggaatcattttcaggtcatccacatttgaattccttggataagaaggctaactgcttgttggctgggagcgagcg

SEQ ID NO: 34213 - DNA, 303 bp, Glycine max
  Peptide Sequence Number=SeqID_150991
atgggtaaaaggttgaacagactgatcaaggttttcgatagaaaggattcaatcccgcggattctggaacaggagatcggcgagaaggacgttggcggtgccacgctccctgctgccgacaacctgaagcttccgcctgctcgcgatccattccgccaccgccctagagcgggaatgcccgtattcgcaggtgacgacgaagttccagccctcgggaatgccgtcgacgaactccctgatgcgccttgcatcatccgccagcggcggccgccacggccatcctccgttgtcgccggagaatag

SEQ ID NO: 34214 - DNA, 639 bp, Glycine max
  Peptide Sequence Number=SeqID_150992
atggaagccgaggaaataagcatgtcatcaattctgctcgtcacatccagcccgcgcggcagcgaatccctttcaagccagattgccgtcgagctcgccggaaagatcaaggccagccgtcccgaagcggaggtgatccaccgcgatctcggcgccgcgccgatcccgcatctcgacagcgtcaccacgtctgcgatccgcaaggctccggaagaccgcacccccgaggaagcggccgcggcggccatctcggacggcctcgtcgccgaactcctcgccgctgacacggtcatcctctcgaccggcctcatcaacttcaacatctattccggcctgaagtcgtggatcgacaacgtcgcccgcgctggccagaccttcaaatacaccgaaaccggcccggtcggtctcgccactggcaagaaggtgtacatcgtcctggcggctgccggcgtttactccgaaggcccggccgtttcgatgaaccatgccgttccctatctgaagaccgttctcggcttcatgggcatgaccgatgtggaagtgatctacgtcgagggtctggctttcggccccgaagccgtcgagaaggctgtagcggctgccgaagccaaggtggaagaactggcacaggccgcctga

SEQ ID NO: 34215 - DNA, 348 bp, Glycine max
  Peptide Sequence Number=SeqID_150993
atggtgggctacacaccttcaagctttgatgatatggtcttcaccgacgaaaggatcaaaggtgaggatgaaggagaagcccgtgctgtgactgccattcctatacaaccaagcccacttgggccctccagaagattcctccagaaggctgttgcttctggaggaagcaacctggctcgcctgggcgagctgggcggcaaccatctcccctattttgctataaataggggaggaaccgaggcgctttcgaaacgtttccgtaacgttttccgtaaggaatttcgcaaaggtttcaaccgttcttcaacgttcttcattcgttcttcatcgttcttcgatcttcaacgg

SEQ ID NO: 34216 - DNA, 510 bp, Glycine max
  Peptide Sequence Number=SeqID_150994
atggtggggaaaggagacaaggcaactttggatacggatagaattgatgtagcaaggctcttaattaaggtgaaaatcaacaagcatgtgaacgctatttggacgctggaagaatctccaactcaggttcaaaaatgtggttgttggaggtggtgcgaaagaagcagtgcttctggagaagactcattggaaagcgtgataggtctagaaataaactcttctaattctgataatggagaggtagacaatgactctacgaaagatgaattggaaggagaaaaaactcaagtagcaaaccacgatgagcgtcgaatgacaacgataatagaggcttccgaatggtgctttaaggagaaaagccatcagttatttcaaaatattagtgggcaaaaggagtgtccagtggaaaaggagaacattgtaatcaacccacaaactcctaaaagagatcagaatgatcaagtggataaacatgtgtttcttgtggagtggggaggcacagggtcgtag

SEQ ID NO: 34217 - DNA, 518 bp, Glycine max
  Peptide Sequence Number=SeqID_150995
atgagagaaaaggaaagaaagcctcaagaggctaacattaacctccgatacttccatgggaaggacaacatagaggctaacttagattgggaaataagggtagagcaaaaaattaaaagaaagtctactttaaaatcttatggctctcactcttatccaaagaaagaccaaggtctaggcatcttaggggctgcaccttctaagcctaaagatgataaggcgaagacaatagaaaagcaaccccctaaggctagtatgcaagagaagactatctctataaagtgctttaaatgtcttggaagaggacacattacttctcaatgccccaccaagaaaaccatgattttgaggggccaagacatttatagtagccaagatgaggctactacttcaccttcttctagtgaacgtgaagaagcaaaatgggaagaatctagtgaagaaatctacccccaagaagaaggacagccattaatggttaaggaggagtgtaaggaggtaattgtctcctccaagag

SEQ ID NO: 34218 - DNA, 429 bp, Glycine max
  Peptide Sequence Number=SeqID_150996
atggacgtgactatagcaaaactctttagaagatgcagcggaattagctccagcaaaagtttactgaagatccaattacaaaagaccccgattacaacaaatggatatactatacctgatggtaatacttatgatggaaaggtagtgtcaaaagataagccaagaacgttagctcatgaattaggacataaggcaagtcttccacatatttttgatacagaaagtacagttgataatacaaaagcaaatgaaaataatcttatgaattctggtgaaaataacaaggtagagctgcgtaatagttcaggaacagatttaacctcttctcaatcaactagtatgcaaaatcatattaagattattagtgagaatagggatagaaaagaaaaagaacaacaaaaatcaaatcaaaaccaaaatggaaattaa

SEQ ID NO: 34219 - DNA, 233 bp, Glycine max
  Peptide Sequence Number=SeqID_150997
agatattccaagagaacttcattgccaaatgctctctcaagaactcatgggcaaacacttgcaaatccattaagagttcatccatggatcttcactttgtaaggattcctgaacacaagggatgggttatccctgtgtggttcagaagttgtaaatggatttttacaaagatagtggaaatctcaagtgggttgcttgagtactggacgcaggcacgggttgtggtcgaacca

SEQ ID NO: 34220 - DNA, 288 bp, Glycine max
  Peptide Sequence Number=SeqID_150998
atggccaaaatacaaggcccaaaagaaggaaaaacctattcaaatatttacaaagaaaagtggatccaaccttggcccatgggctcagaaatctaccctgaggatcatgagaacactaaggccttctttagtagctctagcccaatcctcttggattcttctatccaatacccttggggggtcccccctcttgtccttttaacaaatgctactctcagtccgacgcgtgagatcttagagcctacctttgccacgtccaccctgacgagggacaactctagattttag

SEQ ID NO: 34221 - DNA, 496 bp, Glycine max
  Peptide Sequence Number=SeqID_150999
cgaagcataaaggttatgtgagtggtagcttgtcggatgaggggaaggttgaacttggaggagattctggtaaatcagaaagttctttggagaaaggcttagttgatcgcagtgacgcttcagatgttgatgctaaagtagataacatggcgaggtgtttcagaaccaaccagaggatactggtattgtcagcagccaaagttgccaaaaagatgaagctaaaatttactaaagaatggattgcatatcttagattgcctcttccaattgatgtttacaaagagattttgaaaacaactttcacaataatagctgatcatgagatgaaatgccttttgttattgatttgtggcacacatagtaccaaggatactttaacagctgttacaggaaatgctgaggtaaccatcacgaagcttaatgaggagaggcgcaggaacactcaagaaaaagatttactgctgcggcaggaggaactaaacaatttgttgttcag

SEQ ID NO: 34222 - DNA, 294 bp, Glycine max
  Peptide Sequence Number=SeqID_151000
atggcgacctatggcttgcaggtgaagaacgcggccggggcgatcatcgtcagggtgacggacaagttgcctcgacggttgggcgaactcgttacaggcaggtccaatggttcggttcccattcccgaattctctggacgtgagccttggttttcgtgggagatgttggaggacggctcggtgttgtcgattccggaaattgatgtctctggtattacgctattttggtcgttcgatgccgtgcccgcagtctaccgccgtagcgtaaagattcactatggagtaatcggataa

SEQ ID NO: 34223 - DNA, 651 bp, Glycine max
  Peptide Sequence Number=SeqID_151001
ctggactggggcttgccgcctgggccgtcgatcatcgagcgcacggagatctactactcgcagaattcgagcttcgaggcggccatcccgctgggcgtgttcgcctacccgcagaacacgcacacgctgctgggcctgcgcgctggccaggaattgtggttctgggcccggctggtcgacaagaacggggtggcgggtgagtggtatccggccgccacggggattggcgtgcgcggccaggccagttcggacgccgggccgattctggatcagatcggcggcaagatcgagaaatcgatgctcggccaggatctgatcactgaaattgaatcgggcggtggcgccgcgaccgaaatcaaggaagtgaaagacggcctcaatgcgatggtgagcatcaaggcacagtccaccggaccggacggaaagctgtacgccgccggcatgggcgtgggcgtggagaacacgcccgagggcatgcagacgcaggttcttttcttggccgaccgcctggcgctcatcaacctggccaacggggtggtttccacacctttcgctatccagaacgggcagaccttcatcagccaggctttcatccaggacggcacgatcacaagcgccaagatcggcgagtacatccagtccaacaactag

SEQ ID NO: 34224 - DNA, 450 bp, Glycine max
  Peptide Sequence Number=SeqID_151002
atgacccaagagctggtagcccgcggagacaccttacggttatccgcacctcgtcattcagtgaccccaagtgtgattgatgagcagaggccaatgtggtcatctgcgccctttacggagatgtctgcatcttccggtggagactttttcaagtctcacaagttatctagaactacaggcggcgggcccgatgacatgcggagacaaaatttggtcattccgcacccctttgccattcaaacacagtcgtgtccgatggcgcgcagagacaaaatttggtcattctgcaccctttgtcatccagaggcggcgggcccgatgacatgcagagacaaaatttggtcattccgcacccctttgccattcagacacagtcgtgtccgatggcacgcagagaaaaaatttggtcattctgcaccctttgtcatccagaggcggcgggcccgatga

SEQ ID NO: 34225 - DNA, 240 bp, Glycine max
  Peptide Sequence Number=SeqID_151003
atgaattctgcaccctttatcattcaagagcaacaagctgagtggataaacgcgcatagacaaattatgcaccctttatcattcaggaacaacaagttgggtgattttgcaaattgggtgataaacgcgcagagacagattctgtgccctttatcactcaggaacaacaagttgggtggtaaacgcgcagagacgaattctgcgccctttatcattcaggagcagcgagtcgagtggtaa

SEQ ID NO: 34226 - DNA, 834 bp, Glycine max
  Peptide Sequence Number=SeqID_151004
atgaccactctcgctcagacttggagggttctttcttactctaacttggtccctacctcccacacttctgacatcacactggatcgggccaagttgatttatggcattatcatgaagatgaacatgaatttgggctacctcatctcccaccatatttttatcattacccagcatgactcctctaggcttggatttctagccttaatcacaactttgtgtaaagctagagaagtcacatcagattccagatctttggagagtcttagccctgccattaacttggcatacataaagaagaattgttggaatctagatgatccaacagtgacatttagagaaccaaggaaggccaggggtaagagatctaaggctccccttgcttcagtaacaccaaatgcttatgctccttcttcatctactttaccagatcctacagcaccatccacttcgactccacatcttccacagttaccaacttcagctcccactcccttaccagttccagttcctgctccagctcctcctacaggaccttcctcattcacctctaagacattatttgctatgctacagagcctgcacagaggccagatcatcatcatccagaggttacaaagctttggccagcagccggctatgagtgtggaggagttccttgcactggtggcttggccaggaggccagcctcctccttctggaatgggtaaggcctccgcagcccaagagcctatgccagtagaggagcctttgcctgatgtagaggatgagcctgttcctcctgagccatttatctttgagactaatccatccgttcaggaggaagcagcagcttag

SEQ ID NO: 34227 - DNA, 724 bp, Glycine max
  Peptide Sequence Number=SeqID_151005
agggccacacgccctcaccatcagaggactacacgtcctcgcctttagagggctacacgccctcatcttcagaggactaaacgtcctcatcttcagaaggctgcacgccctcgccttcagaggaccaaacatcctcatcttcagaggactggacttcctcgcctttagaggattgcatgtcctcaccttcggaggactttacgtcctcacctttagaggactacatgtcctcgccctcaccttccgaggactacatgtcctcgcctttagaggactgcacgtcctcgccttcagaggactgcacgtcctcaccttcagaggactacatgtcctcgccttcagagggctgcacgtcctcaccttcagaggactacacgtcctcacctttagagggctatatctcctcatctttagaggactgcacgtcctcgccttcagagggctgcacaccctcaccttcggaggactgcatgtcctcaccttcagagggctgcaccccctcatcttcacaggactacacgtcctcactttcagagggcggcacgccccgccttcaaagggctacacgccctcaccttcaaaggactgcacgtcctcgccttcaaagggctgcatgccctcaccttcagaggactacacgtcctcgccttcagagggctacacgttctcgcctgtagagggctacacgctctcgccttcagtgggctccacatctgcaccttaa

SEQ ID NO: 34228 - DNA, 184 bp, Glycine max
  Peptide Sequence Number=SeqID_151006
agtggtcatcttggtgcgcatgatccacactcgtctctttgcagcggcacaggtgaaatcttgccccggtatgcatagtagctgcgtgatagcctccctctctggttgtgctcgcatagttggcccttctctgggatcagggggtggccccggagttgataaaaggaaactactggccccttaa

SEQ ID NO: 34229 - DNA, 369 bp, Glycine max
  Peptide Sequence Number=SeqID_151007
ctctgcgtcgaacttcagccccttcgagttggccacggggcaacagcctctgacgccccacaccattgcggcaggaggaggcttgcccatcagcctacttttttgccaagacgtggcaggagcgcaacgacctagcccaaacctacttaaactaaaggcttggcccggtctgaaggaagaagaaagtagaccttgtagagaagcggataggagagaccgacccagagaggaacgtgcccagcccacgagggcaccaccagatgttggccaacctgagagcgaggcaagctgggaacgggctgaaactgacgattctaagaccaagtcagagactactggacgtctcgcagagcgactctcaacgaggac

SEQ ID NO: 34230 - DNA, 159 bp, Glycine max
  Peptide Sequence Number=SeqID_151008
atgtcaatgaaaaacctcttcgagcgcctaggagtacatgacaagacagaccacacactagtaagtcaggtcactctcactaggattggcacatacttaaatgaacattcaaatcaggagtatttacccccaaggcctagactccgaagagtccagtag

SEQ ID NO: 34231 - DNA, 260 bp, Glycine max
  Peptide Sequence Number=SeqID_151009
aacttgtaaaagaaattttacaagatagtggaactctcaaagcgggttgcttggggactggacgtaggcacaagggtgtggccgaaccagaggaaccaacagatttgaggtcaaatccccttcaagggggaggggatgatacagtcctccctatgaagggatcagtcaccagagccatgagcaaaagactccaagaggattgggctagagctgctaaagaaggtcctagggttctcatgaaccttaggatagatttctga

SEQ ID NO: 34232 - DNA, 300 bp, Glycine max
  Peptide Sequence Number=SeqID_151010
atgttagaagagaagtttgttactattattgatgttagtagcaatgaagagaaagttcattataaaacttgggaaagacctatcagactcagcctaatgttgatgagaatgactgttgcagacagtattaagacaactctccctaaattaagacatttccaaaaggattgcctaaagtgtaagtcttggttcgaaaagaatggtgagcttaatactcatagattccttacaatccaaaccatatgcccaaatgagaagttcattttcatagggaatgaagtgaaagctccagtggaatag

SEQ ID NO: 34233 - DNA, 210 bp, Glycine max
  Peptide Sequence Number=SeqID_151011
atgatccaaaacaccgagacttatattcataaggagacacactttcggtgtcggtctttggaggagattaagaattacgagaaatatggaagtcttcctcggtgtcacaaagtgaaaatacaagacaaagaagaaagcaatgacaaaacccgaagtgaaaaagaatttactgacaactacaagctcatgaatacgactgagagtgattaa

SEQ ID NO: 34234 - DNA, 564 bp, Glycine max
  Peptide Sequence Number=SeqID_151012
agagtgattcttggtggtgcttttgtagtaaatggcaatgtgaatccaactgttgaagtcaacgctgcagacgttgtatttacaagtggggtagatgtacttgcagtggggataaatgttacccaccaagttgtactaactggctccagtgccgcctcagagtttgatagtcaccgttttcggtgtgtcgagcaccagcagcgcttcgagaccatcaagggatggtctttccacagggagaggcgtgtccagctcagggaagacgagtatcctaactttcagggagagatctctcgcaggcattgggcacgaccagtgactcctatggctaaatttgacccggagatagtcatagaatttaatgccaatgcctggcctactgaggagggggttcgggacattgctcatggccagttcttgggcgacccactgattttgaaggaagaccagcagtgtgaattcagccagaggaggagccaggcagacagtttcggtgaggaagtcatcgcccaactgctgtgcataccggggcaggattttgcccggaccgctgcaggcaggcgg

SEQ ID NO: 34235 - DNA, 180 bp, Glycine max
  Peptide Sequence Number=SeqID_151013
atgactttcgtcaaaagcccggaccaccatggagcttggtttcagagccctattatgtcctcgtcccttgacgggaatctcctcgaagccttctatggagttgtcttgggccacatgggccttgttcaaaactttaactaccaatgctcggtgaggctcggaactcatgagcagttctaa

SEQ ID NO: 34236 - DNA, 273 bp, Glycine max
  Peptide Sequence Number=SeqID_151014
atggagcccaagctatcgttttcgaaccgggctctgcagtgtacttcatcatctacggcggctcatggttttccggcaccatcattgactgcgttgactccgacagattcttggtccagtaccgtcgtaattcggttgagagcacagttgttagtcttcaccagctccgactacttcctccaccggagagccaccgggaattcaagtcgggcgacaaggtggtggtgttccacgaccaccgctggcgggatggccatgtcaccgcagatttag

SEQ ID NO: 34237 - DNA, 207 bp, Glycine max
  Peptide Sequence Number=SeqID_151015
gaattggcgacttacccattcaatgactttggcaccggacgttcccaaactggaatgtgtattatcgatataggggatctttcaattgagaagatccatcgacctgagacgaagagaaagaaagatagcaacaaccatctcatctgggaaaaagccatctttttctcaacaatgtctttgtcatttgatccaatagcgcttcgttag

SEQ ID NO: 34238 - DNA, 468 bp, Glycine max
  Peptide Sequence Number=SeqID_151016
atggggacaaggggttgcatcagttacaatcccgttcttgctataagacaacttggctaccctatgagaggggcaccactagaggaagagctcgcacctattattgcacaaggcttcaataagaccaacgtggaggcacttaagaaggtccgcaaggcgtgggagatggtgcaaaagaaggacaaagaactcagaggcagtaacaacgggcccattggcggctaccgtaagtggttgaaagcccacatgcaaggtttggattggctcccgagtttgagaaccactaaaggggaggaagttgaggcaccagagcaagatgaagaggtgcaggcccttagggcagaactcgagcaagcccaaacagtcaaagaaaggttcaactcagcagctcttaagatccgaaaggagaatgttgaactgagagatgttaatgtagctaccaccaaggccttggaacaagagacctaa

SEQ ID NO: 34239 - DNA, 342 bp, Glycine max
  Peptide Sequence Number=SeqID_151017
atgcggggttaccttatggttacccgcacctttggtcaaccagtggcgaacaagcccgttgacgcacagagactaacatcgtctgctgcaccttttgtcgtcctgacccgtgaagtcagccgcacctttcatcaaccagggggaaacgagcctgttgacgcgcgtagactaacatcttcctctgcaccttttgtcgtcctgacccgtgaagtcagtgacctgcggtgttacctaatggttacccgcaccgttggtcaaccagtggcaaacaagcctgttgacgcacagagactaacatcgtctgctgcaccttttgtcgtcctgacccgtgaagtcagatga

SEQ ID NO: 34240 - DNA, 678 bp, Glycine max
  Peptide Sequence Number=SeqID_151018
atgggagatcgcttagaggatatgatttgtgatcttgcacaagagtcttttcagcaagcacatgttcctatgtatcatacatttcaaattgattcgaagaagcctttgtatttggggtgcaacaagtcattgacgttgttgtcagcagtgttaagtctggttaatgtgaaggccaaatatgggtggagtgacaaaagcttcaagtcattgcttcaggtagggcatgatatgcttccaaaggaaaacatgttgccaaaaagttactatcaggcaaataagatactgtgtccaatgggtatggagtatcaaaagattcgtgcatgccctaatgattgcatactgtacagacatgagcttgaagaaatgcacaaatgccctaggtgtggggtatcgcagtacaaagtaatggatgatgatgaatgtagtagtgacaaaaacttaaagaaagcccccctagcaaaggtgttgtggtatctttcaatcattccacggtttaagtatttgtttgctaatggagacgatgcaaaggaccttacatggcatgcagatggggaaactgcaacggaatgctctgctatccaactgattcatcctagtgaaagaaaattgatcgtttgtatccaaatttcgccaaagaggcaagaaatcttaggcttggacttgccactgatggaatga

SEQ ID NO: 34241 - DNA, 375 bp, Glycine max
  Peptide Sequence Number=SeqID_151019
atggcagacaacacacgcatgaaggagcttactggggatgtcaaaaggatcctgaagatgatggaaaaccgcaataaagaatatgctgctcggtttgagaccttagaaacaacactggagatgacactcaaggataaaactagagatcctgggagtatatcactggctatgaacaatcacccttttaaggttgtgccctggtaccaaatgatgactcgtgaaaattcattcaaaacatggattgcttttatgcgagccttagagacagaatttggcccatcaccgtgtgaatgtcctagatctcagttgtttaaactcactcaaattggttcagttcagtcatattacgtgcagttcacggctttagctaatcga

SEQ ID NO: 34242 - DNA, 453 bp, Glycine max
  Peptide Sequence Number=SeqID_151020
atgcagagtttttgctgtgaaattgtgcagcagaattttgcacaagtgcagaaaaatgcttgtgtgtggttggctgtggaaagtctagtgcagaatgagttctggatgtttgctagtatatcccaacggtcaaaatgcaggcttatacactatagacttccagtaaaattttgggagtcgatccaacggttaacgaattggatcgaaggaattgttactgtgcttgtgctgtttgaacgttgttttgcttggatgttgtggaagcttgagaggattgatggggacccggtgttgagagaaaacgaggagatgggctacgtggagtacgtgagctcagttggaagttgggcaacaggggatggggggtttatgcgcgcattgtggatgtgggaaagcttgttgtgcaccatcgcccgaccgccagctagtaccacatgtgatgggaccccataa

SEQ ID NO: 34243 - DNA, 411 bp, Glycine max
  Peptide Sequence Number=SeqID_151021
atggcatcaagaaagagggctagaaccgatggcatcccttcatcatccatcccagctcctcagtcagtagccataggaccaaatcaagtagcttggcctgaagctcaacttccattggtgagacccaatgaagttgctcctcctgagcctgcaccggcacgggttgaaccaatgccagctgagccacgatctctagtggggaatccacctccttctcttgagcttgaagtagttcccccatctccacctctgattatcatctccgatgcatcatcggatgaaactgctgcccctcctgattcaccggctggagaaacagctaatccccctgattccccagttggaggaattgccgatctttctgattcatcatctgcagaagttgttgctctcactgattccccagtttag

SEQ ID NO: 34244 - DNA, 219 bp, Glycine max
  Peptide Sequence Number=SeqID_151022
atggagctgtggaacagagcccgaggctttgcggaagaagcagcgaaacgatcacaggttaagtgcaatgatgatgatacggaattgtctgatgttcctgcagtttcaaatgttaggcaggatctaaccgagtggcaggaaaaacatgccaggcttgttctttctacagtcaagggcatgggtgcttttatcaatgttaatggactacatagtacatag

SEQ ID NO: 34245 - DNA, 1162 bp, Glycine max
  Peptide Sequence Number=SeqID_151023
atgggttcggctgtgaaagtagttacggctatgttaaagggatcgttggggatatttgtttctcactctctctcatgttcactcaacaacaacgacgcactcactgacatcaacactagtttcaggtgctatctcatccaccaaatgcagcaaatacactccatgcccggagggaggtttttctccggctccggatccgccgaccggaggctccgaccccaccatcagaaccagcaggccttaaagtgcccccgctgcgactctctcaacaccaagttctgctactacaacaactacaacctctcccagccccgccacttctgcaagaactgccgccgctattggactaaaggcggcgtcctccgcaacgtccccgtcggcggcggttgccgcaaatccaaacgctcctccaagcccaacaaaataacaccctctgaaaccgcttcaccgccaccacccccgcaccccgaccacaacaacaactccaactctcattccagcagcgagagctccagcctcaccgccgccgctgccaccaccaccgaggccgtgtcggcgccggagactttaaactctgattccaacaacaacaacaacatgcaagagtcaaagttgttgatccctgctctggaaactaataattctctggagcagggaacaggggactgcggtggtatcttctctgaaattggtcctttcaccagtttgatcactactactacttccactaatgaacctttagggtcagggttcgggttcggtaactccactctccccgatgcgtcgtcgtttcagtggcactaccagaaggttagcagtaacaacgaagaattgaagttgccggagaactcctttctcgatcacaccgttgatttgtcggggatgcatagtaaaaccagccacgggggaggattcggatcgttggattggcagggcggtgcagatcaaggtttgtttgatcttcctaacaccgttgatcacgcttactggagtcacactcactgtgatgagttgcatgcgcgatggatcatgattcttgagtccgcgtgcgggagaggaagggttatgaatgccaaaaaagtggggacagacgctcatcatgccgcggactgcgtcgctctccatcacttgaaggtgacggtggttaatattcatgacgcag

SEQ ID NO: 34246 - DNA, 646 bp, Glycine max
  Peptide Sequence Number=SeqID_151024
gttcagaaacatcaaactctcttaccctttcgcaacgctttcatctttcgctgagggagaacaacaagagaatcaggagggaacagaaacaccaccgagcaacgatgaattgggaggaattgcgaaggccttcaacatatcgtctcgaacggcttctgccatatcgatatgcatggcattggcggtgttgacttttccgttgttcatgacttctttggggcagggcatggttctgaagacgaaggtgctgtcgtacgcgacgttgctgttcgggttctacatggcgtggaacatcggcgccaacgacgtggcgaatgcgatggggacgtcggtgggatccggcgccctcacgctccggcaggcggtgctgacggcggcggtgctcgagttctccggggcgctgatgatgggaacgcacgtgaccagcacgatgcagaaggggattctcgtcgcgaacgtgttcaatgggaaggattctttgctcttcgccgggttgctctcttctctcgccgctgctggcacttggttacagggagcggtcggaggtgacttttgcttaccctcctctacccctaaatctcataaccactcccgtcctcgaaaaccgacggactataaatttgcccccgcccccacacccgactag

SEQ ID NO: 34247 - DNA, 696 bp, Glycine max
  Peptide Sequence Number=SeqID_151025
atgctgaagcgtgtggttcactccttagacctggtagagcaaaaagagaaggattccagaaggaagaaccgtctgagaggaagagaggctccgccaacgaaggactttgttcgcggccccgatgtgttcaaatttcctcatcaatcagtgttttggcatgaagatgttccggtgccaggccacaagtacatcttgatctcgtttcgagatgtcgataagctgaaaagtaagctcttggaggaagagaggagcaaagaggctaatggagtggtgctggaaacaaagaccaggtctcctagtggacacaaggacaaagtgaaagtgtcaaatggtgtagcaggccatgaggcactggagacaatgatcacaagtggaaatggaaaaatgaaagagccaaatggagttgcaggccaagagataagtgtgtcgttgtctcccaaagacaaagtgaagagtgtagagatggtggatacagacatggaaggttctctaggtgagggaggtgtagaggaatcttttttctctgcaaaggacttctatgcccctaaggagaagtccacaagcacaagaccttcaagaagaaaaggactaaaagggaagaagccttttgtggcacctcttccaaaggcaaaaaaactatataggagtttgggatggcaacccagcctcccaactgtgaaggaaccctctccatga

SEQ ID NO: 34248 - DNA, 963 bp, Glycine max
  Peptide Sequence Number=SeqID_151026
atggtggggtttggcctagcttatggaggtgccggagctgttttctggggttcactggccagggtgatctcttcgtgggttgtctcaccactaatgggagctgctgtgtcttttcttgtctataaatgcattcgaaggtttgtatacagtgcacctaaccccggtctagcagcagctgcagcggcaccaattgctgtatttctgggtgtaacggggatttcatttgttgcatttcctcttagcaagagtttcccttttgctctggtccaagctttagcctctggaactgttggtgcttttctggtagacagaatcatcagaaaacagcttggacatcttcttgtcaagtcaagtactccagagcctgagccaaaagaagacactgtccaccaccacaatatcggattcctcgacgatgttgcaggcccgaagggtgctcaactggaaatagtttatggagtctttggttacatgcaggtcctctcagcatgtttcatgtcatttgctcatggtggaaacgatgtctccaacgctataggtccattggcgggtgcactagctattcttcaaggcagtaccatgggaactgagattattattccaactgatgtccttgcttggggaggatttggaatcgttgcagggcttatgatgtggggttatagagtgatagctacaataggaaagaagataacagaacttacaccaacaagaggatttgcagctgagtttgctgctgcctctgttgttctgtttgcctcaaagctggggctacccatctcagcaacccatactctagtaggtgcagtaatgggagttggatttgcaaggggatttaacagtgttagatcagaaactgtgaaggagattgtggcttcatgggtagtcactattccagttggtgcttctctatcagttctctacacttggatcttgactaagattttgtcttatattttatga

SEQ ID NO: 34249 - DNA, 642 bp, Glycine max
  Peptide Sequence Number=SeqID_151027
atggcatggctagccagatcatttttctcggtttgctggttgcccttagatgatcatgaactgacttcatcccctcacgggacaatgaaaagcttggcatttgataagaaaaacgaaaaaagttttaatagtattagtaacaacgatttgtcacggccaagcaaaaaaatccacagcaaggagagactttcaaacaatccaataataaaggataaagatgatggtggggttcccattggaaacaagtttgattgttcaagttggtcactctccgcggatgaagattacatagtgttttgctttggaaaggatgtggcacaaggtgacaaaagtgttaatgaagtgcataaaaattcaaggccagtgaatcgcaagctgaaatatggtgagaatgaagaacaagttagagacctgaacattcatgagaaaatatcaaatgctaatcagcaccacaatgatgatgacatgagaagggcagaatcaagtaactctgaccaatctgaaggcagtagaagttcttttgcattccctgtgttaggttgggaatggattggaagccctgtacaaatgcccaagtcagaaggtttgcacctaaggaagaacaaggctcgagctatgcgatttgagtgttgtagattctga

SEQ ID NO: 34250 - DNA, 369 bp, Glycine max
  Peptide Sequence Number=SeqID_151028
atgaagtgtaggcagttgaggtacagagatgaagaagggaacctgattgacgacatctcgctctctgtaccaccggagcgtcgccagccgcgcgaggaggcccttcgccactgcctccaaatcggcgtcaaagctctcaaagccatactgccttctctcgacgtggttgggcttgttgatatgcatgttcgggagttggagaacattccgttgtttaacgcggggagaggatctgtgctgacttggaaaggcaccgtggaaacggaagcttccataatggacggcggcagcactatgaattgcggagctgttttcccgcctcattacggtcgtcaacgccatctctctcgctctactggtcaaaagtga

SEQ ID NO: 34251 - DNA, 516 bp, Glycine max
  Peptide Sequence Number=SeqID_151029
atggtgttaagtttggttaatgtcaaggccagatatgggtggagtgacaaaagctttacttcactgcttcaggtagtgcgcgatatgcttctagaggaaaacacattgccaaaaagttattatcaggcgaagaagattttgtgttcgatgggtatgaaacatgagtttgaagaaatggataaatgccccaggtgtggggtatcacgatacaaagtgaaggacgatgacaagtgtaacagtgacaaaagcactaagaaaggccccccggcgaaggtgttatggtactttcctatcattcaaaggtttaagcgtctatttgctaatggagatgatgcaaaagaccttacatggcatgcagatggaagaaactacgatgaaatgcttcgacatccggctaattcctctcagtggaaggaaattaatcatttgtatccggatttcagcaaagagacaagaaatctttggcttggacttgtcactgatggaatgaatccctatgggagtttgagcacttag

SEQ ID NO: 34252 - DNA, 543 bp, Glycine max
  Peptide Sequence Number=SeqID_151030
atgccaaagcaaatacagttatacgccgtcaatgtaagggaaaacaagaagggaggagaaggtggtggttttaccggagaagggagcggagcgagggagggcgaggacgcgggtgtggccgccaaagtaacggagcttgctgtcgggaaaacgggggaggattttgccgccgtagctgcagaggaatttgaggttgttgccatgggagggagaggggcccaccattgggttttcgttggatttagcgggaacgaatgggattgggggataatgattttcatgtacccatctcttattcctgaagccacgggagctactggcgatataggctgttggcgagagagctgcttacgtggacatgccgtcattgctgttggcgagacaactgacgtggcctgcataccaccattctcattggcgagtctggtgacgtggagagagtctcgcccttcccattggcaagacatgcacagcgggttgcagagcaggaggcctggtttttctgagcatatatcgtcattactaatggtgagaataatgtga

SEQ ID NO: 34253 - DNA, 393 bp, Glycine max
  Peptide Sequence Number=SeqID_151031
atggtgaagttggaagaactatgcggcgcacacgtcacccacctccgttgccagttaccaaccgaagacctcgacgcgttggtttccatcacgtgcgacgaggacctcaataatctcgtggaagaatacgacggtgccgtttcatctttgaaaatcagagccttcctttgctcttcgcctgctccgtcaaaatcttcgtcgacaacgtcgtcgtcgtgctcatcttcttcgtcgtctccgtcgtcttgctgccgtaccgctatggcagcgccgccgcagttggcgaagaagtcttatgtttctctttcctctccccgctactatagtcatccccgcgttcaggggaaccgtggcgtcgtttacctcgtccccagcggcaaccactggcactag

SEQ ID NO: 34254 - DNA, 650 bp, Glycine max
  Peptide Sequence Number=SeqID_151032
gtgcattgtttacgatggttcgtgggcaagtgatgattgttgcggtggttggtatggccattaacagcggagccatacaaattgcttatacggatcaccaatctgtaaaagccatatggattgccaatttgtatgtcttatatggattttcgacaaccagaaccaaacaacctccacaaagagacaaagagagggacgagacacttacggcggagaagcacaacaacacgacaattggtcttgcggttattggcggcatgagcgacgacagtgacaatgcggagacaaaaccaagtcatgaacgaagaagaaggaaccaaaacaatgttgctggtgcccaaagcaattctccagtcagcattgttctcttccacaatggtcccgaagatggaacaagagtggacaatgataattacttaatacaacccatttttgcttgcccgtcacaattccctctagtgtttgctagtcactcaaccatcaccattgaaggcaacacaaaagacacacttgaagcatggagattcatgaatcatagggaagtgcatggcgaaggtagatggttgagtggcaacatggtgtggtcatggaggtttgggggagaggcaaccaagtttgcttgggagaggaagttaaaaagggaatattag

SEQ ID NO: 34255 - DNA, 228 bp, Glycine max
  Peptide Sequence Number=SeqID_151033
atggcttgccagaaaagaaaaagaatgagatgcagcaagagactgatgatgaagagtagtcagtgggggaaagcaaacattgcaatatggtacgtgttgggttggggtggttacatttatgttggtaaaaagtcagatataattacaggcaaacattgcagtgctggtgccctttacgtgttaaaatatgctttattaacgccaggctgtttgtacaactactactag

SEQ ID NO: 34256 - DNA, 168 bp, Glycine max
  Peptide Sequence Number=SeqID_151034
atggaggagactcagagtgcgagtgctgagatgaaagagactgagagtaagagtacgagttgtagcactgcgaaagtgacaaggttgaccctattctttgtaacagagatgtttagagaagagaaaaccctactttttgaacttttgttcattgatgctaaagaatga

SEQ ID NO: 34257 - DNA, 408 bp, Glycine max
  Peptide Sequence Number=SeqID_151035
atggaggattccaagggattccttagcttcaatttcgagggtagcctcaatgttgccccttcctcatccttcgccgtcgccccctccagcctcctcatcctgcacaactcctccacgatcgcctttgctggttctaacaaagggcttgccgcccccaccccatccgcagtggacctcgtgggcagcgacaatgttcccgaccagtggaacttccggcaaatggtgtgccgacactggttgcaccacctatgcatgaaagctcaaagagattcctctattggtggagtttacaacaagcaggaggaagagaaagcaattacgaggttattggatggaagtgaaaactatactcttatttatgaggataatgaaggagacatgatgcttgttggagatgtgccatggtag

SEQ ID NO: 34258 - DNA, 247 bp, Glycine max
  Peptide Sequence Number=SeqID_151036
gggttgtgctgatactaggactagggttccgaaggttgaagcttttggtgccccttatgattcgtctaccatgcagcaccaatttgaagccattcatcatggcttcaacaccatgcagggcgtgtctgtggagagaaacaaccagtttttgatgaaccatgttgctgcaggatgctccaacctggaagattttcttcagtatccagagatttttaattcccttgtagcaaggatgcaaaatgcttag

SEQ ID NO: 34259 - DNA, 237 bp, Glycine max
  Peptide Sequence Number=SeqID_151037
atgcgaaggcggcctcctccgccgtgtcgaaggtgccaagccaacgccgttccttcgactgcgggtcgcggatctcggcagcgtagcggccccaggggcggcgtcggacgccgcgatagcgcatggtgccgccggagctggcggtatcgcgcagcccgcgcttggtggtggcgcttttcttggggtggtggtcggagagggttgtgtcggggtcttgagtggggcccattccgttga

SEQ ID NO: 34260 - DNA, 228 bp, Glycine max
  Peptide Sequence Number=SeqID_151038
atgaggtacgagggagggggaagaaatcctagagaactagtactcctccaactcaactcagatactctcagtgttgttaaatggcgacgctatggccgacatggcggaatgccatggcgtttttttttttggccaaccgacatagggaatttgggaatggaggcccgctatggcgtgtttatatggtggaatttgggccttcagccgtgtaccgccatccaccattga

SEQ ID NO: 34261 - DNA, 147 bp, Glycine max
  Peptide Sequence Number=SeqID_151039
atgatacaggttcaacaatcagcacaaccacaatcacagactaaagaaaacctaaaagtttctcctacagtgcagaaggaggaagatacacacaatccacaaagcttcgagagaaaaacatactgtgagagcgagagtgacacctag

SEQ ID NO: 34262 - DNA, 336 bp, Glycine max
  Peptide Sequence Number=SeqID_151040
atggagtaccaaaaaattcatgcatgccctaatgattgcattttgtacagaaatgaatttgaagaaatgcgtaattgccgcacatgtgaggtgtcacgctacagagtgaacgacggggaatgcagtgttgatgcaatcgcaaacaactgggtccagcaaaggcatgaaagggagctgaggaaggggttccaaggtttagtagtgaaggaaattgagagaagagagaaagaagaagaagaaagaagaggaaacgaagctgaggcgtcgccgaatcgcgactgtgatcaatctctacgttgttccctgttcggtgttcttcatgcgaccatcaattaa

SEQ ID NO: 34263 - DNA, 768 bp, Glycine max
  Peptide Sequence Number=SeqID_151041
atgaggattgaacaattcttgcaatttgctgcacaaaatgcactagttgtaggtcgtaaatttttttgtccatgtgtcaaatgtaggaacgggagacaacactcagtgaatgacataagatcacatcttatatgtgaggggatcattctgaattatacagaatggatattgcatggtgaattgccagacatgccaacggtgtctcacattgagcatgttgatgtagacatcggagattgtataaaggacatgttacatgatcttgggcaagagtgtttctggcaagcagatgcacctttgtatgggaaatacaaagcaagatttaggtggagtgacaaaagcttcattgaattgtttgtcgtgttgaagaagatgcttcctgaagataatgcgttgtcaaaaaatcactttgaggaaaagaagatattatgtcctatgggtatgaagtaccagaaaatacatgcatgccttaatggttgcatattgtacaaaaaccagttttccgaaatgcacaaataccccacatgtggggtatcacgatacaaagtgaaggatgacgaatgtagtgatgatgcaaccacaaataatggtcttccaaaaaagcgaatatacattatattgtgtatgatgatagagggtccaagacaactaggaaatgatattgatgtctatctctctgccttgattgaagacttgagaaaattatgggtagacaaggttgatttgtttgatgggatctctagcagaccttcaggttgcatgcaatga

SEQ ID NO: 34264 - DNA, 312 bp, Glycine max
  Peptide Sequence Number=SeqID_151042
atggggggggggggggggagaagttgcctgtgcacgataggtgcattgaagagattaaagactagtttggatggtaaatctgatcaacttacacctcagtggattgaagtaaagattagtcatttaatcaacactttaatccgacaagtgagtcatgttcaaaatggaggctatgagtgtggttattatgtcatgcattggatgtggagcatattcatagggggtttcaagaacgaatggactatgtggtttggtgaaggaacaccattagacatggagaccataacaagaaatgggcaacatactttttag

SEQ ID NO: 34265 - DNA, 348 bp, Glycine max
  Peptide Sequence Number=SeqID_151043
atgacacgtaatgaccaacatggtcatccgcacccttttcgtcatccagagacaatcaagtccgattacatgcggagacaaatcatggtcatccacaccctttttgtcatcaaaagacaatcaagcccgatagcacgtggagacaactcatggtcacccacacctttgtctgatgacacaccgaggcacattagtctccactcccttcgtcaaccagaggcaagcgagcccgttgacacgcagagaccaatgtggccttctgcaccctttgtcgaagactcaatgtctatcgatcgagactactttagtctctcctttttgtcagccagagacaatcaagttcgatga

SEQ ID NO: 34266 - DNA, 633 bp, Glycine max
  Peptide Sequence Number=SeqID_151044
atgccaacgtcatcacatcggctcagcgactcctcaccaaaatcttactccttgcaccctgatgctgtcattctattcccacgaacaaggttcgcaatcatcacagggacatccgacaaggtcaatgcaccccccacgaacatacacaacatccaacgtatgaaacatgggcgccatcaacatgcacatcgatatcacatcccattagttaaaaatgtcattttcttgaaagaaaatcagcatgcaacagggccagatagatattctcatagctacctccctgaccctaactatggtgtcaaaatgggtttttcaaaggaagcgcaaaacatacaatggtggttccaaagtcagaaaatatgcaaagacaagctaaaactaacaaggaacaagcatagaatcacgaccggggcttcgttctcaaccaaaaccgcgaggcaagtttggaagattccgctttggttgaagggttcctctcggtgtggggtttcaacggagaacaacggtggtccgtggtggccaccggtggttgtgggtggtggagaaaaagcttgggatgttggaaatggttttggaagagagaaggagaaaggaatggctgttttccaaggctacacgaaatacaaaggctga

SEQ ID NO: 34267 - DNA, 747 bp, Glycine max
  Peptide Sequence Number=SeqID_151045
atggattcaccacttcatatccaaaagcctcatgttgtatgtgtaccattcccagcacaaggccatgtaaacccctttatgcaactagccaaactccttcattgtgtgggtttccacataacctttgtgaacactgagttcaaccacaaccgttttgttaagtcccatggaccagactttgttaagggtctccctgatttcaaatttgagaccatacccgatggcttgccgccttcggataaggatgcaactcaggatgttccagcactgtgcgattctactaggaaaacttgttatggtccattgaaagagttggtgatgaagttgaactcttcttcccctgaaatgcctccggttagttgcatcattgctgatgggactatgggatttgctggaagagtcgcaagggatttgggcatacaagaggttcaactttggacagcctcagcgtgtggttttgtgggatatttgcaattcgaggaactggtgaaaagaggcattcttccattcaaagttgtcgcaacctacccttcggcgggagggcgatgcgtgactcgcgggatgcgtgttccacgaaaggaatacgcgcggagtcgccaccaacgtttatttgaggaaaacgtcggaaaaactggaaaagacgcgatctacgaacttttaagtgaaagggtgtttccctttgctcctacgtattcctcaattgcgatgaggaaatcagacctacgtagttctttcttcatcaagtga

SEQ ID NO: 34268 - DNA, 348 bp, Glycine max
  Peptide Sequence Number=SeqID_151046
atggaaattaaccatgatgttaggagagaagagatagcaaagcttgtgaaggaaatgatgatgggagaaaagggaatggaaatgagacaaaaatccttagagtggaagaagaaagcaataagagctactgatgttggaggatcatcttacaatgatttctataagttaataaaggagacacaattggatgctccattggatagaagacaaattctagcacaaaggactagactaggcgatacatacaatgtcgtccaatcaccccagactataggtggtgcccgtgaagagcctcaagagcgagctcaaggcgacttcgactcatattctccgttcacctactactag

SEQ ID NO: 34269 - DNA, 237 bp, Glycine max
  Peptide Sequence Number=SeqID_151047
atggttgtgtatagaatccagaatcgtggcacattagggtggacatggatgattgggctcccgaacttcacatgtcggcttgaagatgtacctttgacaggaagggggacctgtaaaacaaaggatttcgacgctcaagctagagataacctatttgttggggagtccggttgtcaagggtccggcgtccgtgctcatgtagcaggattgatgtggaagattgacacatgtctataa

SEQ ID NO: 34270 - DNA, 648 bp, Glycine max
  Peptide Sequence Number=SeqID_151048
atgactagaagcaagaggattcaagaggacttcaaggaaaatgaaggttctttcccaaaagctacagatgacgtccttactaagaaggaccaagcacctaggaaagttgaggttcctacttatgggaatccaattttaaacaaggagggtaagaatgaggtactggcacatcctctgataattgttcaaattccaaagtatgccaaatatttaaaagaaattctttcaaataaagaaaagttggcatactttactacaatcggtctcaacaaaaaatgttttgctatagttttaaggaagttgccacctaagcttagtgatccagggagtttttcagtcccttgtactattggcaacttacaaattaatagagctttatgtgatttgggtgctagcattaatttgatgccttattctgtctataagaagttagggttacaagaaccccaacccactaacatttttcttttgctagcatacaagactcttacttatccaagaggaatagtggaaaatttgctagttaaagttggaaaattcatttttccaattgattttgtgattctggacatggaggaagatgaagaaatccaaattattttgagacaacctttcctctacatagaaggggttttgattgatctttga

SEQ ID NO: 34271 - DNA, 1983 bp, Glycine max
  Peptide Sequence Number=SeqID_151049
atgacccaccaacggttactctctttcaccgtttgtgaccccaaaatcgtatcatttcctatgcacttgctcctccaaaacccacccactcctgctaagcccctgtgttccagcagcttgaatgactcgtacctcattctgggttcctgcaatggcttactgtgtctgtatcatattcctcggtgttacgtagcgttgtggaacccttcaatcagattcacatcaaaaagattgcccaccggcttatcacctggcgagggttttagtactttccatggttttggctatgatgcagtaaatgataagtacaagttgctattagccatgagagttctcggtgagacagtgaccaaaatatatacatttggtgcggattcttcctgtaaggtgattcagaatttgccattggatccgcacccgaccgagcggctagggaagtttgttagtggcactcttaattggatagcgcctaagatgggtgtaagtgatgagaaatgggtgatttgttcatttgattttgcgacggagactagtggtcaagtggtgctgccttatggagacagggacaatgtttgcaagcctgtgataaatgcggttcgtaactgtctttgtgtttgtttctttgactctaggaaagctcattgggctgtgtggctgatgaaagagtatggggttcaagattcgtggactaaattgatggtcattcctcgttttgttcaagaagatagttggccctggaaattgatccctcatgatgagctctgcacttgtagagggtttccagcacttgaacccttgtgcatttcaggaaatggtattgctctgttcaaaactacagcttccaacatagttgtgtataattcaaatgatgatgctcatttctggcagaataaaggcctcagcaattctagaggtgaatgtgctatttggctggtcatctggagtgcagtaattttctgtgtgtggaaattgcgaaatgatgctattttccgacaagaatcagtggacaaaaagaaattagtggaggacattaaatttgtcagttggtcatggctaaactctctgcactctgacttcaatgcctcctttgtgcagtggtcttttaaaactgcattttgcttgcaggttttggtattggggatccttgggaataaagtgaatggattcataggtgctaggtgttggtatgtgaagcttacattcatgcacatggaatctagagagatggatcctatttgtttgttcggtacctctggaggtactgttatgatgtattatcccttttttgctgagcaaaaagaaaacctggaaaagggtaaaaggaagtctagatgtttgttgtttgtactcttgttgggaattggattttggaatgaagtgaggaggaggagtaacagtgttacggtggtggcggctcacaggataggctatgcatcatctaaagtagctttttcctggagatttctcttggacaggattcagacaaaaaagaatcttaggaagaggaaaatggggaaggttgatggattaaactgtctgttttgccaacaagctgaggaatttgctgaacatctgatgttctcttgcaagttttcataccaggtttggaaggaatgttactcatggataggagtaaaagtggtgctacctaaagatcctaaaagtcatttctggcatcatagtggttttattgcaaggaagaaagcttggtgggtagtgtggttagcaaataaaagctcaagtgattcagcagcttattctctaggagaaaaacaaaaacctagagggatgcaccttacaagaacccaccagcaaaggactacttacactcaaattaaaggaaaagaggagaaaaagtatattcttaaccaaggcccgattcctggtggtttcaagttttcatacactaatcgcccattgccttgtgctccttcaccatccctctcctgctcaagggcagagctccttttcttgcttgtttaa

SEQ ID NO: 34272 - DNA, 504 bp, Glycine max
  Peptide Sequence Number=SeqID_151050
atgtttgcattgaagagggaccagttggctgagcatcaatctgtagtgatatctgcaaatgaatctcaagaaatttcgatcgagcatagagaactaagagatttccaacatattatgactatattgtgtggacaagcattaggaatcgtggaagatgagtgggatgaggaagaatacgatgttgatgattttgatccagaatatgtcctcttatctttgttggataattatttcagttcaagtcttcctggcttcgcacatttcaggcccaaacttggtcaagtgtgcatcttgcaaagagatagagagacaccttcaaggatcgtcaggcgacatagcatggacaggtcaatgattccatcagtggttaaggattctataggtggtggctctttaaaccacaaagggttgattgcagcatgcttgttagaaatgtatccaaccaacaaggtcttgtctgtggtgaagatgacgaaaaaaaaagaggggaaagggctaatctga

SEQ ID NO: 34273 - DNA, 552 bp, Glycine max
  Peptide Sequence Number=SeqID_151051
atggagggcaatgaagaaacattagaattgtgtaattggatcattgacattcatggagatgccatacatatcaagaatttcatcatgaaccataacataagagaggatgacacggggaaagcaaactttatgaaagagaagattgtgaatgatgattggtgggataagatgtgggatttcatgattgagaaggtgaaacttgagatttacaagaaaaaaaaactccctcactcggagaattgtccattttatgatgcggatgttggtggtgatgcatttgattcaatggaggatgtggaatttttagagtttgtagaactctctgttggatcaagtggcctcagaataattaagaaggagagcaaagatccacaagggatgtaccctcccttgttctctttgaacaacctagtggatgtaccctccactagaactgatccacaagagatgtaccctctcttgttctcagtcacaacaacgcaagtagatgtaccctctacttgtaccacaaaggatgtaccctccaatgtgttaagacaaagttctcaggcg

SEQ ID NO: 34274 - DNA, 303 bp, Glycine max
  Peptide Sequence Number=SeqID_151052
atgggaaatacgccacttgatgaagctcagatgtgtggaaataagaacctgatcaagcttctagaagatgcaacatctgctcaatggaacataacatggacactctacaagcttatggtagtgaactctttcactgtggccgcgacatacaagcttttagaaggactacaacaatctgaacaagagggtcagcagagtgcaaacttgttttccaaattctggtgtgcaaaagttccaacgaaagtacttgttttctcttggaaattactccaagataggcttccaacagcacaagcgctctag

SEQ ID NO: 34275 - DNA, 318 bp, Glycine max
  Peptide Sequence Number=SeqID_151053
atgtctcctctgatggtaagcggagccgacaaggatgtggaacgttgctgcatgatttcgggtcgtggaagtggagttagcatgggaggcgtggtcggtatgggggcggctggtggcgatgactgcataggggaggaagatgaagaggagtgtggtggggttgttgttgttattgagtggtctgcaaggtggcatcaaatgcttattctagttccttctacaggtcctacgagggaggctagcaataacggattttggaaatatcctaacagaaagatatattccagtagacagaatattctaattgtccaatgctaa

SEQ ID NO: 34276 - DNA, 183 bp, Glycine max
  Peptide Sequence Number=SeqID_151054
atggctagaatcgggtctttggacccatattcatggaaaggtagaacaagcagaagtaaaatcgctacgatcatttgttggagtattaggcgcccacggaatgaaaagaaatggaacaataaggaaactgattgcaaagctattgtggatattttccaaaataattccttaacttattggtga

SEQ ID NO: 34277 - DNA, 1044 bp, Glycine max
  Peptide Sequence Number=SeqID_151055
atgaagtttatgaaactaggatctcgttcggacaccttttacactgcagagtctatgattaatggattaatgtgtatcagcttcaggacaatctcttctgaagtttcaagtgacttcataattcaagtgaaaggaactagataccttcttcacaagtttccactactgtccaaatgttttcgcctgcaaaggctatgctcagagagttctgattctccacagcaccaaatagtccaactacctgattttcctggcggggtggaaacatttgagctttgtgccaagttctgctatggcataacaatcactctcagtgcttacaacatcgtggccgcgcgatgcgcggccgagtacttgcagatgactgaggatgttgagaaggggaatttgatttacaagcttgatgttttcttcaactcatgcatcctcaatggctggaaggattccattgtgactttacaaaccacaaaggcattgcctttgtggtcagaggacttagcaatttcaagcagatgcattgaggcaattgcctcaaaggccttaagccacccatcaaaggtgagtttgtcacacagccattcccggagggtgagggatgatgtgtcttcatgcaccggaagcgaaagcttgagacacaaatcaacaagcagaggttggtgggctgaggatttagcagatttgagcatagacttgtattggagaaccatgatagccatcaaatctggtggcaagacaccctcaaatctcattggtgatgcattgaaaatctatgcatctagatggctaccaaatataaggaagaatgtgcatcatgtcaagagggaaaaaactgaatcagactcagattcagattctgcaagtgaagtgaattcaaaacatagactacttttggaatcaatagtgagcttgcttccagcagagaaaggtgctgtttcttgcagcttccttcttaagctattgaaggctgccaatattctcaatgcttcttcttcttcaaaggtggaattggccacaagggtaggacttcagttggaggaagcagcg

SEQ ID NO: 34278 - DNA, 204 bp, Glycine max
  Peptide Sequence Number=SeqID_151056
atggttcaacttggtaatcggctcaaacgagtagatgactatggtggatccaagacatggggatctcttgtattgaaagtctttctgttgggtgagtccatgcatggaggccagatagcaggtctcataggtgttgggacggtaaaaactatcatgtggaagagactcacacttgaagggaagattgttggaatacaagggtga

SEQ ID NO: 34279 - DNA, 264 bp, Glycine max
  Peptide Sequence Number=SeqID_151057
atggacacatcacctttacggaaagaagatgcaaaaactcacaatcagggtcaagactgcaagcacatgcaacacaaaataggaccaacaatgcacctcaaaaaggaaaaaggggttaggaggagaagggaagggggtggacgtttgcagaaatgtggaggtgagaggaaggggatggggtgtaggaaaatgagggagggaagttgggtaatttggcttgattttggaaaaggaatgggggtgggaataccatttgtggtgtga

SEQ ID NO: 34280 - DNA, 663 bp, Glycine max
  Peptide Sequence Number=SeqID_151058
atggaacaacccccgaagcccgaaactgtgcccgaatcccacgtcccgaacggccactccaccaccaccaccgccacaaccaccgtcacaaacggatcgggatcggaattggaatcgcaggtcccgaaggaacgcgccgcatcgtcgtccggcagcacgaaaaaatcggtgcactggagccccgaattggttaccgaatccaccttcacctcttctcctcgcgaatcgcgctccaatccatacttttccacttcttcttccttctcccaacctcccccaacgttcatggagacggtggtgaccgttcgcaatgtgctgggaagatggggcaagaaggccgcagaggctactaagaaggctgagagtctcgctggaaacacgtggcagcacttgaaaacaagccctagctttgctgaagctgctatggggagaattgcccagggaacaaaggtcctggcagaaggtggatatgagaagattttcctgaatacatttgagacagttccggaggagcggcttctgaattcttatgcatgttatctatccacgtctgctggtccagttatgggagttttgtatgtatccaccgcaaagattgcatattctagtgacaatcctatttcgtatagaaatgacaaccaaacagaatggagctattataag

SEQ ID NO: 34281 - DNA, 675 bp, Glycine max
  Peptide Sequence Number=SeqID_151059
atggccttagatcactttgaggagactgtgcaccaaaaaggaaattggaaatcttccagtgaaatcattgcagattctgatagaaatgcctctggtgactttgactgcaacatctgcctggagtgtgtgcaagatccagtggtgacactttgtggtcatctttattgctggccctgcatatacaaatggcttcattttcaaagcacctctttggatgatgaagaacaacagaggccacaatgtcctgtatgcaaatcagaagtttctcaatcctcccttgttccattatacggccgtggccaaaccacattaccttctaaagggaagccacgtcaagtaggcactgtcataccacaaagacctcatggtccaagaacacttaacactagaagtgtttcacaacctatttctcaaagttaccatccctatagtaatccttatcatcctcaacaacacttcaactcgattccaagcggttacacctcacctatgattagaacaactggttcaatagacaacacatttggaatctttgtgttggagtgcatttgcaagtatcctaaccctttaccatcgagctctgccatgcctaaagagagaaccaccacgagagtacttccgaacacggttgaaatcaaactcggacatctcagactagttcagttggtattctag

SEQ ID NO: 34282 - DNA, 195 bp, Glycine max
  Peptide Sequence Number=SeqID_151060
atggcaactcgtggcaatcaccgatggtcgtgggtggtggaggaggagagcataaaagggagagtgaccttgactttcactcttacgcctattccattccaagaacatcacttccatcacacaattccagtcgctttctacctatacatgacctctatgctttcacttcatattttcatcattttctgctcatag

SEQ ID NO: 34283 - DNA, 771 bp, Glycine max
  Peptide Sequence Number=SeqID_151061
atgaatatcgtgactgacgatgcttcaaaccaaatgataagtgtgtcggagcttatgctgcagcaaacaagggttcaatctattattgctcagttgtcattaatactctacctaccatattttgggctttcaagattgctccccaattatgtaattcatgtctccatagccccacaagggtctccggggtatcttgaccctcaatatttccaattctataggctcacagacaagagtgatgtgtatagctttggggtggtgcttattgagctgatatcatccatgccaacagttgatgcagccagggaaagagatgaagttaacttggcaaatcttgtcatgaaaaagattcaaaaaggaaagcttagtgagcttgtagacccatcctttgggtttgagtcagaccaagtagttaaaaggatgctaacttcagtagcagggttggcctttcggtgtgtgcaacgagacaatgaattaaggccttctatgaatgaagttctggaagcactcaagaaatttcaaaatgggaattatgagtctgagaatctagagaaagaagatgatgatggtgttatctcttctacttcatccagcgaagtacatccacctcaaccagcttcacaggactcgggtgaagttggaattttaatgaataataagctaccaactttaccgaattccttgactgagaaactagaaagtgaatctaacatgcccaatgccagcaaagatgaaaccaaacatactacttgtttgaatgtcacacactga

SEQ ID NO: 34284 - DNA, 672 bp, Glycine max
  Peptide Sequence Number=SeqID_151062
atggatagagccaggttggtttacggcttagtcataggcatggacatgaagatcggagccctaatctcagccttaatcactgctctatgcagagctagaggagttacctctgacagtctgacctatgagagcctaagcccgaccattaacttggcctacattaagaaaaactgttggaatgtggatgatctggcagttaacttcagaggggccaggaaggtaaaggctcgaccaacagatgttccttcttcttctgcaccaccagctcctcccacttctgccacgcctacaccagctacccatgactctcagcgctttgaagccatgcttcaaaggtccattctgtcagtaaaacagttcaatgagaaggaggttgctactcctgagaggacaccacagaccccaaaagatccaccctcaccagggatagaactatcttttgctcagcaggtagcagatcctcctacaccagtacatgagagaccagctaacccttctactcccattttagagataccagaggaccctaccacaccggccctgacactgaacaccactcttccagccacacctgagcttcagttttcagatgaggaggggggacgaattactactcctccggggacgccagtgttacatttcgatgatgaggagcaagatcaagatgaatga

SEQ ID NO: 34285 - DNA, 126 bp, Glycine max
  Peptide Sequence Number=SeqID_151063
atgactccggattcagtgggcaagattgagagtatgtcaagacttggagattccaatgagtccttgaggaacagtcaggtgttgagccttctagctgccctaggcgttatgcgtaataccacttga

SEQ ID NO: 34286 - DNA, 726 bp, Glycine max
  Peptide Sequence Number=SeqID_151064
atggtgttgatgcaaaaatctcatagccacataaaattaggagcaggaaaacatatgtatcaaagcactatgacaatgctggcaacttcaatcaatttttgctgcacgtggactccaaatttcacacctacttttgttttcatcggagtctctgtttggttccactttgcatcattttttaaaaagaaaaattcaaacatatttttttacttagtaagggagaaattaccatctgtggagagacctaaggtaagtattttttattgtcaagaagaagactggagtctcttgttgaggatggaagaagaatacattgaggagctctgcatgcagatattgaagtttaaaccagatttggtgattacagagaaaggacttagtgatttcgcatgccattttctcagcaaccatggacttagtgcaatcagaaggctgagaaaaactgataataatagaattgccaaagcatgtggtgctgttattgtgaacagaccggatgaattacaggagtctgatgttggtactggtgctgggttatttgaagaccccaaggcttgcagtgtactattgaggggtgctagcaaggatcatctaaatgaagttgaaagaaacctccaggataccgtgtctgtagcaaggaacataataaaaaattcaaaacttgttcctggaggaggtgctactgagttgactaatgactgtcaaagatgtagagatttttcttaa

SEQ ID NO: 34287 - DNA, 396 bp, Glycine max
  Peptide Sequence Number=SeqID_151065
atgtacctccacgaaggtattgtgtcacgaaaccaaaagccctcgactgtgtccctctttaccctttccctgatcaagctagcgcttgccgatcttcgaacggcgtcttcgacccaccaccgtgacgttcgtgcccctttgactaccacttgcaactgttcgtcaagaagtcatagtattaagggttcacttgcaattgttgagttgaagaagtttagaactgctttcgcatttggcctgctctcgcttcttctgttggttgcacttctcgagatcggtgccaatacgggttttgtgtctcccactatgcatttgcgtgaactcatgaaatgtaagctgggattagcgccatgcttgatgtactttcccataagcactgataagagaagaaaataa

SEQ ID NO: 34288 - DNA, 195 bp, Glycine max
  Peptide Sequence Number=SeqID_151066
atggagttctctgacattacacaaggactttgtttctttgcatccaacgctgaagcacatgaggaaacaaccactgcagttggatatgtgctttaccctctgaaatcatcattcaacgcacacattttgttttcattagagcatgctgcagctccttattttctcataaaggtacatggcaatgatttactctaa

SEQ ID NO: 34289 - DNA, 220 bp, Glycine max
  Peptide Sequence Number=SeqID_151067
gcgagaaaacggcttaagcgatcggtcaaagctcgttaaaaacggaagaaaagaaaccgaaagtgaacgaaataaagatgaaagccaaaaaaatggaaatgaattgaaagtctcagatttggaaacttactcattgaagaacgaagaacggatgaagaacggtgaggaacggaggaaaaccttcacggatttgcttacggaaacatctcggaagcattaa

SEQ ID NO: 34290 - DNA, 186 bp, Glycine max
  Peptide Sequence Number=SeqID_151068
atggcagcttctgaagcaaagattcgcctctcatttggcaatggcatgcccccactagggatggaaatgagccaagccgcttgtcaagggatgaagtggcataaagtgcttagagagtttacttgcatgtggaaaattttcaaaaagaaaaagactcaagttaaaaggataatgcaaccaggttaa

SEQ ID NO: 34291 - DNA, 552 bp, Glycine max
  Peptide Sequence Number=SeqID_151069
atgaagaaaagtattgaaccttcaactttgtctactctgattataaatcatggacttgatttgttacctcaagaggagtttctaagccttttaggtggtgcaagcccactagttcatcaatttctcgttaacactgttggagaagtgggtgttaagcgtatttcaaatgttctctccgatgcaggcaaagaacttgaatgtattgtcttggaccacctccagcatgttgtagaagttattggattcagaataggagaactaagagggctttcaagatggcatgcacattatcacgacattggcttggatgagtcacttattaacaatgcaacagaaaaggctgtgtttgcttctaaagtgaaaccaattaaaagcagagcctttaaacccaaggcattaattgctaaactcagcaagtggaagaaggctttagacattgctgccgttagttgttgttccacgtcaaattttgactctggtaaatcaggaacaactctttcaaaatgggtaagagctaggagcatggctgctaagccattagtttccaattga

SEQ ID NO: 34292 - DNA, 183 bp, Glycine max
  Peptide Sequence Number=SeqID_151070
atgcagatagggttggatctacttgtgaaaggacaaggagatctgcctccagatattgttttttattttctgatttgttcaccaaagttctccgaggaccaaggatatcttgtatcaacaacaagctggatgcatttgatctctatactccagcttgaagcggggtgggtgttggagaagtag

SEQ ID NO: 34293 - DNA, 504 bp, Glycine max
  Peptide Sequence Number=SeqID_151071
atggatgacaaggattatgtgggaaacaagcggttggagttatctggccagttaatatctctgctttttgagagctttctaatccttttcatggcttgtgcaaccggtggtgaggagattccggtgattggaactccaactctgcaaattgagtcagcaatcactccgcttgggctcaacaatttcatagctagtcctcaagtccctccgcgatatctttctgaagcaagacaaatttcttcttgtttggctttagtctattctctcgagctcaatgcttgcttgtgttcttggatcattgcacttggacaaaggcgtgacaacttcgatctgaactttgtcatacctatctcaaaaattgatttgtgttggaatttcttggaaagatcaagacgattgttgatgatcttgcttcagttggagatgtcgcaaccaattgcgagcacatggactctatttttgaaggtcttcccagggacatcgattttgttattgctcttatag

SEQ ID NO: 34294 - DNA, 1202 bp, Glycine max
  Peptide Sequence Number=SeqID_151072
gtgcaccttcagttgagaaagattttgcttcttcaataaaagcagctactgaagttcctccatcgtattttcagttctatgtctggtcagatgtgggaattaatcttcatgttgatttaaatttgtcctcatcagattggattaacaggtttagaaatgaggtttgcataagtgagaatatgcatcgaaacaaatcccgaagcctttggcaggatctgagcggcttaggagagaattatacacaaggtaaatcttcctttttgttgagtacaaattctggtcaaattgaggatcatggtggacaagccagatcttcctcaagcttgaaactgaaaaaagatggtgctacagagttaggtcaacagaataaagatgacattccattgatatgtgattcattaactccatgcagcatgactatagaagtgaaagatgatttacaggaaaatcattcaactgtctcagctgaactgaatgtaaatgtggtagacaatttaatgcaagatcaatcaactgtctcagctgaggtcagttgtgctaaaggtgcatctaagaaattcattgattcagatgctaccaatatgccattcatcaagtcactttgtgattctgttgtcaactcagtgtcagatcctggcatgctagaacttcgaaattcaaaacctgataatgaatgttctgaggattgtgctctgccaaatggttcttgctttgtgaaccctggtgtggtgtgtgctggagcttcattaagtagttctgtaggactacaaaattcagaagttataagttgtcataaatatgcatcagtttcactctatgataatgatggttccatggatttaagtgatccaaaaagtactgcagacatggaacagggcagactagtcaaaactcggattaattttgaaactgacagtaacaatttcacatcagtaactgatgaatgggaggtgggcaagattgttgatggaagggagagttcagaatgctcccaatttgatgatccaatgaagaaatctagcctagactataataatcatgattctaaaatggaactccgtaaaaagagaaaaaacagagactctgagattcaaggttcaaatggtaaacctactactacaagagttttacgaagcatgaagaatactactacaagagttttacgaagcatgaagaatactgccgtgaagcctcctagatga

SEQ ID NO: 34295 - DNA, 378 bp, Glycine max
  Peptide Sequence Number=SeqID_151073
atggagagttcaatgagacttggatacttgatgactgtatttgctatgtcaggaagcatcgtccttttgttttatcaagtcaataagcatttgtgcaacaacttcgtgaagaaatttgagtttgaaattcgaggctcaatgaaacaccaaacaaaaaagaaggtgcaatttgcaaaagatgtgatggaaattccaatggaggagaaaagtgatcgtataaatgtagcaaggactcagcaggtcattgataaggttttgtttatagatgatgttatgaaatcaaaacatgaacagaaattgaaagatgccatgcctcctaatagggcaattctatatagagggattatgaatgataggaaagggagacttggtttttaa

SEQ ID NO: 34296 - DNA, 2391 bp, Glycine max
  Peptide Sequence Number=SeqID_151074
aagaaattattagacgagaagagaaaaagagtagaagaggaagcattattgagtgaaaacccagcaagtgttgacgaccccccatctccaattaaaagacatgttaagtggaaggttgctcggactagggcttctggcaatatgacatctgagtcggcacaggaaatagcagataaaattggctcatttgtaccccatggtcggcaagacatattgaacactaccattgggcgacctgaccatgggggtcgcgttcgtgcagcgggctcaggtgtgactattactcagtactacggaagggcatcaaggacttgtagcaactcatccacatccatcactcaacaacaattagatgaagttgttgcaaggcttagggaagacatgagtggtcaaatcagggaagaattgaggagtcagattaaggaagaattgaggactcaactagaagaggaaaataaaaggaccttggaaagaatgactatggcattgaaaaaggctattaaagtagagttgtcacataaaggatccccagagtcactaataattcagccgaacatacaacaattagccgcgcgtgtttgcactaagggaagtaatgctcaaagcaatgcccagccttcacgggaatctgatggtgatgtgacacaaaagatgggactgtatgtgcagcgtaaggatggtacactaggattggtggccatggggaaaataatggatggggattcagtgatacacactgtgggttatgcagatgatgttgtaagggcccttcatacatttgtagcttggcccacagaccttgttaaacttgtattcgatgaggatgaagaaattattccgcacaaagtggatgcacatggagataagccggctaatgtggacacagatgatccaatgcgtgggctgataaagtacaactttgatatttacgacaagccagtggaatgcaaatttgatgggagcaaatttggaatcgcagatgcacctccattgatattcctaacatattctgatcaaggttccaactatgcattccttgagccacagttgttggtggtttcaaaggagacatgtggtgaatgcaaaggatatcttgaaagatggctgaaggaatctgaccgagaggtgtacgttggaccttacttccatcaggcacattggcagctcctacttttgtgtcctaggcaacatgttgttgtttggttgtgttcgttgcgtaggaaacctgatatgcatattaaagctgcaattaatagtgtaatgacgaaattaaagacgagtttgtctcctgaaagtaaggcagctgcacctaagtggattgaagttaagagtcacgttcaaaccggatgttatgaatgtggatattacgtgatgcattggatgtggaacatcataaccagcgacatcaaaagtgattggtccatgtggtttggcgatgacacaccattggacaaggagaacatcacaacaattcgaaagaaatgggcaagatattttttgaagactgcgttgtgcacttttgaaatttttagtgatgctactaatacagtgaccaatgacaattgctataatgctcatgtgctgaaacttcacgattctcctatgctcagcgttttgaagggatttcataggatgagggctgtgattgcaactttgagcattcccgaaaatgacattcagcgttttgaagggatttcagaagttgaggttgttacaaaatcacttcaaggtctttccattgaatctgccttggatctgcaaaaacttcttagagttgaaacatgcacatcacaaacaactgctttgcaaaggcttgaagcaaatcttccccttttccaaagtcgaatgggagcattgcttttcctaatctctgctttactttctcgaggactggacctacacaagggtcctgctctcctggagctacctgcacccaaagtggtgcttaatgatttttctaaaggactgtctttcacctttcagcttctcttaaaagataatctaaaagatgtccaggcagccgctcagcctgaattgccatacttgaggacatctggaatcatacttgctggtgaagatgatacaagcagtaaactaaatggcatagttgatgcctcaatttctgagtcaacgccaagtcatgcaagtttggacataggccaagattatagcttgccggcatcaggtcaaacaccatcaacagatggaagagctcaaatatcaatgtcctggccaaaccatctaccacaaagtgggctatatgggttgtggggagtgaatctcattacacagtggtcgagaattcaacgacggtcaaacatagacccgtcgttatccactgaggtgaccaatacaacgacggtcaccattacagtcgtcgttaccgtatga

SEQ ID NO: 34297 - DNA, 414 bp, Glycine max
  Peptide Sequence Number=SeqID_151075
atggtagttgtggagttacacaaaggggcatcggggttggtggtggtgtgcgctaatgacagggttgagagatgtggttgcgcactaattgagaactccgacacgatagaggagatgacacacaaacccaagaacaccgctgtcgcaacgtgcccttttgcgggctcacgaaggcgaggctcgcgggtgcgctttccaaaggaggaaagatgcgcggagtcgccaccaacgtttatttgtggaaaacgtcggaaaaaccgaaggaaatcggtcaaaatgaaaattctaagttcgggagttgtatttacgtttgagggaggtattagcacctctcacgtcgacaaaagcggggttgttgctcctacgtaccctccatcgaagaggaaatcagacctacgtagttctttcttaagg

SEQ ID NO: 34298 - DNA, 228 bp, Glycine max
  Peptide Sequence Number=SeqID_151076
atggtgattttccaccatggagatgcagcggaagacaaaggagaagaggattgcatcagaaagaccttaagactcatctccaaggttttgctctacaacaagagaactcagatacatgggactagaaacaaggtagaatcattgacaggatacaagtgttatcttgccattgacttttctacaaaaatcgcaccaagtcagggatggtattttcttcatggtgcatga

SEQ ID NO: 34299 - DNA, 609 bp, Glycine max
  Peptide Sequence Number=SeqID_151077
atggaagcaagtcaaaaggcgagaaaaagggaaaatcttttgaatcaagctttgactttgaaagaagaaaaaggttctcgacaagtacctaggaagggagatggccaaacaagctttttctttacaaacatttgccaaacctatctactaaggatttttggaatgctttttacttttatggaaaagtctcaagaggtagttattcctgggaaaatggataaaaaaagatttgtcctacacattccgatgaaattagaatcatcagaagatgaagatggaggctcatcaatgtcagatttggaggtagtggaagactctttggtgggacaagcaccagagaagcaagattttgaatttgaatttgaaaatattcaaattcaaaatgatgaaggctctgaaggtaacattgctagaaaagcatgggaaatggctaagccaattggtgtgagaggatcacagaatgatgggtattatatacaatcattccaaataatggaagatagacacgtagcagcaaagcctttagggagatgcagtctagtgtcagataaggattttgtcactaaatgtgaaggggatcaacaatcagataaagaagaaacatattag

SEQ ID NO: 34300 - DNA, 681 bp, Glycine max
  Peptide Sequence Number=SeqID_151078
atgtggtggtttttggacatggtggtgaggatgcgtggtgctagttgggccagtgaggggtctcgcgcttgcggatctgaaccaatgaaggggtgcgatttagatctagccgcatggtgcgatggtgatgggttgggtgggatgaaaaaaaaggtgaaggtgaaggggaaaagggatgggaagataaagatcattgtaaggctagaggtcattggtagaaggaataatagggggcatgagttttaccaagttttaccacctagcaaccacttagaggaagaagagaaacaagattcaatttctcagttttggaagatgggtttgtttaaggatgaggatccaatctatgtctggttgtatggtggagctttccccaacttctcaaaagaagatcttgctctcattcaaaatgacccccttaatgaggagagtaaatcggttgtcttcagcatcagagcccttaaagctctagggccagacgatttgaatcccctattttttttatcccaatgggatactgttaggtcttctatttttcttcgtgttaaggaagctttattgaacctctcttccattaagcttttgaatcacatgaacctgattttaatcctgaaggttagagataacattattctaaccttagagcttttccgttctatgaggattactaaaaggaagtag

SEQ ID NO: 34301 - DNA, 537 bp, Glycine max
  Peptide Sequence Number=SeqID_151079
atgcatccaatgcttctcatagatatcaaggttcggggaaaccagggcataaaaaaatctgattgtggaaagttcaaggtttggctagagaataagcagaaatcaggaggtaataacttagcttttgtctgtcttgagtctaatctagttgatattcctatagattctagggaaatgattgtgctaaaggacaaaattgtagagtccatgaatggtaagtttttggagcttgatgtggtggaccttgttgttccatatgatgatattgatgctgggattcatatcctctcaactgagactagggtcccaattgttccagttgagaccaaaattgtgatgggagatatagttgactttcaaacaaatgatatgcttgatcctcatatgatgaatgagaatgcacaaccagatgcatatgacattggagtcattgttgatcgaaagagttatcatgaagttgtttcttgccctcaattagaaatatggaagcatacaatgaacgaagagatgcaatctatctcagttaatggcatatag

SEQ ID NO: 34302 - DNA, 162 bp, Glycine max
  Peptide Sequence Number=SeqID_151080
atggagttgcagcaaaagataaaggagaagaggaatatttcaagaatatgtcaaaggcatcttagcatattccctttcgatgccacaagcatggaaggtgtgactctagcacgtgggaagcttccttgggaagcaaagaagaaagcttccttgagaagctag

SEQ ID NO: 34303 - DNA, 672 bp, Glycine max
  Peptide Sequence Number=SeqID_151081
atggacttcggttgttcttatcatatatgtccacacagaagttggttcgtgacctatgagaagaaatctagtcgtaatgttctgatggataacaatgacccttgcaagactattgggataggttctatgcaaatcaaaatggatgatggaattgttagaaccttaactaacattcattatgttccaaagcttatgaaaaatctagtctttttgggtgccatgggttcaaaaggttttacctgttgtgttgaaggtggagtggtgcaaatcaaagggaaagagaagtatgtagtaatgcagggaaccaagcaagaaaatctctatatccttcaaggttccattgtgacatgttcagtctcaactatttcacaagctgaaagtcatgtgtccaataataattctctgtggcacatgtgtcttggtcacatgagggaaaaagggaatggaaatttcggcaagcaagggttacatggaaatcacaaggtggaacatcttcagttttgtgagcactgtgtctatgagaagcaacataaggtgaaattcccaaaggtagtgcacactataaaggccacattggattgcatcctatatgattgttgggggccttctagagttccatccttgggaagagctaagtactttctatcaatcatcgacaattactcaagatga

SEQ ID NO: 34304 - DNA, 507 bp, Glycine max
  Peptide Sequence Number=SeqID_151082
atgaagattgcttgggagcttatatctaaacctcaatatttatgggttcaagccatgcgtgcaaaatataaatgtggctcttctatcatccttgatgttattgctacattgaatgcttccaatacctggagaggggtttctgtttggcaggatgtggtagagaatgccctcaatgagattatcgcttatcctactcctattgatcgttatagagtggatatgcctttgtggaagctgacttcggatggggattgggtgatgcataatatgtgctcgagcaccttgaagtggagaacggttattggagtaaccttggcccctacccaaggcttctgtaagttcgatgttgatggttctgttaagaaccttgggcaatctatttcctataagggtatgcaacatgatatggatgccatttggaaagtaggttgcaatcgcaagctagggaagtgcactatcatggcaaatgaagtgtgggggattctcacttcactggaacaagcttag

SEQ ID NO: 34305 - DNA, 216 bp, Glycine max
  Peptide Sequence Number=SeqID_151083
atgtttgaaccagggacgttgaaagggggaggggtgaagcttcattcaccccaaaatcttcccaacgttcaagaggcatatgagctcacgggattcacgagttttgcagccctaagcccccatttttgcgcttttgtttccatttttgcactcttgctcactccatacaagggattgtatgggatggtcgtaggccaattgtgtattctgaagtga

SEQ ID NO: 34306 - DNA, 1116 bp, Glycine max
  Peptide Sequence Number=SeqID_151084
atgatgaagctgtccctgaagttggatggtgagaatgaaaagcaaaacctgcaacagcagcaacacagcagccaaatcatgacagcaaaggtacccatctctatactgaacaagccctttctctcaggcgtaacagcctccaccggcacccactcaccatccgagttttccttctcactctccacaaatttcccatcaggtccttccctcagactctcttactcccccaccgcctctgcccccttctccctctccctcaaatcgggcctgggcctcttgggctcccctgcccactcccctctcgtcttctccgccaacttctctctctccccaaccccttcctttttcctccactttaaaccccgattcggtcatttctctctccacaaaaccgttttttcagacaccattacccacacccattccctttctacttctttccctcccactcccgaaattgtcccccatggatcttccaccacgggttggcacaatttgaaactggaaccctctgctaactcagaccaatcaaataataacacctatttcgaaaacttcaagaacgatgccaaaaatgctctctctcctggtgttagggttatggcgcggacggtcatgcctgtcaccaaaggcttcttgttgaactttcgctggggtgtcaattttccccggaatttcggttccaaaatgccgagtttgaccgttaataagatagggttagagagggttgaggaagggaaagagaagaagaataataacgatgataagaaacagatgagggatagttctggaattgatttgaagctgttgaagggaatgtgtttttggatgggtagagatttggagattatggaaaaggaaaatagggagatgaagcgtttgttggatgagatgaaattgggaatttctagcacgaggaatagccgtgaggagagcaatggaagtggatggaagttgagtgaaagcaatggggaggttcagcgttggagaagttacaagagtgaaagacaagaggatgagaaaaaagtacaaccaaacaagccgctaagtgtagccactactgatgtggaatctgagttggagaaagccattaaggctgctacctctacctcttag

SEQ ID NO: 34307 - DNA, 1659 bp, Glycine max
  Peptide Sequence Number=SeqID_151085
atgatcaatgatgcattgaaccaagctctggcaacccttgcattctttgggatcggcgtgaacctagtgttgtttctgacaagggtggtaggacaaaacaatgctgatgcagccaacaatgtgagcaagtggaccggaactgtttacatcttctctcttgtgggtgctttcctcagtgattcttattggggaagatataaaacatgtgctgtctttcaggtcatctttgttataggtctaatgtccttatccctgtcatcatacctattcttgcttaagcctaaaggttgtgggaatgaaacagttagttgtgggaaacattcaaaattggagatggggatgttctacctctcaatctatcttgttgccttggggaatggaggttatcaaccaaatattgccacatttggggctgatcagtttgatgaggagcactcaaaggagggtcacaacaaggtggccttctttagctacttctacctagcttttaacattggccaactcttctcaaacaccattcttgtctattttgaggacgaaggaatgtgggctcttggtttctggctgtctgcaggatctgcctttgctgcattggtcttgtttcttatatgcaccccaaggtatagacacttcaagcccagtggcaaccctatctccaggttcagccaagtcctagtggctgcatcaaggaaatccaaacttcaaatgtcatcaaacggagaggacttattcaacatggatgcaaaggaggcatccaacgatgccaacagaaagattctccacactcacgggttcaagttcttggatagggcagcgttcatatcttcaagagatctaggggaccagaaagggctcggttacaacccatggcgtctctgtcctgtaagtcaagttgaagaagtgaagtgcatactgagacttcttccaatctggctctgcaccataatatactcagtagttttcacacaaatggcttcactttttgtggagcaaggtgctgccatgaaaaccaaggtttccaacttcagaataccaccagctagcatgtccagctttgatatcctcagtgtggctgttttcattttcttttaccgtcgagttcttgatccatttgtgggaaaacttaaaaagacagattctaagggacttacagagcttcagagaatgggagttggacttgttatagctgtactggcaatggtttcggctggattagttgaatgctataggctcaagtatgcaaaacaaggatgcctacactgcaatgactcgagcactttaagcatcttctggcaaatccctcagtatgcatttataggagcttctgaggtttttatgtacgtaggtcagttggagttcttcaacgctcagacaccagacggcttaaagagctttggaagtgctctttgcatgacatccatttcccttgggaactatgtgagtagtttacttgttagtgtggttatgaagatatccaccgaagatcacatgccggggtggatccctggacacctcaacaaaggccacttagataggttttacttcctcttagctgccttgacatcgatagacttgatcgcttatattgcatgtgcaaaatggtacaagtctatacagctagaggccaaaactggagagattgatgagacacaagtataa

SEQ ID NO: 34308 - DNA, 240 bp, Glycine max
  Peptide Sequence Number=SeqID_151086
atggttacttgtggggatcttggagctgaacttccaatagaggaagttcctttattgcaggaggacatcattataagatatcaaagtatgcaaacgccggttattgtggcaacaaatatgcttgaaagcatgattaatcatcccacaccgaggagggcagaagtctcagacattgcaattgcagtaagacaaggtgctgatgctatcatgctttcaggagaaactgcacatggaaagtga

SEQ ID NO: 34309 - DNA, 306 bp, Glycine max
  Peptide Sequence Number=SeqID_151087
atgaaagcaaggagaggaaaacgctcagaggctttctggccttccattgtgatgaaaaaatggttaaacatcaagcctaaggtgaatgattttagtgaagatgaagttgacactgaaactgaaagtgaagatgatgcttgctcaattagaggctcaagaatgtgtgtgcgtgaagataatccacatccacttagaacagaaggggttcaatccatattctcaagtctaacatcaggcaattctccattccttctcagcaatctagttctttttacaagacaaaaaaaaggaaaaagattcaattaa

SEQ ID NO: 34310 - DNA, 1122 bp, Glycine max
  Peptide Sequence Number=SeqID_151088
atggtctgtactctgttgagtggtggtggcccactggttatcttcagcgggggatgcttaaacctcaatcgattctctcacttcccatcccctccctctctaccatcctctcgttccgatttacttaaggttgcgtctcgtagattcgctttatcagtgactaaaacgcagcaatctccagtcactaagccacaatccacctccaccgctataattgcaaataacccggccagtgtcaaaaggcaattggcgcagctgtttgacttgtctctgagggcaactgtgcccgatgagccagatgttgtgccgttaattgatgcttgtgctgttaaaggtggcgtaaaatttggtgattatcaatgtaataatgcaatgggtatatggtctaagatgaagggaaagcagacaggatttaggggtcccccagcaattggtcaggctatcgttaacaatcttcctccatctgaaatgatagattcgtgctctgtagctggtcctggatttgtcaatgttgtattgtcaaagaagtggatagctgagggtgaatatgtgaaagttaagagaatgctaattgatggtatcaattcatgggcacctcgacttccagtcaagagggctttgattgatttttcctcacctaatatagcaaaggaaatgcatgttggccacctgagatctaccattatcggtgatacattagctcgtatgcttgaattttcacgtgtagagtgtgtaatccgtagaaatcatgttggtgactggggaacacagtttgggatgctgattacaaacctctttgaaaaatttccaaacccagatgatgttagtgaagcagacattggagatcttcaggattatctccccaaacacgtgatgcctcctccaattcgtaacccggagcacgtcctccacaagacgcagtggctggctatattcgctctcttcggtgcttgttcactctttgcaccacctcacttcagatctgagtgtgtgctgtcacatatgctcatcggtgaggtgacacaggcggtggtcagatctgagtgtgtgcgagatgagcggcaacgatgttcagatctgagtacgtgcgagataggcagtgatgatgttgttcagatctga

SEQ ID NO: 34311 - DNA, 273 bp, Glycine max
  Peptide Sequence Number=SeqID_151089
atgtcgtggcaaacttacgtagatgaccacttgatgtgcgatatcgatggcacaggacaccacctctcctcctctgccatcatcggccacgacggctccgtctgggctcagagttcttccttccctcagattaagtctgatgagatcaatggtatcatgaaagattttgatgaacctgggcatcttgctcctactggcctccaccttggaggcaccaaatacatggtaatacaaggagagccaggagccgtcattcgtgggaagaaggtataa

SEQ ID NO: 34312 - DNA, 153 bp, Glycine max
  Peptide Sequence Number=SeqID_151090
acaggaggcatcaacagggttgtcaatgccataaacctcgtagctgaagatgctgtgacagctgcttattcgatcagtagcaatggcatataccacgcatgcatgcatgtgctacttgctgcctttattgttgaatttagtgaaaatgtttaa

SEQ ID NO: 34313 - DNA, 1461 bp, Glycine max
  Peptide Sequence Number=SeqID_151091
atggagggcacaaacacttacaaattcttgacgttgtggtcaaaatcaagaaatttacattcaaaggaagtcaacatctgtacagaaaaagttgtacaaaggtatgcctcaaacaaactcaattacataaacttaaaagaaaatggggaaaaagttagggaacattcaaggctaaaaatggagaatagctgcattctagcttttctcctcctcattctccactcaagtacaacaaaagctgccttcagtgttggtggtggagttggtgtaggtgttggtgttggtgttggtgttggcaatgggaatggtggtggtgatggtggcagtggtggagtggtttgggttggtggagggattaacagcccagagccacctagatcctcagtgccaaatcttgaaggagcttacacagcacttcaggcatggaaatctgcaatcactgaggaccctcttaagattttatcaagttgggttggtcctaatgtgtgtgcttacaaaggagtcttctgtgcaaaccctcaagatgaaatggttgcatcagcattcccagttgtagcaggcatagatctcaaccatgcaaatctgaaaggaacccttgtgaaggagctctctctactcagtgatttgtctcttctccacctcaacagtaacagattcacaggcactgttcctgatacattcagagacctggtttttctggaagagttagacctcagcaacaaccaactctcaggtcctttccctgctgctactttgtacatgccaggcctcatctacttggacctcagattcaactacttttctgggcccctccctcaggaacttttcagcaagaaccttgatgcattattcctcaataacaaccagtttgaaggtgaaatcccccaaaacttgggcagttccccagcctcagtgataaacttagccaacaacaagttgagtggtagcatcccagcaagtttgggcttcatgggttctaaaataaaggagattctgttcctcaataaccagttaactggctgcattcctgagggagttgggctattcacagagatgcaagttctggatgtgagcttcaactcactcatgggtcatttgccagacacactgtcatgcctgcaagacatagaagttctcaatttggctcataacaagctctctggggaattatcagatgtagtgtgctctttgagaagccttgcaaatctaactgttgcttacaatttcttttctgggttcagccagcaatgctcaaggcttttctttaggaatgttggttttgatttctcactaaactgcattcctgatagggacatgcagagacctccacctgagtgctctggcatcccaggtggaagtcttagttgtctcagaatccccacaccaaggcctcttgtttgtggttcaatggctgtaagtaagtctaagcacattgatcccacttcaccatctcctccttga

SEQ ID NO: 34314 - DNA, 735 bp, Glycine max
  Peptide Sequence Number=SeqID_151092
atgtttgccaagttcaaattaagctatctttgcatgtgctgtggtatctggctgcattgcatacccaggtgtctaccctcagattttgccaacaaccccagtagatggaggagaaccttgaagggtattagagagcgtcatgggagggagagaaagggttggatgataatgatccatgatctctctggctcacccgttgcagctgcctccatgataaccccatttgtcccttcccctggttcagacagagtatcaagatcaaacccaggtgcatggctcattcttcgcaccaacaatggtgcctctgtgagtagctggaagccatggggccgtctcgaagcgtggcgagaacgaggccctgtcgatggcttgggctacaagtttgagctcgtcactgagaatggacctgccaatgggataccaattgctgaggccacaatgaatgtgaaaaagggtggccagttctgcattgactacaaagtgatgagggattctggattgggttcaaggttgaaaggaaaagggtttgtgatgggttccacagtggaaggtgaaggcaaagttagcaagcctgttgtgcaagttggtgcacagcatgtgacatgcatggctgatgctgctttgttcattgcactttctgctgccattgatcttagcatggatgcatgcaagctcttctcgcataaactaaggaaagagctttgccatgaagaacaacaagtttcctttccctaa

SEQ ID NO: 34315 - DNA, 534 bp, Glycine max
  Peptide Sequence Number=SeqID_151093
atggctctcacatctatggaaatcggatttgagatcttcaatgagacttcctttgataattgggtggacttagctgcagccccagctttgccagctagtttgagtttgtataacgagcttaaggaattgggcttcaagatattcctcttaactgggagaagtgaatttcaaaggaatgccacaggggcaaaccttctgagttcagggtacagagattgggagaggctcatcttaaggagggatcgaacccgcgaccttttctccttgctttctctcttaaccatccaactcaccttatatctcccatgtcttgttctgttaaataattttcacctgaaattccttcttaatgaaacagggtcttctgatcaaggcaaaccggccactacttacaattctgagaagagagcagagttggagaatgaaggctacaggatccatgggaactctggggatcagtggagtgatttggggggttatgcagtggctgcacggtcttttaaactcccaaacccaacggactatattccttaa

SEQ ID NO: 34316 - DNA, 774 bp, Glycine max
  Peptide Sequence Number=SeqID_151094
atgacctctagttttaatgagattgtcaaggtgaaacttttggaatggttggtcaatagactgtggacttgtggttatgaaagaattggagcttcaaaagctgtgtgtgcatatatatatgcattaatcgtactaataaaaggaattgttattaagttccttaagccaataaagtattcaattttggtggcattattgatcttggtagagctgggatgtgcagcctttatattctttgacaaaaactggaaagaacaaataccaactgacaaaactggagagtttgatgcgatatatggatttctgattgagaattggaatatcatgaaatgggttgctcttggaattgttatctttgaggcccttcttttcctgttagcccttattgttagggctgcaaataggccagcagattatgatagtgatgaggagttcattaatccaaggcagcaagtacaacagccattgctcaacagactaccagcaggcccagcaacagggataccggttgctggaacaattgaccagcgtccaagcagaaatgatgcatggagtacacggatgagggagaagtatgggcttgatacttcagaatttacatacaacccatctgagtctaacaggttccaacaattagggggagtgagtagtgaagtcgttgatgcccccatattgttgcttcaaagccaatgtcttctttggcccatgttttgcccgtggtcattactcgcttgttgggaaaactatgatttagtccttaaaggttctgattga

SEQ ID NO: 34317 - DNA, 555 bp, Glycine max
  Peptide Sequence Number=SeqID_151095
atgtcgaaaaaggtaattcttccgacggtggcgtctcaccggcgacagccactgctgctgcagcagagcgagagctaccggaaggcggggacgcggctcatgggggaggcggtgggcggcaccgccgccgtgtgctgctgcttctcgttcggcctggccaacattatatacctggcgatttacaaggttccggcgaagctgtgccaggaggcgctgcgaaggaagcgccgccgccgccgcctgcagatcagcatggaggaaggggcggcgatcccgtcacggccgcggtgcacgtgcggctgctgtgatgacatcgtcggcgccgggcgggtttacccgctgtgcagcgacgacggcagtgacgtggcggtgctgcggagccggagctcggtggagaaggacaaggaggtggtggagttggaggaggagatgtgggagaggttttatggcagtggattttggagaagcccctctcagagagaaaactcttcttcgcaacaaaggatcgctaccactgtttctgctcataatcttcaggttgttgatgttaattaa

SEQ ID NO: 34318 - DNA, 399 bp, Glycine max
  Peptide Sequence Number=SeqID_151096
atggataatccaaggaaggcttattggcaagttgtgaaatggattctcatatacttgaagggttcaactgatatgggattggtatttggcagaggaataaatgaagttcataatcatgttactagattctgtgactcagactatgtagttgatcttgatcgtaggagatcattaattgattatgttttcacacttggagcgtatatggcagctatagaagctgtgaaagaagctttatggcttaaaggtcttattggtgatcttgaagtaagtcaaaaagacattatggtgttttgcaatagtgaaagtgcaatccacttaaccaagaaccagatgtatcatgagaggacaaagcatattaatgtaaggatgcatttcatttgtgatgtcataacatga

SEQ ID NO: 34319 - DNA, 630 bp, Glycine max
  Peptide Sequence Number=SeqID_151097
atgcctcaagctcagtgcatgtcgcaagccaccgacgctagaaagaaagcattcgcgaagaactgcaagggatggaaaaagctctattgcggatcgtgcacattcggatccaaaggcatgaacatggtacttgacaagtgcaccacgctggaggagctctttgtcaagtgcctccgtggaatcatcgatgcggcagtggcagagctgattggtcccgacatggttgcggcgtcactgaaactttgtttcaaactttccagtcattatagggaccctgggactcttgatattcggaaaaactttgttggtttctttaattggaagagcttttggtatttctctcatttttgctatcagagtggaatcaaacaaggttacttacaaggttatttcaacaaacattcaaaggttaagcattgcttcaagattaattcaaaggttaagcattgcttcacgattaattcaaggtcaagcaaacaagatcaagaaaaagtaaggcctcaaacaatctcatcggttgatcaagctttttcctcaaaacacattgtttccaacatccaaggctttgctaatcgattaccaggcagtgtaatcaattaccagaagataattttgaagcaaaggatttaa

SEQ ID NO: 34320 - DNA, 213 bp, Glycine max
  Peptide Sequence Number=SeqID_151098
atgaaagagcaaagggttgcagacaacagcataggagttaaactaagaaggcagcaaaggagggtaaaacagttgcagagcgcagaggaagttagggaggttttgatgcaatcctaccccgcaagggcattggatagaagactccaagtagactgggccagagatccaagggaaggccctagggttctcatgatccttagggtagatttttga

SEQ ID NO: 34321 - DNA, 504 bp, Glycine max
  Peptide Sequence Number=SeqID_151099
atgaaaaatcctcaaaattgtggcgtaggagacttagacatctccatagatagaattaaaacgttagtgaatgatagagtacttgagactcttgactttactgactttaacacttgcgtgaactgcataaagggaaaacagactaacaagacaaagaaaagtgccaagaggagttcaaaaatattaaaaattatacatactgatatatattgtcctgatatggattcacatggccaaaaatatttcatctcttttatagatgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgtgatgaggaaatcagacctacgtag

SEQ ID NO: 34322 - DNA, 156 bp, Glycine max
  Peptide Sequence Number=SeqID_151100
atggttgatgtgctagttatacgtgttcctttacgctcacacccgattgatgttacactagctttcttggagaagatgaaagatgaagaggtgcaatgcaccatatcagacttccaagggagggatgggcataattgtttgttaaggtggcattag

SEQ ID NO: 34323 - DNA, 1581 bp, Glycine max
  Peptide Sequence Number=SeqID_151101
atggcactacttcagttctgctactgtcttctgctttgtccaattatagtcattttgaacagtgatgaagcaagggtcagcaaacaaccaacaggtactgtttctctctctaccatgagcttgtgcatggcttctttctgcatgcctctcttttgggcaagagtggttatgcgcaaatggcttaacatggctagtaacgagcctgattacaccgctgaccctgatgatgataatgaggatgaccctgaaagtgactcagataatgaagagttgggaaaacggacacggtttggggacagcagagaggaacaagctccaattgagtcaaatgaatttcttccaaggttaaggaggcaaaagtcattaacttctaggtctcagtatataaacaaaaaggaactaagagtttgtgttggaacatggaatgttggaggaaagcttccatctgatgacctagatattgatgattggttaggcattaacgagccagctgatatctatgttcttggtcttcaggagattgtaccattaaatcctggtaacatttttggtgctgaagacactcggccggtaccgaaatgggaaaacattattcgagatacactgaatagagttagaccaaaagcaccaaagatgaaatccttcagcgatcccccatcaccatcaaaatttaagccatcagatgatgcgccagacatagaagaagaaatattacttgaaagtgatggtgatattggtgaggaagtccatccgttggatgaagaacacaatgtttatgatggaggtgcagataaaccaaccacatatgaagaagcctcgaatactaattttcaggcttcagatgctgctgatattgccaacacagaagaaccaataggcaatgatttaaagagacagttttctgatggaaagaggttgagtaggctgaattgtttccgtgacgaaaatttgcccaaaaaaacagaaacatcatcttctcaacaggccagtaagctatccagaatgattagtagttctgataggattggattgagctggccagagccaccactacatctgctatctcagggaccattggatagaccaacttcttttaaatctgtcagatccttttcagcatcaaagtctttcagaacatgtcagaccttcaaaaaaaccatagatgacataggtttgcttgctgaaattgaccttgaagctttaatgaagcggaaaagaagatcatcatatgtaaggatagtgagcaaacagatggttgggattttcatcaccatatgggttcgtcgtagcttgcgtaaacatattcagaatttgaaggtgtcaactgttggggttggtgttatgggctatattggtaacaagttttctgcattactcgcttatcaaataggttcttatttattttctgctatctattgtggacttggaatacagttggtgaaaaggagggagatgaacataaaagaaatgctgatgtgcgtgaaatacatcaacgaactcatttttattctcttgcggatattggagttcccagaaacatccttgatcatgagtgagtgcatgttttacatacaaagataa

SEQ ID NO: 34324 - DNA, 1803 bp, Glycine max
  Peptide Sequence Number=SeqID_151102
atgtacatcttagggaggcacaattcttttccagttgttggactagtagtcagaggcaacactagctatggaatactgtccagagcagaaaaatataatgatggaatcgcaaccaatcagggagatattgttgaatcagaggtgggagttgttgcaactgatgattctcggtgttctacaattggtgtttcaatgcttaggcagggtggacatgctgttgatgctgcagtggcagctgcattatgcattggtgttgttttctcagcatcaagtggtataggaggtggcgctttcatggttgttcgatcttcttcaacctctcaaactgaagcttttgacatgagagaaactgctcctttagctgcttcacagaatatgtatcagaacaatcccaaagataagaccttaggtccattgtcaatgggagttcctggtgaattagctggccttcatgcagcctggttgaagcatggacgattgccgtggaaaaccttgttccaaccagctatagaacttgctgaaaatggttttgtagttactcctactcttggggagtacatggctggtgatgcaaataagatattagatgatcctgggttaagaaaactatatgcacccaatggaactttgttgaaagcaggggatgtgtgtagaaatgttgaacttggtcgcaccttggaggttgtggcagagcaaggaccacaagctttctacaatggaaccattggtgaaaatttagtcaaggatgtcagagatgctggtgggattttaatgatggaggatttacgcaattacaagttggaagtaacagatgcaacgactgtgaatgtgatgggatacaccgtatatggaatgccacctccttcatctggaacacttgctctttctctggttctgaacatcttggacagttatggaggtcctgatgctgcaaggggaaatcttggtctacatcgactaatagaagctctgaaacacatgttggccgttcgaatgaacttgggtgaccccaactttgtaaacattgatgatactatatacaaaatgctttccccatcttttgcaaaagatattcagcacatgatatttgataatactactttccctccagagtactatatgaacaggtggagtcaacttagagatcacgggacaagccatatgtgcattgtggatgctgatagaaatgctgtatcactaacaacaactgtaaacaatcattttggagccgggtttcgttctacttctactggtatcttggtcaacaatgagatggatgacttctctactcccactgatatatcccctgataaactacctccagctccagcaaattttattgaaccaaacaaaagaccattgtcttccatgactcctcttatcatcacaaaggatgaccagttggttggggtacttggagggagcggtggaatgaacattattgcagcagtggttcaagtatttcttaatcatttcatcttgggaatgaaacccttggatgcagttgtgagcccaaggatctatcacaagctaatgccaaatgtagttcgttatgagaacttgactgctcataatggcgatcacattgagctttcaaaagaaagtaggcttttccttgaagagagaggtcatcaactaagtgggtctgaagcactagcagtcactcagcttattgtccaaactctcaaaacgcctatgaacatgaataggaaagttggtgaaaacaccaaatcacttacaaagcatggtactctaacagcagtaagtgaccctagaaagggtggatgtcctgctgctgtttaa

SEQ ID NO: 34325 - DNA, 1056 bp, Glycine max
  Peptide Sequence Number=SeqID_151103
atgccatttactcttcatccctctaaatctctttgctctcccaacttcacaataacaccaggtaaggatactactcttttcaccaacaccttcttcttcatcaacaaaccacgcaaaaaccccacaaagtttcgttcttttgccaaggttgttctttacactccccgtgcttccatagtttctaagaaagatccaatcttgggctatacccacttcacacttcgctccaggagtgatgggtttgatggcttttccactgatgtatctcaagatgatggaacaagccaagaacttgaacagcttgagttgctgaacaagccttcaccagtgcttgttaccgaagagtcttcttctgaggttgaagtggaggaagagaaaccctccaaggaggaggctttggcacctttcttgaagtttttcaaaggcaaagattctgggcaggaggttgaggaagatggtgaggggttggaagtttctgaagaaaaaagtgatgtggagggtgagaatgaagagggagataagaaggttagtgttgagtactatgagcccaaacctggggattttgtggtgggtgttgttgtttcaggtaatgaaaacaagcttgatgtcaatgtaggggcagacttgctaggtacaatgttgaccaaggaagtgcttcccttgtatggtaaggaaatggagaacttgttgtgtgatgtggacaaagatgctgaggattttatggttaatgggaagatgggaattgtgaagaatgaggaggcaataagtggagtgccagtgcctggaaggcctgttttggagatcggaaccattttgtttgctgaggttttaggtaggactcttagtggcaggccattgctttccaccagaaggctctttcgccggattgcctggcatcgagtgaggcagataaaacagctcaatgaacctatagaggttagaattactgagtggaataccgggggcctgctaacaaggattgagggtttacgagctttcctacccaaagctgagcttgtaaaaagagcaaatagctttactgaattgaaagaaaat

SEQ ID NO: 34326 - DNA, 582 bp, Glycine max
  Peptide Sequence Number=SeqID_151104
atggcgggttcaactggtgttttctcaggaaatttaccaatgtttgatagaaataactttgacgattgctacaacaacaaacaagtattggatattttaaataaagcatatggagggcttgatataacaaagaaggtaaataaagctccgtatgcttggaacaaaagaattgacagctttctaagccaaataggctttgttaaatgcacatctgagcatggagtgtatctaaaggtcttgaaagtggtcactgatgacttactagtgattggaagcaatgaagaggagattgaagatttcaagaagaaaatgatgaaggagtttgagatgagtgatctggggctcttgtcctactttctttggattgaattcaaaacaatagagaatggtactgtgatgcaccaaaccaagtatgcaactaacttgttgaagaaattcaacatgtttaagtgtaatttagttgtcacaccacgtgaaattggattggtaattgagaaggaaaggactaaggaacttataaattgtacttcaagcagatcattggatcacttagatatttgtgtaacatcaaacttgatttag

SEQ ID NO: 34327 - DNA, 339 bp, Glycine max
  Peptide Sequence Number=SeqID_151105
atgacctcctctgcctcttgtcgtcatgcctctccttccaccctattgccttattgtgcaatgctgccgacaaatacgcctcctccatttccacctctgtctgtgacatccctcatccatgttgccatcaccctcaatgtcgagtacctctgtgactccactctacacatgcaccgccttcgtgccaccaacgaccccaaacctactggggaaccatcaacaccctcgaaccttgagacttctgttgagagaaagaggacctatttcgagaagttgttgagtgaattagagagctatcctcttgggagcatagtggacgagttgggtgttgtacttctt

SEQ ID NO: 34328 - DNA, 2547 bp, Glycine max
  Peptide Sequence Number=SeqID_151106
aacatttcctccgagtatgcataccctaagaatcctaatctgccacttctactctcagatctcagaagctttcctctgggagaaaggaactgttataggttagtagctggaaaaagaggcgagttacatttgataagggcttccttcttgtatggaaactatgatggagaaaacaagccaccagagtttgatctctatgttgatgtcaatttttggtcaacagtcaaatttagaaatgcctcagaagaagttactatggaaataatcagtgtggcacaatcaggtgtcacacatgtttgccttgtgaacaagggagcaggaactccttttatctcaggcttggaacttagaccacttaatagttctatttatgacactgagtttggagaatctgcttcactgtcacttttcaaacgatgggacattgggtctaccaatggaagtggtagatatgaggatgatatttatgatagaatctggtcccccttcaattcctcatcctgggaatctgtcaacacttccacaccaataaatgtcaatgatgatggctatagacccccatttaaagtcattagaactgctgctagaccaaggaatggcagtgatactttggaattttcttggacccctgatgatccgagttggaaattttatgtctacttgtactttgctgaagtggaacagcttgagaaaacccaactgaggaaattcaatatagcttggaatggatctccattgtttgatgattccctaataccgcgccacttgtttgcaaccactctttctaattcaaaatccttggtagcaaatgaacataagatttctatccacaaaacaaaagattcaactcttccacccattcttaatgcggttgagatttatgtagcaagacagctagatgcccttgcaacatttgaagaagatggatctgttcctaccattcttttagaaagatcaagggctggattactcacattgagggtggatgatcaaaatctcggggacacaggagggaacaataaaaccaagaaaattgttattcccgtagtggtatcagtatcagttttagttatattgattgctttcactctcttttggaaacttagaagaaatgaacgatcagacgaggagattagtatgctcaacaaaggaggaaaaaccgtaacaacgaagaactggcaatacacatattcagaggtgttggacatcaccaacaactttgaaatggcaattggtaagggaggatttggaactgtgtactgtggggagatgaaagatggcaaacaagttgcagtcaagatgctttctccatcatcatctcaagggccaaaggaatttcggactgaggctgagcttttgatgacagttcatcacaaaaatttggtatccttcgttggctactgtgatgatgataacaagatggcactcatttacgagtacatggccaatggcagcctgaaagattttctcttgctctcagatggaaattcacattgcttgagttgggaaaggagaatacagatagcaatcgatgctgcagaggggttggattacctacaccatggatgcaagccaccaataatacacagggatgtaaagtcagccaacattcttttaagtcaagactttgaagctaagatagcagattttggcctctccagggagtttaggaaagataaccaagatcaacaatttcaagtcattcacaaagatgctacatatgaaaaatctgcagtaatgggcacaacagggtaccttgatccagagtactacaaattagggagactgaatgagaaaagtgacatctatagttttggaattgttctactggaattactcacaggtcgccctgcaatattaaaaggcaaccgagtaatgcacatacttgagtggataagacctgagcttgaaagaggagatttgagtaaaattatagatccaaggctccaaggaaaatttgatgctagttctgggtggaaagctttaggaatagcaatgtcatgctctacatcaacctccattcagagacctacaatgagtattgtgatagcagagctgaaacagtgcttgaaattggaatcccctagtgatactaaaacatttgtggcccctccaagacaagtctacgacgaagtttatagttcatctgaagcattttcctatgataacggtcttgaaatgctggagaaaaaagattatgtgtttgctaaacaaaaatggggaagaggaaaatccaaagaattggctaggggaaataacaaaaggggtaggaaaattgatgctgttgacaagacgttggatgagatcaatgaacagattgagaacatgagaatgattcaggaagccttgtcagctccaattggtgaagctgcttattttgatgaggatgaattggaagcagaactagaagaactggaggctgctgagtttcatccagcaactacagctcctgcagccacattgctggtcccggcccggcgaccacctagtcgccctgttcctgtggaagatgaattggcagctttgcaggctgagttggcaatttga

SEQ ID NO: 34329 - DNA, 714 bp, Glycine max
  Peptide Sequence Number=SeqID_151107
atgggaagggctccatgttgtgacaaatccaatgtgaaaagagggccttggtctcctgatgaagatgccaccctcaaaaactaccttgagaaacatggcacaggtggtaactggatagctctccccaaaaaagcaggccttaagcgttgtgggaagagctgtcgtctaagatggctaaactatctcaggcctcatattaagcttggagcagctcaacttcccgggagaacagacaatgatgtgaaaaatcactggaacaccaagctaaagaaaaagttcttggcaggaaacacaagtagtactgctgccacgacaagcaacaacaatgtcactttcagcaatactagttattctgatcaagttaagacccttgtcttggatcatcaaaaactgaactcagctgataattggtttgactactcctacaatgttttggaattggaacaaacaccaattccagttccttttccaatgtctcaggaattagaggcttttaattatactgctgggagtataagttgtagtgcaccaccaccctctaaggaagtttcaatgctttccaatgcagacaatcatacgctatggtttggttatgaccatgcaagtgaagatgatccaaatttgcttgagtttgtgcttgatgatgatctgctgaatcatggatttgtttctcaagacaaaagctgcagccaagttggtccaccatctggctaa

SEQ ID NO: 34330 - DNA, 168 bp, Glycine max
  Peptide Sequence Number=SeqID_151108
atggctgctgctagtgcattttggaaaagatcagggacttacacgacagatcggatgaggtttttagaaatcatcttaaacaaactctttggtgatgaacttaagatcgactcaggagaagcgtattcagactttgctaaagatgaacttgacttgctacgacgataa

SEQ ID NO: 34331 - DNA, 453 bp, Glycine max
  Peptide Sequence Number=SeqID_151109
atgccgaccagggatcagcggatgttgcttttaggactccgctggcacccttatgagaaatcaaagtctttgggttccggggggagtatggtcgcaaggctgaaacttaaaggaattgacggaagggcaccaccaggactctttcttgattctatgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaaccttatcatttag

SEQ ID NO: 34332 - DNA, 315 bp, Glycine max
  Peptide Sequence Number=SeqID_151110
atggctaaatttgatcttgagatagtcatggaattttatgctaacgcctggcctacaggggagggatgcgagtatagccagagaaggagtcaggcctcaggcttcgatgaagaggctatcgcccagttgctatgtgtgtcggggcaggacttcgcccggaccaccactgggagacgggtgcggatcatgcacaccaacatgaccaccctcacacagatctggatgacgttgcagcttagcaacattctgcccaacgaccacaactctgacctccccctaccaaagtgtcagctagtttatgccatcctgacgcag

SEQ ID NO: 34333 - DNA, 252 bp, Glycine max
  Peptide Sequence Number=SeqID_151111
atggggaggggtaagattgagatcaagaggatcgagaactcaagcaacaggcaagttacctactcaaagagaaagaatgggatccttaagaaagctaaggaaatcactgttctatgtgatgctcaagtttctcttatcatctttgctgcatctggaaagatgcatgactacatcagcccttctaccacgttttttcttaaaatttttattcttgatcagttcacaaagggaaattttatcaaaagggtatga

SEQ ID NO: 34334 - DNA, 345 bp, Glycine max
  Peptide Sequence Number=SeqID_151112
atgtcaaagaaaaggggcctctcattggaagagaagcgcgagaagatgcttcaaatcttttacgagtcgcaagacttctacctgcttaaggagctcgagaagatgggtcccaggaagggtgtcatttctcagtctgtgaaagatgtggtccaaagtttagtggatgatgaccttgtttccaaagataaaataggaacttctgtttatagcaactttcctaataaggtacacagtgttatgtgttacttgaaaaacaggagtgacagtgcgatgtacagacgtgccacgactgtgtacttttggagtctacctagctgtgctggtaatcaggtgaagttctattga

SEQ ID NO: 34335 - DNA, 831 bp, Glycine max
  Peptide Sequence Number=SeqID_151113
atgttgtcacgctgtgtgaagcctgggaatttcgcgttttccattgccctcaaggcgtgttccgattccggcaatgcgctggttggcagagcaatccatgcccaaattgttaagcatgatgttgaagaagctgatcaagtggtgaacaacgcgcttttggggttgtatgtggaaattgggtgcttccatgaggtcttaaaggtgttcgaggcaatgcctcaacgaaatgttgtgtcttggaacactttaattgccagttttgctggtcaaggtaggatgtttgagacccttgctgcttttagagttatgcagagagagggaatggggttcagttggattactcttacaaccgttttaccggtgtgtgctcagattactgcacctcttagtggcaaggaggtacatgggcagattctaaagtctaggaagaatgctgatgtgcctttactaaactcattgatggacataatgcacagcaaggatttgacatcatggaatacaatgctggctggattttcaatcaatggtcaaatatatgaagcgttgggtttgtttgatgaaatgataaggtatggcattgaaccagatgggattacctttgttgccttgctgtcaggttgtagccatttaggactcaccagtgaggggaaaagattgtttaatgtgatgcaggattttggggtgcaaccatctttagagcattatgcctgtttggtggacatattgggcaggctatatggaaatgttgctcttgctgaaatagttgcagagcgattgtttgagattgaacctagcaatccgggaaattatgtgatgctttcaaacatataa

SEQ ID NO: 34336 - DNA, 1065 bp, Glycine max
  Peptide Sequence Number=SeqID_151114
atgggagaacccgtttctcgaatacccaatagccatagctacccacacaggttcttctgggatgttctcatcgccaactctgttttgagaacgaagcaagtgcaagtggagttttcggccatgttccaaggaccttctggagatgcacgcgtggaggaggagagagatgctttcttcttcttcaatggtttgtgtgtatttgtggttctgggtgtggaagtggctgttatgttcgttttgacggttatgttggttggaagagaaatggcggggagcatgatggagactgagacagtcaggaaggaaaggaatcatagtgattttaagggagatcggctgacgaatcgagaggatctcatcgctcgcaagggattagggtttcaatcgatcgcatcacatatcacaatcatgtttagccggatgttcggtaaacctaaacaggaaaccaatgctgttgccactttggacaagctaaacgagacacttgaaatgctggagaaaaaggagaaagtgctccttaaaaaggtggcagcagaagttgaaaaggccaaagaattcacaagggggaagaacaaaagggcggcaatacaatgtctgaagaggaagaggttatatgaacagcaaatagagcagcttggaaatttccagttgcgtattcatgaccagatgataatgttggaaggtgctaaagccaccacagaaacggtagacgcgttaagaactggagcagctgctatgaaggctatgcaaaaagcaacgaatattgatgatgttgacaagactatggatgagatcaatgaacagactgagaatatgaaacagattcaggatgcattgtctgctccaattggtgcggctgctgattttgacgaggatgaattggaagcagaacttgaagaactggagggtgctgagttggaagaacagcttcttcagccagcaactacagctcctgcggccccagtgcaggtcccagctgggcagcaacctactcgcccagttcccgcaaagcgaactccggaagaagatgaattggcagctttgcaggctgagatggcactttga

SEQ ID NO: 34337 - DNA, 276 bp, Glycine max
  Peptide Sequence Number=SeqID_151115
atggaagtgttgagagttcaggtttttgttatgtccattgtggctcttgctttggcttatgtggcaccttccatcaatgctcaggtccttcctcctgcccctgcccctgcacccacaagtgatgatttctccctactcctctcacattccaattcatccaacttctcgcgcataacaatgacaacacctccaccgtttccaaacagtacaccggcagaccactgcaattctgctgccactaccaaagaacaaacttcttcaaatgcacacttctaa

SEQ ID NO: 34338 - DNA, 407 bp, Glycine max
  Peptide Sequence Number=SeqID_151116
attctgatctagaaagcagtaagaagcggcatgcccaacttgttgatcaatgtgaggagctaaagaaggggcgagaggaatctgatgaaagagtggaggccattgcagatctaaaagccattgagcaaaagcataatgaattgaaggttaatcttaaaaacatattacagtttcggagttgggacactgatgttttggtattaactttggcagaggaagcaattgcagttgcccatgcatcggcaaacagatggacagacaacattttcaccctgaggcaatggtgttcgaacaatttcccacaggctaaggaacaacttgaaaacttgtacaaggaggttggtataacagatgattttgactatttggagttagcacctgtcccactcaaaacagttgctgattaa

SEQ ID NO: 34339 - DNA, 195 bp, Glycine max
  Peptide Sequence Number=SeqID_151117
atggggagaccagtcagggtcacactgttttgcgagaatgctccaaccatgtgggatcagcacagacttaaagaagaattcaaactgggtgtgtttacccccaaggcctacactctgaagagtccgtcaaggcctctccctcttgatttaggtccaacccctaaaacaatttttgcatgtaaacactgctcatga

SEQ ID NO: 34340 - DNA, 3828 bp, Glycine max
  Peptide Sequence Number=SeqID_151118
gttgtgaccacggcgagaagaatgtcgagtttcaccttaatatcttctcagacacagcacttgttggcttctatgctgtcggataaggagttcaccgagaactacataaagaccaacagagagaggctgaggaagaggaaccaaatgatcattgaagggttgagaagtgcggggattgagtgcttgaaggggaatgcagggttgttttgctggatgaatctaagtccacttttggagaagaataagccaaaaggaagggaaggtgaattggagctttggaatgctattctgcatcaagttaagctcaatatctctccaggctcttcttgccattgttctgaaccagtggtaaaattgtgccttggtgacttgttggtcatggattcgaatctggaaacagcttctttgcatatgcaaggggcgagccctggtgcagcggtaaagttgtgccttggtgacttgttggtcatgggttcgaatccggaaacagcctctttgcatctgcaagggtcaaccatcgaccaccctttccttttaattcttcccacaaacatgtcacgcgccgctgcttcattcggaattctcctctgtctgttccttgccgccgccgccgtcgtcaactgctccgatcaggcaaactgcagcaccacatgcattgcggagcagtgcgacactgttggaatcaaatatggcaagtattgcggggtggggtactggggttgtgctggcgagaaaccatgcgatgatcttgatgctagctgcatggcccatgacgactgcgttgacaaattcgttcgtgtgtttgcgcaaaacatgttgcatagaagcttcaagcccgcaaagtgcaaaacgacattgaagctcgccgtttcacgcataaagcttttgaagaacaagagagaagcccaaataaagcaactcaagagagagttggctcaattgcttgagtctggtcaggaccgaactgctagaatccgggttgaacatgttgtcagagaagagaaaacgatggcagcttatgatcttgttgagatatactgtgaacttatcgccgcacgcttgcccatgatcgaatcacaaaaaaactgccccattgacttgaaggaagcagtttcaagtgtaatatttgcatctccgagatgttcagacctaccagagctcatggatgtgaagaagcaaatcacatctaagtatggaaaagaatttgtctcagcagctattgaattacgccctgactgtggtttggttgagaaattgtctgccaaagcgcctgatggtccaaccaagataaaaatactggccgcaattgccgaggagcataatatcaaatgggaacccaagtcacttggagaaaatgatgtaaagtcttctcaagactttttggttgggccaagtacttctgaaaaggttgcttatgctgaaccttctcaaattcatgttccacctgctcatgatgaaaagggtccttccaatttacatgctccctcacaagttaaaccagtgcatcattcatctacaaattcatatgagcagactgcaagtggtgctgctagaaaggatcaatcaacaacatcaggcgtgtccaattcagaagtcggatcttcaggaactggaagtcaagaaacgaaatttcaagattcatactctggaaacaatagttcttttcctatgaataggcagaattggagcatggaattcaaggatgcggcctctgctgcggaggcagctgcagaatctgccgaacgtgctagcatggctgcaagggcagctgcagaactttcaaaccgtgaaaatatgacaaggcagtattcaagtggatcacatagttcttctagaagcgggttgagagatgaaagatcccaagaatacacttttcatgatgacaaaaatctttctacaagtcctgttgatgctagcttccatagaagcagttctgggatgcacaatgaacaaattactgctacagaacaagataatctggtaggaccgcccaatgaatattacaggaatagtcatgagaatgtggtgagacatgcccagtcagcttcattgatgcctggcagtgttttcaatgatgataaaccatttaccgatggttctcaaatggctgatatatatcagcataataactcatttgggcaaaagagtagtgacttacccgaaatgagtataaaaacacaagcaggcagaagtgaagaagattttgtgactgacctatatgatgacagtgatttgaatgctgaaaacaattatcactttggagatgcaaggacaaatagacaatctagtaaagtttcctcttctcatttcattactccaactgatgatcacaatgataatttggacttggatgactggaatacgaggaacaaagctgtggaagacccttttgttactgatgaagtaaacactcagagaaacaatatggaaacaagttcttataatgatactactgttgtatttgatgattctggatcagaggatgatgatcataagtttgatgttgataaaaagtacaatggtgagggatctagtttgtttgtctcatcccctgctagcaaatcacaagttgatccatttgaaaatacaaattctttggcctatggacaaaacattgatgagaaagtgacaagttctggtacacagtcacatttttctgtggtttctgaaagattgacatctgcagtttcttctgaaaaagaagacttgccatctgtcacttttgatgattcagatgacccaggttcagatagtgacatgaattttgtcaacaagtctaaggtttctgggctctctgattatggaaagtttttccttgatccgattgcaagccatggggttccagggtcctcatcaagaaatgagaaaaatgtgggcactgacagaaagtcttggttgtcacctttgtcagttgattcagatactgtggaagagcattttgagagaagggtagacaccactactgtgtcagaaaagaatttgggttatgatgacttgccagccagtcagccacctacaaaggaaagaagctctatattgggtttggatctcgaggcaaacaatgatactgaaactctggaggaatatcataaagagagtggcaaggaattaagctatggtaccttgaagggcggtcttcgcaataaaggcttcaagcgaccaccttatattaagaatacactggatgatgtttcatcttcattgggggacacttcagtccagaatgaaggatctttgcctacagcaaggacttcaattggttctgatgctcgtgttcaggacaagtacacgagggaagtgagcagaggaaacaggaatgtgggcctgggagcgcacaaaataccttctgattctgatagttaccgtgtggttgcaaattcacaagagactcttgctagtactaatgaacctcgcattcaaaaagagcagagggaagtaaaaaagaaatcaagctcaagggcctctgttacatacttcggttctgataatagtgattctgaagatgaacttactaaacaaaattcacctagtcttgcccgtcctattagtggaatatctcgaaggacatcagcttcttctaaagctgctacaggtttaagctcaagagatgctcctttatccaaggcttctgtgacttctgctgcaacacttggatggaaatcttcaaggacttcatatgagagtaataatcaaaatgcttcaaccataatgaagagctctgaaaatgggacaggatctaagcctggatcagccaaaaacaaagcatccgagccaatttcagaacctaatagatccttggatggggaaatttcgaaatcatctgcaagg

SEQ ID NO: 34341 - DNA, 534 bp, Glycine max
  Peptide Sequence Number=SeqID_151119
atgcgcaattatctctgcaaagatctttctaaagcatgcagtagcaagccacctcctgtccctaaggacagggctcctggtgaaccatttgttgcaaagtcttccaaggaggctgaaatggaaaagctactaaaatctatggagggcatgccaggagcacccggcatgaaaatgtactcaagagatgatttaatgaacatgaagaattttggtggtgaagatggcgatgaagaagatgaggatgatgatgatgatgaggccagcttcccatcgaaattgggaaatgttttgagagcaaaagaaagtggaaaaagagactggaaacaaatgttgaacaatagcacaacatttccaccacgttgggttattgatattactacaccaaagatggacaagaatttagaagggaatcaaatgagaacttcacaatcaccacttggaatgatttgttttccagtccaggatttgctatctaatgatgagtatgagggtggatgtatactcggtaaccttttagaggctacacttttttga

SEQ ID NO: 34342 - DNA, 474 bp, Glycine max
  Peptide Sequence Number=SeqID_151120
atgtctgtgtgcgtggtgctgatggtgaaaagcaaagcaaggatgtggtggctccttctcttcaataacacaataggatatcacgctgtgattggtgtcaaatgtcaagacatgaaatacaagccagaggatgaatgttacctggaagttggacataataatgatattagggaacattcttcaatccaccgatcttcaaaatcaaccgataggacagttattggtaatgccaattttataatgggatcttgtcatattacccatgattgcaagattggtaacaacaatattcttgccaacaatactcttctagctgggcatgttgaagtggaagtttatcttttttatcttcatggtcttgaatcaatctgttttgtaacaagggaaatgattgttatgcaattatgtaagtatgctactgtacactgtacaaaatctaaggcagtcggcagtcagcactcagcagaagtttaa

SEQ ID NO: 34343 - DNA, 441 bp, Glycine max
  Peptide Sequence Number=SeqID_151121
atgaagatgaagggggtgttgtgggttgtagttgtatcagtggtggttgcagcatggattcccctttcacactgttcaaagaaaccggtgggggtggctagaaaggaggacattccgtacatcaagtgtcaagtgtgtgagaagctcgctaaagagttgtatcagcaggttcaaaacaagcaagctgagatcgctcccaaaaagatctcggagtaccaaatcattgagatagcggagaatgtttgtaatctgaaaaaggtagaagcggattggatattgcgcatagatattgtggagaaagaagataggctggagctggtggaacaagactctgaaggacaatgtaattctgaatgcaagacaattgagcgagcctgtcaagaggcgcagatctatgaatgggagatgttgtgtgagcatctagagtcccactgccactaa

SEQ ID NO: 34344 - DNA, 801 bp, Glycine max
  Peptide Sequence Number=SeqID_151122
atggcgaagcagaggcaagaagacgggaagaacgacgtggtcgatcacatgcctctttcgccaaggaactacttgccggcggctttgccaagaccgtcgtcgctcctctccaacatgtcaagattctctttcagggccgagtttcagagcacagggctgattggatcaactgtcataattgccaaaaccgaaggccttttgggtttctacaggaaatggagaagtgttgcaaggattattccttacgcagctattcattatatgtcatatgaggaataccgcagacggattatacaaacttttactcatgtttggaaaggccctacccttgaccttgtggcaggctcactctctggagggacagctattgttagtccaacaaagttgaatgcttccgggatggttaataatgaacaagtttacagagggatccttgattgtcttgcaaagacttgtagagagggcggcattaggggtctctatcgtggagtggctccaactcttattggaatattcccatatgcggggttattgggtcagaccatcacgtatcctcttgaagtggttaggaggcaaatgcaggttaaaaaactcctgccatctgattatgctgaattgaaggggactcttaaatctattgtttcgatttcccaaaagcaaggctggaagcaactgttttcagggctgagaatcaattacataaaggttgttccatctgtggccatcggctttacagtttatgatactatgaaatcatacctgagagttccatcaagagatgaagctgcggttgaaaattga

SEQ ID NO: 34345 - DNA, 306 bp, Glycine max
  Peptide Sequence Number=SeqID_151123
atggcggaagaaccgaaagttccaccaccttccaatcctacgttgtcgtttgatcctagtcgaacggttggtattatcaagaggaaggccttgatcaaagacttagctgcggtataccatgccgaatgccttgcatactgtcaagagcttttggaacttcaaactaaatgggaagaggtaattacggaaaaatgtgaccacaattgcggttgcgattgcattgcagtaaagttaaaataccttaacattgcagtcgcaattgcagttgcggaatgctatttaaaaccatgcactgaacttttatag

SEQ ID NO: 34346 - DNA, 1386 bp, Glycine max
  Peptide Sequence Number=SeqID_151124
atggcttccattccacgcgcagtcttcacccattcctcttcatccattcctttctgcgcctacgcggtccccaatgcgagcaggcgccgaaacggcaccaacaacagtcgttccactcacaaaatccctcctttgtgtaaggggaaccttcccaatgaacagaaattgcagctcgaccatcaaaaccaaaacgccccattacccttgaatgtggacttggtgtccctgtgtgaagagggtaaccttgatcaagtattggaactcatgggtcaaggtgctgttgctgattatcgcgtttatctcgcgctcttgaatttgtgtgagcatacaaggtcgcttgaatcgggcaaaagggtccatgaattcctgagaagatcgacctttcgtagggacgttgaattgagcaacagattgatcggaatgtactgcaaatgtggcagtgtgaaggatgcacgccgagtgtttgatcaaattccggagagaaacatctcttcgtggcatttgatgattggtgggtacgcagccaatggtttagggtgtgatggtttattggtttttcagcagatgaagcaagcaggggtgccacctgatggggaaacttttgaattggttttggctgcatgtgcacaggcagaagctgtggaagaagggtttttacactttgagtccatgaaggagcatggaattgttcctagcatggagcattacttggaggttattaacattctggggaatactggccagttgaatgaagctgaggagttcattgagaagataccaattgagcttggagttgaggcttgggagtctcttcgaaattttgcacaaaaacatggagatttagatcttgaagatcatgcggaggaggtgttaacatgtcttgatccttcaaaagccgttgctgataaacttcccccgcctccaagaaagaagcagtctgatatgaacatgctagaggagaagaatagggtgactgagtatcggtattctataccctataaagaagaggctcatgagaaattgggaggtttgagtgggcagatgagggaagcaggttatgtgccggatacaagatatgtcctccatgacattgatgaggaggaaaaagagaaggccttgcaatatcatagcgaacgtttggcaattgcttatggcctcatcagtacaccaccgaggactacactgagaatcatcaagaacctacgcatctgtggggactgccacaatgcaattaaaatcatgtcaaagattgttggtagggagctaattgttagggataacaagcgattccatcatttcaaagatggaaaatgctcctgtggagattattggttcaaatccttagtcgggcagatcaaagaaatttttgttccatctatgaattga

SEQ ID NO: 34347 - DNA, 315 bp, Glycine max
  Peptide Sequence Number=SeqID_151125
atggatcgtggtgtctcagtcctacacaatggaagggtagacgagagacttggtgaagaagttatgcaaacaaaaaagggaggatcctcctcaagatattctgaaatggatccagattcattgattgatgaagtgagaaacaatatgcaagagaagagaattttaatcacaactagaatgcaagaggttgtagtctcttgtaagggaactcctcttgaccacgtgcatgagatgaaacctttaacttcagaaaaatgtctggaactcttatggaagaagacattccaatatggggaaaaatttggcaaattctaa

SEQ ID NO: 34348 - DNA, 581 bp, Glycine max
  Peptide Sequence Number=SeqID_151126
atgaccaattttgttggactaaggttgcatacgaggttgtcattgccattgccattgccagtgttgggtggtgcttctcactcttgttctgccactgccactactctgtcaagagcagtaataaggaagtggaattggggaattaagggtcctcgtcgtatggtattgggccttggacttggagtttccttcttgtctatggccgcacctcgatttgtgacgcacattgatgatcctgcaattgctgctctgactaagtattactccaaagttttcccacccagcaacactcctggagtaagcatcttggatatgtgtagcagttgggtcagccattttccatcaggatacaagcaagaacgagtggtgggattaggtatgaatgaagaagagctgaagaggaacccagttcttacagagtatgctgtgcaagacttaaacgtgaaccccaaactcccatttgaggataactctttcgacctcatcactaatgtggtcagtgttgattaccttacaaagcctcttgatgttttcaaggagatgtgcaggatacttaagcctggtggactggccataatgag

SEQ ID NO: 34349 - DNA, 345 bp, Glycine max
  Peptide Sequence Number=SeqID_151127
atgggtgcaggattaaaatcaacattgatgcctcagtcaagcgacaaatttttacgtactggcatgggaatggtagctccagaccatgaaggtaatgtgcttggtgctgcaacttgttttgaggagagtgttttcgagccaagaattgcagaacctctttgtctcagatgggcaatacaattatcctcagatttctgctttgcaaacgtggaatttgaatcagattgtctacagctagtaaatgagatgtggaaaagagctgagtctgctaggagttattttggaggattagtagatgactgcattattttgattaacttgatgaccggtactgctcacacgtag

SEQ ID NO: 34350 - DNA, 513 bp, Glycine max
  Peptide Sequence Number=SeqID_151128
atggaggacgatttggagcggagtatggaagctagggctatcggttgtagaggaggaagaggaacgcatggcagggatatggaggccagcgaagggggtggtggtgttgaaggaaggcgttcggtggaagttgggatggtgcaagtattgatgtgtggcagcaaccttggttccatgtacccaggaatggaaattctgaaaatgaaggacctcaagctcactaattacgaaagtctgagagtgcatggggattggagactaatatgggagttggaagtacctccaattagagtgaagcaactcattgacgagctcacattccaagtgcgcatagcccaaatgctgttgtgcagcttgtggaggaggaggaatgataagctgtgggaaaacatggttgtttcagactctagtgttgttcagcgaggggatgattttctccaagcttgggttaatgctaagatgaaatctaattctggccaacttcaaactgatcaacatccagtccagcgctag

SEQ ID NO: 34351 - DNA, 1386 bp, Glycine max
  Peptide Sequence Number=SeqID_151129
atggcaaaagaatcatcatcaacatcaacatcaacatcaacatcaacccctctcctctccagcactaacccttcttccaccactttcacttcccgcattctcctcttggtcgcctccatgttcctcctcgcagccttcgttctcgccctctacttctcctccccaacgtcgtcgtcgccgtcgctgcctccgccacgcgccaagctcccccacccggtggtgatcctcatttcctccgacggcttccgattcgggtaccagttcaagacccccgctcccaacatccagcgtctgataaaaaacggcaccgaggccgagaccggactcatccctgtctttcccaccctcaccttccccaaccactactccatcgtcaccgggctctaccctccccaccacggcatcgtcaacaacgtcttcttcgaccccctcaccggcgagaagttcaccatgcaatcccaccaacccaagtggtggctcgcccagcccctctgggagaccgtcctcctccacaacctctccgccgccacctacttctggcccggctccgaggtacccaaaggcccctggacttgccctaaagccttttgccagccctacaacgaatccgtcccctttcaggacagagtagacactgttctcagctatttcgatttaccctctcatcaagttccttcctttattacgctctattttgaagaccctgatcatcagggtcaccaggttggccctgatgattctcaaatcactcaagccgttgcggaaattgatgccattgtggggagactcattcagggtttggaacaaagaggtgtttttcaggatgttcaccttatcatggtcggtgaccatggcatggttggtacctgcgataaaaagcttgtctttttggatgatttggctccttggatccagattccacgagattgggtccagtatttgactccaatactctcgattcgtcctcctccttcagttgatccggcacacgttgttgctaagatgaatgaagggttgaattcggggaaagttgagaatggggccaaattgagggtttatttaaaggaagatttgccgaggaggcttcactattcggcaagtgatcggattccgcccataattggtttggctgatgagggttttaaggttgagcagaaccgaacgggggagaaggagtgtggcggtgcacatggttatgacaacgcgtttttctccatgaggactatatttattggacatggtcctaggtttgctagagggaagaagataccctcctttgagaatgttgagatttataatttggttacttccattcttgacattaagggtgcgcctaataatggctctacctcatttccggattctgttctcctgcctgttgcatga

SEQ ID NO: 34352 - DNA, 306 bp, Glycine max
  Peptide Sequence Number=SeqID_151130
atggcatgggggctaatgacagttcctccattattgagatatggcaagtactgtggacttttgtatagtggatgccctggggaaagaccttgtgatggccttgacgcttgttgtatgaagcatgatcaatatgactacctaagccaagagtgcagtcaaacattcataaactgtatgaataactttaagaactcgagggctcctacattcaaaggaaacacgtgcgatgcggatgatgttattgaagttatacatgttgtgatggaagctgctttactggctggaagagttctccacaagccatag

SEQ ID NO: 34353 - DNA, 246 bp, Glycine max
  Peptide Sequence Number=SeqID_151131
atggcggacatggcagtttccatagcacgagagaaattgcttccactgataagagatgaagcaaatctgatttgggacatgcccaaagaatttgcagacctaaaagatgaactagaatacattcaagctttcctcaaggatgcagataaaagggctgctggcaaaggagacaacatgaaagagggaatcagaaactgggtgaaacagtcgagggaaagcatcatttcccatagaagattttattga

SEQ ID NO: 34354 - DNA, 537 bp, Glycine max
  Peptide Sequence Number=SeqID_151132
atggacatttgggatcttaagtggaggagaccatggtttaagtgggagattccttttgtggattgtttcttgcttgatttggaatggattggcctcaaccaaggagtggatggagggcaaactctttggaaaagaacatcaacagggttgaagatcccatctaatgttgcggctttcatttggaggttatctaaaggtgtagtttttcacatagtgtatggtgctattgttatcattggttgggtatgtctacggtacaacattgggattggaggaatcatttttttccagcataactatcattggcttgggaaggggaaaaccagagtatggagatttgtttggtgtgcagaggtgtgggctctctggcgtcatagcaacaacattatcttcagacaacatatcttagattttgattcagtcatagaacatattgagtttttaacttggagttgtttaactgcaaaattgaagtgttttaagttttctcacaatgaatggcatgctaacttagctttctgcattacagctctgtag

SEQ ID NO: 34355 - DNA, 261 bp, Glycine max
  Peptide Sequence Number=SeqID_151133
atggactattatcgtggttggtgcactggtaaagccgaatgtctagagctggtccaagatctgaaatgcttcatcaccttgcttaagagatttgttggaagcttgaaagtagttcgtttagatagattactggccacggatgaggaacacacattactagaagttagtaaagcttattttggggtcactttcgcatcgattattggaagcttgaaggagatgccattgtcatactcatacataccatgtgcactctattaa

SEQ ID NO: 34356 - DNA, 3183 bp, Glycine max
  Peptide Sequence Number=SeqID_151134
atgaagaagaagagcagcataaaggcggagctgtggcacgcttgtgcggggcctttggttaagcttcctccctccggcacgcacgtcatctacttccctcaaggtcacagcgaacaagtctctgcttctctcaacagagatgtccactctcaaatccccaactatcccaatctcccctccaagctactctgtctcctccacactctcactttgcatgctgatccccaaactgatcaagtctacgctcagattactcttcaacccctcccttcttttgacaaggatgctctcttgagatctgatctcgctctcgaatccaccaagccaccacctgacttcttctgcaaacaactcaccgccagtgatactagcactcacggtggtttctccgtccctcgccgtgccgccgagaagattttccctcctcttgattattctatgcaacctcctgctcaagaactcgtcgccagggatttgcacgacaccgtttggaaattccgccacatataccgtggacaaccaaaacggcatttgcttaccactggatggagtctgtttgttagtggaaagaggctttttgccggagactctgttttgttcattagagatgaaaagcagcagcttcttttgggtatcagacgagctaacaggcaacccaccaacatatcgtcatcagtgttatcaagtgatagtatgcacattggaattcttgctgcagcggctcatgcagctgcaaataatagccccttcaccgtcttttacaatcctagggctagtccctcagaatttgttattcctttagccaagtactacaagtcagtgtacagccaccagccatcacttggcatgcgtttccgaatgatgtttgaaactgaagactcaggaacaagaaggcatatgggtactgttacaggtatcagtgatctggatcctgtgcaatggaaaaactctcaatggcgtaatttgcaggttggttgggatgagtcaaccgctggggaaaagcgtagcagggtctcaatctgggaaattgaaccagtgactgctccatttttcatctgtccacctccattctttagatccaagagaccaagacaacctggaatgcctgatgatgaattgtctgattttgataacattttcaagcagacaatgccttggcctggtgatgatatgtgcgtgaaggatccccaaggtctccctggcttgaacttagctcaatggatgaacatgcagcaaaatcctgcactggctagctcattgcagccaaattatgcaccttccttatcgggttctattttgcaaaatattcctggacctgatatttctcaccagctgggattttctgctccacaaatttctcagtcaaacaatgtagccttaaatactcagaggcttcttcagaccgctccacaactggatcaccttcagaagctaccatctacttctagcacattgggaacagtcctgccgccgcagcaacagttgggtgatatcactcaacaatcgaggcagaacttggcaaatcaaacaatccctcagggtcaagttcaggcccaactcgtgcatccccagaacattgtccaaaccaacaatattcttcaacagcagcaaccatccagtcaaaaccatcaactacatagaagcctctctcagaacccatcacagcagcagcagcagacaattattggtcagaatcaacaccaaaatttgatacagtctcctatgcctgatcatgttcaacaattacagatgtctgacgatcagattcagctgcagttgttacagaagcttcaacaacaaaaacaaacactcttggcccaacaaactgcattgcagcattctactcaacttactcaaatccaggatcggcaaagacagcttttagacaaaacgcataacttgtctagagcactaacacctggtcaagtacgggaaattcctcctatttttcagaattcactccccaaggctaattctatctcaaatccgattacaaaggccaattgccagagcaatattcaattctatcagcagcccaagcttcaacagcagcaacctggcttgctttctgaaatgcctggccatacggcacttcaccctaccactacaaccaaccaactttctgctgctggcagtagtatactgactggagcaggtggtgcaggtggtgcagggcagtctgtaattactgatgaagttctatcttgctccacctcaccttctgcaaataactgtaccaatgcacttccacaattgataaattcacgattccagagaagcacactggtaggcgatgacatggcccagtctgctgccacaatcttgagttcaagtgccttagaaaccacgtcatcaaatgcaaacatgttgaaagatttacagccaaagtctgaagttaagccatctctgaatatttccaaaattcagaatcaagggcattttgctcctcagacatacttgaatggtaatgctgcccatacagattgtttggacacatcatcttctacaacttcagtttgcctttctcagagtgacgctcatatgcatcagaataacaatccattatcttacaatccacagtctttgttgtttagagacaataatcaagatggggaagttcaggcagatgctaggagcaatattccttatgccaataacattgatagccaaatgggaatgccactgaatccagattcactctcaaccaaaggcacattgaggttggggaaggatttgtctaataatttctcttcagaaggcatgcttggtaattatgaaattaacagagatgcccagcaggaaccttcgtcttcaatggtttcacagacatttggtgtacctgatatggccttcaattcaattgattccacaatagatgatagtaacttcttgaatagtggtccatgggctccaccaccagcaccaccactgccacctctgccacctctgccaccagcacagtttcagcggatgaggacatataccaaggtatataaacgtggagctgtgggaagatccatagacataacacggtattcaggttatgaggagcttaaacaggatctagctcgtaggtttggcatagagggacagctggaggatcggcaaaggataggttggaaacttgtctatgtggatcatgagagtgatgttctactattgggagatgacccttgggagtaa

SEQ ID NO: 34357 - DNA, 702 bp, Glycine max
  Peptide Sequence Number=SeqID_151135
atggctctttcgatttttcaatttcttctgttctcaatcagcaatttcttcctcgcttcttctttccaagatcttcttcttctctctgttaatgcgcaatcacacaatctcactcaaccttcagttacgccaatcaacttcgatctctaccattccagtggcaatttgatggaggagatcagggccttggtccatcgtcacccagataaactcactatggagacaattaaagctggaaacaaaggctatggtgctgaggtttcagtggttacttattgcaaggaaaagaaagacaatgatgagaggtcgaagcttcggattcttcttagttttgggcagcatggaagggagctgattaccacagaacttgctttaaggattttgtctatcttaagtgaagaaaaatttctacccagcatggatcaagcttccttaaacagtgcacttgacaagcttgtcattaaggtggttccaatggaaaacttgaatggccgcaaagttgttgaagctggagatctctgtagaggagttgatctcaaccggaattggagtgtagattggggcaaaaaggagaaggattatgatccatatgaggagaatcctggaattgctccattcagtgagcctgaaagtcaaattatgcggaaacttgccatatcttttgaaccgaatctatgggtcaacgtgcactctggaatggag

SEQ ID NO: 34358 - DNA, 501 bp, Glycine max
  Peptide Sequence Number=SeqID_151136
atgacaattgttgagaaaataggtgatccattgagggactcgctccacgtggcgtctgccgatgaggccatccgaatcagaccgccaccggcgcgactcagttacttgaacagagcctccatcgtcgacaccgcaattcgctccaacactcaggctattcaccgtggatatggatacttgtcagagagtgctgacttcgccaaactttgtgagggcagtagtctcacatttattgggcctcccgcatctctgctattcgagatatgggtgacaagaggtatcgtacagattatcaatcttttttttggtatggattgtggcactgcatctaagagaataatgggagctgcagctaatggatattcggtcatcatcactaatgatctacaagtcatcaaagagggttgtgccaaatcctttgctccctttccaacaggtcccagccacaagtttgaaaagcatgatgttgaggggggccctgttttaaggtcaaaggagtga

SEQ ID NO: 34359 - DNA, 2043 bp, Glycine max
  Peptide Sequence Number=SeqID_151137
atgaaccttttaccaccacaactaacaacaacccccttcccttccccatccacccaccgccacagccaccacaacaacatccatttcctcccgccgccgcaatcctccgcaagccccataaccgccaaaccaaccatcctcgaagaaggccccgacgacatcctctcccttcacaaccgccgctacgacttcacccccctcctcagcttcctctccaccacttccaactcaagccctcccacctcactcgactcaaccgagttccaactcgccgagtcctaccgcgccgtccctgccccactctggcacgccttcctcaagtctctctgcgcctcctcctcctcctcctcctccatcgccctcgcgtacgccgtcgtttcatggctccagaaacacaatctctgcttctcctacgagctcctctactccatcctcatcaacgccctcggccgctccgaaaagctctacgaagccttcctactctcccagcgtcaggtcctcactcccctcacctacaacgcgctcatcggcgcgtgcgcccgaaacggcgacgtcgagaaagccctaaacctaatgtccaaaatgcgccgcgacggttaccagccggacttcgtcaactacagctccatcattcagtacctgacgcgctccaacaaaatcgactctccaattctccagaaactctacgccgaaatcgagaccgataaaatcgaaatcgacggccacctcatgaacgacatcattgtaggattctccaaagccggcgatccgactcgcgcgatgcggtttctagctatggctcagagcaacggactgaaccctaagccctcgacgcttgtggcggttatcttggcgcttgggaattcgggaaggacgcatgaggctgaagcgttgtttgaggagattagagagaacggcttggaaccgagaactagggcttataatgctctgcttaaaggttacgtgagaacgggttcgcttaaggatgcggagtttgtggtctctgaaatggagaaggctggggtcaagcctgatgagcaaacttatagtttgttgattgacgtgtatgcgcacgcggggaggtgggagagtgcgaggattgtgttgaaggagatggaagcgagcaatgtgcaacctaattcttatgtttttagtagaatcttggcgaattatcgcgacaaaggggagtggcagaaatcgtttcaggttctgaaggatatgaagagcagtggtgtgcagcctgataggcatttttacaatgtgatgattgatacgtttgggaagtataactgccttgatcacgccatggccacgtttgagaggatgttgtccgaggggattccgccggatatcgttacttggaacacgctgatcgattgtcattgtaagtcgggacgccacgatatggccgaggaattgttcagtgaaatgcagcagaggggatactcgccttgcatcactacttataacattatgattaactctatgggggagcagcagaggtgggagcaagtgactgcgtttttgagcaagatgcagagtcaggggttgcagcctaattcaattacttacacaactctggtcgatgtgtatgggaagtccggaagatttagcgacgctattgagtgcttggaggtcttgaaatctactgggttcaagccaacttcaaccatgtataatgctctgatcaatgcctatgcgcaaaggggtttgtctgaactagcagtaaatgcattcaggttgatgacaactgagggtctgacacctagtctcttagctctcaattcattgatcaatgcattcggtgaagacagaagggatgctgaagcctttgctgtgctgcagtatatgaaagaaaacaacattgaacctgatgtagttacttataccacactaatgaaagctttgattcgtgttgaaaagttccaaaaggttccagctgtgtatgaagaaatggtcgcatctgggtgcactcctgatcgaaaagctagagcaatgctgcggtctgctcttagatacatgaagcagacactaaaatcatag

SEQ ID NO: 34360 - DNA, 726 bp, Glycine max
  Peptide Sequence Number=SeqID_151138
atgccttatgatcataaaaatacaacaccagatggattgccattgcaacggatgaaatcattgcttgaagaagtaaaacatcttcattgccaagagcgctgcatgattgggtctggaggcggttctgtaggggttagtttgatttctggtagaagtggaatgagtaatggctgcaaacatgtttctcagctgtactcaaacgacacttgctgtctggaattgtcatttaaaggtctcaaatattctaccacttttgataatttgaagtcgtattttgcacacgggacagcaactgatttcatgtatgacattgtgggggtacccatggctttcacctttgagatatatggtgatggaactgcctcatcgagagattgtttcaaaatgttcaatcccaccgaccttgctacctacaatagagttctgagtgactggtcggcaacattctttacgattttcaaattggtgccgcagaaacttggtgattcaaacgcgtctattttgaagccggataagttggtatcgatagatgagtatctagatgggtatttgatggaaagaagaaatagatatggaaagaagttggaggtgcttgagcttggaatgcaagaaataagaacatattttaggctctttttattatcttcagtgttattactgttcatgttctgttctagaatttcaaaaagcaagtgtagaccaattgtttctgctatacccctctaa

SEQ ID NO: 34361 - DNA, 531 bp, Glycine max
  Peptide Sequence Number=SeqID_151139
atgcaagctgttttgccttacagtgagattaccaatttgatctcgcttgcacttctgtctattcaatcatgccataatatggagtctatctttggaggggtgagattctctgctcttaaaacattgcgtgttgctgactgtcatagtctgaagtgtttgccactggatgttacaaactttccagaattagaatttcaggttgttgaaaactgtgttaatctggacttggaactatggaaggaccaccacgaagaacaaaaccccaagttgaagttaaaatgtgttggattctggggtttaccacagcttgtggccttacctcgatggcttcaagaaactaccaactccttacagaccttgattattaaaaactgcgacaatcttgaaatgcttccggagtggctgtcaactctgactaatctgaaatcacttcttatatcagattgtccaaagcttatatctctcttggataacatccatcaccttaccgcacttgaatctatgtatatcgatttattgtgttggacgtga

SEQ ID NO: 34362 - DNA, 1431 bp, Glycine max
  Peptide Sequence Number=SeqID_151140
atggcggcgagttctagaggcttctccacgacgcagtttgatttcaagctcagagtaatgcgactcaatgccgctcttcttcctaagagtcacgtgctcgaatttggtcccagaaagcgtagaaagctctgtttcgactctgaccgagttcgactcggtgatggcgcaatgcgctgttgctgttccgactcggttactccgattcgcagaacgagtggacctggcaacggcagtgacaagaacgaggagtggaggttcgataccaaaaaaccccctcacattcacagagtgagggttcaggcctcccctgccgcaatgcctttcgcttctccaccatcatttctgaagcaggaaaaattctttcctcgttgcaccccgagaaattctggcccacagtcacgtgatacaccccccaaaagagacactggtatagcaaatgagaaggactggggtatcagcttgttaaacgaaaatgttaatgagtctggcactaatgaagatgggagtgcctggtaccgagaaagtggggaagaactgggtgaaaatggatatagatgtagatggacaagaatgggtggtcaatcccatgatggttcctcagaatggaaagaaacgtggtgggagaagagtgactggactggatataaggagctagaattcttaagtgtgcatttggggccagtgcagaattgcttctgggcagaggtgtggagaaatctggtagaaattctgagggggatacttggtgggaaacatggcaggaaaatcttcatcaagatgaatggaggtctttatatttctctacttgttgtgaatagtaacatagcaagaatagaaagaagtgcacaaaaacaagcaaaatcaggaactgaaaatgctggatggtatgaaaaatggtgggaaaagtatgatgctaaaggctggactgagaaaggggcacataagtacggtagactgaatgaacaatcatggtgggaaaagtggggagagcattatgatggaagaggatctgttctcaaatggacagataagtgggcagaaactgagcttggaacaaaatggggagacaagtgggaggagagattctttaaaggcataggttcaagacatggagaaacatggcacgtatctccaagcagtgaacgttggtcaagaacttggggagaagaacactttggaaatgggaaagtccataagtatggaaatagcacaactggtgagagctgggatatagttgtagacgaggaaacttattatgaggccgaacctcattatggatgggcggatgttgtgggtgattcaacccaattactttcaattgagcctcgggagaggcctcctggtgtcttccctaatttagactttggttcacctccatcgcctgaagctcatgatgactcacctgatgaagattttccctcttcacaatga

SEQ ID NO: 34363 - DNA, 414 bp, Glycine max
  Peptide Sequence Number=SeqID_151141
atgtcaatcgagtgttcccatgtatgcagtgttgattaccatccccaaaagcagcacatacttgttactgcagaacatgagtctgggatacacatttgggatctaagaaaacctaaagttcccatccaagagcttccaggacatactcattggacttggactgtcaagtgtaacccagagtatgatggaatgatcttgagtgctggtacggattcaactgtcaacttgtggcttgcctcaacaaatcatgatgagttaacaactgaaagacaagtcgattcatctgcccgatgggttgatccattgcttaatacgtacagtgattatgaagacagcatttatggtaaagagggctcacatggagttctcgtgaaccatggatctttgcatcattatcctatgatggcagggtaa

SEQ ID NO: 34364 - DNA, 1515 bp, Glycine max
  Peptide Sequence Number=SeqID_151142
atggcacatcagcgccggcgccaccactattaccaacgcttccgtcacatgattccagtgttttccgccgtcgccgccgcgctattctttctcttcgctctcctttcgtttttagctccttctcccgtcgaaaccgatcgtatccaccggagacgccaacacacttcggttaacgttcaaaaggatgatgcgattgacaatcctgcgttccgcgttccgggtgatggaggaaagttgggacgcgatatctggagttctctaaattcggaacacttctttggatgtagcaattccagcaacaagtttcaaaaagctcaagtgattacacaaccgaatcggtatttgatgattgcaacaagtggaggcttgaatcaacaaagaactgggattacggatgctgttgttgctgcacgaattttgaatgctactcttgtggttccaaaattggatcaacgatctttctggaaagattctagtaacttctcagagatctttgatgttgattggtttatatcatttctgtcaaaagatgtcaaaattatcaagcaacttcccactaagggtaggaaagcattatctgcatacaatatgcgggctgttcagctcagcaagtttgactacaggcttgctaacagatttgaacctgatatgcttgcattttctggatgtgattatggtggaggggagaaggagcagaaggaactgggtgcaataagaaggaggtggaagacattacatagaagcaatcctgatagggcaaggaggcaggggagatgcccattaacccccgaagaagttggtctcatgctaagagcattgggatatggttctgacattcatatttacgttgcatcaggggaggtatatggaggggaaagaacattggcacctctcaaagcattatttcctaatttccattcaaaagagaccattgctaccaaggaagaattagaaccgttttcttcattttcttctcgcatggctgcactcgacttcattgtttgtgatgaaagtgatgtttttgtaaccaataataatggaaatatggcaaaaatattggctggacgaaggagatactttggccataaaccaaccattcgtccaaatgctaaaaaactttatcgattgttcttgaatagaagtaattcgacttgggaagcttttgcttctagtgtccgaactttccagaaaggcttcatgggagagccaaaggaggttagaccaggtagaggcgggtttcatgagaatccatcatcatgcatatgtgaagattctgcagcagccaaagtggacaaaaattcacaatctagaaaatatgggaaggataatacaacgaagaaaaatgtagcaaatgatgaactggatgttgacaatgtgtctgagtggccagacatggatgatgatgacgatgatcagaatgatctagcagagaagggtacattcaatgaaacaatttcggattatgatgctctgaacttcgaggatcccgagttggaggaaattatatcagattag

SEQ ID NO: 34365 - DNA, 1341 bp, Glycine max
  Peptide Sequence Number=SeqID_151143
atgaagaagatgacgatacacgttcttgatcgaaacacggcgatacaattaggtgtatgtgtgaatgggaaaaccctaaagtttgtgacgccctttactaaatgggtttctgatcttaattggcgtttaggtttaactgggttgatcatccctctggttttattcatcacgttcttctctctgcattattcatccacttcaaacggtttttcagccttttaccctgttcagcagtttctcttcaacatcccttttaagtttatctgcgaggacgatcctgttatttccaaggatgaattgttgcggtcgaaaattgcggtgtgtttggtaggtggtgccagaaggttcgaactcacgggaccttccataatcgaaatggtgctcaaagaataccccaattcggatctttttcttcacagcccgttagataaagacacgttcaagttctcgatcttgaagtttgcgccaaacgtcgccgccgttcgaatcttccacccccaaccgttgccggagaacgagccgtatgttcgagtcctcaccgcgcataactcgcctaacggaatccaggggcttcttcagtactttaacctagtggagggatgcctaacgatgataaaatcacaccaacagaagcacaacttcacgtacgattggataatccgaacacgtgtggacgggtactggaacgcgccgttgggtcccgaaaacttcgttccgggaaaatacctggtcccaccgggctcctcgtacggaggactcaacgaccgtttaggaatcggcgacctcagaacctcgacggtggcactgtcgcgtctctctttagttccaaacctcgattccgctggcttcaacaacctcaactcggaggcagcgttcaaggcccaactcaccacgctgaacgtgagccacgtggcgaaacgactcccgttctgcgtcgtttcggaccgcaggtacgattttccgccggggcggttcggggtgccggtggcggcgctttcgagcccgggcccattgagtggggccaagtgcaggccgtgcaggccggcgtgtgagggtttgtgcgtggagactgtgatggataacgttgagaaggagtggagttggacccattgggaaaacggtgcgcttcagctctgcgacgcacacgatgcctgggagagtggttgggagaagatttttgaccggttttctgggaacaaatttgcggcggctaggaagcgaattcactctatgagaatgggggagtgcgttaaggattttgttcagttgaggaaacggagtgcgcattggagtgcgcctccggtggatgagatttgtacattgggtttgagtccaccgtga

SEQ ID NO: 34366 - DNA, 1989 bp, Glycine max
  Peptide Sequence Number=SeqID_151144
atgggctgcaacacctcgagacttgaccggctaccggcggtggcactgtgccgtgaccgttgcaagttcttggacgacgcgcttcgccaaagctacgccctcgccgacgcacacgtggcacacatggaggccctcaaaacacttggccacgctctcctctgtttcttcgacggtttcgaggattccgacgaaactaatgtcccaaataaggaaaccaaagttcctgtcgccacgaaatctccaccccctcactccccttcttcctttagttcggactcagacgacgcacacgtgcttttgcattccgaatcagaaaccgaagacgcagaaaaagaagagttccaattgttcactcacgcgcgttatgactacgctcactcggctcgttaccccccgttttctccgccgcgtggctattccggctcgaagccgccgtctccgccgcctccttccggctccgcctgggatttccttaacttcttcgagccgtacgagaagtaccacgtgccttattttcctggcggcggtgacgctgacgtggccgagaatgaaaaggggaaggttgagaaacgtgacgggtctaaatctaaggaggaaaatggagaagcgaagaaaaagaagggtgattcgaaggagaagaaggtggtttctgagaaagcggaagttgtattagtttcagagcaatgtagtgactctgcgaaaggtttctctgaggcagtgaaagagattcagattctgtttgagaaagcgtcggagtcggggaaccccgttttggagatgctggacgctgggaaactccgttaccatcgaaaatttgacctcaacccggtttcgtgcaagatgatgcatgtgtttactccctcaagtcctcttggggttagatgcatgaaatcctcggttgggcggagaatgggatctgggtatgaaggagacaaggatctcacttacgccaatctctgctctactctgaaaaaactatgtatgtgggagaagaagctgtatcatgaagtcaaggctgaggagaaattgcgtatgcttcatcagaagaagtgtaagcagttgagacgtatgaaacaaaaggatgccgatgcacagaaaattgattctgttcaaactttcattgggattttatctacaaaaatgaaaatttctatccaagtagttgacaagatatctattacaattagtaagttgagagaagaggagctgtggccgctgatctacaggtttattctcacgtttctcggaatgtggaaagatatgcaagaatgttacaaatgccaatatcagcaaattgttgaagccaaaactttagatgccttatcgttaaacacaaagcctggcaatgctcatattgatgcaacaataaaactcaaatctgaggtacagaaatggaatttgagcttcttagattggattcacgcccagaggtcccatgtgaaagccttgaatggttggctggtaagatgtctattatacgaacccgaagaagtacccgatgattcaactcccttctcacctagcaagattggggcaccacctgtgtttgtgatctgtcacaaatggtcaagggcagtggataatctctcagagaagaatgtaattgaagccgtaaatgggttcatgctacgagtgaacgagctcttggaaaagcatattttagaccttcaacaaaaactaacattggacaaagaatttgagagaaaggtgaaaatgttggagagggaggagcaaaagatgcacaaagtgatgcgggctcatgagaggaagatggttacagttggcagagaagaatctgatgcacttttacgtggagatgctgtgcatcacgctgatatcgttgattctactaacctacaatcaagtttgaagcagatctttggtgccatggaaaagttcacagactccactgttcgcttatatgaagaactttgtcaacaaattaagcaagaggatcatgttttgggagaaaccaacaaaattagctag

SEQ ID NO: 34367 - DNA, 2397 bp, Glycine max
  Peptide Sequence Number=SeqID_151145
atgtcgagggtgaattcagagaagaagctgggtgcaggacgtgtggtggctgtggcaattgagaataacaagacaagccaacatgctgccaaatgggcagtggacaatcttcttcccaaagaccaatgtctcttactaatccatgttagacaaagaccatcttcggttccatcgtcggatcatttgagcgaagctgtgggcgacaacgaatccaaggaactttttgaatcatttcgagtcttctgcaatagaaaaagtatacaatgcaaagaagtgctgctggaggacacggatatatctaaggcattaatagacaccatttccacgaataccatagagcttcttgtacttggggcgccgtcaaggggtggccttgttagaagatttaggacaactgatgtcccaagcactgtgtccaaaggggcgccacaattctgcacagtttatataatttctaaaggaaaaatctcaagtgtgagatctgctactgctccattggctcctaacaaagctgccattgccgctgccgccgccgctgccaccacaccccgtaatcaattgcagccacaacaacaaccacacccgcagataatgcgaagtcctgaaagattttcagattctcagccaccccgcaactacccaccacgacctacatcagagaggccaacagcattcgggagtcatggggcacaccaccccatgatggatgaagatgatatcatatcaccgttcacaagggctgggaaaacatacgagccttcaaaatttcaggattctgatatatcattcgtgagcagcggaaggccaagtgttgaacgaatgttcccaacattgtacgaggatcaggacagtgcgagtggaattgccctgggtaggttctcagattacgatggtaggaacagcttcgcttcttcctactcttcacaatcgcagggcatcgatgaccactccttctcctcgcaatcgaggttatccgattgcaccgacgacgtggaattcgagatgaggaggctgaagctggaactgaagcagacaatggaaatgtacagctctgtctgcaaggaagccatgaccgcaaagcagaaggcaatggagcttcaacgttggaaagtggaagaacagaagaaattggaagactcatcaatgtcgtcgtccccgggtgaagctgtaacatcatcatcatccatggcactgatggagatggagcaggaaaagataagagaagaagcacttcaaaagattgcagcattggaagcacagaagagaatgagtctgcagatggagaggaagaagcctgaggagaagaccttgagtagttttggacacactgcgaggtacagaagatacaccattgaggaaatagaagaggcaacaaacatgttctcggagtctctcaagatcggggaaggagggtatgggccagtatacaggtgcgaactagattgcacccaggttgcaataaaggtgttaaagccagatgcagcacaagggagagagcagttccagcaggaggtggaagtgctgagttgcataaggcatccaaacatggttcttctgctgggtgcgtgtccagagtatgggtgtctggtgtacgagtacatggccaatggaagcttggacgactgtctgttcccaagaggaaaatcacggccacctctcccatggcagctgaggttccaaatcgctgcagagatagccacaggtctccttttccttcatcagactaaaccggagccactggtccaccgcgacttgaaacccgggaacatcctccttgaccgcaactacgtgagcaagatcagtgacgtgggcttggccaggcttgtccctccttcggttgcagacactgtgactcagtatcgcatgacttccacagctggaacattctgctacatcgacccggagtaccagcaaacgggcatgctcggaatcaaatcagacatatactctctcgggatcatgcttcttcaattggtgaccgccaagcctccgatgggtttgactcatcatgttggaaggtccattgagaagggcacttttgcagagatgcttgacccggccattcctgactggccactcgaacagaccttgcatttcgccaagctttccctcggatgcgccgagatgagaagaaaagatcgacctgatctaggaaaagttgtgttgccggagctcaataagcttagggcatttgctgaacaatgcatgtcacctatgatgatgtttgcacttagaagtactggtggtgctggtggtggtgctggtggtggtgcaggatatgttcccagaaatagtaactcttccggactttcttcttcaactcaagacatgagtgaagtgtctggcttctctggatatgaaagccgctcaagcacatcatcgctggggagaatatga

SEQ ID NO: 34368 - DNA, 1797 bp, Glycine max
  Peptide Sequence Number=SeqID_151146
atgataaccagtgcttcagacacaggatctctcctcaaattcagagactcccttgaaaacaacaatgcattgttgtcctcatggaatgcatccatccctccatgttcgggttcatcccactggcctcgcgttcagtgttacaagggacacgtgtcggggttgaagctcgagaacatgaggctcaaaggtgtcattgacgtccaatccctcctggagttaccatatctcagaaccataagcctcatgaacaacgacttcgacactgaatggcctgatatcaacaagattgtgggtttgaagacccttttcctttcaaataacaatttctccggggagattccggctcaggcttttcagggcatgcagtggttgaagaagattcatctctcaaacaaccagttcacaggtcctattccaacttccctcgcatccatgcctaggcttatggagttgaggttggagggaaaccaattcactggccccattcccaattttcaacatgcattcaaatcatttagcgtagccaataatcaattggagggagaaataccagccagcctccataacatgccaccttcttctttctctggcaatgaaggggtatgtggagcaccgctaagtgcatgctcctccccaaaaaagaaatcaactgcgagtattgttgcggcagcggttcttgttattgtagcactgatagtgattggagcagtaatattgttagtcctgcatcaaagaagaaaacaagctgggccagaagtgtctgcggagaatccatcatcaataatgttccaatcccaacagaaagaagcctcgtcttcagatgaaggaagtcgggggtcgcctactagctcgagccacagaagcagaagcttgaggctattgtttgtgagggatgacagagagaagtttgattataatgaactgtttagagcctcagcaaagatgttgggcagtggttgtttcagctcttcctacaaggttgctctgttggacggaccagagatggtggtgaagagattcaagcagatgaacaatgtagggagggaggagtttgatgagcacatgcgacggattggaaggttgaatcatcctaatctgcttcctctggtcgcctactactacagaaaggtggagaaactcttggttactgactttgttcacaatggaagcttggccgttcgccttcacggataccaagctctaggacaagaaagcctggattgggcaagccggttgaagatagtgaaaggcatagcaaaaggacttgaacatctgtacaaggagatgccaagcctaattgcggcacatggacatctaaagtcctccaacgttcttctgagtgaatctttggagcccatcctgacagattatgggttggggccagtgataaaccaggaccttgcacctgaaatcatggtcatctacaagtccccagagtatgtgcagcatgggcgcatcacaaagaagactgatgtgtggagtcttgggatactcattctggagattctcactggcaagttccctgctaaccttctacaaggcaaagggagtgagttgagtttggcaaattgggtgcattcggttgtcccccaagagtggactagagaggtgtttgataaggacatggagggaaccaataacagtgagggggagatggtcaagcttttgaagattgcattggcttgttgtgaaggagatgtggacaagagatgggacttaaaagaagcagtagaaagaattcatgaggtcaacgaggaggaggtgaagtcatcactttctccatggatggttaattga

SEQ ID NO: 34369 - DNA, 478 bp, Glycine max
  Peptide Sequence Number=SeqID_151147
atggcaagctcacaaagacaatctgcgacaaaacaaggatcgccgtcgtctcagaagggaaatgaaaaggcaacatcatttggtgagtgctcttggaagacactccgaataacatataccgacccagatgctacagattcttctagtgacgaagaaaatgacaaagtatcaaatggtggtcccaaaagacgattcatagacataacgaatccaaattggaaggatccaaactgcaaactttccatcagaaaaggaaaacgcatatgttccagcaagtatctaggtgttagacgtcgaccatgggggaaatatgcagcagagattcgtgacccgcgtcaaaagaattgtcgtaagcgcttgtggcttggttcatatgatactgagatagaggctgcaatgacttttaatgtaaaaaggcaagagtttgagagagaaatggctctagaaagaggagataatgcatcagtgcattcggagg

SEQ ID NO: 34370 - DNA, 933 bp, Glycine max
  Peptide Sequence Number=SeqID_151148
atggactcagacgctgctgctgcgattgcgatatggaaagaaattgaggcttcagagagctaccttgtttgttctatgtacgaagaagcggcagaattagcttcctctgttttggaacgcttgcgtcatggccatcatgatatcgatagagatatgttggaatcaagtgctatggtgcttcttcaggcattcaaccaacttcccaccaagacaccagacattcttaatcaactcaaactacactttgtttcactcaaagctattcctactcttgttcttcttactggagcttgttttcaaatagcacaaggttctgaatctgcacttgcctccgttcaacaatttctccacgacttccttaatggatggtctcttgaacattcacaatattcttctgtcattaccgaggctgcaagtagagaccaaagcccccgcttcattcttccagttgatgaatatttgcaagttgttgagctctatgccctcacccttcttgcaacagttcaaaaagatgttgatcttgcaatctcctgggttgagaatgcttcattgcctgaggaaaatcgacagggacttctgagaagtttacactccatgcattcttctaaaagtaccattttgtctcaaagttcctttcagcagtcacccacaaatagcaatgaagcttatcctttgaaagaacaaagtgtgtctgaaggattaccaaaagccttgaaaagcaatgaaaagtataggtccaaagaagctgttacaaaactgtctgaacgaatagaagcatgtttctggtgcttccgtggtatcaatttgaagattggcactactaagtttgtcataactagtgggaagatcatgcttggttgtttaatattgttcatctattatgttttcagaaagaagcaagctactttaaacagagacaggaaaggatcctga

SEQ ID NO: 34371 - DNA, 180 bp, Glycine max
  Peptide Sequence Number=SeqID_151149
atggcagaagggaacagcatcacacttaggcgaagtgggcttatcgctggggacgagctcgaagggattctcggcagtaacgttgaagttgtagatgaactaacagacttggagcttgttgacgtcggagtggaggaagtagcccaaaaaggagatgttaccccaaggccccaaccctaa

SEQ ID NO: 34372 - DNA, 897 bp, Glycine max
  Peptide Sequence Number=SeqID_151150
atgcaggtagttcaatgtcagggatataatggttctcaattttgggatgtgactttttctattcaagcaatattagctatcaatcttgaggatgaatatggttcgattcttaagaaagcaaataatttcataaaatactcacagatcacagcaaatagctctggtaatctgagtcattggtatcgccacatttctaaaggtggttggcctttctcaactgcagacaatggttggcctgtatcagattgcactgcagaaggtttgaaggcagccattttgttatcaaacttgccatttgagacagttgggaaaccaatggaaacagaacaattatgggatgcggttaatttgattttatccctgcagaatagaaatggtggatttgcatcctatgagctcacaagatcctatgcatggctggagaaaataaatccaactgaaacgtttgaagatatcatgatcgattatcagtgcgtagaatgcacatcatcggcaattcaaggtcttgtcttattcacacagcgatatccaaggcatagatggaaggaaataaaaacttgtattgctaaggcggcaaattatattgaaagcatacagctagctaatggatcatggtatggatcatggggaatttgctatatctacggaacatggtttggaataaaagggcttatagatgctggtaagagttaccaagatagccaaagcattagaagaggttgtgaatttttgctttccaaacaacaactttgtggtgggtggggagaaagctatattgcatgccaacaaaagtttgtgtttggatacaacacaatcgattttgaggccaaaaaccatggtgtgaccgtgaattttgagaagcaactgtgtgttgttgtggctccaccatggggttga

SEQ ID NO: 34373 - DNA, 2562 bp, Glycine max
  Peptide Sequence Number=SeqID_151151
atgggtatatttgaaccttatagagcaatcggatgcatcacaagcagcgtccccttctctgttcaaaggctcggaactgaaactttccttactgtcagcgttggaaaggcttttcagatttttaactgtgcaaagctcaatttggttctcgttggtcctcaactgccgaagaagattagtgctcttgcttcttatcgcgaatacacttttgctgcatatggaaacaacattgctgttttcaagcgtgcacaccagtttgcaacttggagcagccataatgctaaggttaagttgcttctgttgtttggagatcatattgtcagtgttgatgctcgcggaaacatgttcttgtggccatttaagggaattgatgagaaccatgttccgtttgggcacatcatgctagatgagaaatttagccccagctgtataatgcatccggatacatacctaaataaggttcttattgggagtgagcaaggtcctatgcaactttggaacattagcacaaagaaaaagatttttgagttcaagggatggaattcacctatctcctgttgtgtttcatcccctgccttagatgttgttgcaattggctgtacagacggaaggattcatgttcacaacattcgttatgatgaagagttagttacatttacacattctacacgtggttcagtgacttccttatcttttagcactgatggacagccccttctagcctctggaggttcatccggtgttataagcatatggaatctggaaaagaaaaggctccaatcagttgtaagagaggctcatgatagtgtgatcacttcactacatttttttgctaatgaaccagtgctaatgagttcatcagcagacaactctgttaaaatgtggatttttgatacaagtgatggtgatcctcgccttttgcgcttccgaagtgggcatagtgctcctcccttctgcttaaagttttatgccaatggaagacatattctttctgcaggtcaggatcgtgcctttcgccttttctctgtagttcaggatcaacaaagcagggagctttctcaatggcatgtttctaaacgtgcaaggaagttgaaactgaaggaggaagaaataaaattgaagcctatgattgcatttgattgtgctgaaattagagaacgtgattggtgcaatgtggtcacttgtcatatggatactgcacaggcatatctttggagacttcaaaattttgttcttggtgagcatatattgaatccatgccctgaaaatccaacacctgtaaagggatgcgttataactgactactgctttcatacggtaacaggcttgtgccatcagtgcctgtggaaattttgtctttctagggacagcaggggtgcttacattgacatttcagaatcaagaagttgtgctcatgatggtgaagtagttggagttgcttgtgactcgacaaatactctcatgataagtgcgggatacgaaggagatataaaggtttgggatttcaaagaacgtgatcttaaaaccaaatgggatgttggttgttctgttgttaagattgtttaccatcgttataatggtctcctggctacagtagcagatgatttaacaattcgattatttgatgttgtggctcttagacttgttcgtaaattcgaaggtcacacagatcgtataacagatttgtgcttcagtgaggatgggaagtggcttctgtcatctagtatggatggaagtcttcgaatttgggatgtaatcttagcaagacagatagatgcaatacaagttgatgcatctatcacagcattatccctgtccccaaacatggatatattagcaactacccatgttgatcaaaatggaatatacctgtgggtaaaccaggcaatgttctctagtacttcaaatgttgattcatgcgcaagtggaaaagaggttgtgagtgtcacattgccgtctatctcttctgcagagcattctcgagatgagcattatgatgagccagtgaatgcatctcaacctaaagatgctctgcatttcccaactcaagataagcaaatacccgaattagttacactttcattgctgcctaagagccagtggcagaacttaatcaacttggacattataaaggttcgcaacaaacctactgagcctccaaaaaaacctgaaaaagctccattcttcttgccttcagttccatccctctctggggaaatattgttcgagtctgatgcagcatttactgattatattaaaggattatctccgtcaagtctggatatggagcttcgaatgtttcagatcattgatgatgatgatcagcaagaagcagagaagagacctgagttggtatccattggatggcttctggattattttattcatgagctttccagcagaaataattttgagtttctacaagctgttatgaggctatttttgaagatccatggtgagacaattcggcagcagtcatgcttacaagaaaaggcaaggaagcttctagatattcaatgcatgaaaagtagggtagcaaatttgttaaaagctggtggataa

SEQ ID NO: 34374 - DNA, 948 bp, Glycine max
  Peptide Sequence Number=SeqID_151152
atgagaaactatatgcagtttcttaatcctcagatcttgtgcttcctatttttcagtgctctattattatgtctagttgaaacaaagtccaccattgaaccatgcaattcctcaaactcgtgcccctctcttctctcttatctcttgccatgggactccaagctctccgaaatcgccactcgcttcaatgtaaacttttttgatatcttggcctcaaactctctcttccccataacaccatcaagtgcacaccaaatccttagtgccaaatcacaagtgaaaataccaatctcatgttcttgtgtggatggcatccgaaggtccatgtcaaccatttacactgttcatgcagctgatacacttgcttccatatcagaaggctatggtggattggttagtgctgaacaaatcaagattgtgaacgccatcaatgccaccaaccctttgacatatagaggcacccttgttattccactgccatgcacgtgttttgacaatgtgaataatgggggaaatgctatttatatgtcatatgtggtgcagagaagggagagcctggggagcatagcaaccaagtttggtacaactgtttcggacttggaaactgtaaatggctttggggaagctacggtagatccaggagacattctatctattcccattgcagcatgttcatcagcaaccttgaattggtacgatgagagtatgatagtcccaaatggctcatatacattaactgccaccaactgcatcaaatgcacttgtgaaccaacggatatcacgttgcaatgtgttccttctggactagacgtcccctgctataatttacgttgcaaaggatccaatcttattattggtgatcaatgtgtggatctttcacaaacagcttgcaatgtgagccaatgtgtttaccgtggccataggggtggcaaaattctgagtaggtaa

SEQ ID NO: 34375 - DNA, 177 bp, Glycine max
  Peptide Sequence Number=SeqID_151153
atggaggaacggaaagaatatgggtatggagacaccttcctcgcgctaagtggaaccttcccgctaagtggcttcaacacacagagtggtcctagtggcgctaagcgagaatcattaggcctcaacttatactccaattcctcggctgtatttctacaaaacaaaagaccaccataa

SEQ ID NO: 34376 - DNA, 1824 bp, Glycine max
  Peptide Sequence Number=SeqID_151154
gtttgtccttggtgcttagggcttataacggacatgcatgaaccagttggggatgatatcagagattttgacatttcagttcagacaatgttctctcattttggagccaccacaaagaaaatgctgctatgtcccaaagaagaagcacttgttaaactcttctacaatgtcgtctcaagccctttccagcttctcttcctcattctcttctcctcttccgttttccttgtcaccttcttaaccttcacaggcagattccccttaatccaaagggatcaagagtatgaatatgtgtataccgaggatgaagaagaagaggaagaagaagaaaatcaagaagggtattcttgtgttgattctaacgagagattacaagtcacttgtggcaaggagactcatgtgtttctgcagaatgatgaggggcatcagaggactcattcttattcggaagaattcataagccatgaggagagcttgaatgaagaagagtcagaagaaaagcattattctgaaatgttgtctctccataactcaccacaagtttctgacttggaaaatgaagaggtggaaacgattcaagtagactttccagagagagatcctgattctgttccaaattctgcccaagttgaaagaaggaccacctctcccatcagcctcagcgcatacaaaagaaacaaaaaccgtgacgacgatcatgttagcattgaaattattaaaaacaagaaagtgcaagagacaaaccttgcaagggatgagagattctttgtttttgcttctacccaattgcagagtaagaagttaatgattgaagagaaggatgatgagtcctctaaatggaagagctccatcattggcagggactctgatactgaagatgagttttcttgctcatcaagaagttgccccaagtgggaatcatacacattgttccaaaagtatgatgaagagatggcaatcctagacagaattagtgcacagaagcttcatgaaactgagtcattaaggtccatccaaatgtctccaagatcaatgtctgagcgtattgtgtataagtttcaaaatatgaataaaaagcccgctgaggctggtcacaacccatatcatgaactagaggctgcatatgttgcacaaatttgtttaacatgggaagcccttagttggaactacaaaaactttcgttccaaacacgcctcacaccaggatcatgataccggttgttctgccaccgttgtgcagcaattccagcaatttcaggttctgttacagagatacattgagaatgagccttatgagaatggcaggagacctgagatctttgctagaatgaggcttttggcgccaaagttactcctagtgccagaatatcaagatttagaggaggatcagaaggatggtggttttcaatgcaaaatatcatctgcttcatttctaaagataatggaggacgggataaagacattcatgaattttctgaagaatgataaagagaagccttgtcagatccttgcagcctactttaggagaaaacaaagaggcacagttgatccaacactactccgactaatgaagaagaagagggtgaaggttaaggatcttaaccatgcagggaaatgcttgaggaagagaaagttaaaggtggaaaaggatatggatattttgatggcactcatagacctaaaagtggtgtcgagggttttaagaatgaatgacttgagtgaagagcagttgcactggtgtgaggagaagatgagcaaagtgagaatcatggaagggaaacttcaaagagattattccaccccacttttcttcccctcacattga

SEQ ID NO: 34377 - DNA, 3807 bp, Glycine max
  Peptide Sequence Number=SeqID_151155
atggcacacaaaaaagttgtcctttttgactccaacctcttggggaccattttttcaagttcagttaggaacatagtgatgaattccccacctgatgacaacagttcagaacctacagagttgggcagcccagatgctagttccaatgaaaatgggaattttctatcctgctatggtgaggtggaagccaaacatcgattgctcttggttcagtggttaacttgtcttgtcccttcattgaaccttccaataaatgtcacggatggtgaattaagagcatgcttgagcaatggtacagttttgtgccagatactgaacaagatacgacatggtaccgtgattgtggttagtgaacctgataattttctaccatcacaatcagaaaatgttaaaacgtttctgaaagctttggatggaatgggactgccccggtttgaaatatccgacctagagaaggggtctatgaaagctgttgtggattgtcttttaacacttagagagaaaagtttgcagaatgctttgggagataatatttctgtaactaattccaacattgtgagccctcatgggaatacaccactaagttttcattgttctccaacatttggtggagagcagaggaaaattgcagctgggtcgatgttgcaacgtgttaagagttccccagttatggcagaatcatcagcttcattaatacaccatgttggtcataactttcatgaggtgtttcaaatgaaacctgggagttacgcagatcttcctgctgcaaaaatagcagaaatgatgaaatcaaacagtatagataatgctcccactcagtcgcttctgagtgttgtgaatggtattcttgaagaaagtgttgaaagaagaaatggggaaatacctcatcgtgtggcttgcttgttgaaaaaggttactcaagagattgagcggcgcatgtcaactcaagcagaacatttgcgaactcaaaacaatcttttcaaggctcgagaagaaaaataccaatcgagaataagagtactcgaggcacttgcatctggaactatagatgagagtgagatatgtcctagccagtttcagcagttgaagggtgagaagatcaaagagaaagtaaaaaaggtagatgagaatgaagttgttaggttgataaaagagcaggaggacaaaaatttggaaatttcagccttgaaggtagaactggaaacagccaaaagaacatatgaagtacaattctcacagatggaagaagaagctaacagttttaaagcagcattgacacggaaggtccaagaatatgagcatcaattggaagaattaagaaatgaggctgaaaagatcaacgaggaagtaaaaacgacagatgaagaggaatctattaaattcatgaaagaacaggaggacaaaaaattggaaatttcatcattgaagcaagaactgaaaacaaaaaaaaaaacatatgaagtgcaatgttcacagttggaagaagacgctaaagatgctaaagcagaattgacacagaaggcccaagaatatgagaatcaattggaagcattaggaaataaggttgaaaagatcaaagaggaggtaaaaacggcagatgaaaaggaaatcgttaggttgatgaaagaacaagaggacaaaaatttggaaatttcagcattaaagcaagaactggaaacaaccaaaagaacatatgaagtacaatgttcacagttggaaacacaagctaaggatgctaaagcagaattaactcaaaagtctcaagaatatgagcaacgattggaagaattaagaaataaggttgaggagatcagagaggaagaaaaaaaggcagatgaaaaagaaatcattaggttgatgaaagagcaggaggacaaaaatttggaaatttcatcattgaagcaagacctagaagcaactaaaaaaacaaatgaagtacagtgctcacagttggaaggagaagctaagggtgctaaagcagaactggaacaaaagtctcaagaatatgagcatcaattggaagaactaagaaataaggttaaggagcttgaggtttcttctgattcaaaagatcagaagtggaacatgaaaatgaaccaaatgcagacagttataaaatttcaattcagttccctacagaaattgaaattatcttgggagtccattaagcacaatgttatgaaagagcaaacggtttatgcagaggattgtgatcggttaggtgtttatcttaaaccactgctacatgcagctgagaactaccatgctgttcttgctgaaaatcgaaaaatgtttaatgagattcaagaattaaaaggaaatatcagagtattttgtcgaattagaccatttctttcaggcaaaaaggataaacaatctattgttgaactcattggtgaaaatgatttggttgtggcaaatccatccaaagaaggaaaagatgctcttcgatcttttaaatttaacaaggttttcggctctgccacaactcaagcggaggtatactctgacattcaatcctttataagatcagttctagatggatataatgtgtgtatatttgcttatggccaaactggttcagggaaaacttatacgatgactggtccaaatggggcaacaagcgagactattggtgttaattatcgagctctaaatgacctcttcaagattgccacaagtagagaaagcttcatagactatgagattggagttcagatgggcttagcagtaccagatgctagcttgttccctgtgaaatcaccttcagacgtgattaagctaatggacattggacttaaaaatagagccattggtgcaactgctatgaatgaaagaagtagccgttctcacagtgttctctcaattcatatttgtggaaaggacttgaagattggttccacaatggttggtaatcttcatttggtagatttggcaggaagtgaaagggtagatcggtctgaagtaattggggataggcttaaggaagcacaacatataaacaaatcactatctgcccttggagatgttatttttgccctttctcaaaaaagcccccatgtaccatacagaaacagcaaacttactcaacttctacaaacttctcttggtggccaagcaaagacactcatgtttgtccaaattaattcagacataagttcatattctgaaacactgagcactttaaagtttgctgaaagggtttctggagttgaattaggagctgcacgaagtagcaaagagagcaaagaagtcagagaattaatggaacaggtgtcttctttgaagaacgctatttctgcaaaagaggaggagattcagaggcttcaattactcaaaggttcagtcggtagcattgtttggcgaaaccaaattccacgaagtagaagtattaagcactacgaagctgataaccagcaaccgatggatgatcacatacatcaaagtgaatctcttcatcaatctgaacttaatgggggaaatataggaaagaaagttgctgcaaatgcagaaacttcgggatttacagattctgattttgatggaaaatcaagtgatctttctgacagtagtgttgctccaggcacagaaactgatggttctgaaaattccagtctcaccgaaggcaaaaaatcatcagacaagagatctaaagcaattcgtaaaactgttcaagtgatgaggaaattaagccgaacttcatctacggcgaccaccccagtaaaggacgaccccgtgaagaagtcaccaggtattaaaaagagcgtcagtataggcaaccttaaacctccaaaactgtggaagtaa

SEQ ID NO: 34378 - DNA, 1107 bp, Glycine max
  Peptide Sequence Number=SeqID_151156
atgaaagacgcaggtgccctgggaggcaagacagcacgagcctgcgatagctgcgtaagcagaagggcaaggtggttctgtgcagcagatgatgctttcctctgccatgcttgcgacactttggttcattccgcgaaccagttagcaagcagacacgaaagggttcggcttcaaactgcatcctctaaggcaaccacaaccactacgcacgcatggcacagtggattcacacgcaaggcaagaaccccgcgtcacaacaacagcaagcactttgcgctgcaacagcgtctcaaacacgaagttctcttcaacaacaccagtgttcttcccctcgtgccggagctcggaggggaagaacaagaaccggtggttgtggacaacgatgaaacggaggaacagatgctgtgtcgcgtgcccgtgttcgacccttttgatgtgagaaccgatgacttggatagcttttctgacatggatttttctgaatttgctgctgatgttgaaggccggcttgacaaagaagacgatgaaataagtgcgtatgtgggaggaggagagggagttcaaggtgtattggccaaggttaagggcgaagaagaaattgatggtgatgtagcgtgttatctggagtcagtttttgacatgatcagtgatgatgcctttcattggaataatattgagtctgtggtgtcagatgcccgggaagagaaggggtgtgtggtgccatgtgatggtggggttagtgaacaaggaggaataaagagagacatatttttgagactaaactatgatgaggttattactgcttggtctagccaaggttcttccccatggacaacttcaaacccacctaagttcaactctgattatgacttctccttgggtttgagtggtgtagatggagaaggaagaagcttaaggggacacctagatggtggaagagaagcaagagtgtcgaggtatagagagaagagaaggactcgtttgtttgcaaagaagataagatatgaagtaaggaagttgaacgcagagaaaaggcctagaatgaaaggtcgttttgtgaagaggacatgctttgttggagccaatgcttttcctgcttaccactga

SEQ ID NO: 34379 - DNA, 405 bp, Glycine max
  Peptide Sequence Number=SeqID_151157
atgtggaagctgaagttttcaaagagcaatgaggatgagtggataatgcaaagtgtgaataatcatattggaagacagttctgggagttcgatccacatcttggaaccaaagaagagcgagctcaagtagaacaagttcataaagaatttaacaagaaccgcttcaaatataagcatagttctgatctcctaatgagactccagtttgaaagggaaaaaggcttaaagacgaaactaagtaagatagaaattcagagcgagcaagatataaatgaggaagttgtgcgaaacacactgaaaagagccttgagatcttattcagccctacaagccgatgatggattttggcctgctgactatggcggccccttgtttcttctacctggtttggtacattccttttaa

SEQ ID NO: 34380 - DNA, 154 bp, Glycine max
  Peptide Sequence Number=SeqID_151158
atggaagaaaagctacctcctgggttcaagttccaccccacagacgaagaactcatcacatattatttattaaggaaagtgtccgatgttggcttcacatccaaagctgtagcagttgttgatctcaataaatctgaaccttgggacctcccag

SEQ ID NO: 34381 - DNA, 837 bp, Glycine max
  Peptide Sequence Number=SeqID_151159
atggcgtataatattattttttggacactaaccgtagacaaattgattcgtaaggcatcgatgggcgagaaggaatggtatttcttcagcttgaaagatcggaaatatccaactgggcttcgaaccaaccgagccactgaatcagggtattggaaaaccacaggaaaagataaggaaatatttggtggtggagttttgatagggatgaagaaaaccttggtcttttatatgggcagagctccgaggggtgagaaaagtaactgggttatgcacgaatataggcttgcaaacaaacaaccctatagatcttcaaaggaagaaagggtgatttgcagagtcttccaaaagagctcagcacccaagaaaccacagcagacatcctcttcccaaccatctcaagagtctcctacctcaatggtcaacgaatttggtgatgttgacctaccaaatctaaatagcattgcaaattcatccagtagcttcaccaataatattgcatacaatattaatggtgatcctagcaatgctgttaacaccaatatgaacttgaccatgaattggccttctggatttctgaatccaaacctttctgtgaattcattgcttctcaaggcatcacaacttagaaatacttatcaacaaagagaagctgcgaccagtagtgatcatcactttgcaacatatgttcctcaaggattttctcacaataatactattggaactgaacatcacctcatgactccaaatctcagtgctacttcttcttcttccaaagctttagagtattcttgtgtgccgcagcaggagcaaccatttaatatggactccatttggtga

SEQ ID NO: 34382 - DNA, 2220 bp, Glycine max
  Peptide Sequence Number=SeqID_151160
atgagattaagcatgaaaagtgctttactatcaacactcccaccctcttcatcagttctcttattctcctcctactctaaattcaaactcaaatccccactcggaattcccattcgcgctctcacctcctcttctctcccaaccacccgcgaccacgatgatttattcgaccctctttcccttcccgctccccaacaccttcacaaagccaccaacgccatcgagagaatcgccctccgcttgcgcaacttagggttagcttccaccaccgaccttgccgacgccgaagacgatttcctgcgccgcgaatggcttcgccccgaccaggcgctttttccgtgggacaagggacaagaagaagacgcagaggagcccggggaacagcaaaaggagatgctaaagaagaagaacgttaatgcgtcgacattggcggagcaaacgctggtggaggaggagctgcggcgattgcgaacccttggaatgagtcttaaggaaaagatcactattcccaaagctggcctcacgcgagccgtgctcgacaggattcaccgtcactggagcaactgcgagctggtgaggctcaagtttcacgagtttcttgctcagaacatgaagttggctcatcaaattgtcgagcatagaactagagggttagttatatggaggtcggggagttatatgtgggtttaccgtggtaagaattatcaagggccggtggagagtgatgcaacatcaatggaaaagagtgaggcagtttggtggaagggggagaacatgacgccagaggaagcagaattcaacaggatgctggatggctttggtcctcgatttgttgaatggtggggtactggaatacttcccgttgatgctgattcacttccccctatggttcctggttacaaaacgcctcttaggcttcttcctgccggaatgcgtccgcaactgaccaatgatgaactcacgaatatgcggaagcttgctaaatctcttccttgtcactttgccttggggagaaatagaaatcttcaaggtctggcatctgctattcttaggctttgggagaaaagtttagttgcaaagattggtgtcaagcgtggtattgtgaatacaaacaatgaactgatggctcaggaactgaaggcattaacaggaggtaccttactgctaaggaataaatattacattgtaatatatcgtgggaaggactttgttccaaccagtgtggctgctgttattgctgaaagacaggaattgacaaaacaggtgcaggatgttgaggagaaggtgcggtgcaaagctctcgactcaactccatccggggaagatgaatcaacagcacaagcaggatcgttggcagagttctacgtggcacaggcatgctggggaagggatatatctactgaagaacgtgagaggatgatgcaagaggttgccaaagccaaaaatgctaagcttgtcaaaaaaattgaatgtaaactagctgttgcccaggccaaaaggcttagagcagaaaagctattagcaaaaatagaagcatctttgcttccagttggtcctgattatgacaaggaaacaatcacagatgaagaacgtgttatgttccgttcagttggtttaagaatgaaggcatacttgccacttggtatacgtggtgtttttgatggtgttattgagaatatgcatttgcattggaaacatcgagaacttgttaaattaataacaaaacaaaagacccttgcttttgttgaagacacagctaggttattggaatatgaaagtggtggaatactagtagcaatagataaagttcctaaaggattttctcttatttactaccgtggaaagaattataggcgacctatgacattgaggcctagaaaccttctaacgaaggcaaaggcattgcagcgttcagtagtcatgcaacggcacgaggctctgagtcagcatcatttaaatgtttctagaatttcagtgtgttcaccagctcatgtatatgcgattattatacctactgttgacataccaacccgtcagcatcagggtttgtctcaggatttggggactaaagataggtggaacgtagaggaccacaaccaaatagaccatatatcagagttcacccaaagtgaggaggaatactctgatggagatgacactgacggtaatttcaatgacgacgaatacagtgagtgcaatgacaatgattctgaattttaa

SEQ ID NO: 34383 - DNA, 567 bp, Glycine max
  Peptide Sequence Number=SeqID_151161
atggtggcggcagcaccaccgccttgtggcgcgggtttgacagaggtgcggtggcggcacggaatgtggaagctcaagttcgccgaaggagggaatccatggcttcggacattgaacaatcacgttggaagacaggtgtgggagttcgatcctaagcttggatcgccgcaagatctcctcgagattgagaaagctcgccagaattttcacgataaccgctttacccacaaacacagcgctgatctacttatgcggatgcagttcgcaagagagaacccaacacgtgaagtcttgcccaaagtcggagttaaggatattgaggatgtgacccaagagattgtgacaaaaacattaagaagggccgtaagtttccattcaactctccagtgccatgacggacactggccgggagattatggaggtcccatgtttctgatgcctggcttggtaattactctgtctatcactggggcgttgaatacagtcttaactgaagaacatagaaaggaaatatgccgttacctctataatcatcaagtaagaacttcatgccattttgctccttaa

SEQ ID NO: 34384 - DNA, 972 bp, Glycine max
  Peptide Sequence Number=SeqID_151162
atgtcgggtatgggagatgggtacgtgggcaccgcccaagacgcggtgaggattcgacggttggagaagcagagagaagcggagcgtcgcaaaatccaagagctgaaaaccaagtctgcctccgccaaggaccaacccggtcttctccaattcggttccagcacttccgagattctagagactgcctttaagaaggaaactgtgggtttggtcactagagagcagtatgtagaaaagagggttaatattcagagcaaaattgaggaagaagagaaggagaaacttcagaagcaacaacaagaagaggaggagcttcaattacaaaagcggaaaaagaggaagatcaggggcaattctcgattgtcctttgctgaggatattgacaatgaaccccaagaggacgaaccacatcacaataatctggaggcaaatagattacggtgtggtaagcttggcaaagaccctactgttgaaactagctttctacctgacaggagtgctgaggattcttgttcagtgagcgagaggctgaggagcaagctgagcgtgaaaggctgcgcaaacagtggcttcgtgagcaggagcaaattcgaagtacgcaagggtgacagcataggagagtttcttcgagcagttcaacagcaacttgctcctgaattccgagagattcgaacaacatcagtagaaaatttgttatacgtgaaagaagaccttatcattcctcatcaacatagcttctatgagctaattgtgaacaaagctagaggcaaaagtggaccgctttttcattttgatgtgcatgaggatgtacgaacaattgctgatgccactatagagaaggatgagtctcatgctgggaaggttgtagaaaggcattggtatgaaaagaacaagcatatatttcctgcttcaagatgggagatatatgatccaacgaagaaatgggaacgttatactatccacggggattga

SEQ ID NO: 34385 - DNA, 759 bp, Glycine max
  Peptide Sequence Number=SeqID_151163
atggctgaattcactgcagatttgcaaagtcttaggtttcctttcttagatattgataacatggaaattcagaacttcatgatgccattctcctgtgaaagcttcttaggctctccagaagctgaatttccaggaaacttattggaagaaaattttccggctcttgttcaatgtgtcgatcacaatgaagttccagttttagttcctattggttcagttaaaaatgaaatccatgaaggtcaaaagaggaaagcaactgatatatgtgagccaagttctgcaaattcaactcctgctgtttctgagagtggaagcaagacaaaaaatagttctggaagaggcaagagagtaaagaggaattcgatagaagacaagaaaccaaatgaagtagttcatgttagagccaaacgtggtcaagctactgatagtcacagtttagcagaaagggttagaagagggaaaattaatgaaaaacttaggtgtttgcagaacattgtcccaggatgttacaagacaatgggtatggcaataatgttggacgagataataaactatgtccagtccttgcaacatcaagtggagttcctctctatgaagcttactgcagcaagtacctactatgacttaaattcagagtcagatgctttggaaacaatgcagagagcaagggcatccgaggtgaaagagttgggcaagtgtgtgagagaaggaagtgaagaagtttcttgctttgaaccaacatggccatggcctctgtga

SEQ ID NO: 34386 - DNA, 237 bp, Glycine max
  Peptide Sequence Number=SeqID_151164
atgaagagcaagagagggaaggagaacgatctacggcggggcgctcgcatttggcggctttggcattggaaggggaggtggttttcaggtgtggctcacagtgacgatgaagatgaggttccagcgatgactgtagttgttttggacgcagcgagagatggaggttgctcgatggttcgtcgttatctggtgttttcctttggcgaaggatttcacaggggctcgcgtttggcttga

SEQ ID NO: 34387 - DNA, 685 bp, Glycine max
  Peptide Sequence Number=SeqID_151165
atggcggaagcttccgtaacggttggaggcaaggcttcctctatctcttcctcctccgtcttcgccgtggccacgggccgcgctcacgtgcggatcgattcttccgcgctcgatagactccccaagaccgaaacgacgtcggcttcgcctcagctgcgcatcagcgtccccgatttcctaaccctagaggaatcccgcgccttccttcttgtcctcctcaacaacctcgtcctctccaacgccccctcccgcgttcccctcctcctctcccaaaccctcaattccaaccctcccaccttccatttccacgatggtgctgacgtcacccaacaagacctactcacctcttccacgctgctcgctgtctccgccattgtcgaccaccagtccgccgcgctctccgccttcgccgacgtcgccgccgccttctcctgcgaggccttgaaggccgacgcaacgcccttcaatctcatggattccggcgacggacacacctcgaaggacgaggtcgccgtcgccgccaacattcgggttctgctcaacggatccaagtccgtcggcaaggagaagattcgatccgtcgcgagggttcccaaggttcacgggagtgtaagggagcaggccaaagccttgcactccagaatgcgtgttgagttgaattcgggggttaagggtgtcgttggaa

SEQ ID NO: 34388 - DNA, 963 bp, Glycine max
  Peptide Sequence Number=SeqID_151166
atgtggtgtcactgccggatggtctatttgccgatgtcctacttatatggcaagaggtttgttggtccaatctcaccaacagtattatctttgagaaaagagctttatacagtaccataccatgatatagattgggatcaggctcgcaatttgtgtgcaaaggaagatttgtactatcctcacccacttgtacaggatattctttgggcatctctacacaagttccttgagcctattctgatgcattggcctggaaaaagattgagggaaaaggctattatttctgcattggagcatatacattacgaagatgagaatactcgatatatttgcataggtcctgtaaataaggtgttaaatatgctttgctgttgggtggaagatccaaattctgaggccttcaagttgcatcttcccaggatttatgattatctatggattgcagaagatggcatgaaaatgcagggctacaatggaagtcaactatgggacactgcttttgctgtccaagcaattattgcatctaacctcattgaagaatttggtccaactataagaaaagctcatacctatattaagaattcacaggttttagaagattgtccaggtgatcttaataaatggtaccgtcacatttcaaaaggtgcttggcctttttcaactggagatcatggatggccaatttctgactgcacagctgaaggactgaaagctgttctattactatccaaaattgcaccagaaatagttggtgagccaatagacgtgaagcgattatatgattctgtaaatgtcattctctcactacaggtagctagacttctcgcaattggagccagattatctgaatactatgagaaaatataccatggagatcattttatgctattacttgtcaatgtcattattggttccttcaatacttatgatgctaatatcaataagatgactgtttttcactga

SEQ ID NO: 34389 - DNA, 1592 bp, Glycine max
  Peptide Sequence Number=SeqID_151167
atgggttcgatcagaagggccgaagcctggtttgtcaagatcgcttgcactgttttcgttcgctccaactcgctggatccgttcgtgggttatttcagtaagcacctaaccccttcgctcgtttacgaggtcgtcaataggctacacattcccaatttgggcttcaagttcgttgaattctgtagacacaagttgcacatgagtcactcttatttgacttatagtttgctcttgaggtcactctgccgatccaatcttcaccatacggcgaaagtggtgtacgattggatgaggtgtgatggccagattcctgataatcggctgttaggatttttggtttggtcgtatgccattgttggtaggttggatgtttcgagggagttgctcgccgatgttcagtgcaacaatgttggagtcaatgctgttgtgtataatgacttgttcaatgttttgattaggcagaataaggtagttgatgctgttgttttgtttagggagcttatcagggccggggaaattgacgaggcttttaggcttctcaatgatttaaggagttttggttgtttgccagatgtaattacgtataatactctcattcatggtttgtgtcggattaatgaggtggatagagctagaagtttgctgaaggaagtttgtctgaatggggagtttgcacctgatgttgttagttacacgactattatatcaggttattgcaagtttagtaagatggaggaggggaatttgctgtttggtgaaatgattagatctggaactgcacctaatacgttcacgtttaatgctcttattggtggctttggtaagttgggtgacatggcttctgcactagccttgtacgagaaaatgctcgttcaaggttgtgtgcctgatgttgctactttcacttctctgattaatgggtattttcgacttgggcaggtgcaccaagcaatggatatgtggcataaaatgaatgacaaaaatattggtgcaactttatatacattctctgttcttgtcagtggtctttgcaataataacagactacacaaagctcgtgacattttgagactgttgaatgagagtgacattgttccacaaccatttatctataatcctgtcattgatggctattgcaaatctggcaatgttgacgaggctaataaaattgtagcagaaatggaggtcaataggtgcaagcctgataagttgacgtttaccattcttattattgggcattgtatgaaagggagaatgcctgaagcaattggtatctttcataagatgttggctgttggttgtgccccagatgaaatcactgtaaataatttaagatcctgtcttttgaaggctggaatgcctggtgaagctgcccgcgttaagaaagttcttgctcagaacctgacattggttctatggcaaagtgcaaaccagtggattgacacagccttccaccattatgccttgagtacttggtgcaggtgtctccagcttgtggatcaaaggcatgctatcattgggcaggttgatttttcgcttttcatggtctcatttttcacttttcatggtctcatggctggtctcaagtccgg

SEQ ID NO: 34390 - DNA, 546 bp, Glycine max
  Peptide Sequence Number=SeqID_151168
atgccttcggatgctaagcaaccctcacgcttggccatgtggaaaggtgttatgtttgcttacacagtcatcgccttgtgtttgtttccccttgccattggaggttattgggcctatggaaatttaatacctaccaatggagggatgttaggtgctttgcaaaaataccacgaacatgatacatcaaaatttatcattgctttgacaagcttgctagttgttataaacagcctcagttccttccaaatctatgcaatgccagtatttgacgatctggaattcagatacactagcaagatgaacagaccttgcccgaggtggctacgaatagccttcaggggtctcttcgggtgcctagcattttttattgctgtagccttaccattcttacggagtttggcaggtctgataggaggcgctgctctaccaataaccttagcatatccctgtttcatgtggatacagattaagaagccacagagatgtagcacaaactggtacttgaactggacactaggtgttgttgggatgattctaagtgtactg

SEQ ID NO: 34391 - DNA, 402 bp, Glycine max
  Peptide Sequence Number=SeqID_151169
atgggaaaactactagcactcttcccaatcatgtatttatcgggtgggacgtgtgtgacactgatcatgatcggagctgacacaatgaagatattctttcagatggtgtttggaactgcaagcccactcacaaccattgaatggtatttggtgtttacatgcacagccattttgcttgcccagttaccaaacctgaattcaatcgcaggggtttccctcataggagccatcactgcagtgagttattgtgctcttatatgtatagtatctgtagtccaaggtagacttgatcatgtatcctatgaaccaccaaggggacaatcagaggctagcatgatttttagcgcgtggaatgcactaggcatcattgcttttgctttccgcggtcacaatcttgtgtag

SEQ ID NO: 34392 - DNA, 183 bp, Glycine max
  Peptide Sequence Number=SeqID_151170
atgactgggcctctgtctcgttcttctcctccacttcttcaaacatcaccacttccaggagtaggagaagattgttgtctaggctctatggttaagttccaagttttaacacaattggttaggatgacaggaagtcctgatacacaatacgatatggatatgaggttacagggaatttcttaa

SEQ ID NO: 34393 - DNA, 120 bp, Glycine max
  Peptide Sequence Number=SeqID_151171
atggaacgtcatagaaacagaaaagttcacaagcttagtcagaaagagtcatttcatacagatcctccttttaagttaaattggagagatggaaccacaacaagaaatggagtggaatga

SEQ ID NO: 34394 - DNA, 270 bp, Glycine max
  Peptide Sequence Number=SeqID_151172
atgaagatgaaagcaaacaaaacaagaaatgaattgaaagtctcggattcaaacacttaccggttgaagaacgaagaacggacgaagaacgatgaagaacgcaggaaaatcttcacagatttactcacggaagtgtctcagaagcgttacggaagcacttcgactcaattcttcttcacggaaacaaattttacggaagccaaggaagccccaaaaaccatttttcaacaaaacgtggaggagcttgccgcccagttgcttcctccttaa

SEQ ID NO: 34395 - DNA, 1356 bp, Glycine max
  Peptide Sequence Number=SeqID_151173
tacatccttctccatattgcagaagggtgtgatccagttaacaaactttactactgcgacttgtccaaacttcctaatgcgctggaaggctttcggaatggaaattctctcctcccatttgccaaacttattgataactttgatgcacagtatgaagccattgccaatgatgacacctcccgagtagatttgaaagaaccaactgcttgggctgatgttctccaagagtctgaaaaagatgtactggagtcagcatgtgctgtaaatggcaaccaactgatagatccttgctgcatcaattaccaattgagattggcagtgtttctgaaatttctgcacgacgtgaagatagtgtggttttcatttggctttacaagcttcttaactcccggtatcatctaccagtgcaacctaggaacagagattcctgatatgaagatatttcgtgaaattgttgtccctgggtttgatcggtctgaatttcatgttaaacaggatttcgtgactagtaaagatggtaccaagatcccaatgttcattgttgccaaaaaggatattactttggatggttcacacccatgtttgttatatggatatggtggttttaacatcaatattacgccatatttcagtgtcagtcgcattgtactcacaagacatttaggtgttgttttcagcatagcaaatattcgtggtggtggagaatatggggaggaatggcataaagcaggctcccttgcaagaaagcagaattgctttgatgacttcatttctgctgctgaataccttgtatctactggttacactcaacccaaaaagttatgcatcgaaggtggaagcaatggtggacttcttgttggtgcttgtataaatcagagacctgatttatttggctgtgctctggctcatgttggtgttatggacatgctacggttccacaaatttaccataggtttctttcgatctgtaatgtccagtcatgcttggacctctgattatggttgttcagacaaggaggaagagtttcattggctaatcaaatactcaccattacataatgtccggagaccgtgggaacagcatcatgatcagtcatttcagtatccatcaaccatgctgttgacagctgatcatgatgatcgtgttgtgccactgcacacattgaagctattagcgaccatgcaatatgtcctctgtacgagcttggaaaaaagtccccagacaaacgctataattggtcgcattgactgcaagtctggtcatggagctggtcgtccaacacagaaaatgatcgatgaagctgctgaccggtacggttttatggctaaagtgttggaagtgcattggattgaatag

SEQ ID NO: 34396 - DNA, 924 bp, Glycine max
  Peptide Sequence Number=SeqID_151174
atgaacagggatgcagcactttatgccctaggcgttggggtgtgtttgtcagacgctgttgacggtgttgagcttaaatatgtctaccatgaaaatggtcaggggtctatcaaggtcttgcctacgtttgctactctacttgtacttagatctggggcgagtggttataatctcccaggtttggaatatgatccacgccttctacttcatggacaacagtacatagaattatacaaaccacttccttcaagctgtcatatacacaatatagtaagccttgccggattacatgataaaggtaaagcagcaattttggagattgaaacaaaaagctacgagaaagaatctggtgatttattgtgcatgaacaggacaactgtctttctccgtggtgctggtggcttctcaaaatcatctaagccattttcttatacaaattaccctatgaatcagaatccagctgtgaaaattcctgaaagtaaacctttttcagtgtttgaggatcgtacccaaccatctcaggcatgttataactatgcaatattggcattgctctataggctatctggtgattacaatcctctgcattcagatcccatggttgcaaaggttgctggattgtacctctcgctcttccgcggtagaagttggggtgtgctaagattctcgcagccaatattgcatggtctgtgcacattaggatgggcagttagggcaatcatcaaatgcatatgcagaggagatccagacttgataaaaagcgtagcgggcagatttcttctacatgtctaccccggtgaaactctagttactgagatgtggcttgaaggctcaagggtaatatatcggactaaggtgaaagagcgaaagcggacagttctttctggctacgttggtctgcgtggtttgacttcgtcactgtga

SEQ ID NO: 34397 - DNA, 780 bp, Glycine max
  Peptide Sequence Number=SeqID_151175
atggcttcgctttgtgccctaaactatcctcctgctcgcagagacgattcagtcgtcgaagattaccatggtgtcaaaattgccgatccttatcgatggctcgaagatcctgatgcggaagaagtgaaagagttcgtagcgaaacaggttcagctgacggattcggttcttcaaaaatgcgaaacgagagggaagcttagggaaacgataacgaagctatttgaccatcctcgttacgacgctccgtttaggcgagccaataagtacttttacttccataacactggccttcagccgcaaaacattctatatgtgcaggagagtttggagggagaggcagaggctttgctcgatcccaataccttcagtgaagacggaaccgtttccctgagcacactttcggtgagcgaagatgccaagtacttggcttatgcgcttagttcaagtggtagcgattggactactataaaagtaatgcggattgaggaccggaatgttgagcctgataccttatcgtgggtcaagttttcctcaattagttggacgcacgatggcaaaggtttcttttatagccgctatccagcacccaaagatggagaagtagtagatgctggtactgaaacaaatgctaaccttcatcatcagctctattatcattttctgggtacagatcaatcggaagatattttgtgctggagagatcctgaaaatcctaaatatacgtttggaggaagtgtaactgatgatggcaaggtgcttaatgttttgtcattgttttag

SEQ ID NO: 34398 - DNA, 231 bp, Glycine max
  Peptide Sequence Number=SeqID_151176
atgtcagtcttcaatcatgagcctcccctaacgttcagagagggctcgtgtagcgttgttaatgtgtatgtgtattcggcaatatggaaagtaaaaacatcaaacatctgctacaccggtagaactaaagaaacgaggaaatgcccaaattctaagggaaacatagggtttactaagaatggagggatcgaaattatagggtttctaacaccagatgcaagcggaaattga

SEQ ID NO: 34399 - DNA, 2205 bp, Glycine max
  Peptide Sequence Number=SeqID_151177
atgaagagggcacagggaaatgggggtttggagatgaagcagagaatagtaggtgcgctgaacaaggttggggatcgggacacgcagcaaatagggatggaggagctagatcgaatggcgcagggcttaagagcggaagggatatggtccttcttgtcatgcatactagactccgactgggagcagaaagcctccatcagaaaggagtgcgtaagactgatgggaacgttggccacctactacgatggcctggtccttccgcatcttcccaaaatggttgcaagcatcgtcaagcgcctcagggatcccgactctgtcgtccgggatgtctgcgtcaacacggttgctcttctcgcctccaaattgggccgtgacggcgaggacaaggtgtttgttgttcttgtcaggcccatcttcgaggctctgggagaacagaataagcacgtccagtcctcctctgctctctgcctcgctaggattatcgacaacactccccatcctcctctttcccttttgcacaagatgttgtccaggactctcaagttgcttaaaaaccctcattttattgctaagccagcccttcttgacttcacccggagcattattctcgctggcggcgctcctactcataatattctctccgctgctatttccagtattcaggattcccttaaacattctgactggtccactcgcaaagccgcatcacttgcactcgccgatattgctttgagcgctgcttctttcttgggatttttcagggcttcctgtcttcagtcccttgagtcttgtcgatttgacaaggtgaaaccagttagggatgcagttatgcaagcgctcaagtattggactattcttcccgctcccccagatacacccgacccttctgaaactggatcctccttaaaagaaaacatctgcagaggtgactcctctgatcttagcagtactactactgaatccagacacatacaaaaagtcaatatgaaatcaactatgggaaggatccctttctctgttaaaaattatgcgaggaacaatcaccagaaaccagatgattgggatgttcaagttgcagtccccagaccccactctctcgtggaattccagaacaaagaatcagagagttgttctgtcactaagcagccattagaaacaatgagtgctgatgttaccagcatgcaggatgttggttatgaatatgtgcccatggatgacaagcaggagtgttcttctgtctctaatcctcccactgataactttgagaccaagtttttatctgcttctcatgactgttttatacagaagatgccaattgcaagaagccaacgatttagtgaggaaataacttctgatgaacgggtaaagatgcaacaccctacaagttctgattctaccgtcacagagccaactcaccaaactgcacatgaatgctgtatgcaaatggcaaatgaaatgatctgtattcagaatcaactttcagatattgaaatcaaacaggctaacatgatgcaccaattacagatgtttacaactggcataatggatgccctttctacaatccaatcaagaataacaggcttagagaatgtatttgatagattaagtcaagaatctttgcaaagaggaagacattcttattcagaaaactccaaattagggagacagagtgaaaatgttgcctctcccaggttctccatatgcactccaacaccaaggccatctgtggaaattaataataagcaatcagactctatgtcagttaaaaattccgaaagttgggagaaaaaggcattttcaaggagccaaccaaggattcattctggagatagtttggatatgtggaaaagtaacaaggtcaaggctaccagaaaatttacagagaaggatgttttgaacagctcatcaaaggataccttacaaatgggttctgtaaaaaatgatggtatcttctctgctaccagaataaccaatgccagaaatgattgttctgagagtaataataactactggaagcatattgttgaaatgagtactatccatggaccaaattgcattgctatctctattgaagccaagaaacatcttttatcggcagtccaggaggccatgaacctgcattttttcagtcatgcagaaagaaggcgtgtggctgaattagcaatgaaattacatcatatatggggtaagatcactgaaagttaa

SEQ ID NO: 34400 - DNA, 144 bp, Glycine max
  Peptide Sequence Number=SeqID_151178
atgtgtgacaaaattgcaaatggtggcactctgacatgtggactggtatcaactgtcacgggagaattgcgctacagtgatgcattgaggctactaaacaccttggaggatgcatccaaaaggttgggcactattctgcaataa

SEQ ID NO: 34401 - DNA, 582 bp, Glycine max
  Peptide Sequence Number=SeqID_151179
atggagtctggagccctagtgtcgtccgagaaagaagggcagcaaggagcctcgtatacgtactgggttaggaaaataacggaagatgcagcgcctttgcctgtgcctcgtaagctcaacccagaagatgttcccccttgtcattctcaatctcaatctcggtctgccacgcttggctcagcttggaatcgcgctgggacatgggaggagaaaagtctaaacaattgggcaactccgagaattaaggagttgcttatctcattaggctccatacagttctcctttggcagagcagaagtagaagatgtaacaaaatgtgttggcgatgcattcatggtgatagttcggaacaagaaacgtgttggttacacatatgagttgagcttaaaagtcaaaggggaatggatcatacaaggagagaagaagttcgttgggggtcatatagatgtcccagaattctcatttggtgaactagatgaattgcagttgttcaagagatatattcgcatcccaagaattaaggcaggggatgtgagaccttccagcacccgtgttccacagatgcctgtcagaacaggctaa

SEQ ID NO: 34402 - DNA, 252 bp, Glycine max
  Peptide Sequence Number=SeqID_151180
atggattctctactggttgcattgctcctcactagaaaagtggtgagcatctataaaaggcactttgccctagttagtggatgtccaaagtggaaggaataccccatctactatctagttgaagtgagactgagtgaagcaagggatatcttgcatcaagacaagacacagatttgcaacgacttgaagctatttttacagcctgttcgggaaaagttgcttcaatttgaacaggaactcaaagatagatag

SEQ ID NO: 34403 - DNA, 351 bp, Glycine max
  Peptide Sequence Number=SeqID_151181
atggggggccatacatttgtcaccttgaacgacactttgtacaaaaaagtagctttgctcaaatttacaggttataaaattatcaataacatttcagatactgggaaggcttttctaattatactgatcacagatatattcttagggtatcattctgaatctggttggcaaactttgctagagataattgttgagcactatggacttgaagttgatcagtctgctataactatttttatctgtctgatcccagttgtcatcgatgcatgcgtgaaactttggctgtttaaattcctcccacgtttatccccaagggtgacaaatatatttcgggaaatgaaacgtcactag

SEQ ID NO: 34404 - DNA, 225 bp, Glycine max
  Peptide Sequence Number=SeqID_151182
atggcttctgcttccacttctgctcctcctcctccccctcctctgccaaggaatgatggctctctgctaggttcttcgacggttatcactgccaaggagtttttgtactccatctcacagaagcttaacaattccaattatctcctttggtgtcaacaggttaaacttgttctcaaagggcgtcgtctttttcatcttctcactgaaccgcagattccaccctga

SEQ ID NO: 34405 - DNA, 1002 bp, Glycine max
  Peptide Sequence Number=SeqID_151183
atggcttttatgcaccaaggtcagaatattagaatacaaggggatcccagcttggttaagtctacaatttcggccaaaaccttgatgagattggtagaaaacaaagtggaggcaatgtctatattatggatagtggaaaaggaacaaaggcatgtggaaatcttaaccgaacaggatgaagagctatacagtctgttagaagaatttactcagggagtgacaacggcacaagggaagtcaacgactattcgacacgatggcagcataaggcccgcaatagcatcatcctgctccggagcaattgcggacacgacaattgctacttcaatccaccccgcaacagaggatggaagttggaggttccgtgtggacaatcggactctcaacaaagctacaatcccagataagtttcctattctagtgattgaggagctcctagacgagttaaatgggattgcaacttctccaaggcaaatcttaggcaccatgagacagcatcacctctttgccaatagaaagaaatgcagttttggaaaaacagagatgagctacttggtgcacatagtatccaaagcaagagtttctatggaccctcaaaagattgaagctatattgcagtggcctctcccaaagtctatcaaggaagccttacgggatattaatattataggcactttatatgcaaaagctgtgacaacaacccttgttttggtcacgcctcattttggtaaacctttctctattgagtgtgatgtttcgagaaaggggataggggtcttagccattcaacattggacgccttatctcttggggcagagattcactgaccaaaagatttttagacccctattggagctaagggaaaggagggttgatcctgcattagcaaaaatcatggaggaattgaaaaaggatcctaattcccaccccaatacaccctggaacatgaaaggctccattataagggacgattgctgttggcagcatcgtcaacctgtatag

SEQ ID NO: 34406 - DNA, 783 bp, Glycine max
  Peptide Sequence Number=SeqID_151184
atgaagttgatcacaaatggaggaaatgtccctgcgcaattgctggttcttgatggaaaaaattgggagcggtggcatattcaaatgaaggcgttgtttgaatttcaagacgtgatggaggtagtgaagaatggcgtagcggcggaatcagcagaacccgctactgaggcggtgaggaatgcatacaaggatagcaagaagaaggatgcgaaggcaatattctttctgcatcagagtgtagatgatgcgaatttcaatctaatctcgaaggcgacctcagcaaagcaggcctgggataaacttgagaaatgttatgctggtggagatcgaatcaagaaggtgaaacttcaagtgttgcagcgacagtttgactcaatgatgatggaagagaatgagaaaattgctgacttctttgcacgagtaaaggtagtcaccaatcagatggctacacaaggtgagactctaactgatggaaaaatttgtgagaaaattactcgatctctgctggaaaaatatgattatatagtatgtgtaattgaggaatccaaggaagtaagtgaaatgagtttagaagaattgcaaagttcactagaagctagagaacttagattgctagagagaaataagaagaaaattgctaaacaagccttattggctcaatctagtaacaagaattctgacgacagtaacagaggaagaagtggttttagaggaagaggtcatggtaggaacaatagaggaagaggtggctatgtttctagtagtggaagaggccagaataat

SEQ ID NO: 34407 - DNA, 933 bp, Glycine max
  Peptide Sequence Number=SeqID_151185
atgtctaagccaagtccagaaatttcagaagaagaagctgaagaccgattgcaagatgctattcaggagaaatttgctgtatttggtgataaagaacatcaggccattgatattcttttagctgagattgatatatatgagctttttgcttttaaacattgcaaaggaaggaaagtcaagcttgctctttgtgaagaactcgatgagaggatgcgggatttgagaaatgagcttcagtcatttgaaggtgaagaatatgatgaaagccataagaaaaaggccatagaggctttgaaacggatggagagctggaatctattcagtgacacatatgagacttggacctcagtattggcttcattcatggatttgcccgtgcaggagttccaaaattacacagttgcgcgtgattcttttcttgcacatctaggtgcaacactgtggggatctatgagacatattgtgtcaccttcagttgctgatggtgcctttcattattatgagaagatatcctttcagttgtttttcatgacgcaggagaaagttaggcacattaaacagcttcctgtggatatgaaggctataatggatgggttttcctcattgatggttccttctcagaaaccaatgttcagtcctcacgtgttgcctttgtcagaggatcctgccttagcaatggcctttgcagttgcacgacgagcagctgctgtgcctttactacttatcaatggaacctaccgaaagacagttcgtacatatcttgattcttctattctgcagtatcaattgcaaaggctgaataaacatggttctcttaaaggtctttcttatatccttaaatcctcatgttttagaaggccaattgtgtgtacatggaaaaacaagaatatgttggggaatccttttgaaattgaaaaaagaaaaggtggaaat

SEQ ID NO: 34408 - DNA, 414 bp, Glycine max
  Peptide Sequence Number=SeqID_151186
atgcagatagagtggtataatatttggcttgatgcactagataattttgggaggttgtatcaagggagagacacagctgagatcattgaggtcaaagctttacagttactaaaagggaaggatcaagatctgaagctccatctggaaaaagtattaaaatctggagactacagtggttttcaagcagaatgtctcacggacacatggataggaaaggacagatgggcatttattgatttaagtgcaggccccttttcatggggacctgctgttggaggagaaggtgtgcgtacagaagcaagtttaccaagtgtggaaaaaacaattggttcagcttcaggtagtaacgatgtgttagattgtgtgcatgtaatgtatccagctgtaaatcatactagtcatactcacagttaa

SEQ ID NO: 34409 - DNA, 4260 bp, Glycine max
  Peptide Sequence Number=SeqID_151187
atggagttaactccaagaggaagaacccaaggccatgtgttgacctttgagagagatgcagattcctttgtggaggaagataaggagcttcagtccaagtgggctgctatagagaaactacctactttcaaaaggattaagacttcttttgttgatgtcagtcaggaggagggtgcaagcagcagcagcagcagcactgtcatcacgttgagaagcggcagcaaaagggtggctgatgtttccaagcttggagctgtggaaaagcgtttgttcattgacaagctcatcaagcacattgagaatgataacctccaactgctgcagaaacttagagaaaggatggacagagacataaatggggtaccagttgatgtaggcactttatttcaagaaattgacaaattggttgttttcagagtcaatgtgaagttacctactgtggaggtcaagtacaagaacctgaatgtaagagcagaatgtgaggttgttcaagggaaggcattgccaactctatggaactctttttctagctcactttctggtttcatgaagaatatatcgtgtacttctcaaggggcagagataagcattctgaatgatgtcagtggcatcataaagccatcaaggcttactcttcttctcggtccaccagggtgtgggaaaacgactttgttaaaggcactggctggaaaattagagcaatctctcaagttttctggagaaatctcttacaatggctacaagctagatgaatttgttccccaaaaaacatctgcttacataagccaatatgacctgcacgttccagagatgacagtgagagaaacaatcgacttttcagcacgctgccaaggtgttggaggcagagctgatctagtggctgaaatcagcaggagagaaatagaagaagggatcatccctgacccagatattgatacctatatgaaggcaatttcagttgaaggacaaagcgaaaatcttcaaacagagtatgttttaaagattctcggactggatatctgtgctgacatactggtaggtgatgcactagatagaggcatttcaggtggacagaagaaaaggctaactactggagaaatgattgtgggtcctataaaagctctttttatggatgaaatatcaactggcttggacagctccacaacctttcaaatagttacatgtctccagcaattggtgcacatcacagatgcaactgcagtgctttcactccttcagccagcaccagaaacctatgagttatttgatgatcttatattaatggcagaggggaagatagtataccatggcccccgaagccaagcactccaattttttaaggattgtggtttctggtgcccagaaagaaaaggagtggcagactttcttcaagaggtaatctctaagaaggatcaaaggcaatactggtaccgcactgatattccttacaaatatgtttcagtggatgaattctctcaaatattcaaatcaagttattgggggagaatgttaaatgatgagctctcacggccagatgataaatcagagtcccataaaaatgctttatcatttagcaagtactccttgggaaaattggatttgtttaaagcttgtatgaagagagagattcttctcatgaaacggaactcatttatctatgtatttaaaactgcacagctaacaatcacagctatcataacaatgacagtcttcatacgtactcagcgggctgtggacttgataggtgcaaactatttattgggttcattgtactatacacttgtccgcctcatgactaatggggttgcagagttaatcatgactattactagactccctgttgttgataagcagaaggaattctatctctatccagcttgggcatactgccttccatcggccattctaaagattccattttcagttcttgattctatagtttggacatcagtaacatattatgttataggctacagccctgaaataacaaggcaattactcatgtctcatggagttatattcactgcagcatcactaccacggtggttgaggtggggattttggctttctcccatgtcatatggggaaataggaataacactaaatgaatttcttgctcctcgctggcaaaagatccaagagggaaatatcactgtagggagggaggttcttaggagtcacggtttagattttgacagccacttctattggctatcagttggagccctacttggtttcaccatactatttgattttggatttgtcttggcattatcatacataaaacagcctaagatgtctcgagctttagtctcaaaaaagaggctctctcaactaagggaacgagaaacaagcaatagtgtggaactaaagtcagttactgttgatattggccacacaccaagggaaaatcaaagcacagggaaaatggtcttgccctttgagccactgtcaatagcatttaaggacgtccagtattttgttgacattcctccggagatgaaaaaacatggttctgatgagaaaaggctacaattgctctgtgatatcacaggagcatttaggccaggaattctcactgcactgatgggggtcagtggagcaggaaagacaactttgatggatgttctttcaggaagaaaaactggaggtatcattgaaggagatataagaattggaggataccccaaagtgcaaaagacatttgaaagagtttcaggttactgtgagcagaatgacatacattctccatatataaccgttgaagaatctgtcacatactcagcttggttacggttgccaacagaaattgattctgtcacaaaagggaaatttgttgaagaagtccttgaaacaattgaacttgattatataaaggattgtttagttggcatccctggtcaaagtggcttgtctaccgaacagcgtaaaagactaaccattgcagtggagctggtttccaatccatcaataatattcatggatgaacctacatctggtttggatgctcgagcagctgcagttgttatgcgtgcagtgaagaatgttgttgccactggcaggacgacagtttgcactatacaccaaccaagcatcgacatatttgagacttttgatgagttgattctaatgaaatctggaggacggattatttatagcggaatgctaggccatcattcaagtagactgattgaatattttcagaatatacctggggtgccaaagatcaaggacaattataatcctgcaacctggatgttggaagctacctctgcatctgtagaagcagaacttaaaatagattttgcacaaatatataaagagtcccacctttgccgggatacccttgaattggtgagagagttgagtgaaccactgccaggttcaaaagatttgcacttttcaactcgcttcccacaaaatagtttgggacagttcatggcatgcctttggaagcaacacttgtcttattggagaagtcctgagtacaacttaacacgtttcattttcatgattgtttgtgcaatcatatttggagcagtattctggcagaaagggaaaaaaataaacaatcagcaggatttgttcaacgtacttggatcaatgtatattgctgtaatattcttgggtctaaattactgttcaacaattctaccatatgtggctactgagcgtgctgtcttgtatcgagaaaaattcgctggaatgtactcttccacagcttattcatttgcacaggtggtcattgaaataccatatatcttggtgcaatcaattttatatgtggctatcacatatccaatgataggtttccattggtcagttcagaaagtgttttggtacttctacaccacattctgtacatttttatactttgtatatcttggaatgatggtaatgtcgatgagctcaaatctcgatatagcttctgtattgtcgactgcagtctacaccatattcaatctcttttctggattcctcatgccaggaccgaaaattcctaaatggtggatttggtgctactggatttgtcctactgcttggtccttgaatggcctcctaacttcacaatatggagacatagagaaggaggtacttgtattcggggaacgaaaatcagttggttcctttttaagagattactatgggttccggcatgacagattaagcctcgtggctgtggtgctcattgtttacccaattgtttatgcctctctgtttgcctatttcataaagaaaatgaattaccaaaagagataa

SEQ ID NO: 34410 - DNA, 756 bp, Glycine max
  Peptide Sequence Number=SeqID_151188
atggccaattccaattccctccctttcgcaccccaatcctttccaaacttcattgctgaaaagcttgatgattcgaactaccttcactggaaacagcaaatcgagccagtgattaattcaagattagatgctacctacctggcttcaatcgatgcttttgagtcgatcttatctcatgtccttggatcgatccactcgtatcaggtgtgggataagattcataaacatttcttcactcaaatgaaagcttgtgcttgtcaacttcaaacagacttgcacaccacttctctagaaggcaaaaccatgtgcaagttcttgagccagatcaagaacatcgctgatgagctcgccagtgctggaagtccaattcagcatgaagaatatgttgattcgatttgggaaggactgccacaagactatgctattgtattctctgttattgaaagcaagttcgagactcctccagtcacggaggtcaaagtgttgttactcgcacatgagtctgcttacatgtgtggaattgctggtcatagtagctactctgatcacgatggcggccaccatggtggtgatctgacaccacctatcagcctcatgaatctctggtgttgtatgatcctgctacactgcaacctgtgcagtatagtagctcacagtcaggctaactcgaagcctaatacttgggttaatccagcaaacaccaagagtcagaatcaacctgcttctactcaagctactcctagtgcaatatgctag

SEQ ID NO: 34411 - DNA, 633 bp, Glycine max
  Peptide Sequence Number=SeqID_151189
atgtttctggtacaggcaacatcaattaaagctctaaagagtagccttcagacagactatattttaaagatacttggtcttgatatatgtgccaatacatcagttgatataagaagaggtatatctggtggtcaaaagaaaaggttaactacaggagagatgattgttggaccaacaaaagcactctttatggatgaaatatccaatggtttagacagctccactactttccagattatctcttgtcttcagcatctggtgcatatcacaaatgccactgcattaatttcactccttcagccagcaccagagacctttgatctctttgatgatattgttttaatggcagaagggaaaattgtgtaccacggaccgcatgattatatacttgagttctttgaggactgtgggtttaaatgcccacaaagaaaaggcactgctgactttcttcaagaagttacctctacgaaagatcaagcacggtattggaatagctcagaaaaaccttacagttatgtttcaattgaccagttcattgagaaatttaaggatttcccttttggtctaaagctgaaggaggagctctcaaagccatttgatgagtctcagccacaagaatgcccttgtatttaa

SEQ ID NO: 34412 - DNA, 1591 bp, Glycine max
  Peptide Sequence Number=SeqID_151190
gtttcatgtacttcaagagtttgatgaagggaagagaagttgtcgaaggcgtttggcaggccacaataggaggaggagaaaaactcatcctgatgtctctgttgttaatgaaggctctctgaacgatcaaagggacagtaactatctgctgatgagtctgttacggatactgaccaatttgcattccaatggctcagatcatacaaggaaccaagatattctctctcatctgctgaagaacctggcaagtctggctggtccaaataatggtggaaggttagcacccttactggaggaatctaaaggcttggtaaatgctgggacgcatggagctgatcatgataaacccaaccttaactcaaatgctcctgaagcttccaggccttcttcttccatcaagacagacaatggcatcatcgctcaggaccctccaatgtcggtggtgcagtatgaaacacctgctaatggcatgacacaaaaatgtatagcttcaggtgatggagtaggaaatttaaaacctccttcaggaccactgctctcaaatgtatgtgaaccaagggacagcgttccatcccaattaactacagcagagactaaagtaggaaggggaaacttgaataacattgaccttaataatgtttacaatgatatacagaatactgttgagaatcataagaagccttatcctcctgtggcttcagggatggggtttattgaccatgcctcatggttgcaatgtgattctctcaaatcaagtcctccacagacaagtagaaactcagattcaacctctacccaatcaccatctagttccagtggagaagctcagatatctttactgataaagatactattttgccaaggtcatcatttgaagtccccttttcagagtcgcacagatcgaattgtttttaaactctttggcaaggatccatctgattttccccttcttctccgatcacagattctcaactggttatcccgcagtcccacggagatagagagctatataaggccaggttgtatcatattaacaatatatctccgtcttgaaaaatctgcatgggaggagctctactgtaatctaggatcaagcttgagaaagcttcttgctgcatcaaatgattcattttggagaacaggatgggtatatgcaagggtgcagcacgctgtagctttcctgtataacggtcaggtagtcttagatgtgcccttgcgtctcaaaagcccacaacattgtatgatttcatgcattaatccacttgctgttcctgcaagtgctagtgctcagtttattgtgaaaggtttcaacctttcccaatctagcacaagcccagatgttgatctgttgctaatgatttccaggttgcactgtgcacttgaagggaagtatctggtacatgctagttgtcatgatttgataggtggagctgatgcacccattcagcatctaagcttctcttgtcaaataccaagtgtaactgggagggggtttattgaggtagtatcaattcatcatactccaaaaattgtatgctgtaaaattcctgaaactaacagaagaacacaaagctctggtgcttgcttctga

SEQ ID NO: 34413 - DNA, 402 bp, Glycine max
  Peptide Sequence Number=SeqID_151191
cctacatatagagaagcatgctttgcaaagggttttttgcaagatgacagagaatttgtggaagcaatcaaagaagctaaggactggggtgtcattactaaacctgaagaactttggagtcagacatggaattggttggctgaagacattgcatatcattataaaaaaacaactctgaacacagaattactcattgatgatgagcaacttaaaaatttaacattactggaaattgaaaaacttctgcatgcaaaccaaaaatcactcagagactatcctacaatgccatatcctgagggtggaaatcctgcatcatgtctagagaatagcttgatattgtctgaacttaattacaacaacgatgaggctagatcagaattcgaaatctttttctatggatga

SEQ ID NO: 34414 - DNA, 273 bp, Glycine max
  Peptide Sequence Number=SeqID_151192
atgcgtttactaggcaatgcccaattaattgatgatcaagaaactactaaatttgcaaagtggattctagatattggagatggagttattgggaatcaaaatgatggatatgctaccattgaaattcctgagtacctactgattacggaatataatgaccccattgatgctatagtcaaatcaacatttccagatttatatcaacatcacagtaatcctgaattcttcaaatctagagcaatattagcttccaccaatgaaatagttgaagag

SEQ ID NO: 34415 - DNA, 696 bp, Glycine max
  Peptide Sequence Number=SeqID_151193
atgtggccggtgcgcgggcgcacgctgcacggctttggcgaacagcagcagggcgagctacgctggaaaggcatggtgatcgaagcccgcgaaggcagcgaagtgaaagccgtcgccgatggccgcgtgctgctggccgactggctgcaaggctatggcctgatggtggtggtcgaacacggtaaaggcgacatgagcgtgtacggctacaaccagagcgcgttggtcaacgtcggggcgcaggtgcgcgccggccagccgatcgctctggtcggcaccagcggcggccagggaacgccgtcgctctatttcgaaatccgtcgtcagggacaggcggtttacgctgcgcaggcaggaaaactctccatcgtcatcgatgacgtgggctaccgccctcacgaagaaaacgcggtgctgcaaatgccgacggcgatctcggtcgcggtgttgcccaacgcgccgcatgcccgcctgatggccacccgcgcccacagccagggccgcgaagtcttgatccacatgccgatggcgccgctcagcaagcagccgctggagcgcgataccctgcagccttccatgagcagcgacgagatccagcgcatcatccgcaacgcggtgaataacgtgccctacgcggtcggcatgaacaaccacatgggcagcgccatgacctccagcctgccgggcatgcagaaa

SEQ ID NO: 34416 - DNA, 1626 bp, Glycine max
  Peptide Sequence Number=SeqID_151194
atgaggctgggggaagatgtgcagcattctagaggagctgctggcaaagtcctcctgttcaagagcagggtatggttgctggctggatggtgggcagcagggagagagccaatccctgagagtgtgcacgaagaggtgaaggagtctgagtggacgaccgtgagtcataggaagcctcggaacttcccaccacgtcgtcatggcaggagtgggaaacgcgaggaagaccaccctcaacgaaggaactggagagatagaacagacattacttcattttacttcactcgttttcatgatgaggtaactgaaacggagttgtggacccatttccgtaagtggggagacgtaaaagagattttcattcctaagaggagaaacagagaagggaggaggtacggttttgtacgctacaaagggatctctgataaaagaagaattgaaaaggaactggacagtagcattgtaaagggccttaagctccatgttaacgctccgaaatatggaagaggacagacgatgttggaacagtacaagatcgttcctgcgaagaaggggaagggagtggatgtttatggccaaaaagaagaagcaccgctcaggacaacggggaacaaggtacttcggaagacatatgcagaagcagtggccgtatcgtctgacagaaacacacctgggacaactgcagatgttaagctggttagctatgggggaccacaacctcagataaccttgaagatatcggagggagatatacggcgatacgaaaatacgtgggtgggaagaatgaagcagttggaaatcttcgagcgtttagaagacgaggttttatggaaactgggaccagcggagatcatggcggaagaaatcgaacaaggttcatccttgttttactcgttgacgaaatggaaatcgcagctacataccggaaacaggctaatatggctccgatgctggggtatcccattagtcgcgtggtcgatagataacatccgtaagatggtggcggtggtaggtgacctggtggaggtagacgacgacgtcgaacacatgcagagactcgaccgtgcccgagtcttggttagaactcctcgaccaccgctaatacaacaggtagtagaagttcatgccggaggagaaacttaccgcgttcacttggtggaagaaaacggcggcgacgggctgagtaataggcgtcgcgagaggagtacttgggagtcttcggaggagattttatcggacgccgacgatattgtcagtgtccgatcttggagagacacggcggcgccgtcatcaccggacggtaaccgcgaaggcgataggcgcgaactgcactctacccttttacccactggtctcgacatagctgttgacccagtgggtaaagaccaccatgcaagggccctctgtccagttcagatgttgaaaagaacaccggacctaaagaggaaaggatttgaatccatctctagtcaacacataccatacctgccagttgacgaggaagaggaaattcccagtacagagatatgggtcaacttagatgagaaaagagagcttgaggccagctcagcagtaggagcttctgaaaatgtccattttgagcatgtgttaaagcttggtagaaat

SEQ ID NO: 34417 - DNA, 633 bp, Glycine max
  Peptide Sequence Number=SeqID_151195
atggccgaggcgggggtggtttcaaccatggaggtggttgcggtagtcggagctcagtctagtgtcaatggtggtaacaatagcaattatgggaatagcaacaatggcaattatgggaataacaacaatcataataactgttcacagcaaagtcagaatcagaatcataactctcagaactctaattctagccctgcacaagctatggtggcaaattctgactgcaatgcttcatcatcttggtttccagattctggagcgtccttccatgtgaccaataactcacagaacatccagcaaacttctccttttgagggtccagaccagatctccattggcaatggacaaggtctgaatatctcagccgctggtcattccaattttgtttcccctttcagtcctaatgtcaaacgtattcttaaaaacatgcttcttgttcctcaaataactaagaacctaattagtgtaagcaaattagccaaagataatcatgttttctttgagtttcatgctaattgttactttgttaaatctcaagattccaataaaatcattcttcaaggagatgttggatctgatggcttgtatcaatttcccaatcttcagttctgctctgttgtccagcttgtataa

SEQ ID NO: 34418 - DNA, 1482 bp, Glycine max
  Peptide Sequence Number=SeqID_151196
atggaaagaatagaaaaagtggtcaagatctcagagcaagagctagaccgagtgaagcaaaataggaatgaggtggcagggataccaaggaagcacttggaggagaaggtggaagctctggccagccaaggagagtgggcaacattcatcgatgtattagctctactagtgtttgggacggtactattcccaaatgtagacgggttggtggatttagcggcaatcgacgcctttcttgcttatcaccccaacaaggcaagcccagtcatcgctgttttggcggatgcacatgatacattcgacttgagatgcaagaagagcagtgcaagaattgtctgttgtacgcctgttctttatgtatggttggcatcccacgttgcttatcatgaaggcatgacgggagcgtccataagttggttcccacggtggaaagaaggaggggcaggagtgttatactcatgtttcattgaagctaatgcgaagatacttcagagaatccgtaaagcatggaatacaatggaaagaaaagataaggagcttaggggaagtagcaatggcgtcataggcgactatcacaaatggttgaagtctagaatgcaagggataacttggctcccaaagctaacaggtctaagtgggaaagaggctgaaattcctgaagagagtgaagaagtgcaagctttgaaagcggagctcgaaaagacaagactggtgaaggagaagctgaaggtggtagtcactagggtcaggaaagaatgtgataagctaaaagatatcaacatgaccacggttgaagcattagagcaggaaacgaaaaaagcccgaaaggaagaatggagcaggaacacattccggggggctttgtggggcagcagtaacaagctcaaacttagaaaggccgagagggacaaatcaaggatggaaagtatgaaggagaaggtgaacttggctgctagtcacgggcagatgctgcaagatgaacaggcaaaggtattggctctacagattgaaagggaagcgagagaaggggtgatagagttattgcacaaggaagccatgaaatggatgaatagatttgctctcactcttaatgagagtcaagagcgtccaaagttgttagccagagccaaggcagtggctgacacatactctgctcccgatgaagttcatagtcttctcgattattgccaacacatggctagaatcatgagcgagatagaggaagttcaagaacagatgaaggccgacatggaggccatgaaataccaaatgaccaccatgatggaggccatgatgagcatgaggaaaatgatggaggtcaatgcggctgcagccgccactataagtgccaccactgagagcaagcatcctttccgatcgtatggcctgcctcccaactacgcaccacccaatgttgtacatgtgcccaatgagaacgtcaaccactccgctcctataccccttgagaaccaacaaccctag

SEQ ID NO: 34419 - DNA, 1506 bp, Glycine max
  Peptide Sequence Number=SeqID_151197
atgagtatcactagacagtgtccccttggtggtgggggtcatcacgtattggactacttgaagcatatgcaggcagagaatcctgctttcttttatgcagtccaggatgtcaataatctcgcgtgtgggaatatattttgggctgatgcaacatctagaacaaactactcttattttggagatgctgttatattggacacaacctacaagactaaccgatgccgggttccatttacctctttcaatgggttgaatcatcatgggcaacctgtgttatttggttgtgcattgattttcaatgaatctgagtcgtcatttatatggctattcaggacttggcttcatgccatgtctggccgccaccctgtctctattacaacagatttggaccctttcatacaagttactgttgcccaagttctcccttcaactcgccatcggttttgtgaatggagcatattcagagaaacccgaggcaaactggctcatttatgtcagtcatatcctgcttttgaaactgaattcaagaaatgcgttcatgaaagtgagactattgatgagtttgagtcttattggcactcactcttggaaagattctacgtcatggacaatgagtggcttcagtcaatatacaactcacgacaacattgggttcctgtgtacttgcgggagactttctttggagagatatctttgaatgagggaaatgaatatttgatttctttctttgatggatatgtgaattcatccaccactctacaggtattggttagacaatacgagaaagccgtgtcaagttggcacgaaaaagaattaaaagcagattatgacactactaatagtagtccagttttaaaaacaccatctcctatggaaaaacaagctgcgagtctttacacgagaaagatattcatgaaattccaagaggagttagtagagactcttgcaaatcctgctataaaaattgatgattcaggaacaatcactacatatcgagttgccaaatttggggaaaaccaaaaatctcatgttgtgacttttaattcttttgagatgaaagctagttgcagctgtcagatgtttgaattttcaggaattatttgtaggcatatactgtcagtcttcagagctaaaaatgttctcactcttccatctcagtatgtgttgacatgctggacaaggaatgctaaaaccggtacattgttagatgaacatgcatctgaattgccaagtacttctcgtgaatctgtaccagtttgttataacaatttacgacaagaagcaatcaaatatgttgaagaaggtgcaaaatcaatccaaatctatcatgttgccatgagagctctgaaagaagctgctaagaaggtttgcaccataaaaaatcagagttctggaacagcagagggagctacagcaaccaatggaagcaggggtgaattgcttgtagcagatgaagatgttccaagcaatcaatctgtgatgataaagccattaggttctcactag

SEQ ID NO: 34420 - DNA, 264 bp, Glycine max
  Peptide Sequence Number=SeqID_151198
atggcgggtttaatcaccctcctaagtggcaagggtgcatatataaaggaggggagggggggggggcaaccagacccaaccacaattaggcaacagggttggaaaaaccctatgtgcctcaaccctaaaacgtcgcagaaaaggtggaaaccaccacggagggtggcacgcctccacgaatggtggcacacctcctcggcaccactggtgcagggccaacggtgcaaggcagccatagggatggcagaggcaatgaaaacttaa

SEQ ID NO: 34421 - DNA, 312 bp, Glycine max
  Peptide Sequence Number=SeqID_151199
atgttgagtcctctaaaacataaaggcaaggatgctgagtcctatgaaactaaaaagcaagggacgttaagtcctgtgaaacataaaggcaaggactttgagtcctatgaaactaaaaaggaaaggatgttgagtcctgtgaaacataaagacgaggacgttgagtcctatgaatctaaaaagcaaaggagattgaatcttgtgaatcataaaggcgaggacattgagtcctacgaaattaaaatgcaaaggacgttgagtcctgcgaaacataaaggcgagaaggttgagtcctatgagacatgccaatag

SEQ ID NO: 34422 - DNA, 192 bp, Glycine max
  Peptide Sequence Number=SeqID_151200
atgagggatagagagcaacatgacatgcaaatttgtaaaagaaccaaagataggcctagagccatccagcacagccaccaatcaaagcatttgattatggttttacatacaactcacctcacaaacattgcaaagaaagcaacaaataaagcactaaacatcacaatgcaaagcgcacactcacccaggtga

SEQ ID NO: 34423 - DNA, 501 bp, Glycine max
  Peptide Sequence Number=SeqID_151201
atgggtaagggttggggtcctggtgctgctggtgcagtgtatattgatagaagctatcgttcaactgcacctggctcctatggtttgttgtctgttggtcaaccaaatgctgcatgtatgcgtgcatctggagctccatcctctgcatgtgagctgagatggactctagggacggtggctgatgtggaggcaatggtggtgcgtctgctgtcggttgttgttactggtcttgccccggctgttgtgcctgcctcggcatgcgaactggcagaggcctgtgatcaatgctggaaatcccagtgccctattggacttctttgggatagcgtagaccaactggcatttaggaagcgggagattagaattatggtcactgggaaggatgttgctgagcagaagcgtcatacagatctgagtgaaagtggtcatgctagtgcgcatgatccgtacccgcctccctgctatgctctgtgcacaatcatgtcccggggagcacagtag

SEQ ID NO: 34424 - DNA, 1128 bp, Glycine max
  Peptide Sequence Number=SeqID_151202
atgaatttggcggtgtcggcgttgggagggtggagggtgtgcaatggagcaatgtttttgcttgagggaggcggtaatggtttgggaatgggaagtgggagagtgtgcagtcggagtcggagtgaggttagtggagtcagagtcggagtgaggctggatggacctgtgcccctaaaagacgacgttttggaaaaggaagtggttttcgagcagtgcgtgacgcggactctgtctccggcgttgacattggaggagggacttgagaaactgaaggaggctctccaaatcttgaattctccttccccttcttcccctactggattccttaggtttcaggtggcgctccctcccagtcctaagaccttcactttgttttgctcccaaccccactcctcctcggtctttcctctcatttatgtttccaagaacgatgccgactctaaatcactctatgtcaatttggatgataatgtgagtcaccagaaagaaagccgctcccagattgagttagatgagctggaaagtgtttccattctgtcaatgacccttgcatgggatgaattttccttctctacttttcaagaagcccattattcgcttcaagtttctctagaccaggtgcctggtacgataattggaaatgaagatatcaatagtattaggtggcccggttctgcatggagacgcctcaaggatacattatacttggagaacatagaggaaagggaaactgggggcacgcctccaataatccagacagtgagagcatgggacctgatacttatgtggcaaggtcaaggcatttatctatggacttttgagctagaagtgatacagattgataaattaaggtatcaagatgtcttatcgaaggggttccgttcagccgccgataaggtggatactgcggactcagactgctgggaatttaggagccaattaaagagtatgaaaggatacattatacttggagaacatagaggaaagggaaactgggggcacgcctccaataatccagacagtgagagcatgggacctgttgtccagttgaagtccacaccaaaggaaaagcagaagatgcaagagagggatgatggagtgatagcagctagaagtgatacagattga

SEQ ID NO: 34425 - DNA, 391 bp, Glycine max
  Peptide Sequence Number=SeqID_151203
atggcattgcatgaaatggatgccgtggcggaagaaacgcctatgtctgccacacgtttatggacaacacgcctattggtcgcgttgctggtgctggcggtattggcaggcatcggttatggcatcaaaaaactgttttctggtggcgccacacaaaaaaaacaaattacgacggtgaaattgctccctgatacaccgccgcccccaccgcctccgccgcctaaagagccacccaaggaaacgccaaaggagcagccaaaagaggcccccaaagagccagagccaaaaccagttgaagcgccgcctgccgagaacctgaagatggaaggggcggctggcgatggacctagcccgttccagtcaggggcagtcaacaatgaatacaagggcg

SEQ ID NO: 34426 - DNA, 591 bp, Glycine max
  Peptide Sequence Number=SeqID_151204
atgactacaccacccaactctcatcctcctcctcctcctcctcctgatgcaacatcacatttcccttctaccttgaagcgaacaagaaaagccacacgcctaagatcattggcgactagactagttgggacagaaagacccctggcccatgtggatcctgcaacggggaaagccgacagtccctacagaaagaagttaagaacatatttggggattgtcactcgcgataaggtagatgtgacatacgagaattggaaacaagtctctgccacccaaaaggatttgatatggaagaatattcaggctgaatttgatatccctgaagcatttgatctgtggacaaaaaagaaaatacttcagacttcgacaaggacgatgtcgatgacactgtttgcgaaaagtacgacattagcaaggaaaaatggacccaattttgtcacagttgcagagaccctttgtggaaggatgtgcaaaaaaaaaggcacaggtcattcaaaaacaaaacgctgcccctcactcacgtgttatctcatgggggatccgttggaggagcaggcctcacagggttcctttgtcgcctatggacgttag

SEQ ID NO: 34427 - DNA, 356 bp, Glycine max
  Peptide Sequence Number=SeqID_151205
gatacattatacttggagaacatagaggaaagggaaactgggggcacgcctccaataatccagacagtgagagcatgggacctgctgtccaggtgaagtccacacgaaaggaaaagcagaagaagcaagagagagatgatggtatgaataatggatgtggaatagtttctactggtattagtggtgcaagctactgcaccggaactttcaatactgtcgattgctctccagatggaaggtatgttctagtgtcaagtcggggaaacttctacctaacctgggagtctggttgtggaggcaagtcaagattttgtgccacttattttgaggcaagtcaaaatgtgcagtggctttaa

SEQ ID NO: 34428 - DNA, 1752 bp, Glycine max
  Peptide Sequence Number=SeqID_151206
agagatacagtgagagctggagagaggattcccaccagaatcatgccggaattaggaatggaggccactgtgaaagacttatggcaccatttcaagaagtttggtgatgtaagggaggttttcatctccaagaataggaacaagaatggtagaagatatgggtttgctagattcaaaggcgtggaggatgtgcatagtctcgaaaagaaacttgatgacatcgtctatggtggcctaaagatgggagaggaggcaattcggttaaggcagctgcaacccaagtcgaacaaagggtcgtatgtggaggttgtgtcagggaataaaagtggaacaggctcaaggagaccagtaggtagtgaaattcgcagttatgaagggtcatggtcatcggtgtatcttgatgtgccggaaactgagtttacccgggtcaaggaggcatgggtagggaggttaaaaaatttggccatgtttgataaagttgaagatgatttgtactgggacgatggagaagatgtagtgccgaagtacatgggggacgatatgatcttattattaggcctcaccgacgaaagagccaagcagatgacagaggaagaacacccgaagctgtgcacggggtatagactaacgtgggtcaattgctggggtataccactattggcttgggacaccaaacaaataagcaagattatggctgccattggtgatttggtggacgttgatgacgatgtcaaagtggttaggaggctggacaggacacgggtcctgctgaaaacatcacgaagaccactcaaacaacacatagtcaatgtacatatccatggggagatgcacagtgtgcatatagtggaagaaggcagaagtaacccagagaggggtcattgcaggcgatggtgtgagtatggatcatcggaggagatacaaacaatagatagtgataaggacgatgaatgcgatttcacgatggcactcagaaatgctgaagtgcagccattatcaaatgaggcgctgccggaggggggatcgagctatgtacctgggcaattacctaaccgtcgcgagatgatgttggcagctgagcaggaagcgtcgccgacgatggacgcggcggtgaactcgaccgagcaggactcgacggtgtacgaagctaaagaagaggagctcgcggctgcagccaaagaggaggagggcagacaaacgtgcttgatcgacacagtggagacccatacccaccgacagctagacgctcagacggaatcagaaccacgtcagcaagagaagaatatggaaggtggatcgggccttgctatccacacccccctcacttcacttcatcaacacctctttagctctcattcacctaatttgcaggtttactcacgaaaaaaaaaattccaaaagaaattgcacctaggctgcagcacagaaggccccatttcagccacaaacccaaaattaaagaccaccatccatagcccaaaccatcatcagctcggggtcgaggacaaagcgggtttagaccaagtaggaatcagttctaacatagataaaagcccaattcaaatagactatgaggaggaagaaggtgctaccaagcagaagcaagaagctgcagcattatgggaaatggcaaaggaattgggggtcacttgtgggccacagcaaaacaattatgtgagcaaattaatggaaatggagaaaagggataaaatagaggcacagagcgtgggaagtaggaggggtatccaatga

SEQ ID NO: 34429 - DNA, 579 bp, Glycine max
  Peptide Sequence Number=SeqID_151207
atggggatgtgcgtgaagctgttgataccacaacctcaaccaatgaaggagaatgggttaaaattcccatcatgggttaatgagaaggacttgtggcagaaatttcaaagatggggaaaggtaagggaggttttcatccccaagtataaaaacagagaagggcagagatttggttttgtcagatataaggacgtggaagacgcagcggggctggaaagaaaactagataatagtatcttctttgatgggaggaaaatgttcgttaatcagcccagattcgaaaggaacaagggggccataaggaagcaaaatggtaacagtctgcctcataatgttaacttgcaaggtgtggacagacgtagacaaggaggcttggaaacgtgtgttaatggcggcagactttgttcatacgccgaggtagttaaggtagctcagttgggaacgagtgtcctttgccaccagaatgaaaaaccccaactcgttgaggatgtgtcgacagcagtcatcctccagactaaggctatgcagttgattcaggaggagaggcagaatggttccactccgatcatggacctttag

SEQ ID NO: 34430 - DNA, 444 bp, Glycine max
  Peptide Sequence Number=SeqID_151208
atgcctgcatatgctaaattcatgaaaaaggtcttgacaaagaagaaaaacattgaaaaggataacattgaggtcctagttaagtttgttccacattattccaattgttgtaactattccgcaatcaagcaatcgagcttacctcggtatgtctacatgtcagcattctccaacttgatgtttgttaaagggtggtcaagtgatcggcagggctttggtcttggaaccgcaactgaacagcactgcctaggtgcaggtgctgtagttggttgtgccaatgagtttttcgcaggagataaagggtcgtttgtgaaagtcatgacagaggaagcagatccaaaattagatgaagccatcgccaaagagcaactaaacacaactaaaaggagccaaacagccaaaaaggatcattggaggaacaggagcacaccggagtgtagatag

SEQ ID NO: 34431 - DNA, 141 bp, Glycine max
  Peptide Sequence Number=SeqID_151209
atgggtgttgaccatcccagccaagttgacggtggtgttgccgcctccgcgcatcggcattgtcgaggtgagtcgcgaatggacgctgcactcgacgccatggaaccctacgacttccccaacagactcgaacgaaattaa

SEQ ID NO: 34432 - DNA, 201 bp, Glycine max
  Peptide Sequence Number=SeqID_151210
atgggtagttcaagacaacttggagagacttggcaacaacttctaaagtttaggaagaccaagatgtcccaactaggcatgtttggtgaggaaagatgtggtagcaaaacacattttatggtggagcgaaggggcaatagagattatgagactcgcatccaatgccaatcgtctctcccgagcttcgatcctacaaggtaa

SEQ ID NO: 34433 - DNA, 2952 bp, Glycine max
  Peptide Sequence Number=SeqID_151211
atgttcgccacctttcgactccttcttcttctctcattcctctcactactcaccagcgcccaatccgaagaccagcgtcaaatccttctgaacctaaaatccaccctccacaattcaaattccaaactcttccactcatggaacgccaccaattccgtttgcaccttcctcggagtcacttgcaactccctcaattccgtcacggaaatcaacctctccaaccaaactctctccggtgttctcccgttcgactcgctctgcaaacttccgtcgcttcaaaaactcgtgttcggttacaactacttaaacgggaaggtttcagaggacattagaaactgcgttaagttacagtacttggacttgggaaacaaccttttctctggtcccttccccgacatatctcctctcaaacaaatgcaatacctgtttttaaacaaaagtggattttcgggaacttttccgtggcagtcgctgttgaacatgacgggtctgttacagttaagtgtcggagataaccctttcgacttaacgccctttcccaaagaggttgtgagtctcaagaatctcaattggctctacctatcgaactgcaccctcggatggaagcttccggtaggactcggcaacctcacggagctcaccgaattagaattctccgataacttcctcaccggcgattttcccgcggaaattgtgaaccttcggaagctctggcagcttgagttcttcaacaattccttcacgggaaagattccaaccggcctgagaaacctcacaaagcttgagcttttggatgggtccatgaataaactcgaaggggatttgtctgaattgaagtacttgaccaatctggtttcgttgcagtttttcgaaaacgatttgtcgggggagattccggttgagataggcgaattcaaacgcctcgaggctctgtctttgtacaggaacagattgataggtcccattcctcagaaggttggttcctgggccaagtttgattacatcgacgtgtcggagaatttcttgacggggacgattccgccggatatgtgtaaaaagggaactatgtcggcgctgctcgtgcttcagaacaagctctccggcgagattccggccacctacggggactgtttgagtttgaaacgattcagagtcagcaacaactcgctctccggtgccgtccctctttcaatttggggattgccaaacgtggaaataatcgatattgagatgaatcagttatcaggttcgattagttcggatatcaaaaccgcgaaagcactcggttcaatattcgccaggcagaaccggttgtccggtgaaataccagaagaaatctcaatggcgacgtcgttagtgattgtggacctgagcgagaatcaaatctttgggaacattccagagggaatcggcgagcttaaacaactaggtagccttcatttacagagcaacaagttatcaggttcgataccggaatctctaggttcctgtaattccctcaacgacgttgacctatctcgaaattcattctctggagaaatcccttcctcgttgggttctttccccgctttaaattctctgaatctttcagagaacaaactctcgggtgaaatcccaaagagtttagctttcctcagattgagcctctttgacttatcgtataaccggttaaccggtccaattccacaggctctaaccctagaagcttacaacggaagcctctcgggaaaccctggtttatgcagcgtcgacgcgattaactcgttcccgcgttgccctgcttcctctggcatgtcgaaggacatgcgcgcgctcataatatgcttcgcggtggcttcgattttgttgctctcgtgtttgggcgtttacttgcaactcaagaggaggaaggaagatgcggagaaatacggagagcgttcgctgaaggaagaaacgtgggacgtgaaatcgttccacgtgttgagtttctcggagggagagattctagattccatcaagcaggagaatctcataggaaaaggaggctcggggaacgtgtacagggtcactctttccaatgggaaagaactcgcggtgaagcatatttggaacaccgatgtccctgcaaggagaaagaactcgtggagtagcacccccatgcttgggaacaagcacggtggtggtgggaagtcaaaggagtttgacgcggaggttcaggctttgagctccataaggcacgtgaatgttgtaaagcttttttgcagcataaccagcgaggattcgagcttgttggtgtacgagtatttgcccaatgggagcttgtgggaccggcttcacacgagtaggaagatggagcttgattgggaaaccaggtatgaaatcgcggttggggcagcaaaagggttggagtatttgcatcatgggtgtgagaagcctgtgattcatagagatgttaagtccagtaatattttgttggatgagtttttgaaacctaggattgcagattttggacttgctaaggttattcaggccaacgttgtcaaggattcctccactcatgtcattgccggaacccacggatacattgctcctgaatatggctacacgtacaaagtgaatgagaagagtgatgtgtacagctttggagtggtgttgatggaactagtaactgggaaaaggccaactgaaccagaatttggggaaaataaggacatagtgagctgggttcataacaaggcaaggagcaaagagggacttaggagtgcggtggattcgagaattccggagatgtatacagaggaagcttgcaaggtgttgagaacagcagtgctgtgcacggggactcttccggctttgagaccaaccatgagagctgtggttcaaaagcttgaggatgccgagccttgtaaattggttgggattgttattaccaaagatgacagtgaaaagaaaataggagtcaacgacaagtaa

SEQ ID NO: 34434 - DNA, 153 bp, Glycine max
  Peptide Sequence Number=SeqID_151212
atggcaacatcacaaacggcaaaggcggaaactcagctccctggacaatggcattgttcgccaaaaggaaaagcttcaacattgaccggtccatggtggaattgttacaagtcttcatatttgaagcactgggagatacagtcattgacttag

SEQ ID NO: 34435 - DNA, 638 bp, Glycine max
  Peptide Sequence Number=SeqID_151213
atggctagtggctaccatattggacagtgcagatgtagaacattcccagcactacagaaagtcctactggacagccctgctccagatctgaggaccagttatagggaatttgaggaagagagaaatgtgaaccaatacccagaagaaggagtcagtcaaatccagaatgtgagaaagtctatggaacaagagatgcagattcttcaattaaatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 34436 - DNA, 513 bp, Glycine max
  Peptide Sequence Number=SeqID_151214
atggcccagtctaactcctcaagactcgggtttcctgctcttatcacagctttatgcaggaccagaggagttgcctctgacagtcttttctttgaacatttgagccagatcattaatttggcctacataaggaagaattgttggaaccctgatgatccaataattattattaggggggccagaagaccaagggcaaggccaactgaggctccttctacatcagtagctcctcatctagctgctacatcagcagctcctcctctagctcatattgcagcagctccttctaccctacctcttgtagattttcaaagtttcgaagccatgcttcaaagcatacatcaggggcagattattttgctgcaaagtctccacctggtagcgcctctagacttcatccctacagtagagcaatttaatgaatgggtagcctggccagggactcaacctcctcctcacagggacgatgaggatcccgccgctcaggtaccacatcatccagcggatgagtga

SEQ ID NO: 34437 - DNA, 288 bp, Glycine max
  Peptide Sequence Number=SeqID_151215
atggccttttcatcatggcagaacaagctaaacaggcaaatggctacaccacccaactctcttcctccgattggtgcagcatcatcgtcaccatctaccttaaagcgcacaagaaatgtcacaaggctaagagcattggcgactagaccagttggggcagagagatcgttggtccatgtcgatcctatgaccgagaaggccgactgtccccacagtaagaagttaagaacatatttggggatcgtcgctcgtgataaggtcgatgtcacatacgagaattggaagcaa

SEQ ID NO: 34438 - DNA, 519 bp, Glycine max
  Peptide Sequence Number=SeqID_151216
atgacagtttggtatacgggaactggtgataagggtaagacaaaattaccttcagttggtgagatttggaaggatgacgatattgtaaatgctattggagaccttgatgaattaaatgccagtttaggtgtaatttcgtccctttatccacaactccgtgaaattatagtgagagttcaatcagacatattctcgctctcctcggaaattgcagggttcaacttgaattttgaagaagataaggtagaatggatagaagaggagatcaataatttctctaagggtttaccagagttaagaaattttattttgcctggtggacatatcgcatcttcatttcttcatctagctagaaccgtatgcagaaggagtgagagaagtgtagtaaagctactaaagaggaatagggcaaaggacgtccacgttaaatatcttaatcgcctatcctcactactatttgttttagcgttatatgttaataagcaagagaatgtgcaagaaattatatggaaacgttaa

SEQ ID NO: 34439 - DNA, 426 bp, Glycine max
  Peptide Sequence Number=SeqID_151217
atgggtgaagtagaggaggtgcaagagcagatgaaggctgacatggaggccatgaaagagcaaaaggccacaatgatggaggccatgatgagcaagaagaaaataatggaagccaatgcgattgcaattaccgctaccagcactgttgctaaggtgaacctgacgctcccatctggcctcaaccaaatgaatcatccaacctcagttatggtaggcaaagatttgggaacgggtaaaaaccctcatgctatggcagaaatgggaaaattggatcatctagaggaaaggctcagggccattgaaggacgcaaagattacgcctttgctatcctagaagagttgttcctagtacccaatatcatcacccctcccaagttcaaggtgttggactttgacaaggggactacttgcccaagaaccatctaa

SEQ ID NO: 34440 - DNA, 861 bp, Glycine max
  Peptide Sequence Number=SeqID_151218
atgctttctttatcaaacttggtccctacctcacacacatcagatatcactctggataaggccaagttgatttatggaatagttcacaggatggacatgaatgtgggctacttaatttctcatcagatctctatgatcgcccagcacgactcctctaggcttgggtttctagccttaatcattgttttatgtaaagctagaggagtcacttctgattctaggatgctggagagtcttagccccgctattaatttggcatatgtgaaaaagaactgttggaatcttgatgatctaatagtgactttcagagggcctaggaaggccaaggagaagaaatctaagactctcccatcttctgaggttccccctaccacatcagctccttccacattagcaccagtttcttctaccccagctacttctgctccatcagcagctcagctaccagttttagctccttttacttctggaccatcagatttttcttttacaccagagatgctacatgccatgatgcaaagcctacaccaagggtatatcattattaagcagagcttccagagcttgggcctaccatctatcatgagcatggaagactttcacactcaggtggcttggccaggattccggccttctctttctggagggggtgggacctccgcaacccaagagcttgagcccacagaggtgcataaaccagcagtggaggatgagcttacttctcttgagcccttttcatttgcttatgattcagttatggctcaggaggaagtaccttcactagagcttattccagaactatcccctgcacctatctctgaggatactctgccatccacaccagcattggagcaagagtag

SEQ ID NO: 34441 - DNA, 405 bp, Glycine max
  Peptide Sequence Number=SeqID_151219
atgagtggaagaaactactcgtatcatgaatttgagtctcatgcaaatgaggcttttctgataccaatagtcgaaggggacattgcatcacagaggtgctcctgtgcgagaaaatatactaattttaggagggatgatatgttgggaatggaagatgttgccaagaaatttgaacaggaaaaagatatccagttgaaagttaacggaaagaaaaattgtagctgtggagcaaacacgttaacatctatgtcaatgtcatgtattttctccattgccggaaatgaatgcatgcaagatcaagatctccagaataatcgcattccactcacacgtgttgatagcgggcccagcgagagctcagcccaccaaggatggaagatcaacaagagacgccgagtccaataa

SEQ ID NO: 34442 - DNA, 651 bp, Glycine max
  Peptide Sequence Number=SeqID_151220
atggacttgacatggttgagtgccatcctggtgggggctggttaccttgctttgggttacttcattggttctcagtatccccctcgtttcctcttctcacataaattatcgactaaacataaagaagatgcttcacttctcaatgacaacgacaataagaagaggaatactaagtccaaactcaaagaccccctggagattgaacaactcgctgaaatcctcgatgattttaagatgatactcgttgtcaggaatgatcttaaaatgggtaaagggaagattgctgctcaatgcagtcatgcaacgttaggtctctataaaaagatccttcgtcgagcaccaaaggctttgaataggtacttccataaccttggttgcccttgcaggtgggagatgtctgcacagcctaaggtggttgtcaaaattgaaagcgaagaagatatgctggctttgcaaggagaggaagtgagggacttcattcaacagaaaagtttgatgtacaaaaatgctaaattaaaaagaaaaaatcctgaaagggctaaatctctgaagttacctacccatatcacaattgacgctgggagaacacagattgcaccaagacctgttgaagtggtagatgaggtaacaggtggtctgaaactactatag

SEQ ID NO: 34443 - DNA, 2700 bp, Glycine max
  Peptide Sequence Number=SeqID_151221
atgaagagaagaacccaattccaatctggtgcgtgtgcgtgtagtgttgcggtggcgaatgaagctccgatatgttcgcacggaggtccccgcctcagccgccaccacccgtattctccacagacacttctccgcatccaaaccggacgaccaaaacgatggtcgttttgtgtcactcctctgcgacatcgtccgaggaaagcagagttggaaggtggctttcaacgacgcttcaatttcatcgacattgagaccccatcacgtggagcaagtgttgatgaacaccctcgacgatgccaagctagctttgaggttcttcaactttctcggtctgcacaaaaacatgaaccactccacaacctccttcgccatcatggtccacgcgctcgttcactccaggctcttctggcccgcgaattccctcttgcacacccttctccttcgtgggtcccacccaaaatgcgttttttccctctttctacactctcacaagcgatagtttttgatgctgtggtcactgtgaaactcttgtttgccaacaatttgttgcctgaagttagaacactgagtgccctcttgaacgggcttctgaaagttagaaaatttataacagtttgggaattgtttgatgagtctgtgaatgcgggtgttcgacctgatccttatacttgctccgctgtggttcggagtatgtgtgaattgaaagatttttttagagctaaggagaagattcggtggatggaagctaatgggtttgatcttaatattgtgacttataatgtcttgattcatgggctgtgtaagggtgatcgagtttgggaagccgttgaggttaaaagatcgttggggggaaagggtttgaaagctgatgtggttacatactgtacattggtgcttggtttttgtagggtgcaacaatttgaggctggaattcagcttatggatgaaatggttgaattggggcttgctccgtcagaggctgccgtgtcggggttagtagatgggttgagaaagaagggaaagattgatgaggcttatgagttggtagttaaggtggggagatttggttttgtgctgaatttgtttgtttataatgcgttaatcaactctttgtgtaaagatggagacttggaaaaggcggagtcactttataataatatgaggtcgatgaacttgtgtcccaatggtattacttattctattctgattgattccttctgcagaaggggaaggttggatgttgcaatatcttattttgatagaatgatacgggatggtataggagaaactgtatatgcctataactctttgataaacggtcaatgcaagtttggggatttgagtgcagctgagtctctgtttactgagatgagcaataaaaaggtggagccaactgctataaccttcacatcattgattagtgggtattgcaaagacctacaagtgcaaaaagcatttaagctatataacaatatgattgagaaaggaattactccaaatgtttatactttcactgctcttatttctgggctttgcagcacaaataagatggctgaagcatctgaactttttgatgaattggttgaaaggaatatcaagccaacagaggtgacatataatgtattgattgaagggtattgtagggatggaaaaattgataaagcctttgaattgcttgaagacatgcatcaaaagggccttattcctgacacatatacctacagacctcttatcagtggcctttgttctactggtagaatttctaaagctaaagattttattgatggtctccacaagcagaatgcaaagctaaatgagatgtgctatagtgcacttctacatggttattgccgggaaggaagattgatggaggcactgagtgcttcttgtgaaatgattcaaagaggaatcaacatggatctggtttgcctttctgttcttattgatggtgctctaaagcagccagacaggaaaacgttttttgatctcttaaaagatatgcatgatcagggattgagacctgataacataatatatacaagtatgattgacgcatacagcaaagaaggatcttttaaaaaagcttttgagtgctgggatttgatggttactgaggaatgctttcccaatgttgtgacttatactgctttgatgaatggtttatgcaaagcaggggaaatggacagagcaggtcttctttttaaaaaaatgcaggctgcaaatgtccctcccaattcaatcacatatggctgttttcttgacaatcttacgaaggagggaaatatgaaggaagctatagggcttcaccatgcaatgcttaaagggcttttagcaaacactgtaacatataacattattatccgtggcttctgcaaactgggtagatttcatgaagccaccaaagttctttttgaaatgactgaaaatggtattttccctgactgtgttacctattcaactttaatttatgactattgcagaagtggcaatgtaggagcagctgttaaattatgggataccatgttaaacaaaggtcttgagccagatttggttgcatataacttgctaatatatggttgttgtgttaatggagagctcaacaaggcatttgaattgcgtgatgatatgttgaggagaggggtgaagccaagacaaaatttacaagcgttgctgaagggtgaatataacagcaccggttaa

SEQ ID NO: 34444 - DNA, 411 bp, Glycine max
  Peptide Sequence Number=SeqID_151222
atggggggtttagggcctttcaggagatgtcatctttccaggtttggttacatccagagcattcctccgccgcctattagtgcacgatcgtcacacgatcagatagatgacaggtggatgcagtttgcggagcacttactacctgcgagtcagctttgtctagtgcctgggcagccgagagatgcaccagctacagaccctgaggactacatacagccgcccagcccccaggttccagtagcatttgacccccctccacatgtgaggttggagcgtgtgctcaaccttaggatagtcactgcaggcacagagttatatgacattatgcaggacagtctgacgatcgcgagagggggacccagtgctgatgggactgtcagggctcgtcagagacgccgcacggaccattga

SEQ ID NO: 34445 - DNA, 161 bp, Glycine max
  Peptide Sequence Number=SeqID_151223
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggg

SEQ ID NO: 34446 - DNA, 521 bp, Glycine max
  Peptide Sequence Number=SeqID_151224
tcccttctatcaatttggatagcccactaaataaagctgggagattgcgatcagtatacataaggactgaaaaaggtgttcttatagaggttaagccctttgttcgtattccaagaacattcaaacgctttgctggtgtcatgttggaactgcttcaaaaattgagcatatctgctgttggcaagcgcgagaaacttctccgaaccatcaaaaaccctgtcacacagtatttgcctatcaactcacgaaaaataggtctatcatatagttcagaaaagcttgtagatatggatgactacgtatcaactgttaccagcaatatggaccttgtctttgtggtagtcttactagttcaacttttaatttctctgcctattgtctcggttggagcaatggcccatgggaagattgagacagattatacagaagattatgtagcaatttcggggtaccctctaagtgctgcttattgtattacaaggattactggcgcccttgagagaaagtggaagattttgtga

SEQ ID NO: 34447 - DNA, 885 bp, Glycine max
  Peptide Sequence Number=SeqID_151225
atgactcagttcctcaactccgtcctctcccagcgcggcccctccgccgtcccctactccgaggacaccaagtggctgatccgccagcacctcgtggccctcaccaccgccttcccttccctcgagcccaaaacggcgtcgttcactcacaacgacggccgttccgtcaacctcctccaggccgacggcaccatccccatgacgttccaaggcgtcacctacaacatccccgtcgtcatctggctcatggagtcctaccctcgccacccgccctgcgtctacgtcaatcccacgcgcgacatgatcatcaagcgccctcatcctcacgttaacccttctggcttggtttccgtcccttacttgcagaattggacttaccctagctccaacctcgtcgatcttattctcaatctcagcctccacttcggccgcgaccctcctctttattcccaacgcagacctaaccctaacaccaaccccaaccccaaccccaaccccaaccccaaccctaatcccactcctcatccccatcctcctcccaattacggaaactcttctccctctaatttatcgtcatcttcatctggatatccccacgcccatgcccaccctcctccaaggacttaccctccttccccttaccctgctccttcttctagggttcagtccactgaggatccttctgaggttttcaagcgcaacgctattaacaagcttgtggagatggttcatggcgacgttgccgctttgaggaagaccagagaagatgaaatggaggggctgtttagtttgcagggcgtgctgaaacagcgcgaggagagtctcaataggggtgtgaaggagatgcagcaggagatggaggctttggagcagcagttacagatg

SEQ ID NO: 34448 - DNA, 285 bp, Glycine max
  Peptide Sequence Number=SeqID_151226
gtggtggcgcctccaggatcaattccttccattaagcagtttctggagaaggtagcctggactagggcccaaccttctcttcatagggaagatgaaggtcccacagcccaggaaccccgacagcttgcagctgacccctttactcctgtagttgatatgctagaggaccagacgacaccagtcttgactctgaacacttcacctccagctactccagtacttcatctgacagatgagaaggatgttcagactcaggatacacaggacctgtctcagggattttaa

SEQ ID NO: 34449 - DNA, 963 bp, Glycine max
  Peptide Sequence Number=SeqID_151227
atggcgagggaagaggacaatggtatcccagcatataacagcaaccttaactctttgaatgtgtacgcagtgccgcggttttatcggagaaggctttgttcttcttcttcttcttcagagtccactgccgctacaatctccatcgaccgttcttccctttacaatccacctgagcattctcaccaccccacttctgattccgaactcgtcaaacacctcaaaggcataatcaagtttcgtggaggccctatttcgctaggtgagtacatgtccgaggttttgacaaatcctaaagctggttattacatcaatcgagatgtttttggagcagaaggtgattttatcacctcacctgaagttagccagatgtttggtgagatggttggtgtctgggtgatgtgtctttgggagcaaatgggccaaccacaaggagtaaatctagttgagcttggcccggggcgaggaactctcatggccgatctccttcgcggtgcttcaaagtttaagaacttcattgagtcattgcatgtacacttggtggagtgtagtccagcactacagaagcttcagcaccagaacttgaaatgcactgatgaagagaatgcttctcaagatactgatacaagaacagccaggtccttgtttggaactcctgtatcatggcatgctacactggagcagaaagcatctcgtggctggtgtgagaaaatggttgatgtggcagaagattcatcgtttcattttgttctttcaccacagcctacacctgctactctctatctattaaagcggtgcaagtgggctgcacctgaggaaattgcagatctcaatcaaattgaagtttcccctcaagccatggagttgactcagaccattgttgacaggataagttctgatgggggtggagctctaatcattgactatggcttgaatggagtaatctcggacagtcttcaggtctag

SEQ ID NO: 34450 - DNA, 399 bp, Glycine max
  Peptide Sequence Number=SeqID_151228
atgtcatacttgctacctcatttgcactccgaagaagaacgagttgttgtcattcgcttcggtcatgattgggatgacacctgcatgcagatggatgaagtgctggcatcggttgctgaaaagataaaaaacttcgcagtgatttatcttgtggatatcactgaggtgccggatttcaacaccatgtacgagttgtatgagccgtgcaccgttatgttcttttttaggaacaagcatattatgatagaccttggaaccggaaacaacaataagatcaattgggcactcaaagacaagcaagagttcattgatattgtcgaaacagtgtaccgtggtgcaaggaagggacgtggtctagtcatttctcccaaagattactctaccaagtaccgctactga

SEQ ID NO: 34451 - DNA, 180 bp, Glycine max
  Peptide Sequence Number=SeqID_151229
attcgctccaccacagtcccttcttccgcactctcctccgcctcggaactgtcgctgagaacgttcaccaccaccacggtgagagtagacgcgaaggacaccattttcgaatcgtcttctcctcgtagtggtcacaaatctggtcaggacaattgcactagcagcgctgtgagtgagtga

SEQ ID NO: 34452 - DNA, 426 bp, Glycine max
  Peptide Sequence Number=SeqID_151230
atgaccgaccctctcaatgactcaatcttttgctttctcataggggtggacccttcagtactagaacctattgcctttagaggactacacatcctcgccttcagagggctacacaccctcaccttcaaaggactacacgtcctcagcttcaaaggactacacgtcctcgccttcagaggactgcacgtcctcaccttccgagggctgcacgccctcgcctttagaggactacacgtcctcaccttcagagggctgcacgtcctcactttcaaaggactacacgtcctcaccttcagaggactacacatcctcaccttcagagggctacacgccctcaccatcagaggactacacgtcctcgccttcagaggactagacgtcctcccctttaaaggactacacatcctcccctttagaggactacac

SEQ ID NO: 34453 - DNA, 441 bp, Glycine max
  Peptide Sequence Number=SeqID_151231
gggagaagcttgccgcccagctcgcccaggcgagcaagctttcgaaggagttacggaaactcacggattgcgcaaaaacaccttttttcgatttccgccacattacggaatttcacggatcgcgcaagcctacttccgtttgatctttgagacgtctcgggacttcatttattgcatgtcatcaagtaataatccccgaatgaaattagggtatgacactcacatcctcctcaagctgagtgatgcgggtatccattccctcaaagcgagcatcaatggcatcgatacgaccatccaaggaatcaaagcgttcaccaacatatgtgcagaggcctcgagtcatctcattgaggcagaggagagggagtatgttcttcttgcggaggttgtgcatccttcttcaaccattgcccatccatgtccttatggtagccgaaggag

SEQ ID NO: 34454 - DNA, 165 bp, Glycine max
  Peptide Sequence Number=SeqID_151232
atggtggcgaaggagaagaagcagagacttgtgacgatgctcgagtgcgacgaacacgatgctcagatgcagacagggaccttcaaggttaacatcgattttctggaaaaaaccgatgttaacatatcaaacgttaacatcggttttctcaaaatccgatgttaa

SEQ ID NO: 34455 - DNA, 342 bp, Glycine max
  Peptide Sequence Number=SeqID_151233
atgggaagtgctagtccaatggtggggactgtcccccacgacacctcatgggaagactgggaccagctgcgacaagatcatcaccttgagaacaaggtgattcttcaagggccgaaggaagatgatagcacagcagaaccaataccagaaagagaaataggaatcacaacaacaaacacgggtgcaaatggcaaagaaggtcctggccctcgaaggcagtccctgagcatagcagttgtatcacattgttacgggagttttttgctctataacaactatgtcaagactgaagctaatttgaagatgaattgggttgctgacggcattttgtgttcgttatga

SEQ ID NO: 34456 - DNA, 799 bp, Glycine max
  Peptide Sequence Number=SeqID_151234
atgttttttctatacggatttggaggcacaggaaaaacattcatatggagaacattagcaagttcattgagagcaaaaaatcaaattgtaattattgttgcttctagcggaatagcctctctattattaccaggatgcagaactgcatattccagatttaaaattcctataccaatttttgaagactcaacatgtaatatccatcaaggcatcaaattagcagaattattgaaccagacaagcctaataatttgggatgaagcaccaatggcccagaaattctattttgaagtgtttgatcaaagtttaagagatattatcacagataaatcaaagtcaaatcaaatatttggaggcaaagttatagtatttggtggagatttttgccaaatactaccagtcatcccaagaggaacgcgctcaaacattgtaaatgcagcaatcaattcatcctatctatgggattcgtgtgaaatattgaccttgacaaaaaacatgcgcttacacagcaatctagaatcagttgatgaacaagaaactgccacatttgctaaatggattctagacattggagatggaattatagatgatgaaaatgatggttatgctacaattcaaattcctgctcatctactcattactcaatatgatgattcaatcagtgctatagtcaaatcaacattcccagacttagatcagcaccacaataatcctgaattctttaaatcgaaggcaatactagctttaacaaatgaaacggtagaacaaatcaatgattacgtgctatccttcattccag

SEQ ID NO: 34457 - DNA, 156 bp, Glycine max
  Peptide Sequence Number=SeqID_151235
atggcctcgatcaaatttggcaccgttgccggggagcagtgggccaaagcgttctgttttgcatttcagtcgcatcccctggagcacttggtctggcagtatttgagagagacaaaaattttgggaactagttttagcaaacttaaaacgccataa

SEQ ID NO: 34458 - DNA, 216 bp, Glycine max
  Peptide Sequence Number=SeqID_151236
atgttggggaagcttgggaggattggtggggacccggtgttgagagaaacgaggatatgggctacgtgggagtacgtgagctcagttggaggtgggcaacaggggatgagtggtacctggagatatgtcgcgggggtcaggagaccttggggacgtcaggtggggtgctattgcccacaaccaagcttgaccaatcccgacccaacccgggcatag

SEQ ID NO: 34459 - DNA, 303 bp, Glycine max
  Peptide Sequence Number=SeqID_151237
atgacattgatagtagacacattaccagtattctactatggaaaatggtgggctacgcaccttcaaagctttgaggatttggtctttgccagtgaaaggatcgatgtgggtccgaaaagaggaaaagttgatcatcctactaggacgactgagaaaactggggcaaatgaagagagtgagaaagagggagaaacccatgctgtgactgtcattcctatacggccaagtttcccaccaacccaacaatgtcattactcagccaataacaaacctcctccttacccaccaaccagttatccataa

SEQ ID NO: 34460 - DNA, 300 bp, Glycine max
  Peptide Sequence Number=SeqID_151238
atggtttttaggtggggaattttggctttgagtgcttttgccttttccttctgtttttgtttagtgcgtggcgagaaagtcgctagcacacaggattttgtcggcaatcaaagggagaggaccattgtaggtcgtgggcaaggattgacattctcaccctgggtcaaggtttatgataagttgggattttggctcaaggcttgtagaacgggtggtcatgatatatgtcagggtttggccagtggttcggggataaaggggatgtcctacattatttccatgatacacatgcaacaatga

SEQ ID NO: 34461 - DNA, 453 bp, Glycine max
  Peptide Sequence Number=SeqID_151239
atggtcattccaaagttcaaggtgccagactttgacaagtacaaggggactacttgccctaagaaccatctaaagatgtgttgtcgaaagatgggggcattcgcaaaagatgaggaactgttgatacatttcttccaagaaagtcttactggagtagctgctacttggtacactaacttggagccttcccgagtccattcttggaaggacctaatggttgccttcgttaggcagtatcagtacaattttgatatgtggcacaaatctttcaaagaatacgcccaaagatggagagacctagcagctcaagtggcacctccaatgagggggaaagagattatcacaataataatagacacattaccagtgttttactatgaaaaatggtgggatacacaccttcaagctttgcggatttggtcttcgctagggaaagggtcgaagcggatctga

SEQ ID NO: 34462 - DNA, 150 bp, Glycine max
  Peptide Sequence Number=SeqID_151240
atgggttctggcaatgcaatgtggttggactctcatgtcgatctgaatgaatcatcctttccacggagatgtaactccagttacttcggaaatggtaagatctttggcgcaagaacgcaagaggaggggttgatcccgtatcatccttga

SEQ ID NO: 34463 - DNA, 390 bp, Glycine max
  Peptide Sequence Number=SeqID_151241
atgggggataagcttcatcgtcgagagggaaacagcccggatcaccagctaaggcccctaaatgaccgctcagtgataaaggaggtaggggtgcagagacaaccaggaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtgggtag

SEQ ID NO: 34464 - DNA, 1179 bp, Glycine max
  Peptide Sequence Number=SeqID_151242
atggatgaaaaatccagtacacaaaaaacaataactggaagaattgctcaaatctttagtaagagctctgatatgtcttcaactgcatcccgtagaagcattgacttgtaccaatctgaaattagtaaagtagaagttagtgagatgaaggctgaggatcagtcctctaatgagacttttgaagaagctatgagaaaacttcagtctgcagatcaaggcagtgaaattcctagcaatttaccagcaggggtgtttattgatcaacaatatgtcattgcaccagaagacttgaacgagctactattttcatcagattcaaattttctcaagtcattggctgaagtacagagcaatacagaactcgaaataggaccttggaagtttgagaatgatgggaaaatcttcaaaagattagttacttacgtcaaggctcctagtaaacctgctgatctgtatgccactttgttatctcagactattaaacctgctgatctgaaggaccttagttccaataaggaacaagctttagcgtcattacatgcagaacctgaatcagattggaggcttgcagtgcagtattttggtaacttcacagtatttgcaacagttttcatggggttgtatgtgcttgttcacatttggttggctgcaccaagcacaattcaagggcttgagtttggtgggcttgacttgccagattcaattggtgaatttgttgtctgtgcagttttggttcttcaaggtgaatgcatgctgggtataatctcacgcttcataaaggccagagcacaaaagggtagtgatcatggaatcaaagcacaaggagatgggtggttgctaactgttgccttaattgaaggaagcagtttagcttctgttgattctagtgggttgtctgatccctatgtggtgtttacgtgcaatggaaaaacaagaactagttcaatcaagttccagaaatctaatcttacatggaatgctgcatctctaggacatgctgaaattaattttctaaaagcaaatatagcagatcttgctgatatatgggttccccttgaaggaaagttggcattggcatgtcagtctaagctgcacctaagaattttcttggacaacactagaggtggtaatgttgcaaaggactatttaagtagaatggagaaagaagtcaggaagaag

SEQ ID NO: 34465 - DNA, 279 bp, Glycine max
  Peptide Sequence Number=SeqID_151243
atgcgtctaccggggaaggagagtctgctgatgaaatctcccataaccataaatgagattttggatgttagcatttcgtttctaaatgatcatttagaggaaacactgggttcaacaaaaatagaagaaatccactcaaagtgtatcaatctcgcacagggtaaggtttatggtgagtcaggattttggctcaaggcttgtagaatggctagacatgatacatgtcagggtttggtttggttcaaggataaaaagggatgccccacattatttccatga

SEQ ID NO: 34466 - DNA, 972 bp, Glycine max
  Peptide Sequence Number=SeqID_151244
atggaaactatacagggtataaactctataaacaaattagatttcaaagtattaataactgatccagtagatcactacatgataaaaactttacaaaacaatggattaatagttgactataaacctgaaatttcaagagaggaattactaaagataatagaccagtatcaggttttagtagtaagaagcagaactaaggtagataaggagataatccgttatgggactaatcttaagattatagccagagccgggatagggctagacaatatagatacagaagaggcatccaagagaaatataaaaatagtatatgcagcaggggcttctacagattctgcagcagaactaactataggattacttcttacagcagctagaaaactatatgattccatgaatatggcaaagggtggcatattcaagaaaatagagggaattgagttagcaggtaagactataggtgttataggattcggtcgaattggtaccaaagtagctaaggtatgtaaggcattagatatgaacgtaattgcgtatgatgttatcgatataaaagaaaaggcgaatatgcttggagtcaaggtagctgaaagtttagacgaattgttaaagaactcagacgtaataacctttcacgttacagtaggtaaagacgctaaaccaatccttaataaagatacatttaattacgtcaaagataatacaatcataatcaacaccagtagagccgtagtaatagatggtaaggcattactagaatatattgataaaaagcaactaacttatgctacagacgttttgtggaacgaacctcctaaagaagattgggagattaaattattgagacatgagagagtgatagtaactactcacattggtgctcaaactaaagaagcacagtatagagtagcagtagtcacaacagataatctcatcacttctttaaaagaaatcggtgttctcaaatga

SEQ ID NO: 34467 - DNA, 300 bp, Glycine max
  Peptide Sequence Number=SeqID_151245
atggctaccattgcattattgagtagatatgggagtaagttagcatacgacgctggaattggggtgaattctacaggcttcttttctagaaaattccttcactggttggcctcggatgtgcagcaggcaggccaaggatcttcttcatcaatggattcttttgcttcttggaagatgaatggcagcggaatagagaaggaagagagagaagaaacgccacttcaaggagaagatgagtctagaataaggaagggagaggaagacaagagcacaaaattttgtgctctaaaagagctctga

SEQ ID NO: 34468 - DNA, 324 bp, Glycine max
  Peptide Sequence Number=SeqID_151246
atgactcatcaggattttcaagtgcaagccattggtcagtttgctcaagcgacctgtgctcctgagtttggacttccaagaccgttcaatcagagattactcgtcttgcacgttggtggggttgccgtaaaacaacggacgttcatgtggcctcattttatcattccggaaagtttgtcttcttcgagaagcgagttgtcaagaataggatgttggacatatggcctcagttatcttaagaaggggggggttgaattaagatgcaaagactattccccaattaaactttcactctctcttttcggattaacaatgcacccttaa

SEQ ID NO: 34469 - DNA, 379 bp, Glycine max
  Peptide Sequence Number=SeqID_151247
atgggatcaagtcgaatgccttcgcttaaaaagaggttctatcaagtcaaggtcaagagcctagggatcaccagtctaaaagagttagggcagttgatgggtcagctccagcgacaagcttttcacaaagcttacggtaaaatctgggacctagccatggtagaagtctctacagaggccattgcctccctcgcccagtattatgatcatccgttgaggaagcaagttgaaaatggggtggttggaataccgagaaaatatttggaggcaaaagcaagaatcttggcagcgatcgacgcttttctcacctatcataaccacaaggaaagcccggttgtcgctatgctagccgatctatatgacaccttcaaccgaagat

SEQ ID NO: 34470 - DNA, 697 bp, Glycine max
  Peptide Sequence Number=SeqID_151248
tggacaggtgctatcctgtacactatgggaaaattactgcttacagtttttgtcttatttgaatgatattgaagatgaaaggccgatcgttattctcttgactcatgctaggattaaggaagcacagggatcatatccggcatcggtcagtaattctttcaaggcatctaaactcatgatcaatgacctcgtgcttgaaattcaagaatttagagagagtcttttagatttagggatcgaggttagatcaattttggcgcctattggacaagggagttcacagtttcagggtcatctcaattatcatcaaaagatgtgtttctgtcaaagactgaagtatcgggttgaggtgatggttaatcacaagggtgaacaaaccaaatttttgatctgggatcgtgaatgtgcacagttaattggtcagtcaacggatgaagtcaacaggctcataatagaagatggggatgctgatttaaatgcctctcctcaagcgctagataggctattgggttgtttccttgcattcaaagtgaaggtgcaaccaaggttcaggaattctgttgttcttaaatattcaaatgaattagacttgatcaatgttgtgctagatatgattcccgatagtgagccatgttgcaagatcgagaattcaatacttgattcgactgatcctacagtgcttgaatctgtgagctaa

SEQ ID NO: 34471 - DNA, 525 bp, Glycine max
  Peptide Sequence Number=SeqID_151249
gactacacgtcctcaccatgagagggctgcacgccctcacctctagaggactacaggtcctcgccttgagagggctacacgccctcaccttggagggctacacgccctcaccttgggtactagttaccctcaccgtcagagggctacacaccctcaccttgagaggactacacgtcctcaccatcagagggctgcacgccctcacctctagaggactacatgtcctcgccttgagagggctacacgccctcaccttgggactacctgtcctcaccttgagagggctacacgccctcaccttgagaggactacacaccctcaccatcagagggctgcacgccctcacctctagaggactacatgtcctcgccttgagagggctacacgccctcaccttggggttgcacgccctcacctccagaggactacatgtcctcgccttgagagggctacacgtcctcaccttgggtactagttaccctcaccgtgagagggctacacaccctcgccttgagaggactacat

SEQ ID NO: 34472 - DNA, 385 bp, Glycine max
  Peptide Sequence Number=SeqID_151250
atggcagaaccatcgaagaagcgaaagggggttgcgactttcatccgcagtcactggaacacgaagccacggaacatccaagaacaacgtatccggtacaattctcttttctcttctcgttccattatcgaccctaagttcgttgacttagctttctttgatgatgaagtctttgattgctttcaagcatttcaaaattctggtttaattcagtttatctccatgaaacttcctttttaccctgaattggttaaagtcttttattctaacttggaaattcaaaaagattccttgatttctgaagtttatggaattaagatggtcatagaccaatcccttttctttgatctcactcaattatcaagtgatggtgtaccatttgagg

SEQ ID NO: 34473 - DNA, 531 bp, Glycine max
  Peptide Sequence Number=SeqID_151251
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgcccagcccgttcccttggctgtggtttcgctggatagtagacagggacagtgggaatctcgttaa

SEQ ID NO: 34474 - DNA, 145 bp, Glycine max
  Peptide Sequence Number=SeqID_151252
atgtgctcactcagcgtgcaaccagcccgcccagcaaggtcgttgtttcttctcaagcttagcgcacccagtctccctaagccaaaattcacttactcttgcttagcgagccagtctcgcaaagcgagccttcgaaagctgaaag

SEQ ID NO: 34475 - DNA, 353 bp, Glycine max
  Peptide Sequence Number=SeqID_151253
atgattgatggctaccttagaatgaaccatttcataggggctttggcacttttccgtgagatgcaaatgtcaaatgtgaaacctgatgagttcaccatggttagcattctaatagcatgtgcacttctgggagcacttgaactaggggagtgggtaaagacttgcattgacaaaaatagtaataaaaatgatagttttgttgggaatgctctagtagacatgtactttaaatgtgggaatgtcaggaaagcaaaaaaagtattcaaggaaatgtatcagaaagacaaatttacctggacaacaatgatagttggtcttgccatcaatggccatggtgaagaagctcttgccat

SEQ ID NO: 34476 - DNA, 1986 bp, Glycine max
  Peptide Sequence Number=SeqID_151254
atggagtttgttgctcgtgctacccctgataataatgatgagatatctgattcaggaacacaacccaataagcagatgagaaagaagtctatggtgtgggactacttcacagtggaaactgttggagctggatgtaccagggcctactgtaaacagtgcaaaaaatcattttcttatataactgattcaaaattatctggcacaagccatctgaaaagacacatttctttgggaatctgtcgagtgctttgggagaaaaaccaacaaagatcatatcccaaaactggtggctctctagatactgccaatccacccaagaaacagccaagagcaacacctgggtttgctggtaatggcatctcatttgatcaggagcgttgcaaccatgatgtcgctaaaatgataattttacatgattatccacttcatattgtgaaacaacagggtttcattgattttgtgcggattcttcaaccccagttcaatccattatgtctaaattctgttgaaggggattgtgtcgctatctacctcagaaaaaagcaaaatctgttgaatgttattaatgggattcctggccaagtaaacctgacattggatttgtggacttccaaccaggcaatgggctatgtttttgttcgaggacacttcattgatagtgattggaaattacatcgtcctattctcaatgttgttacagtaccatttcctgtttctgatgactctttaaatcaaactttagtaacctgcctatctgattggcatttggagggtcggctgtttacccttgcacttgataaatccttttccagtgaagctgtgatgggaaatctgagaggccttctctttgttaagaaccctgcaatcctcaatggtcagttgttaaaccagaattgttatgctcgtgttcttagtcgtcttgcagcagatgcactatggacaatgagagaaactatttgcaaagttcgtgaaagtgtaaagcatgtgaaatcttctgaatcccataaaaggaagtttatcgagctgaagcaacatctacaagtacctagtatgatggacctttcaattgatgaccagtgtaaatgggacacaacatatcatatgcttgtagctgcctgtgaattaaaggaagtcttcacttgccttgataccattgatcctgattacagaatgactctaacaatgggtgactggaagcaggttgacaccctgtgcacatatttgaagtatttgtatgatgcagctattattttgactgtgcaaccatgcccaacttcaaacttgttttttgctgaagtgtcaaaagttcaggtggagttgacacatgcggccttcagccaggatcctttccttagcagtttgtttttgcctttgcacaagaactttgaccaatattggagagaaagctgcctcatcttggcaattgctgtagctatggacccaaggcataaaatgaaacttgtcgaattcacctttgctaagatatttggtgagaatgctgaggaatggataaaaatagttgaggatggtcttcgtgaactttttattgaatatagcatgcaaatgttccttacaacaacaaatggcgatgaaggggatgacattatgataaaaaaaacatttctagaagggtcaattgactgctcactttttgttgacggggatgaattttcggattatgaattctacatatctgattttacgggtaacccacaatttaagtcagaattggatgagtacttggacgagcctctgctgaccagagtggaagaatttgatattctgagctggtggagagtaaatggattgaagtacccgacattgtctagaatcgcatctgatatcttgtctttaccagtttccactctgtctgcagattccatttttgacatgcaaattagaaaaatggatagctaccggagttctttaagctccctgacccttgaggcccttatttgtgccaaagattggttccagtctgaatga

SEQ ID NO: 34477 - DNA, 579 bp, Glycine max
  Peptide Sequence Number=SeqID_151255
atgatttcacactgctttggagaatctccaatctctttgcttgaaaagtgcaagtccatgtaccagctaaagcaaattcactcccacaccatcaaaatgggtctctcttcagatcctttatttcgaaatagagttatagccttctgttgtgcccatgaatcagggaatatgaactatgcccatcaggtgtttgacacaatcccgcatccaagtatgttcatttggaataccatgatcaaggggtattctaagatcagccatccggagaatggagtttccatgtatctactaatgctaactagcaacatcaagcctgaccgttttacatttccgttctcgttgaagggatttaccagagatatggctttgcagcatgggaaagagttacttaaccatgcagtgaagcatggatttgattctaatttgtttgttcaaaaggccttcatacatatgttttccttgtgtgggattgtggatttggctcacaaggtttttgatatgggtgacgcatcctgtggagaaatggatgaagcacaaggtgtttttgacaatatgaagactcgagatgtgatttcttag

SEQ ID NO: 34478 - DNA, 535 bp, Glycine max
  Peptide Sequence Number=SeqID_151256
gattttgcaaaagtgaagaaaaatgctatgcatttgctggttgtggaaagagcagtgcagaatgagttctggatgtttgctagtagataccaacgagttttctgcctttgctctgttttcttggctgtgatagtttgtgctgagtacatgagctcagttgggaggtgggcaacaggggatggtgggtttatgcgcgatttgtggatgtggaaaaacttgttgtgcaccatcgcccgaccgccacctagtaccacatgtgatggagtggtacctggagatatgtcgcgggggtcaggagaccttggggacatcaggcgagctcctggcagtcaacagataaaaggaacaaagaccacaaagcaaggaggcttgtggtggctggccagctgtgaatcttgtgtgatatatgggttatggcctctggtaatcgattaccaagggcttgaaaacgaggttgtggaggcctctggtaatcgattaccagtctgtgtaatcgattacacagaggaatgggtcactggtaatcgattaccag

SEQ ID NO: 34479 - DNA, 318 bp, Glycine max
  Peptide Sequence Number=SeqID_151257
atgcccccaagatcaggaaaagggaaatcaaataaagcaaaggcagagaaaaagaaaaaggaagagaaagctgcagcagcaccttctcttgttgacatcactgtggtcaccccatatgacacacagattgtcttgaagggtatctctactgataagatacttgatgtaagaaaactattggctgtgaaggtggagacatgccatttcacaaactattctttatctcatgagaccaaagggcagagattaaatgacagagtggaagttgttaccctaaagccatgtcttctaagaatggttgaaggtaggtgcacttag

SEQ ID NO: 34480 - DNA, 4823 bp, Glycine max
  Peptide Sequence Number=SeqID_151258
aggattatacagatgaagcccaagcaattgcgcacgtgcggagggtcttggacattgtggcctgcacaacaaggttcggtaggcccaaacggagcgtagcaagctcagagtcaaggcccaagaaaaatggtaaggcccaacatcagaaccagacaagtttgagcccaccggggacaccgaatggggaatcccgggtcgggtcaccgtcgtcggaggcgccaccgtcggcgatcttggataacgtggggatgaaggccattcacccaacaccgaagctctcagatttctacgagttcttctccttctctcacctctctcccccgattttacatttgaagagatgtgaagtgaaggatgaagaggataggcgcaaaggagattactttcagcttcaggttaaaatatgcaatgggaaggtaatagaagtggttggttctgagaaagggttttacacagtagggaagcagtctctgcacagccacaccttggttgatcttctccaacagctcagccgagcctttgctaccgcatatgaatcattgatgaaagcctttttggaacgtaataagtttggaaatcttccgtatggattccgagcaaatacatggcttgtccctccgtctgtcgcagagtctccttcaatctttcctgcattacctgctgaagatgaaaactggggtggtaacggtggtggccaaggaagaaatggtgaatttgagcttagaccatgggcaacagattttgcaatactggcctctcttccttgcaaaactgaggaggagagggtggttagagatagaaaagcatttctgcttcacagtcagtttgttgatacctcaatatttaagggtgttgcggctatacagcatgccatggaatccaagttaaataccaagaatgaattgaattcttatccagattctgttctgcatgaagatcacgtgggagacttatccattatagtcaaacgtgatatccaggatggaaatgcaaagtacaattctttactggatgaatctagcatgcataaggtggatgctcagaagaatttactcaaagggttgactgcagatgaaagtgtaattgttcatgatatgtcttccttggctgttgttgttgtacaccactgtggatatactgcaacggtaaaggttgtgggtaatgtgaacacaaggaagcctaaagttcgagatattgagatagatgatcagccagatggaggggcaaatgctctcaacatcaacagtttgagggtactgcttcacaagtcgggagctgagtcattagaagggactttatcatccctgtcaaattcgaatgacttagatgcttctaaagtccttgttcggaaggtggttcaagaatgtatggaaaagataaaggaggagccaagtgcttcagaaaggtctattcgatgggaacttggttcctgttggatccagcatttgcaaaaacaggaaacttcaacagataacagttccaaaaacaaagaagatggcaatgatcttgagcaagctgttaaaggtcttggaaagcaatttaaatttttgaagaggagagagaagaaatccaataatctagatggtgcagattctagggagcaaaatgactctagacttgcaaacatgaatgatgttgcggataaagttgagccaaacaatgatgacttaagtaactctaatgaattagagaaactactttctgaagaagcatttttgcgtctcaaagaatctggaactggtcttcacacaaagtcagtggatgagcttatcagcatggcacacaagttttatgatgaagttgccttgccaaagctggctatggactttggatcactggaactttctccagtcgatggtcgtacactgactgactttatgcatttaagaggattacagatgcgatctttgggtaaagtggttaaacttgcggagaatcttccacacatacaatccctttgtattcatgagatgatcactcgagctttcaagcatctacttaaagcagttactgcctctgttgacaatgtagctgatctatctgcagccattgcatcaacactgaatttcttacttggtgggtctcgaacagaagatggcgctgaccaaattttgattgatgatcataatctcagaattcaatggttacatctgtttttgtccaaaagatttggctggacactaaatgatgaatttcaacatttaaggaagttgtcgattctcagagggctctgtcacaaggttggattggaattgttcccaagagattatgacatggagtccagtaagccctttgggaaaaatgatattatcagcctggttcctgtttgcaagcatgtagggtgctcctcattagatggacgcaatttattggagtcttccaaaattgctcttgataaaggaaagcttgaggatgctgtgaattatggaacaaaggcattagctaagatgatggctgtttgtggaccctttcatcaaaatactgcaagtgcatatagtcttctagctgtggttctctaccacactggagattttaaccaggccaccatctatcagcaaaaggccttggatataaatgagagggagctagggcttgaccaccctgacactatgaaaagctatggggatctttccgtcttttattatcgtctgcaacacattgagttggctctgaagtatgttaatcgtgctctattccttctacattttacatgtgggctgtctcatccaaacacagcagctacttatataaatgtggctatgatggaagaggccatgggaaatgttcatgtggcactcagatacttgcatgaagctcttaaatgcaacaaaagattgttaggagcagatcatatacagactgccgcaagctatcacgccatagctatagctctttcattgatggatgcattttctctgagtatgcaacatgagcaaactacactaaagatacttcaagcaaagcttggatcagaagatcttcgtacacaggatgctgccgcgtggcttgaatattttgaatcaaaagccatagagcagcaagaagcaactaaaaatggaactccaaagcctgatgcatccattgcaagtaaaggtcaccttagcgtgtcagatctcctggattttattagtcccaacccaaaaggaaatgatgctcggaggaaacagaggcgtacaaagatactctcaacaagtgataacaacagtcaagaacatgatgaagcaatagctgatgagacaattctttttgataactcaaaagatgctctaagtatgatacaaggcaaaatagaagaaacaaatggcaaacttgattctcaagtacagaaacaaaatggtgatttcactgggtacagaccagtgacaagtgaacctgtttatgaggcgtcatctgatgaaggttggcaagaagccaattcaaaagggcggtcaggaaatgctgctaaccgcaagtttgggcacaaaaagcgacatcatctatcaaagctcagcattaatggttcaaataattacatttacagggaaggcagttctaggaatgagattacttcgccaccacaaagaggagttccaaaagtcatgttagacatgtcatctccatctagacaatcaaaatctagaaacttaactttgaatgaggattctgttaatcattcaacaaaagcttctgtgtccaaaatttcatctccggcatctctgagttccttggcttcaaagtctatatcttacaaagaagtggctttagcaccaccaggaactgttttaaagccattgttggaaaaggctgacatggaaagggttaatgctggagatgagatatgctgcaatcctgctgtgacatcaataagtgaaggtagttgccaaagttccataactaatacagtttgtcagcatgatgaaacagaggaaactcatgaaaatgaacctcaacaagaaagttctggatcggaacttgagaaggtttctgatcaggcaaaatctacagcagaaacaaatggcagtaagctttcagctgcggccaaacctttcaatccaggaatgttgtccatgtctcaccatttaaattcagcttccttcacaagcatgtatgatacagatgttagtcaaggcatgcacgtggagactgtgcttccccctgctgttgctagggtcccttgtgggcctagatcgcctctgtattatagaaccaactatacttttcgcatgaaacatggttctactaaaggtcaaacctctatcagagaaagaagtggatttgggtctccaagaataatgaatccacatgcgcctgagtttgttcccagaaatgcttctcaaatagaagccaatgatgccaattcaaatgtttccaatgagcataactctttgtctgacataggcatgtcagaagaaaacaagctagatgaaaattttgttgaaatcaatgggagttccaacaaaaacagtatttctgaatctgagaagtccgagatagctaggcagatactgctcagttttctagtgaaatctgtcaaggaaaatattgattctgtggatgagtctaaggatggtgaaggaaaaattgagatcttggaaagttgttctgatgaaatagccaaagacagtgctgtcataaacattatgtatggaaatgaagaaaagaataagacagtgcctcattccagtgatagtgatgagcaagagaaattaggtgttactgaaaaaaagaatggagatggtgaagggtttatagttgtctcgaagaggaggaaaaacaggcagaagatcacaaatggagtcacagaattgtacaaccaacagtccatttgtgcttcagttcgttga

SEQ ID NO: 34481 - DNA, 300 bp, Glycine max
  Peptide Sequence Number=SeqID_151259
atgccacacagatcacaagcatgggctctctctcacgtactcatagcacgagctccagtgcacacaatgggcgttgccgagagagtgaggtttcgaggaactttcaggggtatggtgtttaagatagggagagatgggtttgagggagagcgagagagaggggttagagttagggcacaactgagcttcaggaagagagcgaggttcagctttaattggaaaggtctccaagcgtgtatgagccacgcgcgtgaggaacaaagacggacttatcagaggaccgtcgttgtcttacattaa

SEQ ID NO: 34482 - DNA, 423 bp, Glycine max
  Peptide Sequence Number=SeqID_151260
atgggtgaagtagaggagatacaagagaagaggaaggccgacatggaggccattaaagagaaaatggccacaatgatggaggccatgatgagcgtgaagaagataatggaagccaatgcggttgcaattgccgctaccagcgttgttgctaagtacaaggggactacttgtcccaagaaccatctaaagatgtattgtcagaagatgggggaatacgcaaaagatgaggaattgctaatacattccttccaagaaaagtcttactggggtagctgttacctgaacatttgcaaaaagggggacagatctttcaaagaacacgcccaaaaggtggagggatctggcggcccaggtggtacccccaatgatggaaagggagacgatgatcgtgatggtagacacattatcgatactctactatga

SEQ ID NO: 34483 - DNA, 456 bp, Glycine max
  Peptide Sequence Number=SeqID_151261
atgggagagacacatgaaatgccctaccacaatctagtcaacttcgaaccttgcctcagatatgccactgaagggcaagcagttggtggtgtaccccgacaaaacactttggagggccctcagtatcacccacaaccacaccccttgcattccacaccgggtaaaaaccctcatgctatggcagaaatgggagagttggatcatctagaggaaagactcagggacattgaaggaggcgaagattctgcctttgctaacctagaagagttgttcctagtacccaatatcgtcacccctcccaagttcaaggtgtcagactttgacaagtacaagggtactacttgccccaagaaccatctaaagatgtattgtcagaagatgggggcatacgcaaaagatgggaaattgctgatacatttcttccaagaaagtctaactggggcagctgtcacctga

SEQ ID NO: 34484 - DNA, 1662 bp, Glycine max
  Peptide Sequence Number=SeqID_151262
atggggggagcgtgttctaggaagcaagagcgggacaacaaagatagtcctaccagaggactatcacgaagatattgcaaaagcgggactttgaaatggtggacatcctctttttcttatccatctgtagattttcacctacgaaaaggagaatgtccaccactgttggacttgtgcatacagaaaataaatgaggatattgataaatataacacattttctatgctaccacgagatataagtcagctaattttcaataatttggtttactcccgacgtctaaccagtgcttcccttgaagcttttcgagattgtgctctccaggatctttacttgggagagtatgatggtgttaatgataattggatgggtgtcatctcatcccagggttcatctttgctttctgtagatctttctgggtctgatgtcactgattttgggctgacataccttaaagattgtgaaagtctcatttccttaaatctaaattactgtgaccaaatttcagatcgtggactagagtgtatcagtggtctgtcaaacttgacaagtttgagtttcagaagaaatgattcaatttctgctcaaggaatgagtgccttttctggtcttgttaacttggtcaagttggatttggagagatgtcctgggattcatggaggccttgttcatcttcgaggtttgaccaagttggaatctctcaatttaaagtggtgtaattgcataacagattatgatatgaaacctctttcagggttacagaagcttgcccttttaaatttggaagggtgccttgtaacagctgcatgcttggattctcttgcaggcttactagaactgtgtcaactacagttctgcaccttgcaaatgctaggatgtatatacaacagtaccgcttgtactaattttaatcttcctgcactgtcaaacttgaatcttaatagatgcaatctctctgacaatggatgcaaaaaaatttcacgattgacaaagttggagagcttgaaccttgattcgtgtaagattggtgatgaaggattggtcaatttggctggccttgagcaattgaactgcttggaattgtccgatacagaagttggaagcaatgggctacaccatttatcaggtttgtctagtctgcagaaaataaatctgtcttttaccatgattagtgatagcagtttaaggaaattgagtggactctcgtctttgaagtcacttaatttggatgcttaccaaattactgatgctgggctggcaaaccttacaagtttaactggcctcactgacctagatttgtttggtgcacgaatcacagattttgggacaaactatttgaaaaaatttaagaacctgaggtccttggaaatatgcggtggagtattgactgatgctggtgtgaaaaatatcaaagagctttcttctctagtgtgcttaaatttatctcaaaacagcaaccttacagacaaaaccctggagttaatttctgggcttactgggttggtttctttgaatgtttcaaattctcgtatcactaatgctggactgcagcatttgaaaacactgaagaacttgagatctctgacattggagtcctgtaaggtgacagcaaatgacatcaagaaactgaaatcgatatacctccctaatttgtggtactga

SEQ ID NO: 34485 - DNA, 711 bp, Glycine max
  Peptide Sequence Number=SeqID_151263
atgggatgttgcttaaagtttaagggttttagtatcaagcttaaggttttttattttacaggggatgttgcttttagaatcttggagagcatacacaaagttaagctgagaggacttcgaggtgcttttcaagatactttagaggcagaaactcagatatatgtatgtgacattaaccctaagatgttaaatgttggcaaacggcgggcctcagagaagggttttggagaagatggttcccttgtatgggtggagggaaatgctgaaagcttgagtttccaaaatgattcaatggatggttatactattgcattcgggataagaaatgttacacatatagagaaagtactcagtgaagctcatagggtattgaaaccgggaggcaggttcctttgccttgaactgagtcatgttggcattcctgtatttaaagatttgtatgactattattctttctcagttattccatacatgggtgagctgctgtccatattttcttacttctctattgctcaaagaaaagggccggtagggcttgcatttttgaatggacctatagatgcttctcaagatggctggttactacttattatcacttccctcaagtatgaaaaatttgcatcgatgattgcggatgcagggtttcagaaagtagagtatgagaatctagttgcgggagtggttgctatccattcagggttaaaaatctga

SEQ ID NO: 34486 - DNA, 1395 bp, Glycine max
  Peptide Sequence Number=SeqID_151264
cctataattaatccaatttctgctgctgccgctgctgcaaccagtgctgcactggcagagagggcttcatctgtagtagctattgctggaatgaatggggatacccgaaacttgggtgatgttaaacctagaataagtgaagaatctaatgacaagtcaaagatatggaagctcactgaaatcaacgaacaatctcaatgtagatccttgaagctaccggagaatgtaagagtaaccaagtgctactggatcttaatcactagatggttggatacatccttacttgcttactttgaagcagccttttcctattatctgatatcaaggttgatatatacaaattcaggtaatgctattctggcattagcatcaaatgccattcacctactctggaaatggcagcgaaatgagcgtaactcatctggcaaggccactgctaccttgcagcctcagttgtggcaaccatcgagtggcatcctgatgacaaatgacattgctgatagcaatcctgaggatgctgtaccctgctttgcgttgtccaaaaatgactcatatgtaatgtctgcatcaggagggaagatatctctgtttaatatgatgacttttaagactatgacaactttcatgcctccaccacctgcggcaacctttcttgctttccatcctcaggataacaatattattgctataggcatggatgattcctctattcaaatatataatgtccgtgttgatgaggttaaaagtaaactcaaaggccataataaaagaattactggtcttgctttctctcatgtattgaatgtattagtttcatctggagcagatgctcagatttgtgtctggaatactgatggatgggaaaagcagaagtctagattcttgcagcttccttctgggagaacaccaccggcacagtcagatacccgtgtacagtttcatcaagatcaaatacagttcttggttgtacatgaaactcagctcgccatttatgaagcaacaaaactagaaggtctaaagcagtggttcccgcgagactcatctgcaccaatatcctatgcaactttctcatgtgatagccagctggtatatgccagctttttagacgcaacaatctgtgtatttagtgcttcaaacctcagattacgttgtcggatcaatccttcttcatatcttcctgcaagtgtcagttccaacacacaaccacttgtaatcgctgcacaccctcaagaaccaaatcagtttgctgtcggactgtctgatggtggagttcatgtttttgaaccccttgaatctgaaggcaagtggggtgtgcctcccccgattgagaatgggtcagcaagcaatgtggcagctgcttcagttggaccttctccagatcaagctcaaagatga

SEQ ID NO: 34487 - DNA, 225 bp, Glycine max
  Peptide Sequence Number=SeqID_151265
atggaggagatacaagctctgctaccacgtgatgtagctccatgtagagcttgtaggtcttggatcttcttcatcaatgcaatgctttgcttcttgaagatcaatggtagcggaatggagaaggaggaaagtgaatctcaactatggttcaaaccactaatccaagatcatgtccaagattctccactaagtgtgcttaggtatcataaggcgtgtaaagcatga

SEQ ID NO: 34488 - DNA, 1173 bp, Glycine max
  Peptide Sequence Number=SeqID_151266
atggctctcctcacctcccaacctaaaaaacccattctccatcgcttcaccacccttcaccgcccacttccacgcttagatagaaccgttcttggtcttggctccttctctcacaatactctctccattaaaaaatttaactttaacccaaagcaaaccaaaatttcccttaaaaacaacccctttacctataatttggcagtgacagccaaagccaatgccaatgctgcatttggagaaggtttggaggcaggggaggtgacattgaaacacagaaagattttgttgtctgaggttgaggtgaagagacagagaagagtcttctttgggaggaaatggaactctttggatgttggcactgctggaattgtgttggccatgcatctcctttgcctctttgctcctttccatttcaattggccagcttttagggtggctgtggctctctatattgtcactggcctatttggcatcactctttctttccataggaacctttctcacaggagtttcaagcttcccaaatggcttgaatacttctttgcctattgtggggtcctggctcttcaggggaatccaattgactgggtgagcacccatagataccatcaccagttttgtgattctgagagagatcctcatagcccaactgaaggattctggttcagccatatgagttggctatttgataccagttctgtcatagaaaggtgtggagaagccaacaatgttggtgatttagagaaacaatccttctatagatttctccgaagctcttaccttgtccatccttttgctttgggagcccttctatatgcagcaggaggatttcctttccttgtttggggaatgggagtgaggattgtttgggtttatcatataacctggtttgtaaactcagcttgccatgtctgggggaatcaggcatggaacaccagggaattgtccagaaataattggtgggtggcgttgcttgcatttggtgagggttggcacaataaccaccatgcttttgagtactcagctagacatggactagagtggtggcaactagacatgacttggtacgttgtgagatttctcgaagctattggattggccactgacgtcaagttacccactgagagtcacaagcagaaaatggcactcaatagtgatccaatagacacatga

SEQ ID NO: 34489 - DNA, 447 bp, Glycine max
  Peptide Sequence Number=SeqID_151267
atgaccacaatctttgttggacgacaaggaatggatatctttatgaagtctcagaagagaaaatccctagaggcttacttagattgggaaataagggtagagcaacaacttaaaaggaagtctacttcaaaatgttatggctctcactcatatccagagaaagacgaaggtcgaggcatcttaggggcgacaccttctaagcccaaagatgataaggggaagacaatagaaaatcaaccccctaaggctagtatgaaagagaagactagctctataaagtgctttaaatgtcttggaagaggacacattacttctcaatgctccaccaagaaaatcatgattatgaggagccaagacatttatagtagccaagatgaggctactacttcactttcatctagtgaaagtgaagaagcaaaaggggaagaatctagagaagaaatctag

SEQ ID NO: 34490 - DNA, 225 bp, Glycine max
  Peptide Sequence Number=SeqID_151268
atggaggatcggaggcttctgagaaagcgacttttactgggtggagatcccaccggtaacgacaaagtttctgggaagggggtcccattatgtttgaccctggagtttggggaatattacggtgcgtgccatcgcgagatgcgcgctttatcaccgtgggatacgggtttgattgcgacacgagatggtttggtttgtttgattgatgccgaatgcgcgagatga

SEQ ID NO: 34491 - DNA, 578 bp, Glycine max
  Peptide Sequence Number=SeqID_151269
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggggagggacgaatcaaagcgacaagggccgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacg

SEQ ID NO: 34492 - DNA, 603 bp, Glycine max
  Peptide Sequence Number=SeqID_151270
atggattggttctcctggctttccaaaacaggccttgagccaaccctagtgtatgagtatggccttacttttgctcacaatgagcttgaagaagaagacataatctacttcaaccatgagtttctcatgagcatgggcctctccatagccaaacataggctagagattctcaagcttgcaaggaaagtgaagggaaagagggcaccggcacgccctgtggcaaggctcatggtggctatcaagaggacaaagaggtgcttagccaattacattcgcacgttcatcagctgtgaagaagagtcatcagcacttgttgtggtgccgtcatcatcaaggacaaggccttattatggtacaagatggaagagtcatgtgatgaagaggaacaaaaagatggtggtggctaagcaagagaggctcttgctcacaaatggaagccctaatactgtggtgcatggtcttgatgcttttactagtcctatggtttatcatttccaaaaggatgaaaaaatggaaggatatgatgatgatggatactggtcctcagctgctactgaagaaatcaggtgggataccatgttccaggatctaaagccaaattga

SEQ ID NO: 34493 - DNA, 276 bp, Glycine max
  Peptide Sequence Number=SeqID_151271
atggaagttattttgattaaccaccaacttattgacacggtagtagacataagcaatgaagatgttgatccaacagctgctgttgctgctgctgaaggggcagaagggatcattgtcaaatgctctttcattgccgtggctctcagccctagcttaaaatcccaatatgcttcagcacagatgtcacctattcagcccctgcgtttgctggttcctgcaaattatcctaattgttctcccatactcctagacaaatttccagttgaatccaggtga

SEQ ID NO: 34494 - DNA, 207 bp, Glycine max
  Peptide Sequence Number=SeqID_151272
atgaatcctgcgcagagaaagtgtgtgagggcacatcggagtatgttgggcagtggtgcttctagatctggcccaaaaatgcttagtagatcttctagtggcgattttgatttgatcagagcaactttggaagcaaaaagtggcagttatgttcaattgaattattgggagaaaaaaaggcaaatatttaacatagataggatttga

SEQ ID NO: 34495 - DNA, 1449 bp, Glycine max
  Peptide Sequence Number=SeqID_151273
atgaaagaaagttacttaccagagatgaatgaaatgtatcaaaaaattgctaataaacttcagcagcatgattctcttccccaacagccgaagtcagatcagattgataaattgagggcatataaaacaatgttggagcgtatgatggcactcctacagattcccaagaacaacattttgcctaatttcaaggaaaaactgggatcatatgagaagcaaattataaatctcataaattcaaatagacccaggaaaggcatgaattcagtacaggcaggacagctccccccaactcatatgtcctccatgcaacagccacaatcccaagttactcaagtacattctcatgaaaaccaaatgaaccctcaattgcagtcaacaaatttacagggttctgtaccaaccatgcagcagaataatattgcaagcttgcagcacaatgctttggctggtgtatcaacaggacaacagaatatgatgaattcaatgcaacctgtaactaatttagattctggacatggaaattctatgaactcccttcaacaggttccaatgagctccctccaacaaaaccctgttagtactcctcaacagactaacattaattccttaccatcacaaggtggggcaaatatgattcaaccaaatgcccttcagtcaggttccagtgcacttcaacaccaactgaaacatcagcaagaacagcagatgctgcagagtcaacaattcaaacaacaatatcagcagcgacaacaattgatgcagaggcagcagctcctgcagcagcagcaactacaccatccagcaaagccacagctatcttcacaattgcagacacatcaaatgccccaacttcaccaaatgaatgatataaatgatataaaaatgcgacaaggaatgggtgttaagtcaggtgtctttcagcagcatcttacatcaggtcaacactcaacatattcccatcaacagctgaaacaagggagtgcatttcctgtttcttcaccccaactccttcaggctgcatctcctcagattcagcaacactcatctccccaggttgaccaacaaaatcatctcccatccaaagcaaaagtcacaactcctctgcaatcttctaattcaccctttgtgggacctaccccttcacctcccttggctccatctcctatgccaggagaatctgagaagcctattccttgtgtttcatcaatatcaaatgctgcaaatattggacatcaacaaacagggggtgcaatagcaccagctcaatcccttgccattgggactcctgggatatcagcctctcctttattggcagaattcagtgctcctgatggtgcgcatggtaatgctttagctgccacttctgggaagtcaactgttacagagcagcctcttgaacgcctaattaatgcggtcagtatagaagtttatctgatgctagcttga

SEQ ID NO: 34496 - DNA, 1337 bp, Glycine max
  Peptide Sequence Number=SeqID_151274
atggagacattaaaaaaacatcttcctgtttctggtcctgatggattgcatgaacttcggaagattgctcaaaggtttgaagacaagatttttactgctgcaacaagccagcctgattacctacggaaaatatctttgaagatgcttacaatggagactaaatcccaaaacaccttggctaacaatatgccaccaaatcaagtcggccctagcaataaacctcctgatcaagttcataatcttgggcaacaacattctattcctttgcctggtcagctccagccacatcagcagcttctatctcaaaatgttcaaaataatgttgcgtcgcaacctaaccttccacctgtatctagtctagcccagactcccagccaaaatattgtccagaactccaatatacagaatataactgggccaaattcagttgggaccactattagccaaaattccaacttacagaatatgtttcctggttctcagagacaaatgccaggaaggcagcagattgttcccccacagaattcacagcaatatctttaccaacagcagtttaagcagaagctccagcttcaatctcagatgcagcagcaacaacaaaaccttctgcaaccaaatcagttgcaatcttctcagcaatctattatgcaaacttcatctgttatgcagccatccatgatgcaaacatcttctctatctagcataccacagaatcagcagtctactaatgttcaacagccaatgcagtccatgccacagcagcattcacaagttatcaggcatcagcaacaaacagcagtcactcatcagccaagcttaccttcacaacagcaacaacaacttatggggcatcagccaaatacaacaaacatgcaacatgcacagatgcttgggcaacagaacaatgttggtgatatacagcaaccacagaggatgctctcacaacagagtaatcttacaaacctgcaacagagacagcagttaataaatcagcaaaacaacccagcaaatatacatcaacaacaatttggaaataatggccctgggttacagcagcaacatttgctcggacatgaatctggcaatgctgacatgcaaacaagtcatcactctacacacatgttgcagcaaccaaaggttccaatgcagcaacaatcacaacaaaatacatcaaatttgttgctacctcattcacagcaaccacagccactgggttcacaacagcaattaatgccacagattcacactcagtctgcacagttgcaacagcaattgggtttgcagcagcagccaaatccctcacaacgagatatgcagcaaagaattcaagcatcagg

SEQ ID NO: 34497 - DNA, 960 bp, Glycine max
  Peptide Sequence Number=SeqID_151275
atgttctcacccaggcaaataaattttttcatagggcttgttttgcagtctcaagttcataatcttgggcaacagcattctattcctttgtctagtcagctccagccacatcagcagcttctatctcaaaatgttcaaaacaatgttgcatctcaacctaaccttccacctgtatctagtctagcccagactaccagccaaaatattgtccagaactccaacatgcagaatataactgggccaaattcagttgggagcactattagccaaaattccaacttacagaatatgtttcctggttctcagagacaaatgccaggaaggcagcagattgttcccccacagaattcaccgcaatatctttaccaacagcagcgtttgaagcagaagcagcttcaatctcagatgcagcaacaacaacaaaaccttctgcaaccaaatcagttgcaatcttctcagcaatctattatgcaaacttcatctgttatgcagccatccatgatgcaaacatcttctctatctagcattccacagaatcaacagtctactaatgttcaacagccaatgcagtccatgccacagcagcattcacaagttatcaggcatcagcaacaaacagcagtcactcatcagccaagcttaccttcacaacagcaacaacaacttatggggcatcagccaaatacaacaaacatgcaacatgcacagatgcttgggcaacagaacaatgttggtgatatacagcaacgaaaattgccaatgaatgagaaacacgagcaaagtaagtacaaatacttcatcaggaaggctacatataataattgggatttgcgaatgtggataggtgcttgtaatcgatcattgcatagccgatttgctttacttggattcttttccaacattcacgcggctgcgagggctgtaatcctcaggtgcctaaataatgtcatgtacgtgtaa

SEQ ID NO: 34498 - DNA, 309 bp, Glycine max
  Peptide Sequence Number=SeqID_151276
atgactagaggcaatccaggtgacttacaaccctttgatcctaaaatagataggacatttcatagattagttaggcatagagtgcatcttgatcaccctgaacattttgtaccttttgagcatcctgagcattctgttattggtgaagacctttataaacatctgaaagaattccatattttctactctaccatgaaacctccagatgtccaagaagatcacatctttctgaaggcctttcctcattctttagagggagtggcaaaggactggctatattaccttgctccaaggtccgtcacgagctag

SEQ ID NO: 34499 - DNA, 648 bp, Glycine max
  Peptide Sequence Number=SeqID_151277
atggaggaatatccaaccattcaagtctcaaagagtgcacatctgctagatttcctatatcacatgattgtccccaatatattagaaggccaagatacaattgaagttgagtttaaacaaggagaagaagaagaggaaggaaatgaagaatcaaatgctgacttcagccaagttaagcaactctatagtgaactatggaagaggctttcaaaactaaacaaagggccagtgaagttaataattgtatctagacgatttaaggttctgaagcaacctcttgagtaccttttctctcaaaatggaggagaaagtgagaattcaagctcaaatagtagtctcaagaacaagccaccctcggtggaggaaatcactgttccttctgttacagaactcttgaattcgggggttcgttttttacctactaacggaagcatattaaacattacttttgatgcgaaaacatgcacgttttacctccccacaataggtttggatgctaatactgaagttttcctgaaaaatttggttgcatatgaagcatcagttgcatcaggtcccttggttgtaacccgttacacggagttgatgaacgggattatagactcggatgaagatgcaaagattctcagagaaaaagggatattctga

SEQ ID NO: 34500 - DNA, 483 bp, Glycine max
  Peptide Sequence Number=SeqID_151278
atggtgaattccccgtatccatcttcagcgtcccaaagctccttagggcttgtgatcccgcttcttatattcctcaacaagttgcacttggcccttaattaccattattggcgtccagaactgtatgagatgcagaggtacaagcttgcagcagcaaaaagattccagaaacagttgcaaagcctcaagttagacaatctcgttgaccaattgaccaagttggagcaaagggttcgagcatgctaccacaagttcttggatttcaacggggaaacgttggtgtggatgatggcaattgatgcctcattcttgcttgagtttctcgaagtttgtaccattcaagatgtaacaaaagtacctgaagggaaatcttatcaaaatgcaattttgagggatattgtaatgcttgagaatcaaataccaatgtttgtgttgagaaagatgatggagttcaatttctcatcattagaagcttcagattag

SEQ ID NO: 34501 - DNA, 168 bp, Glycine max
  Peptide Sequence Number=SeqID_151279
atgttgaaagcacaggttactacatcggtgctggctagaaacgatgttgaaagcacatgctattacatcgaaacgatgttgaaagcacaggctattacatcggtattggagagaaacgatgttgaaagcacaggttactacatcggtactaacaagaaacgatgttga

SEQ ID NO: 34502 - DNA, 225 bp, Glycine max
  Peptide Sequence Number=SeqID_151280
atgcagtatcctctaacgtctttgcttgcacggctttcgaccgggacgggaagaggtttcctcgttgcatctttccacacagcattggttctgtcccttaccttacctttatcgcccgtcgggcgtcaagcccagagcaagggctggggggaaagaatgcatttccggaatctcaatgttgccccaccaaaagacgagaaccaaatgccaatcgctgatctgtaa

SEQ ID NO: 34503 - DNA, 123 bp, Glycine max
  Peptide Sequence Number=SeqID_151281
atgactcttcgcttagcggacatgcacaactcatccttctttcagattcttcctcatgctcagccgaggagtgttgcgctcagtggatggctcgctaagccagaagattggcttagcgagagg

SEQ ID NO: 34504 - DNA, 170 bp, Glycine max
  Peptide Sequence Number=SeqID_151282
atggcactgtttgagaggggagttgtgccctatgggtctgccatggttgcacgcaagcgccaaccagttgcttttgcattagggacggctgctgacccaaaggagtctcgtcggtacaaaccttgggatcctggaggaccttggtggactcgtaacaccttgaggacaag

SEQ ID NO: 34505 - DNA, 459 bp, Glycine max
  Peptide Sequence Number=SeqID_151283
atgttaaaccagctggcattaccttttctggtcgtgggcgtgtgtaccgccctgatgatcgctaaagatctgttgcgtcacccgcatccgctggcggtcatgaatatcatctggccgctcaccgggctgtacatgccgtttttcggctggctggcatggtggtatctcgggcgtaaaccgtcacgtcagcgaaaactggcgctgctgctgccatccggattaaccggttatgccagctggcaaaccatttttatttccacctcgctctctgccgccgcctgtatattcggcgacatcatcaccctgccaatagtcacgctactcaagcattttgcaattagccccgcgctgtgctcaatcccctgctcagcgccttctggtttatgttacagctggcgatgctcaccggatttattttctcctggccggcaaatcatttcctcatcaaacgcggattaa

SEQ ID NO: 34506 - DNA, 819 bp, Glycine max
  Peptide Sequence Number=SeqID_151284
atgttcagggcaaggaaaacaaacacgcacagcagcgctgatcgccaccacgtcggcgatgccggtcaccacccagcagaaccagtaagtccagccggtgaaataaccggcccacggaccgagcagatcggcggcaaagtcgctgaaggatttgtactcaaggttggagagcagcagctcacccatggcgcgcatcacaaagaacagcataaaaccgatgatcatatagacgaagatgatcgacggacccgccaggctgatggttttaccggagcccatgaacagaccggtgccaatggcaccgccgatagcgataagctggatgtgacggttatgcagctctgctggctgttgaataacgtgctgttgcacagggcaagagggcataagatagaggaaaggcggccactctcggtaatggtttttaaacctttgtgcccttttgcgtgctttaccgtgtcagtaaatatttacatggcgcgccgtgccgtcattttgcgtaaatgttctgcaaatgagccgcttgcaccacgcagcgctgcgcagggttctacacttgtcatttcgatgaacccggaaaaagtgaggcagcgtgcgcgcattgctcgcgatagtgctgctggccctgtgcggctggtggagtttaccctggctgaaaacgcatctgccgccacagtggaatccgtttataccgctccaggttaccgatccgccgggctggatgacgcgctacaagctgcagcggctgagcagcgatccggccgcgtgtctggcggtgatgcgtgcggccagcgcgcagggcagagtcagtttccgtga

SEQ ID NO: 34507 - DNA, 372 bp, Glycine max
  Peptide Sequence Number=SeqID_151285
atggcggtggccagcacgctgtatgttacgcgcagcaatgcggcgctgcagcaggccggcattacctcgccgctgcgccgcatcgcgcacgttggcagttacgcctgccgcaatatttatcaccgccaggaaggacgccgcagtgaacacgcgacggcggaggcgtgggacatcacggggtttcagctggcggacgggcgctggctgcaggtaggcaaaaactggcagcaaccgccgcaggccgctgccggtttgcacgcgttatggcgcaacggctgtgccagcttcggtaatgcgctggggccggattacaatgcggcgcatgccagccatttccaccttggcatgcgcggcgcaggcttttgtcgctaa

SEQ ID NO: 34508 - DNA, 1104 bp, Glycine max
  Peptide Sequence Number=SeqID_151286
atgcctaaaacagtgattattcctcccggcaccacgacgccgatcgctccgtttgtgcccggcaccttagccgatggcgtggtgtatgtttccggtacgctgccgttcgatgccgacaacaacgtggtgcacgtcggggatgcggcggcgcaaacccgccacgtgctggagaccatcaaaaaagtgatcgagaccgccggtggcagcctgcaggacgtcactttcaactcgattttcatcaccgactggagcaactacgcggcggtaaaccagcgtggcacacattggccggcaggaggcgtaatgcatctggacattcagggattaagcgcgcccgacgcgccgacgctggtactgtcgtccgggctgggcggcgtggccgctttctggcaaccgcagctggcggcactgacgccacactatcgcgtggtgacctacgatcagcgcggcaccggtcgcagccccgatacgctgccggaaggttacagcatggcgatgatggcagcggaactggctgacgcgctggcggagcacggcatcgaacagtatgacatcgtgggccatgcgcttggcgggctgattggtctgcagctggcactcgattatccgcagcgcgtgggacgcgtggtggtgattaacggctggctggcgctggatgcccacaccgagcgctgcttccaggtgcgccaggatctgctgctcaacgttggtgttgaagcgtttgtgcgcgcgcagccgctgtttctttatccggccgaatggctggcacgccatcagtcacgcatcagcgcggaggatgtgcatcacgtggcgcatttccagggcatggagaacctgctgcggcgtctgcacgcgctgaaatcggccgatttccgtccgcacgcctcgcgaatcacccagccggtgctggcgatatgcagtcaggatgacctgctggtgccgtggagctgctcgccgcagctggcgcaggcgctgcccaacggcagcctgattgagatgccgtggggcggccatgccatgagcgtgaccgatgccgacaactttaatgcgctgctgctgcgctggctggcggacaccgccacgccggctcgccgcgccagctaa

SEQ ID NO: 34509 - DNA, 950 bp, Glycine max
  Peptide Sequence Number=SeqID_151287
ggcttcccggtatcaacagggacacccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgcgcgaccagatcatcatcgccagcgtctgcagcacgatcgacacgccgatcgccgtgatcagcggcgccaggcgcggcgcgttgcgcagcggccggtaggcgacacgttcgatggtgtacgccacgatggcgcagaccggcatcgcaaacagcaaggcgaacaccagcgtgagccaatcaggcagattggggaaatatttctggaggaagttgatggcagtcagggcagacattgcaccgaccatcagaacatcgccgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgctcaggaagatacttaacagggaa

SEQ ID NO: 34510 - DNA, 816 bp, Glycine max
  Peptide Sequence Number=SeqID_151288
atgtcttctctgaaatcagttgtgtctcttgactctaagtataactttgatgagctccaatgggtcatccaaatccgtagaacccttgaagaagagcttggtgaagatgatgaattccccgtatccatcttcagcgtcccaaagctccttagggcttgtgatccagcttcttatattcctcaacaagttgcacttggcccttaccattattggcgtccagaactgtatgagatgcagaggtacaagcttgcagcagcaaaaagattccagaaacaattgcaaagcctcaagtttgataatatcattgaccaattgaccaagttggagcaaaggattcgagcatgccaccacaagttcttggatttcaacggggaaacgttggtgtggatgatggcagttgatgcctcattcttgcttgagttcctccaagtctttgattgtgccattcaagatggaacaaaagtacctaaagggaaatcatatcataatgcaattttgagggatattgtaatgcttgagaatcaaataccaatgtttgtgttgagaaagatgatggagttcaaattctcatcactagaagcttcagatcagatgctgaaattgaagtttatagggctgttcaaagagatttctcctttcaagatgatggaggaatatccaaccattcaagtttcaaagagtgcacatctgctagatttcctatatcacataattgtccccaatatattagaacgccaagatacaattgaagttgagactcaacaaggagatgaagaaaaggaaggaaatgaagaatcaaacgctgactccagccaa

SEQ ID NO: 34511 - DNA, 598 bp, Glycine max
  Peptide Sequence Number=SeqID_151289
acagcaaaaaagaatgtttatacggataaccactcaggtatttccgcccgtcaacgtgactcaaatgtcagtatgacagatcttgtgagcgcggaagataacgtttttcgtcttacagacaacaaaaaggaagtttatacggataaccactcgggtatttccgcctgtcagcgtgactcaaatgtcagtatgacagatcttgtgagcgcggaagatgacgtaaatctcggcgtgtcaacgggcttgtcggccgcgattgacgaagagcgcataagacgaccaaaaaagaatgtttatacggataaccactcgggtatttccgcccgtcagcgtgactcaaatgtcagtatgacagatcttgtgagcgcggatgatggcgtaaatctccgcgtgttaatgggcttgtcggccgcgattgacgaagggcgaagaagacgaccaaaaaagaatgtttatacggataaccactcgggtatttccgcccgtcaacgtgactcaaatgtcagtatgacagatcttgtgagcgcggaagataacgcaaatctcctcgtgtcaacgggcttgtcggccgcgattgacgaagggcgcagaagacgac

SEQ ID NO: 34512 - DNA, 318 bp, Glycine max
  Peptide Sequence Number=SeqID_151290
cctgggccagttgcgccttgcactgtgccagtgcttcatcacgttccttcaactgctcatcaaggcgctgcagttgccgcgccatttcggcgcactggtcgcggcgctgctccaggctctgcgcttgagcctccagctgccgacgcatctcctcgctggcgccctgcgcctgggccaggatcgtgcgcaggccctggatctgcgcatcacgctgctccagcagttgctcctgcgccctgcaggcgccggaggcctggcggtgttcccccagcaaccgctcgttatcgcggtgcaggcgggtcagttagtcctgcttga

SEQ ID NO: 34513 - DNA, 3039 bp, Glycine max
  Peptide Sequence Number=SeqID_151291
atggataaaatgtctgctccttcatcaagggagcgtgcacaacgcctctatgaaaagaacctggagttggagagtaagcgtcggaggtcggctcaggtgcgtgtcccatcagatcctaatgcttggcaacagatgcgtgagaattatgaagcaataattcttgaggatcaagctttctctgagcagcacaatattgaatatgctctttggcagttgcattataagcagattgaggagtttagggcatacttcagtgctgctctttcttctacaaatgcaaactcatctcagggagtgaaaggccctgcgcgacctgatcgcataagtaaaataaggctacaatttaagactttcctttcagaagcaactggattttaccatgatcttattacgaaaatcagagctaagtatggtcttcctcttggttactttgacgattcagagaaccggattgtgatggagaaagatggaaagaaatctgctgcgatgaagaaaggcttagtagcttgtcatcgttgtcttatatacttgggtgatcttgctcgttataaaggaatgtatggtgaaggtgactcaataaaccgggagttcactgcagcttctagttattacttgcaagctgcatctctttggccttctagtgggaacccccatcatcagcttgctttgttggcttcatattctggggatgagctggtggctatctatcgatattttcgtagtctggctgtagatagtccatttacaactgcaagagaaaacttgatagttgcatttgagaagaatcgtcaaagtttctctcagctttctggtgatgctaaaactcttgcagtcaaggaatcttctgggcgatcaactggcaaaggaagaggaaaaggggaagcaaaacttgcaacaaggggtattggcgttgatgccagtcctagaacaggagcatccagtatacaggaaacatataaatacttctgcacccgctttgtccgtctaaatggaatcttgtttacacgcacaagccttgagacttttgctgaagttcttgctgttgtaagctctgggctgcgtgagcttctgtcttccggtcaagatgaagagctgaattttggtacagatactcctgagaatgcacttgtcattgtcagaattgtctgcattctagtattcacagtttacaatgtgaacaaggaatctgaaggtcaaacttatgcagaaattgtacagcgtgctgttctgcttcagaatgcatttacagcagcttttgaattgatgggctacataatagagagatgtgcacagctgtgtgatccttcttctagttatcttttaccaggcattttggtttttgttgagtggttggctttttatccagatcatgctgcaggcaacgatgtggatgaaaatcaggcaaatttgagatcagaattttggaatcgttgtgtatccttcttgaataagctgctttcagttgggcctatgtctattgatgatgatgaagaggagacttgctttaataacatgagcaggtacgaggaaggggaaactgaaaaccgacatgctttgtgggaggactctgagttaaggggatttattccacttcttcctgcacaaaccatcttggatttttcaaggaagcattccattggaagtgatggtgataaggaaagaaaagctcgggtcaaaaggattttagctgctgggaaggctttagtaaatgtggttaaggttgataaacaaatgatatattttgattcaaaggcgaagaaatttgtaattggtattgagcctcaaaccacagatgattttggtctaaccactgattcaggcatgcctaatgcaaaacagttagggcaagaaaatcctgcagaccaatcaaagatggaaattattcagtcaaaccaacaccagcatatggaaggagatgacgacgacgaggttattgttttcaagcctatagtgcctgagacacgaggtgatgtgattgcctcatcatgggcaccccatgtgggtttggaacctgtttcgaaagcatctggaggggatttaaaatttcatgttaattctacttctaatcctctaagtaacctaagtcatcaaacttcatctgtttctggtagtggtatggtgcctcaacacctgcaacccgttcagccgcatacatcaagttggttagaggaggaaatttctcttgcttacaatttaaaaggtcttgggttatttgagaatggacatgtgatgaaacctggtctacaagaagctgctggcttctccaaccatgtttcacttccttttcctatccaacaatctataggtgctgatactaatgccatgttttatggtttctcgaaagctttggagtctgtagtaccgtccaaagttgatgttattgcatcttctggagtagttactgataatttagctgtaaacacaccaactttgccagttggttcaagaaaagccccagtcagtcgacctactaggcaccttggacctccgcctggtttcagtcatgttcctcccaaacaaggtattgaatccactgtttcagatgctattagtgggaatccaattatggatgattacagttggttggatggatatcatttgcatgcatcaacaaaaggattaggctccaatggccctcttaactactctcagtcaaatgctcagcaagtcagtaacaatggcttgaatcctactgttagttttccctttcctggaaaacaagttccttctgtgcctcttcaagtggagaaacagaatggttggcaagactatcaaacttatgatcttttaaaatcacatcatgatcagcagcttcagccacaacagctcacaactggaaatcagcagttttctcctctgcccgagcaatttcaaggacagcatattgcgaatgtgctgcatccttttgctactcaaacaaactccaacattgctgtctcgtcattgaatgttgttggagtttctttggccttggcttgttgcaggcacttgctactacaaaagattatgatgagctctagcccagacgaaggaagataa

SEQ ID NO: 34514 - DNA, 1210 bp, Glycine max
  Peptide Sequence Number=SeqID_151292
gtcttggcgtggtgctggcgattgtcacgctgctcgccagcatcggcttgctgacgctgtccggctggtttcttgctgcctcctcgctggctggcgtcgccggcctccacgacgccactttccgcgtgctgcaacatctgcgcgtctttaccttcagccggctgatggcgctggcaccggcgcagctggcgcgctttcgtcacggcgaactgctgaaccgctttgtcagcgatgtcgatactctcgaccatctctatttacgcgttatttctccactgctgggtgcggcggtggtgattgtggtggtgacctgtggcctggcgctactcgatatgcgactggcgctgctgctcggggcgatcatgttgctgacgctgctgctaatgccgccgctattctggcggctcggcgcgcgcaccggcgcgcatattgcccgttaccaggctcgctggcgcctgcaactgacgcactggctcagcggactggccgagctgcagatttatggcgcggcgacgctgtggcgacagcggctggatcaggaagaacgtgcgtggcaacaggcgcagcagcagcaacaccggctgcaggcgctggcgcagagcctgcttacgttgatcgccggcagtaccgttacgctgctgctgtggctggccgccagcggcgtgacgcacgcggcgcagcgcgtgcaggagatcatcgatcaaccgccagcgattcacttcccgacacaaccggtcgcgacgcagcgcggcctcagcctgacgctggaacagatcgatttcagctatccgcagcggccagaagcggtgctgcacaacttctctctgaccgcggcacgattcgcctgaacgggattgatctggcggcgtgggacgaagccagcctgcgtcagcgtatcagcgttgtcacgcagcgcgtccatctgttcagccagacgctgcgcgctaacctgctgctggcagcaccacaggccagcgatgcacagctgattgacgtattacagcgggttgggctggcgcatctgacgcagcacagcgaaggactgaatgcgtggatgggtgaaggtggccgaccgctgtccggcggtgaactgcgccggctggcgatcgcccgtgcgctgctgcacgatggcgatctgtggctgctggatgagccgaccgaaggtctggatgccgcgaccgagcagcagattctcacgttgctacagcag

SEQ ID NO: 34515 - DNA, 354 bp, Glycine max
  Peptide Sequence Number=SeqID_151293
atggtgggcgtgatgggtgtaggcgccgataccgacgaggaggcgcagcatctctttacctcgtcacagcagcaattcgtcaatttgcggcgcaatgtgcggacgcagttcccgaagcccgtgcacagcatggaaggctactggaacgagatggagcgcttctccgtggagcacacgttgcgttttgccgccgttggcgcgcctgaaacgatccagcgccatctcgacggttttctggctgaaacacaggcggatgaactgattgtctcaatgccgatccacgacatcgaaaagcggctgcggtcggtcgagattttcgccgacgtgcggacatccatcaaaaaggccgcctaa

SEQ ID NO: 34516 - DNA, 216 bp, Glycine max
  Peptide Sequence Number=SeqID_151294
atggatgcaagaggtgcgcttagcgggatgagctctctcttagcgcgcaatagtgaatttcgacttagcacgcgtcttctcgctcagtggatggactcaagcggtgcgcttagcaggatgatccatcgctcagcgaacatgcacagctcatccttcttccatattcttcctcgtgctcagccaaaggagtggtgcgctcagtggatggctcgctaa

SEQ ID NO: 34517 - DNA, 420 bp, Glycine max
  Peptide Sequence Number=SeqID_151295
atgtgtgactcccaggcggcgtgccctcggcctaatggcttctcggcgcaacttgcgttcaaagactcgatggttcacgggattctgcaattcacaccaagtatcgcatttcgctacgttcttcatcgatgcaagagccgagatatccgttgccgagagtcattatttgagttccttggcgcacgaagcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcaagctgatgactcgcgcttactag

SEQ ID NO: 34518 - DNA, 420 bp, Glycine max
  Peptide Sequence Number=SeqID_151296
atgtgggcttttcataaaggcctacaaattgattgggcacacttagttcgatatcgcatgcataaggctttgcgattaaatgctccattgccatatccacacctaatcaccctcttccttcaacacttcaacatccctcttgattctgaaccttatgttccaatcaagagatcctttctaataggcgttgttgtgattgcatcctttggttatcaaaaagagcatgatggctcttgggtgaaaaagggtgctcgacccgttgatgaagaaggacatttacatggtggagaagattcctctcttcttcaaaagattttggataggttcgatggtcttcaatcctttgttggtgaaagggttgtcatcatcaaaaagggggagattgtagaagcaagcttcatgatgctgaatcaagattga

SEQ ID NO: 34519 - DNA, 344 bp, Glycine max
  Peptide Sequence Number=SeqID_151297
atgactaacaaattcaactcaatgactgagatcaatgctaagaaagagagttggagaatcatggttagggttgttcatttgtggatgatatctaatgtttcaactaccaaacaaacatttagcagcaaaataccattatccatggagacggtgctggtggactcaaagactctcatttataagtttgacaaaaccttacaagaagggaaagtatactctattcaattttttggtgttgttgacaatggaggtatatatagaatcatcctccacaagtacaaaattatgtttcagtactccactaaggttgcattggtggacaatgcaagtgttccagactctgt

SEQ ID NO: 34520 - DNA, 1113 bp, Glycine max
  Peptide Sequence Number=SeqID_151298
atggcatccaggcgattccattctttggacgcttggaatagatacaccaataacattctcggccggaatatccttccggagagaaatgtgcagatttatcatactgagtatgacgagtttaaagtggaattggagaggcgtaatctacacaaatgcctcgctaatctccaagatggaagcatagatgtagctatggtgaaggagttttatgctaatttatacaccatagaggagcaagcacctaagcaagccagagtacgaggacacttgatcaaaatagatgcagacggcctgaatgagttccttcaaatgccaatggtattggaagagggggaatctttacccacttactctagattttgcaggttaaggactaatcctcaagatattgaagctaggctctgtattccctgcaaggggtttgttttgaatgctgagggccagccatggaagcttcttagaaaagatctgatgacactggctcagacatggagtgtcttctcttactccaacctagctcccacatcccacacctcagatctaaatatggatagagctaggttggtctatggcttggtgactaacatggatatgaacatcggagcccttatcttgggtgagttttcttctattgctcagagtaactcctctaggcttggatttccagccttgatcactaccctatacagagctacaggagttacctctgacagtctgacctatgagagcttgagcctggccattaacttggcctacattaagaaaaactattggaatgtggatgatctaatagttaacttcagaggggcgaggaaggcaagggtgagaccagcttatgttccttcttcttctactctaccagctccttccacttctgctactcctacaccagctcctccaggctcatctactcaggactctcagcgctttgaagctatgcttcaaaagcagttcattgagaaggtatcctggcctggaaccttgccttctgttgtgagaaaaggtgaaggtcccagtgctcaggtaaggcaggaggctgctactccagagagatcaccacaaatttcaccagatccaccctttccagtggtggatcaatcttttcttcagtag

SEQ ID NO: 34521 - DNA, 274 bp, Glycine max
  Peptide Sequence Number=SeqID_151299
ggatcgcgcccgcaagacaccagtggacccgaagaagtccaacagggtcttggagttgtcagctctgattacgggcctctatcagttctacagagtgcctctcgcccccagcaaggtcatcaagatccctactaatcgagctttcatcaagaagtactgcgcccccaggcaagcgcagggcgaaacaccacagcagcctggggatggccggcagtgggcaacagacgcatgttcgcattttagtaaaaaaaaaaaaacaccgagactattttag

SEQ ID NO: 34522 - DNA, 207 bp, Glycine max
  Peptide Sequence Number=SeqID_151300
atgtacaatttaagcgtccaaatattgggactcttaataacatgcgatgatgaagagggatcaggtctgaaagcaagcaggggctgctctcgttcttcgacttgccaagattgctcaacttgttattgtgaagggtgcatcaagtgccactttgaggattgcaattgccaagaatgcagagactttatgctatatgctaaaccttaa

SEQ ID NO: 34523 - DNA, 669 bp, Glycine max
  Peptide Sequence Number=SeqID_151301
atgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactggtttatcaagaatacgcaagaaaagcattttgaattgttgattcattgccagagatggcttagaatcaatagttcattatctaatggatttttccgttctaatactctatctgagagttatcaatatttatcaaatctgttcctatctaacgaagcgctattggatcaaatgacaaagacattgttgagaaaaagatggcttttcccagatgagatggttgttgctatctgctccaataacgaatcattgatcccctatatcgataatacacattccagtttgggaacgtccggtgccaaagtcattgaatggcatatactcctcggggagggtgcagggcggacgatttcaaaacagattacccattcattcgatagagaagatcaccaagatttcgtgattcgctgccgaacttattccaattcaataagagatctcaatattatgccttga

SEQ ID NO: 34524 - DNA, 186 bp, Glycine max
  Peptide Sequence Number=SeqID_151302
atggacaccatagtggtgccttcttcttaccaccaacaatgtgcaccaaaataccctgactttgtccatttcagatatgatggaataacataccaaatcagactaagacaacatcaacaaaaacccgggggatccactagttctagagcggccgccaccgcggtggagctccaattcgccctatag

SEQ ID NO: 34525 - DNA, 249 bp, Glycine max
  Peptide Sequence Number=SeqID_151303
atgttcttcaagggaaggttgcggaggagcctcaactgtttgctatttctggggctgttgctgttgttgttgctgaattggtggaggaatgtatggattcgaccatctaaggttgggatgattcctccacccgggattgtacctattgctggagtaattgttctattgtggctgattttgctgctgaggttgaggagattgttgcacaaaagggcaaaggtctgtgtggtggtcggtagaggagcataa

SEQ ID NO: 34526 - DNA, 174 bp, Glycine max
  Peptide Sequence Number=SeqID_151304
atggtgcaaaatcgggaggaggagaaggatttttggtattttgaaatgtctagaaagggggttttatggaagatcaacgacaaaaaaaggtacaattcattgaagactatattggtgaaggaaatatcggtgaaggagaagactatgagggagggagaagcaaatgggagataa

SEQ ID NO: 34527 - DNA, 786 bp, Glycine max
  Peptide Sequence Number=SeqID_151305
atggaatcccttgatgaagaccatgctgccaaactacttagagctcaaacccacatatggaatcacatatttagcttcataagctccatgtccttaaatgtgtgtgtgacacctttcttgcattccattcttgatccaattttgacaaatccatggaaccaattttctaattggttcaaaaatggtgatcctacaccatttgaaacagcacatgggatgatgttttgggattatgccggcgctgattcgaaacttaataacttgttcaatgatgccatggctagtgatgctcgattagtcactagtttggtgattgagaaatgtaaaggggtgttcatgggattggggtcattggttgatgttgggggaggcacagggaccatggcaaaagccattgctaaatcattccctcagttggattgcattgtgtttgatctaccacatgttgtttctggcttgcaaggaagtgagaaccttaaatttgttggaggggacatgtttgaggcaattcctccagctgatgccattttgttgaagaaatgcaaagaggcaataacgaggaaaggcaaagaagggaaggtgatcatcatagacatggtggtggagaatgagaagagagatgatgaacctattggaacacagctcttctttgatatgctgatgatggtgttggttactggaaaagagagaagcaagaaagagtgggttaagttgaattcctctgccgattataacaactacaagataacgccagtcttgggcttaaggtctcttattgagatatag

SEQ ID NO: 34528 - DNA, 156 bp, Glycine max
  Peptide Sequence Number=SeqID_151306
atggttagcaatgaaagagaaagtataaatcctcaagaggaacccacaatatgtaccatgcatccagattccagagtgggtgatggaagtggaatgttaaagaatactacttcagcaaaatcgtcattaagtggcatctctatgtctacactgtga

SEQ ID NO: 34529 - DNA, 348 bp, Glycine max
  Peptide Sequence Number=SeqID_151307
atgcccaattccacaggcttcgtttcacttcttccaatccgccatggccacctctgtgttactctgctctctccaccactacgaccttccctcttcttctatctccgcctttcgatcgataccatcaccccccactcttccgtgtctccatttttggaggttctagaaaaagagaaatgggggaaggggcttggcggcgcgcaggataatcaaaaaaagggaagaaaaggcgagggaaacgagtgggggcgtagaggtgttgatgttgatggactgaaactgccgatgcaatttttttgggtggaggccgggagaaccagcacatgggagggaaggggtgctaactga

SEQ ID NO: 34530 - DNA, 549 bp, Glycine max
  Peptide Sequence Number=SeqID_151308
atgtttaagcagggaatgacaaccaaagaaaatgacaagaaaaagaaaggaatttcacttaaagcctcatcttccattcaagaagaaagtgacaaagaggacttgaatgaaatagaagaagatgatgatttcagtctcttcataaaaagattcaataagtttctaaggaacaaaggaaatcaaggaaaaacaaacttcaatccaaataaaagaggagaagatttatcttctattccaaagtgttatgaatgtaatcaacctggacatctaagagttgattgccttggtttcaagagaagaatggaaaaatctggcaggaaaaccttcaaagataagaaggcaaagaaagctgacatcacttgggaagataacaatatggattcatccagagactcagaaaatgaagtcatgaatctaagtttcatggctaaaaactatgaaagtgaagaagaggtaacatcttctaacaataacttatctatttcctttgatgacttcaaaatgcattcaatgacttgcaaaaagaatcagtcaaacttgccaaactag

SEQ ID NO: 34531 - DNA, 114 bp, Glycine max
  Peptide Sequence Number=SeqID_151309
atgtccaatttagcccgtgacgggttaaagggccgattcaataaagtacgaacgtttaccctcctgatcaattatgaagcctcttttgaagaggcttcagcttatgaagattga

SEQ ID NO: 34532 - DNA, 1221 bp, Glycine max
  Peptide Sequence Number=SeqID_151310
atggaacacagcacatccttcaacgactcaaataacagcctctcttcacaacgaagcctcgtttcagttccttccctcaactcacactctcaattcctcactccttccaccacctcccacacgtgcctcaccactctcaaattcctcacctcatcctccgtatacatctcctccctcacccttgccggcaagttcctctacgcaggctcctccgacagagaaatcagatcctggaaccacacccatttcatccaaaaccaaaaaccaaccaccaccaccaccaccaccaccaccaacaacaacaacaacagcgttgtaattgccggaaaaggtgctgtcaagtccatagtagttcactccgacaaactcttcaccgcccaccaagacaacaaaatccgcgtctggaaagtcacaaacctttcccacgaccaccagaagtacacacgtgtggccacactccccacgctcgccgaccgcgtcaccaaactcctcgtccccaaaaaccacgtgcggattcgccgccacaaaaagtgcacctgggttcaccacgtcgacaccgtctcctccatcgccctgtcccaagacggaaacttcttgtactcggtctcatgggacagaacaattaaggtttggcgaaccaaagacttggcgtgcttggagtccgtgcgcaacgcgcacgacgacgccatcaacgcggttgcagtctcctacgatgggcacgtctacacaggatccgcggacaagagaatcagggtttggaaaaaactcgaaggcgagaagaaactttcattagtggatactttggagaaacataattctgggattaacgcgttggcgcttaaaagtgatggctctgtgttgtattctggtgcatgcgataggtcaatattggtttcggagaagggagagaatggtaaattgttagtggttggagctcttagggggcatgctaagtcgattttgtgcttggcggtggtttcggatttggtgtgtagtggttcggaggacaaaacggtgcgtatttggagaggggttcagaaggatgagtattcgtgtttagctgttttagaagggcataggagtccgattaagagcataactgcagcgcttgatcttagtcaagacccttcttcccaagccacgtcttttcttctctacagtgccagtttggactctcatgttaagctttggcagctttttcttcctcttctttcaacttaa

SEQ ID NO: 34533 - DNA, 465 bp, Glycine max
  Peptide Sequence Number=SeqID_151311
atggagtctatgaacaagcggtgcgtcttcttggagcacgttgtcggtgttatcggttcctcaaacattcaaattgtaagaggaagagcagagagtttagggcaggatccttgcttcagagagcaatttgatgtagcagtggccagggcggttgcagagatgaggatattagctgaatattgtcttcctttggttcgtgttggtgggttgtttattgctgccaagggtcatgatcctgaggatgaaattaaaaaagctgaaagtgccatccagaaggtgggtgcatctctattgcaatggactgatagggaagtagaagcagggaacacaacacagggagcagcaaacaacatcaacaaagcccaagcaacagaaaacataaacagggaaggacagagggtaccaatagcaaacaaacccaagagaagagtaacaaggccctcatacatgaaggattacgcctga

SEQ ID NO: 34534 - DNA, 291 bp, Glycine max
  Peptide Sequence Number=SeqID_151312
atggatcggaccgagacgcttgattccccaagacgaagcagcagcaactttggatcttccttggctgtgttcttcgtcgtcttcttcttgggcttgtgctgtagtgtggtgtttgtgatggtgaaggtgatgatcatcatcagaagcagcagcatgaggagcaaaaggttggtggatgatgatgatgatgtttctgataaaggaataagggatgggagccttgagggggttgaagaaaaatccaaggtagttcgtgtcatccctctgagaaaagagaaagaggctacttaa

SEQ ID NO: 34535 - DNA, 882 bp, Glycine max
  Peptide Sequence Number=SeqID_151313
atgattattaattatacatgtgatgtcacaagtgtcgtattttggaagagaaggcatgcggaatacgggagtactgaaaaaaaattgcgaagcattgatcagagtcagatcttatccggtcctcgttcactgcgagagcatagcagcataatccactccttttcttttctttcaaaccaaagtccgcaaaacatcgaaaatcccatgtttcctcctcgctgccattacacaacatgtcttctactcttcctcctcgtactctccgacttcaccatttcggaatcacaatccccatgggccgccaagaaaaaacgcatgagagacaaagttcgcaatatgttttaccacgcatatgacaactatatgactcatgcatttccgcatgatgagcttaagcctatctctaaaactttcaccaactctctaagtgagttgggaaatttgaagcttgaacacttgcctcaagactacaatggttctgccctcacacttattgaatcgctgtccagtcttgttattatgggaaataatactgaattcgagagggcagtgctctggctttcggaaaatctgacatttgatgttgatgcacgcataaatctttttgagtgcaacataagagttcttggaggacttgtctctgctcatttacttgcatctgattcttcaaagaagttgtttcaaggagcttacaagaatcagctgctagctcttgctgaagatttagggaaacgctttctaccagctttcgatacacctactggattgccgtatgcatggattaacttaaaggttcatcagcccatccatgcttgtcacccctctccattggcctctacaatgttctggcatgaaactgtcaccagtccgccttttcagtaa

SEQ ID NO: 34536 - DNA, 255 bp, Glycine max
  Peptide Sequence Number=SeqID_151314
atggcattccagcatgcaattacaggtttacttatttcaatcccaccagacaagcagaatgtgcagacatccattggatgtctagctccgactaaggcttcatgcattaagaacgtgttgcgttgtttgcgcgagagaagaggtgaattgtgtttggagtatttgcgggacttgtccgttgatgaagttaaggctgagctgtctcttttcaaaggaattggtcccaaaacagtactcttcttttgttttccttga

SEQ ID NO: 34537 - DNA, 207 bp, Glycine max
  Peptide Sequence Number=SeqID_151315
atggccaaaactattccgggaaggccagcgccagttccgacatcgacgagactcagcttattgcacgaagcgccgcagtgcgagcggagtcttccacaagagtttcaacgtatagatgaatctggtctttctggcgggaggttagggttccgaagtgggagagagtggcaagggatttgtgctgacagagcggtggtgttaatttga

SEQ ID NO: 34538 - DNA, 267 bp, Glycine max
  Peptide Sequence Number=SeqID_151316
atgaatgcaaatagaagaaaagatatgcattcagtcaacgacgcaaggcatgactcaaacccttcgcgctggcgagcactccactgcgtgataggcaacgacgactgctcccttgactggcagcggatgcagttctacgtatccccctacatccgcacccgatcgacgctccacgagctcagattgtgtttcttaaaggagaggatcatcgagtatgagggaagagtcgcgagttcgagaacgggattttcaaaaactttcaagtga

SEQ ID NO: 34539 - DNA, 414 bp, Glycine max
  Peptide Sequence Number=SeqID_151317
atgggaaggcagaaaggggaaagcgcgagaagcaagtcacgtccttccagtagcagtctcgccgcctcgctcttgtcgtccggctccggcgctgccgccgtcggattcggtggttttgtcggtagctcgcgcctcgatcctcttccttcttcatccgaggactctcttccttttgttgatgttgatagcgaaattgcggttcacttaaagaggttagggaggaaggatcccactactaagaacacaaagcttgtgagtttgcttgaagctaaatgccactatagtgctattgcgatgttgaattccttggatccacaattccaactccgtcagctattgaggccactatgggtgttggggttgtggcatacatcctacatccttgtcatctccagcgagtctctggccaattga

SEQ ID NO: 34540 - DNA, 219 bp, Glycine max
  Peptide Sequence Number=SeqID_151318
atggaatgtaagacatcgttaattcaaacagcagaagcaaactttctgtcaccacacaccaatatccagaacaaggggacacagaattgggaatacatacggcaaaggggagagagtcttcggatgaaggaggaagatcaggcccgtgcttccggcaaaaccaccgaatccgacggcggagattgcgagacagcggggaagaaaattcgacaagactaa

SEQ ID NO: 34541 - DNA, 4476 bp, Glycine max
  Peptide Sequence Number=SeqID_151319
atgaaaaccgttgctggtgcaattcttggtgctttcaatgagaaggatccaacttgccatccctcaatgtgggatctaataatacttttctctagaaaattcccagatggttggtcttccttaaacattcagaaaagcatactgaatccattttggaattttcttaggaatggttgctttggttcccagcaggtttcatatccagctttggttttgttcttagacaatgtgccacctaaatctgttggaggggataagttttttcttgaatttttcaagaacttgtggtcgggaaggagaatttctctatctgcagatagactagcatttttgcaggcactgaaagaatgttttctttggtcattgaaaaatgcttcgagatataatgatggagactcaatcaggcatttccaagtcactcttattgataatgtccttgtaaagcttttatggaaggatttccttacagctggaatcccgaaagctaatgacataataaactcgggaaaagcaacagatacatctgaggaaaatgtttctcataacaagaaagtggatatggttgatacaaagtatccaatgccctatttgcaagagttgggaaagtgctttgttgaaatccttttgggcatttatgtattggatagcgatgttctatctgtttttattgaggaacttgaggataattgcatgggtgcccttcagcaagcagctaatgtagacattgttgaacgaatcattttgttcatgttattgctggagaaacatgctgtgctgaaaggtgcagtttggccgttgacctatattgtgggaccaatgttggcaaagtctttctcagtcattagatcttctgattcaccagatgctgtgagacttctgtcagttgctgtttcaatatttggaccacggatgattatccaagaagtattgattaaaaacagagagaactatgctagtcagctttcatatgatggagataacgtgggggaagctgaagattttatgcaaatattcaagaatgtgtttgttccttggtgcctgcagtcaaatagttgctccactagtgctcggctagatttgttgttggctctgctggatgatgagtatttctcagaacaatggtctttcatcatcaactatgtgattggccaaagtcattctgagctccaaccagggttactggatgctgaccatgcatcaacattggccacgctcctggaaaaagcaagggatgatagaatgaagaggaaggtgaaagacgattccagtcatagaatgggctgtaatgctaaagattggcatcatgaatatctcgaatcatctgctattgctgtttctcgatctctgcccccttttagcacttctcatgtgcagtttatatgctctcttcttggtggtttaacagaaggaagatcgtcttttctgtccagaaatgcattgattctcatatatgaggagattttcaggaagttagtcagttttgttcaggtctcacctttcttttgggtacagaatgctgcttctatgttaagcaatgatgcaaagatctgtgtagaatttgatagttctctcaacattgttgagatagctcaatttgctcttaagatacttgatggtagtttctttagcctgaagactcttgatggggaaagtggacttgtatctggaattttatctgcaatttttgtcattgaatgggagtataatttaagcaaggctctggatgattcacttgatgacaattcaatgacaaaaaccaaggccaggctaacattcggtgaacatgtgtgtgctttccgtaacaagataaatgttcaatttttgaaaagcctttccttagatagccgcaagagattatcgaatatcttaattcagtcaataagattttcaatatttgccgaagacagacttattaatgatgaaattgcatcattatgctgtacatgggtgcttgaagttcttgagtgcttctgtgtggatgaaaatgaagaacaaagtctgctacattatctgcttagtaaggatgaattgtggcctgtgtttgttgttctaaattttagcttgacaaaggcttcaggacaccagaaatttgtagctttaattgacaagctaatctcaaaaattgggattgatagggttattgctgcttgtggaatgcctaatttatctttgcttgaaaaaagtcaagaggttgcatcttctgcttggttagctgctgaaatcttgtgcacgtggagatggccaggaagtagtgctgtgtcatctttcttaccttcattgagtgcttatgccaagggaagtaattctccccaggaaagcctcttagatgaaacattaagcatcttgcttgatggttccctggtttatggaggcagtggcacaaagagttcggttagtatgtggccagttccagctgatgaagttgatggtgttgaagaaccattcttaagagcacttgtttcctttctgtctgctttgttcaaagagaaaatatggaggccggagaaggcattgaatctgatagaacttcttgtgaataaactctttcttggtgaagctgttaatactaattgtcttaagattctacctttgcttataaatgtacttttagaaccattgtatgggtatgcagagcctggtacaggtgttcatcattgttctttagaagaaagatttgtgcaaaatactatgatagactggctggagagggccgtaagtcttccacctttggtcacatggaaaacaggagaagacatggaagattggctccagttggtgattgcctgttatcctttcagcacgataggtggtccacaggcattaaagccagcgagaagtactagttctgatgagcggaaacttctttataaattattcctgaagcaaaggcatgtttctggtggatctgctatgtttaaccagcttacagtggtgccgatgcttctatcaaaacttatgattgtttcggtaggttattgctggaatgaattcagtgaagaagattgggactttctgttgtctaacctaaggtgttggattcaatcagcagttgttatgatggaggatgtagctgaaaatataaatggtcttgttgatagttcatctgataatttaaatatgatgtgtcagaaaattgagaaaattattttgatttcagatccttttcccataaagattgctgaaaatgcccttctgtctttcttacttctccttaagcactgtaaacttcaacaagatgaagagagagataatttgaatacatttaaatcagaaaaattggattctgttaaagatcggattctagagggtgtccttcgcctactattttgtactggtgtatctgaggctattgcaagtgcatgctacaaagaagctgcctcagttattgcatcatcacgggttgaatatacacacttctgggatttggtagcttctggagttgttaattcttcatcacaagctagagataaagcagtgaaatcagttgaattttggggactaaggaaagggtctattagctctttgtatgctatactttttacttccaagccaattccttcattgcagtttgcagcatattttgttctttcaaatgagcctgttttaagcattgctgtccttgaagataatgcttgtaactcaaacatatatgctgctagtgaagaggatatcagccgtcttgacttgccaatagaagaaaaagtccatctgaaagaggaaatatctttcatggtagaaagggcaccttatgaggttcttgatatggacttgcttgcagaccaacgagtaaatctcttccttgcatggtctttgttgatatcacatctacagtcattaccttcatcatcatctcaaagggagagactgatccagtacatacaagactctgctactccagttattttggattgcctttttcagcatattcctgtagagatttccacagttcagagtctaaagaaaaaagatgcagagctttctggtggcttatcagaagcttcaagtgctgcaacccgtgccaccacaactggttcactcttgttttctgtggaatctctttggcctgttgaattggggaaaatttcatctcttgctggagcaatatatggtttgatgctccaggttcttccagcctatgtacgtggctggtttagtgacttgcgtgatcgtaacacttcagctgttattgaatcctttacaaggacttgttgcagccctcctctcattgcaaatgaattgtctcagattaagaaatctgactttcgtgatgagaatttctcagttagtgtaagcaaatcagcaaatgagattgttgctacttataccaaggatgaaacgggaatggatctagtcattcgtctccctgcatcttatccactaaggcctgtagatgttgattgtacaaggagccttgggattagtgagaccaagcaacggaaatggttgatgtcaatgatgctatttgttcgtaatcag

SEQ ID NO: 34542 - DNA, 360 bp, Glycine max
  Peptide Sequence Number=SeqID_151320
atgctctcaggggatatacctcccaatcagaccatttacatcaagaatctcaatgagaaggtcaagaaagatgaattgaagagatctctgtattgcttattctctcaatatggaagaattttggatgttattgctctaaagacacccaagcttcggggacaggcatgggtttgtttcagtgaagtcactgctgcaagcaatgcagtgcgacaaatgcaaaacttccctttctatgacaaacctatgagaattcattatgcaaaaacaaagtcagactgtattgcaaaagaagagggtagttttgttccaagggaaaagaagaagaaacaagaggagaaaggttattatactatggtttga

SEQ ID NO: 34543 - DNA, 1209 bp, Glycine max
  Peptide Sequence Number=SeqID_151321
atgatcacagaaaaatgtcttcatcatatccttcaattagaacatctagaagatttggttcttgaacactgccttggcattgaggatcatggccttgcaaccctccaagcaagctgcaagtcaatgaagatgcttaacttgtcaaaatgtcagaacattggtcatattggcatagcttctcttacaagtggtgctcacaatttagaaaagcttatcttatcctccagcctgagtgttactactgatctagcaaaatgtctgcaaagttttcctagattgcgatcagttaaacttgatagctgtctgggtacaaagtcaggattaaaagccatcggtaatttgggcgcctcactcaaagaactgaacttaagtaaatgtgttggagtcactgatgagaatctccccttccttgtgcaaacacacaaagatctagagaagttagacataacatgctgtcacacgataacacatgcatccatatccagcctaacaaattcatgtttaaggattacttcccttagaatggagtcatgtagcttagtcagcagagaagggcttcagtcaatctcaagatgtaccaaactttcttgtctgaagttgggcatatgtttgatgataactgatgatggacttaagcatattgcaagcagttgttcaaagctcaaacatcttgatctctataggagctcaagaataactgatgagggaattgttgcagctgcccttggctgtccttcacttgaggttgttaacattgcttataacaacaacatcacagatacttcattagagtctttttcaaaatgccagaaactagaactcttgaaatccgagggtgccctcgtatttcaccaaagggtctctcaaatattgcttccaagtataaagctgtcatattgctcagtaacagatgtggggctcattgcacttgctagcataagctgcttgcagcatgtatccatttttcatgtggagggtttaacttcaaatggcctagcagctttccttttggcttgtcaaaatttgactaaagtgaagttacatgcatgctttgagtcattgatacctcaacaaattctaaattacatggaagctcgtggctgcacgcttgtgtggagggataaaacttttgaagcttccgggtatgtacttttggacatttcagacctttattttaagctagtcatgcaggaactgaatcatctgtga

SEQ ID NO: 34544 - DNA, 1518 bp, Glycine max
  Peptide Sequence Number=SeqID_151322
atggttaaggaagaagttgaagctgccttaaagaggcatttaaccagcatgaaacagacctgtggaaaggagtttcatactactgaattaagaaatttgcagctgcagtttgaaaacagcatttgtcttcctgtctttactggagctcgaattgaaggagaggatggctccaacttaagaataggtttagttgatgccctaactgggaaggttgttagtacaggacctgaatcgtcggctaaggtggaaattgtagtccttgagggtgattttgaagaagaaagcgaaacttggatgcctgaagagttcaagagcaatattgtgagagagagggaaggaaaaaagccccttcttacaggagatgtaattttatatcttaaagatgggattggtatggtgagtgaaatttcatatacagataattcaagctggacaaggagccgtaggttcaggcttggggcaagagttgtggacaactttgatggtgttagaataagagaagcaaagacagaatcattcattgtcagggatcacagaggagaattgtacaagaagcaccatcctcctggtctgtctgatgaagtttggagattggaaaaaataggcaaggatggagctttccacaagcgcttgagtcgggaaaagatcgttactgttagagagtttctcacacttctgaatctggatccagcaaagctgcgcagtatactgggcactgggatgtctgcaaagatgtgggaagtaactgtggagcatgctcgaacttgtgtacttgatacaacgaggcacgtgtacttcccttctaattctcaagaacctggtgtggtcttcaatgctgtgggacaagtgacaggactgctttctgaatgcgattatgtcacagtagataagctgactgaaactgaaaaggcatttatccctcatcccctattactttccttactctttccttccttctcttatttctctttgataattagcaatatgattttccaccatcaggctgatgctcaaaacgcagttactgctgcattaagacaaggggagaaatacgcaactttcgaagatgaagactctctcatggatgggtcttcacacttaactaatgtactttactccccaagctctcccaagactgagggatcaagtgccaacaagattttggctccccaaaagactggaggattcaattacccgccagcaaatgcctcttccccagatatcatgtcatccatttattctgttggtggaactagtagcttggatgactattgcttgcctaattttgacagcatgggccttagatatgatcagaccctcagttttccagtccaagtttccaactctttgatctgtgacactgattcaatggctcatgcttttagtgatgaagaccatctgcagttttttgatactgatcttcaatcgcatgttcaagcagatctacagagtgctattgatagcttcatgttggcacgtcccacagccaatggtggtgcacaaaggagatggagaaag

SEQ ID NO: 34545 - DNA, 504 bp, Glycine max
  Peptide Sequence Number=SeqID_151323
atgcagctgagtaattattgttcctttgagggtgtcctatactgtaagccccattttgatcaactgtttaagatgaccggcagcttggacaaaagttttgaaggtattccaagaagtgctagggttgaaagatctgctgatcaggtccaaagcaacaacaaggtttcaagattattctctggaacacaggaaaagtgtgttggttgcaagaaaacagtgtacccaattgaaaagtttttcgctaactttgcttatgatctcgtcattagtgataggctccggtgcactcatggaggttgtgtaataagcccatcaaattatgttgcccatgaacatcgtctttattgtagacaccaccatactcagctcttcaagcagaagggcaacttcagtcaattagacaagcatgacagtgtccaagtcgtcatcactgagaacacaacacaacatccggatccgagtaatggcaataccgatacaactccagctgaggaatctagttaa

SEQ ID NO: 34546 - DNA, 246 bp, Glycine max
  Peptide Sequence Number=SeqID_151324
atgatgatcgatgatggagacaatgatggttgtgatgctataagtgttggtgataatggtggtgacaatgagaacaatggtgatggtgatgtgacaatgatgatgacgatgacaataatcaataatagcgacaatgatgatgccaataataatagagacagttatgatcacacccacaaggatgacatcaataatgattactttgatgacaatgatgatgatgatgagaaggaggaaaagagatag

SEQ ID NO: 34547 - DNA, 453 bp, Glycine max
  Peptide Sequence Number=SeqID_151325
atggatgactggaacattccagaaatccctcaggatcaactatacgttcctgaaacaataaagaacaaacacaactttgattacataatcaaaacagtagaaaacaatattcctctaggacaagatataggggaagaatttcatttactttcaaaaaattcaatttatgaacatagtcgtaagtataaatatctacacatcggttgtgtacaagtagccatcaagcccttaattgatatgggcatagatgcagcagttttaatgtgtctaagagacatttggcataatcaatttgaagactccctaattggaacagtcaaaaccagcctaggacaagtgagtctgatggacagaaacattcttgactctctgttcttaaacatccactttcatggccttgacatgaaagaaggatcaatccgagcagccttaatctataggatccagtacaag

SEQ ID NO: 34548 - DNA, 341 bp, Glycine max
  Peptide Sequence Number=SeqID_151326
ggaagctaagtgtgaagtatgcaatcctgcacaggattggcgctgcaaactgggtacccaccaatcatacttccactgttgccacagaatcttttgctgtcaaattacccattgccttcccaactgtattgtgtggcattatgttgagtcaacatccaaatattttaaacaacattgactctgtgatgaagagagaatctgctctttccctgcattacaaactgtttgaggggacacatgtcccagacattgtctcgacatcagggaaagctgctgaggaagaagaagatgcagcagaggatacagaatcagatgatgatgattctgaagccaccccatga

SEQ ID NO: 34549 - DNA, 764 bp, Glycine max
  Peptide Sequence Number=SeqID_151327
atggccccgcagatcctgtacgcgctggatcgggctgtcgcggcgcacgaagaacaccgtctggtaatcacgcacgccgttgcgctcggtcagcagcagtgggcgggcgccactgcgctggcccagcgccaccgccgtacccgaggtttcggtgacccagtcgaccctgccccgccgcagatagctggccatctgctgcgggtcgcgtgccatcaggatcctcccctccttgatgccaacgtcgtgcatgcgcgccaccacgtagtccagcaagggctgcagctgttcgtaatgcgccttgggatcatcgctgatccggcccagcaccagtaccggatccggtgctgcacgcaccgtcccggccagcaggaccatggccaggctcagcagtcccccctgcattgcctttcgcagacccgacacaggcttcatcccccctgggtatccagacagactacccgaaaaaatgagaacgtcgtcagctgtccttgttgcccgcttgtgccagtcgcgccatgcgctgggtgtcggcgaggatgccgcgcaacaggcgcacttcctgctcgctgggttcgctgcgcaggaacaggcggcgcagcttgcgcatcgccgattccggggcgcggcccttgtggaaatcgatctcatccagcgtgtcgccaagctgggcgaagaagctctccatctgctcgtggctggccgcctgttcgcggaagcccggctcggcgtcggctgcaggctgcgcacccagcagctgcatgcgc

SEQ ID NO: 34550 - DNA, 627 bp, Glycine max
  Peptide Sequence Number=SeqID_151328
atgaccggcagattgcttgccggttcattgacattcgattgtcgcatcatgcactacatcattgttcgcattctattacctagatcatcaaacttagctcaagcctcagaagaggatttaatcttgatgtgggattttctcatcggtcgtccgatcgactgggcccatttgatcagataccgcatgcataaggcattgcggtcaaatgcacctctgccttatccacagcttgttactttgtttcttcatcattttcaaactcccttggataatgagccctttgtgaaagtcaaacgctcctttgcaattggtgccggtgtggtaacctccttcagctaccgtaaggacatggatgggcaatggttgaagaaggatgcgcaacctccgcaagacgaacgtactcattctcctccgcctcaacgagatgactactcagccctcatgaatgaagttctttcggagttacgcggtctctgcacctatgttggagagcgctttgattccttggatggtcgtatcaatgctattgatgctcgctttgcaggcatggatacccgcatcactcagcttgaggaggatataagttatgttcgtcagtgcttcgatcttccttcaccatcttcatag

SEQ ID NO: 34551 - DNA, 150 bp, Glycine max
  Peptide Sequence Number=SeqID_151329
atggtaaacaagcctagtgagttcaacatagataggaagattgaaaggaattcgaaaagaggattggtgccatccattgaagaatttcagtcaagaagtgaggggccaaccaccttaagagatattggactaagaagcactccaaattga

SEQ ID NO: 34552 - DNA, 378 bp, Glycine max
  Peptide Sequence Number=SeqID_151330
atggttcatcaagtcaagttgaatcatggaggtgaccatcttgcgaaaattggggcaaaagatgaatcgagttacatcgctgcttgtctactaccaaacacatttaggattgttgatgtccttgttactttcagtttcaccttgacaaagatgtcatggaccataaaagaacaggctttacggcgcccttaccgaacccgtgctagagctagagtaatgggtaaagtggaggaggtacaagagaagatgaaggtcgacatggaggccatgaaagagaaaatggccacgatgatggaggccatgatgagcatgaggaagataatggaagacaatgcaattgcagttgccgctaccagcactgttggtgggatcctctag

SEQ ID NO: 34553 - DNA, 156 bp, Glycine max
  Peptide Sequence Number=SeqID_151331
atgtcgtttcctgctttcaggttagctcgcctgggcgagcacccctgcacctggaaacataaaaacgagggagggggagtttttctccacccaaaactctcctccctcattcaaaaaatgcaaacacccacggaatttgcggattttcacccctag

SEQ ID NO: 34554 - DNA, 3920 bp, Glycine max
  Peptide Sequence Number=SeqID_151332
atggcaatgcagaaaagcaatgaccagattccggcgaaattgccgatcttcgacggcaacaactatgagaggtggacggcgcaaatgaaggtggtgttcaggtatcaaggtgttcttgatatcataagcaccggtgttacacctttggcggagaatcccacagaagcattaagggcaacgcatcgcgaacaattgaagaaggatgacaaggcaatcttcttgattcatcaatgtgtggacgcgaacgttcttgagaagatcatagagtatgagactgctaaagaagcgtgggatgtgctggccgccacatacgccggagataagcaaacaaagaaggtgaaattgatggcaatgaggcgtcaattggggctattgcaaatggaatccaatgaatcagtggccaattttgtaaataggttagtagttctaactaatcaaatgaggagctgtggagaaattgtgtctgaatccatgaaagttgaaaaggttctcactggattaaccccaaattttgatgtagtcgtttctgcaatagagcaagctaaagacttagacacattgaaactagaacaattgctaggtgctttagaagctcatgaattaaaactaaagaacagggagagtataaagaaagatgataaagaacatgagaaagccttgtttgcacaatctcaaaagaaaggtggtggaagtgaatcttggaagaataagagaggaaaaggaaagtggaagaacaataagcaagatggcaacaatcctaagggagagaatcagaagaaagaaggtgacaacaatggaaagggaaagaagaaatctaaagaagacattcagtgttacaattgccaaagatatggtcattatgcagatgaatgtaataatcctaaagtgcctagaaagagaaatgaagaagctcaatttgcgcaagactctgataatcaggaaactgtgttgctgatggctattattaacactgaaacaggctgtgaagaatggtggtatttggatactggatgctcgaatcacatgacaggacataaggattggttctgtgagcttgatgaaacagtgagaagaagcatcaagtttggagatggaagaacagtaatggccaaaggaattggaagagtaagcataagaagagtagatggaagtaaagtggtgattagtgatgtactgtatgttcctaatatggaaagcaacttgcttagcttggggcaattgatggagaagggcctctcaatgcatatgcaaggtgagcatatggaagttgctgatacaaatggcaaatgtgtcttgaaagtacctgtatcaaagaacaggaccttcaaggttggtgtgagctcatttgagcagaaatgcctagctgctcaagtcaatgaaaatgtgtggaaatggcataagagattgggacacttgaacttcaacagcatgaggaagctgcagatgaagggcatggtagctggtttgccagaaattgaagctccaaagggtgtatgtggtaaatgctgtgaagggaaacagcccaggaaatcctacaagactacagtgccaacaagagccaagacaaagcttgaagttgttcattcagatgtgtgtggaccatttgaagctaagtctcatggagctggaaactcaatcaagttactaagaactgatggtgggggggagtttacatcaactgaatttgagaattactgcaaggaagaaggtttaattcatgaagtcatggcaccttacactcctcaacataatgggacagcagagaggagaaacaggactgtactaaatatggtaagatgtatgctgaaggagaaacatttaccaaaggagttctgggcagaagcagtgctcactgcaactcatattctgaatagaagccccacgaagaggcttgaggaattaacacctgaggaagcatggagtggtgtcaagcctagtgttaagcatttcaaagtcttcggctcactgtgctataggcatgtgcctgagcaaaatagaaggaagttggattcaagagctcaagctatgatacttgtaggatatcatagtactggagcatataaactgtttgaccccttgaacaaaagaattgtgataagcaatgatgttacagtggatgaagctaacgagtgggactggaataacagtgttgcagtacaaactagtgatacagtggaagttgaacttgatgatagtcaaatagaagaagaggatatgcaagctaataatgagccacaggagattgttgaaggcaacatagctgcacccttaagaagatctttaagacaaacaacaatgccagctagatatcaggactatgatgtatttcctgacagtgcaattaatattgatggtgatctgcaaaatctagtgttattagcagaagctgaacctgtatctcttgaggaagcactggctcaccctcactggaaggatgctatggatgaggaattgagatcaattcacaagaacaagacctgggaaatggtaaatttgccaagaaataagaaggctatagaagtaaagtgggtgttcaagacaaagattaaaccatctggtgagattgcaaaatacaaggcaaggctagtagcaaaaggatttctacagaaacctggcctcgatttcaatgaagtttatgcacctgtagccagaatagaaactgtaagaatgatagttgctattgctagcagaaagaaatggacattgagccagctagatgtaaaatctgctttcctcaatggtccattagaagaagaagtatacaccaagcaaccacctggctttgtcaagaagggcatggaagacaaggtgatgaagctgaacaaagccttatatggcttgaaacaggctccacgagcctggaacagaaggattgatggtttcctacagaagctacagtttgtaaaatgtactacagaacatggtgtatacatcaaacactgtggtacagctggtgtgataatactttgcctatatgtagatgatcttctggttactggtgatagtgaacaagagatcaaaagttttaaaatgaagatgatggaagagtttgagatgtctgatattggcaggcttggttacttcctaggtatggaatttgtgacatttgagataggcatatttcttcatcaaaagaaatatgcaacagacatattaaagagatttaatatgcttaattgcaaccctgctgccaccccttgtgaaccagggattaaactgactgctggtacagatacagagtttgttgactccactttgtacagacaactcattggctctctaaggtatctctgcaactccagaccagacattaccttcagtgttggtctggtaagtagatttatggagaaaccttgcaaagatcacttgctggcagcaaagagagtcctcagatatgtgaaaggtacactggaatgtggcatattatttcctactgcaacagaaaactctgaaattgaagtcactggttacacagatgcagattggagtggagacattgtggatagaaagagcacttcagggtatattttcatgcttggtgatgctcccatatcttggtgttctaagaagcaagaggtggtagcattgtctagttgtgaagctgagtatatctcagctgcatttggtgctagtcaggctctttggttaagcatgctgctcaaagaattgaatgtcaagtgctgtgaaataatgaagctaagagttgataatagatctgctattgacttggctaaacatccaatagctcatggacgtagcaagcacatagaagtcaaatatcacttccttcgtgatcaagtcaataaaggcaacttagcactggaatattgcagaagtgaagatcagtttgctgatatattaaccaaagcagtgaagcttagaagacttgaagagatgaagaacaagacaggaatgctcat

SEQ ID NO: 34555 - DNA, 144 bp, Glycine max
  Peptide Sequence Number=SeqID_151333
atgggttggtacaatggtccttgtggcagccatcatgcacaacaatgcaaattccctgacttgtttcgactaacgtcagttgttgaaactaatgttgtggagagggcaaagacactctcctatgcacacacgagacgtggatga

SEQ ID NO: 34556 - DNA, 201 bp, Glycine max
  Peptide Sequence Number=SeqID_151334
atggttacacgcacctttcgtcaaccaggggtaaacgagcccattggcgcaaagagactgacatcgtcttctgcaccttttgtcatccaaggacagcaagtcgggtggcaggcggagataccttatggtcatccacgcctttcgtcaaccgaggagaacgaattcgacggtatcatgttggatcaagtggcctcagaataa

SEQ ID NO: 34557 - DNA, 321 bp, Glycine max
  Peptide Sequence Number=SeqID_151335
gttagagaggaaaggaagttgcaactaagtgagctagataagatccgtttagaagcctatgagaattccaaattctacaaggagaagaccaagaagttccatggcagcttgatagctaagaaggacttcgtggttggacagaaagttttattgtataactctaggctcggactcatgagtgttgagatcaaaagtgaatccgcaaataagagcttcaaggtcaatggacaccgactgaaaccattcctcacaaatccctccttagtggatgtagtggtggaggaaacctccttacttaaccctacttctcttatgccatga

SEQ ID NO: 34558 - DNA, 720 bp, Glycine max
  Peptide Sequence Number=SeqID_151336
atgaagaaattaataacatatttgggggttgtggcgtgtgataaggtggacatcacatacgagaactggcccgaggtccctactgctcagacggacttgatttgggaggatattcaggcggaatttgaaatcccagaggcttctgacagtaggacaaaaaagaagttacttcagactgttggcgagagatgtaggcagtttaaatcagacctcacgaggaaatgggcccttgcagccgatcaggacgatgtggacgacactgtatgtgacaaatacggcataagcaaggaaaaatgggcccagttttgccagactcacagagatccttcttgggagaagctcctggctgagaagaccaagaagaaactagaggaagctgcacagtcaggaagcgttgatggcatcatcgaccctctatcccccgtcagacgccacgtgaagtggaagatggcccgcacgaagaaaacaggggagatgacgactgagattgtaaaggaaatcactgagaagatcgagtcctttgaggagcaggctggacgtgaagatggcccccatggacgtcaggatgttctcaccgctgctattgtacgtccagagcaccctggacgtgtccatgctactggagtcggtgtcaccatcaagcaatacttcggatcggctccacgaacatcccacagctcttcctcgttgccacctgaagaattgcagcagctgacctag

SEQ ID NO: 34559 - DNA, 485 bp, Glycine max
  Peptide Sequence Number=SeqID_151337
ttactaatgtgctgagagctactttgcagatgttaactctctcaacagatagatttcagaggattcaaaaggaagcccctcctgaatatcagagctatcttgtccaagtgacaaaataccaagctgcacaaaactgtaagacctggatcgttggtaagtggatcacgccaagagagcaatactgggcaccacgtggaacccattttcatcaatttgttgtcccgccaattttaccatttagaaaagattgcacttatggtgacctggcagcgatgagattaccagaagacgtggaaggactagggtgttgtgagtacacgatggataggggaatggttcacgcgtgccatgcaggaggagtggtacatagccttgaaggttggcctcatcacgaagttggggccatagatgttaacagaatcgatcttgtgtgggaagcagcactcaaacatggcctaagaccagtgtcaagtttcacacagtaa

SEQ ID NO: 34560 - DNA, 657 bp, Glycine max
  Peptide Sequence Number=SeqID_151338
atggaaaacagagcgcgcctcaaagttcaaaagaagagacccattaagcgcagcggaaggaaagtgttactgaaaaatgttttagattatcttaaggctgatacttacatgtatgcccctctcctctctcctccaacctctgattttccctcacccaacgccttcccttcctcagctaaaggggtggaatataaaaaaccagtaacagagaagcagtggtttgggaaacaagttggaaagtatctcaaatatgatggttatatgtatgatccgctgcttcgtcttccccattcatctctaggtgtagctgctaaaatactttatgttggaaactggagcatacagggtgcaccaaattacttgtttcggctgaattggaaggatggaaagcttataatatgcattgattttgtgttcatctgccaaattgaagaacctttgcaggactgtggaatgatgaggatggatgattcagctagaacgttgagaatgaaagttaaccaacgaactaatcatttaggaaatgcaaaccaaagttctgaaagtcatcttcctcaaacagacctctctgatcagcatattgggggacacacggaaactgtgaagcatactgtgtaccaaagttgtcgctcaacttctgccacaattgttgaataa

SEQ ID NO: 34561 - DNA, 210 bp, Glycine max
  Peptide Sequence Number=SeqID_151339
atgtcaaaacgtcttgcagaagatgccaaggcttattttgatgagtgtgtctcgctatcaacttttgatagttctgacttttcatctccagaggatcccccactcaatttcgttggtcctcctactccatctggcagccctgtatgtttaactgaggcaagttctaatgcttcagtttctaatttcattggtagtttcctcaatgattaa

SEQ ID NO: 34562 - DNA, 1074 bp, Glycine max
  Peptide Sequence Number=SeqID_151340
atggagctacatcactactcctccatcttcttgaccacaaaattgattgctgaccttaaagaaagggtcaacctcacctatcacaataatttcaactgggctattgtcgattattgtcttgatagtgaaagtgtttatctcaatgccgacaaaggtcatcctaacttcacgtatgtttgtgaagatacgttcaaggctttgagcataactttgcccttttcgaacttcaagtgtgctattttggccaagataaacgttgctctaatccaacttcatcctaaaatgaccgaggatggcaaggtcggttgggtatctatgactagtgctaaaggttgtgatgttgtgaaagcttgggggaaaatcgtccaaccccaggaaaaacatcccaaggttatatatgtggtcgttctggagtctgaggtgaagaggtttgcagagaaggagaaatctcctgagaaagggaagtcttccgaactgcaaactgttaaggctagtgttgcgattgaaaatgaaaccactccaactcctgaggttgatgctccaattaccaatcctcctccttcgccttctgatcaaaatcaagagagggcaaagctgatattttcccttaaggagaagaaagccttggtggacgaaaaggttaggatcatcttcaacctccaaaagaaaataaccaatcatgagcagatagtctcagctaaggctattgaaaatgggaagctttgccaagacataaaaagcctaaacaagaagtggaatgtagtgatcaaggagttagcgaattccaataaaatgatctccgtactcaatgaccaattgattgaaaaagaggacaaaataaagacactcgtcttggagaaagaagagttaaagaaagagaagaagtccgctgaggatttcatgccccgacttgagaagcaagttgctgacctgactactgataaagagaaaacaagtgcaccattggcacaacaggctccatgtggagcttgtagggcttggatcttcttcaacaacggagtccttagcttcttgaagttcaatggcagtggaatggaggaggaagaaatatga

SEQ ID NO: 34563 - DNA, 396 bp, Glycine max
  Peptide Sequence Number=SeqID_151341
atggttcagcccaaaaatccaagatcaactccaagattctccacgcatgggcccaaaatcaaccctaaggctcatgagatccctagggccttttgttgcatctctggctcaatcttcttggagtcttctatccaatgcccttgtgaggtaggattgcatcacccaccaatcctaatccgaccgacattaggtgctgaatttctacactatttatttgtttctaatacaactttcagttcattattgatgcaagaggatgataagaggcaacccctgatctactttacaagtagagtactgcaaggggccgagcagagatatcagatgattgaaaaactagcactatcgctatttaacttagtaaggaggatgcacccttacattcatagccattag

SEQ ID NO: 34564 - DNA, 219 bp, Glycine max
  Peptide Sequence Number=SeqID_151342
atggccgaaaattcactaagaacggatatgagcagttccttcaatagctcaagaagagctcaattccaagaagtcctcaatgatgagaacctaacaatggagttgaacctaatcgatgaagttagggacttgcccaagtataagaagaagcttgcaaaagaagtgatggaagctttcttgagaagcttctatggaggctggatatttaagcttcaataa

SEQ ID NO: 34565 - DNA, 156 bp, Glycine max
  Peptide Sequence Number=SeqID_151343
atggagaaggaacaagttctttggtggtacatgaaggaggtttctgaactcttgacattccttgcacttctttgtgtatccagcacattcactctgcatggttggccaataataaccagctcagatgacccgagacatcatagttcttcctcctga

SEQ ID NO: 34566 - DNA, 675 bp, Glycine max
  Peptide Sequence Number=SeqID_151344
aggactgcatgtcctcgccttcagaggactacacgtcttcgccatcagaggactacatgtccttgccttcagaggactacacttccttgcttcagaggactacacgtcctcgccttcagagggctactcgccttgccttcagaggactacacgtcctcgccttcagagggctactcgccttgccttcagaggactacacgttcttgccatcaaaggactacacatcctcgccttcagtggactacactttctcgccttcagaggattgcacatccttgccttcagagggctacacacccgcatcttcagagggctacacgccttcagcttgccttcagaggactacacgtcctctccatcagaggactacacgtcctcgcctttagaggactacgcgttctcgccttcagagggctacacgttctcgccttcagaggactacacgtgctcacctttagagggctgcatgcgctcaccttcagaggattgcatgccctcgcctttacaaggctgcacgtcctcgccttcaaagggctgcacgccttcaccttcaaagggcaacacgtcctcgatttcagagggctgcacaccctcacctttagagggctacgcgtcctcactttcagtgggctccatatccacaccttaagagaatttaaggtcctctacccctaa

SEQ ID NO: 34567 - DNA, 453 bp, Glycine max
  Peptide Sequence Number=SeqID_151345
atggctggatggaatgattgtgcgatagctgatgctctccaagccttggctcaggctttggggaatcagaataagggagaagctgttggagctgctgagtaccaagggttgaaccacttccaacaaaacaatccccctggtttcaatggaggatacaaccctgatagtgctcagaattggataagggagatcgagaaaatcttccaagttgaaggtcaagttgtgacctgggaagtcttcaagagggtatttctggagaaatactttcttgaggatgttaggaacaagaaggagatggagttcttggagctcaagcagggaaacatgactgtggctaaatatgtagccaagtttgaagagttggtgagtaaagaacaaaatgaatggaccttaacattggggaaaaccgtactcgaccctcctaagcaatatggtaaccatcccaacaattag

SEQ ID NO: 34568 - DNA, 357 bp, Glycine max
  Peptide Sequence Number=SeqID_151346
atggtttttgataaaaccgttgtgcttagctttaaaccaaagattgttttgcaaaaaccgactcatagaaaaatcatattttataagaaagtgtcagggttgagccaacagaggaggtggaaggaccgacttgatgaggaggaagtcattgttggagtcctagatttggagggagagagaaagaggggaaggcgaaccacttgtcatcgaggttgtcatggaggtgagaggagggggcaagggcaagaagggttcggagtagaaacagagactgcgaagggtagagaaagagaaggaagagaggctaggatcattggatttgagagagagagagagagaaagggaaagaaaaagtag

SEQ ID NO: 34569 - DNA, 502 bp, Glycine max
  Peptide Sequence Number=SeqID_151347
atgacgttgctcctcagcaacatcctgcccagcgatcataattccgacctccctctgccgaagtgtcagctggtgtatgccatcctgacacggatgagcgtccacgtggctcagttgatcgctgatgccatttatttatttgcaagtatgccacctaccaggcaccctttagacccagataagtctaatagggccttgggttttccagccttgatcacgggtctctgccagtcgttcggggttcccgtcacacctagtaaggtgatccggccgccgatcacccaagccttcattgagaagtattgcacgcctagacaggcgcagggtgatgcatcgcaggccgcagatgcaccgccaccacctcatcaggctgatcccgttgggtcatttgacacggagcggtatttacgacatttggttcgccagcaggcggccaaccacagggcgcatgtgcagacccatgactgtctctaccagctcagtctcagtctgcagagccagg

SEQ ID NO: 34570 - DNA, 346 bp, Glycine max
  Peptide Sequence Number=SeqID_151348
atggactcctctaaggacaatagcatcatttcttgcattgaattgttgggagcgcctgagcccggggctaggagggcgggggcaaggccagctgagcttccttctacttctgcagctcctactccaacatccactttagtagccccttctgtcccagtggtggagccttcaggatctattccttcgatggagcagttcactgagatggcgaggctcacgagtgcgctttccaaaggaggaaagatgcacggagtcgccacaaacgaaggtattagcacctctcacgtcgacaaaagcggggctcttgctcctacgtaccctccatcgaagaggaaatcagacctag

SEQ ID NO: 34571 - DNA, 219 bp, Glycine max
  Peptide Sequence Number=SeqID_151349
atggacaaccaagtacacggtcctcccacaccacgcggtgtgaaaaccaccaatcaatcatcgccttatgagctctcacaacttccaacacgacaccccacacaactctcttcaacttgcatttcaacattccactatgatgttatccttgctaggagcggatcacttgatacaggctacagagttttggatgatgctactttcggagagggaagataa

SEQ ID NO: 34572 - DNA, 189 bp, Glycine max
  Peptide Sequence Number=SeqID_151350
atgagctatcaagctgggcttagcggggaagggttcgctaagcgccaacatcattctattttgaagtcattgagtgcacttagcgcatgtagtggtgctaagcctgaatcactcactaaagcgctaagcgccgctgctgcgctaagccccaaatgcttactggaagttacaacttcaagttgggcttag

SEQ ID NO: 34573 - DNA, 459 bp, Glycine max
  Peptide Sequence Number=SeqID_151351
atggcaagacacaaggtcgcacgcacgcacgcacacacacacacacactcacgcaggcacaggggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 34574 - DNA, 594 bp, Glycine max
  Peptide Sequence Number=SeqID_151352
atgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcggttcaaagactcgatggttcacgggattctgcaatttcacaccaagtatcgcatttcgctacgttcttcatcgatgcaagagccgagatatccgttgccgagagtcattgtatgtaaaatgttgtgtcgtgacgactccccgcgggacaccgtctccgggcccccgggagtcgcacttaacagatttgagttccttggcgcacgaagcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 34575 - DNA, 429 bp, Glycine max
  Peptide Sequence Number=SeqID_151353
atggaaagaggtgcttacagaggccgtggccgtaatagttacggtggtggtcgcggtagttacggtggtgaccgtgacggtaacggtgaccataacagttacggtggtggccgcggtggttacggtggtggtcgtagcaacattggatcttcgaagatatcagagaagaaaatggacaccattacacctgtgcgtaggcctgacaatggggaacagtggcagttcgaaaatgctatctccgccaaggctcctccgccgaagaacaatcgccctcccaagaagatttcgaaaggaaacatttactgtggacgtgtccaaaggagaggacgaaagacctgtttcgtatctggtccctctgacattggtgagcaggctcgagcttcggaagttgagggattacctcagtggaagcgtactttcgatccctag

SEQ ID NO: 34576 - DNA, 546 bp, Glycine max
  Peptide Sequence Number=SeqID_151354
atgaacaccaagatggactcccttttggaacatcttgttgcccttactcttattcccacctccccaaaatatccaccaacacctaccccagttagttgctttcgtccacacatgaaacttgaaataccccactttgatggcaatgatcccatgggatggatattcaaagctactcagttttttgactatcagaacattcatgatcaagagaaacttatcgccgccaaattttacatggaggaccccgccctctcgtggtatcaatggatgcaccgcaacgggtttctcacgacttggccgacactgcttcaagctatcaaatctcgctttacgccttcgttttacgatgatctccacaacacactatttaaattgcaacaacatggtactactatcttcaagtacctcacggaatttgaacgtttagcgaaccatatcatcggcctctctcccctttcatccttagttgttttatctccggtttactaccaaaacttcgctgagaggtccgagctctccaaccaatctctctcccacaggccatag

SEQ ID NO: 34577 - DNA, 402 bp, Glycine max
  Peptide Sequence Number=SeqID_151355
atgtctgttcacaaatttggtggaacttgtgtgggaacctctcaaagaataaaaaatgttgctgacataattcttaaggatgattcggagaggaaattggtggttgtctctgcaatgtcaaaggtgacagatatgatgtatgaccttatccacaaggctcaatcacgcgatgagtcttatatagctgcattggatgctagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 34578 - DNA, 321 bp, Glycine max
  Peptide Sequence Number=SeqID_151356
atgcaagatgaaatgtcaaatgaagaattgaagttgcaggattcacgatgtcggatacaatgtcctgacatcctgcccgaaaatactggagttgctgcacaatgcataagtcaagataaaatgtcaaatgaagaattgaagctgcagaatccacgatgtcggacacgatgtcctgacatctggcccgaaaatactggacacataaatctattttcaggaagaatgatagatctcctccagcacaagccgttgcagcccagaaacgcacattgctatataatcatggaggctgcacgagttctgtaccaagtccgggattga

SEQ ID NO: 34579 - DNA, 318 bp, Glycine max
  Peptide Sequence Number=SeqID_151357
atgggaaagggttggggtcttggctttgtagatgtagggtctccatcctccgcaggtgggcaaagatggactatagagatggtgactgccgtagaggtggtggcggtgcatctgcagctggctgctgctggtcctcctcctgctgttgttgtgcctgaccctgctgctgtacctgccttggcatatcaactgggccatatgaacactcacctgggtcaagatgacatggaccagctggcacttcgacaggggaaggttggaattatgatcgtcagggaggatgttgctgagcagcaatgtcatccagatatgtgttag

SEQ ID NO: 34580 - DNA, 456 bp, Glycine max
  Peptide Sequence Number=SeqID_151358
atgcagatgacgacgttagtctctgcgtattatcggacccttgagtctgacggtagaaataagactttttcacggtctcgaccgaaagatgctaacatatccgggacgtgtagtcctctgaaggcgaggacgtgtagtcctctgaaggcgaaggcgtgtagtcctctaaaggtgaggacgtgtagccctctgaaggcaaggacgtgtagtcttctgaagcctctgaaggcgaggacgtgtagccctatgaaggcgaggacgtgtaaccctctgaaggcgagggtgtgtagcccttttaaggggaggacgtgtagtcctctgaaggtgagggcgtgtagccctatgaaggcgagggtgtgcagccctcttaaggcgagggtgtgtagccctttgaaggtgagggcgtgcagccctctgaaggcgagggtactagtacccaagggtccacccttatga

SEQ ID NO: 34581 - DNA, 213 bp, Glycine max
  Peptide Sequence Number=SeqID_151359
atgcaagcaaaagagcacaaatggaggcttggggctgctagaaacgagagctcccataagcttttggtggttttgaatgttgggtgtcgtaacctacacttcggcgagagggtaacgcggggctcatgggtgcatcttccaagggaggaaggcacgcggagtcgccaccaacgtttatttgaggaaaacgtcggaaaaaccggaaaggtgtag

SEQ ID NO: 34582 - DNA, 354 bp, Glycine max
  Peptide Sequence Number=SeqID_151360
atggggctgctggctacctttgctaaagagaaccaagaaatcgtcatttcattactttgtcaacaccctccatctcgctatttgctttgccatcctgccaacgtaagcaattacgaaagccaacctattgagagagggtgtgtttacactttggaaatggcagagaaagaagtgagaaacaagcagttggtattaagggactatgtcactggctttcccaaagaatctgaattatatgtgacttccaatggtaccatcaaactgaagctagaaggtgactccaaaagggttttggtcaaaaacctctttttggcagctgatccacacctcaggccctttgatgaagaaagctga

SEQ ID NO: 34583 - DNA, 600 bp, Glycine max
  Peptide Sequence Number=SeqID_151361
atggaaacaggcatgctcattccttgcacatccccttccggctgcgattgcgataatgacagcgcagctactcgtacagagttctggcgcgatccgtcgctggattttgtcgaaagtcgtcgcgcgtgtcacagccgcgcatgttacagaccacacagtcacccgaccttttcaattggcgcagttgacgcaggcggcagcctgttcacaggcgcatccggtggtccctgttctttacaacctggaatgatggtttttattcccgccggcgcggttcactcctgtaatccattgccccataagcactggagctatcagatgttacatatagatgccgcgtggttaaatgctttacttgctgaaatggacgatgtttcaggcagcttcatcagtcaaggtgaagttcgggtgacgaataatcaggagcgctatcatcgcttctgtgaactgaataacctcctgttttcgactgccagtacagaagacaaaaatacagcgctaatcgagtttattggcgacagtaaatatggcaccggcccggtgaaagcctttcctgtcatggcgtctgacatcagtcgggcattacacaacgtgattgaa

SEQ ID NO: 34584 - DNA, 412 bp, Glycine max
  Peptide Sequence Number=SeqID_151362
agctagaggggttgtctctgacaaccttaccttcgagcgcctgagcccgatcattaacctggcctacatcaagaagaactgttggaatcctgaggatctaacagtctctatccgaggggctaggagagcaagggcaaggccaattgaggctccttccacatctgcagctcctcctccagcacataccttagtagctccttctaccctatcttctacagactttcaacatcttgaagccatgcttcaaagcatacatcaggggcagattgttttattacaaagtttacagctggtagcacctccagactctatcccttctgttgaacaatttaatgaatgggtagcctggcctgagactcagcctccccttcacagggaggatgaaggtctcaccgctcaggtaccacagtag

SEQ ID NO: 34585 - DNA, 240 bp, Glycine max
  Peptide Sequence Number=SeqID_151363
gaagtcaaaaccacggttatcgacatcgaaacgctgaaaatagtcctgcataatttcatcaccggtttcccgcgcccagggatattgtccggtgttcaggctggtttcatagctcaattcgggttgggttctggacaagagtggtttgctgttgtagttgtactgataccactttattatagtgctatcgatattattcggcatcagacaaggccctatgtaatgagttctaagatgtaa

SEQ ID NO: 34586 - DNA, 282 bp, Glycine max
  Peptide Sequence Number=SeqID_151364
gctgaggtaaccatcacgaagcttaatgaggagaggcgcaggaccactcaagaaaaagatttactgttgcggcaggaggaactagacaatttgttgttcagtcatttgagcttcttggatgttttggacgattgcatgacaggggggaaggaagcccgaaaacaaaatagaactttgactaagcttttcccaaataaaattacaattcacatgccacaggatgaggctctactagcatcctggaagcagcaactggaacgagaagttgagactcaaaattaa

SEQ ID NO: 34587 - DNA, 340 bp, Glycine max
  Peptide Sequence Number=SeqID_151365
atgggggatcccatcagcagactctccttccctggtaggcgcattgtttgtcactcaaatcatatgctcagttggaatatttgtctctttgctaaagcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccatgactcaagagctgatacgcggggataccttacggttatccgcacccctttgctatttagacacagttgttgtccgatggcacgcagaggccaagtctg

SEQ ID NO: 34588 - DNA, 192 bp, Glycine max
  Peptide Sequence Number=SeqID_151366
atgccaccgcagaacaaatttgttggatgcgcgttcacaggaaaaaatcttaagaaatttcaaattccttcaacatgtaccatcgatgaactgaagaatttaataaagcaagttgcacctaaagggattccccctcttggaattcacgaatcacaaacggtgttatttgatggaaccggggaaaggcaataa

SEQ ID NO: 34589 - DNA, 183 bp, Glycine max
  Peptide Sequence Number=SeqID_151367
atgactaagggcttgggtgggcgtttagagggaaaaaaaagtgagaacggctgctcgtggtggccactgatggtcgtcggtggtggtggaggaggaggtgttagggcttggatctcacttagcgagctcatcttgctaatcgggagtccacttttggcgcttagtgcgacatttcgctcttaa

SEQ ID NO: 34590 - DNA, 252 bp, Glycine max
  Peptide Sequence Number=SeqID_151368
atgggaaatcagaataagggagaagctgtcggagctactgagtatcaagggttggatcgcttccaacgaaacaatccacctgctttcaataaaggatacaaccctaatgaagaagctaagtattggtgggagaacactcaccaatgcttggaggctgaaggtcaagctgtgacctgggaaaccttcaagatggtatttctcgagaaatactttctgaagatgttagaagcaagaaggagatggagttcctag

SEQ ID NO: 34591 - DNA, 285 bp, Glycine max
  Peptide Sequence Number=SeqID_151369
atggagaattggcgtacaacgctactcaataacttcgcggggctccagagtcgtaggtggaggatgcatgaacagcgccaggcaatgacattcatggggctccgtaaaaaagtggagaatggagaattgtggagaatggagaattggcgaagagcgctacgcaataacttcgcggggctccagactcgttggtggaggatgcatgaagagcgccaggcaatgacattcatggggctccgtaaaaaagtggagaatggagaattggcgaacagcgctacgcaataa

SEQ ID NO: 34592 - DNA, 180 bp, Glycine max
  Peptide Sequence Number=SeqID_151370
gccaaaagaagagaaggtcaagcagctggtgtctcgctaagcgaggcatatgtgcttagcgagtgtcatccactaagcaaggcactcagctcacttagcgtgatgagaaaccctagaagaggatcagccagagatgtgctcgcccaccagcctccaagagagtctaggttagagggctga

SEQ ID NO: 34593 - DNA, 677 bp, Glycine max
  Peptide Sequence Number=SeqID_151371
gaaggcataggtctcatcttagacctcactcccataggagagaagatgaaagaaagcctcaagaggctaacattaacctttcatacttcaatgggaaggacaatgtagaggcttacttagattgggaaataagagtagagcaaaaacaaaaaagaaagtctactttaaaatcttatggctctcattcttatccaaagaaagaccaaggtctaggcatcttaggggcagcaccatctaagcccaaagataataaggggaagacaatagaaaagcaaccccctaagaaaaccatgattatgaggagcccagacattggaaggggacacattacttctcaatgccccaccaagaaaaccatgattatgaggagcccagacatttatagtagccaagatgaggctactacttcaccttcctctagtgaaagtgaagaagcaaaaggggaagaatctagtgaagaaatctacctccaagaagaaggacaacctttaatggttaaggaggagtgtaaggaggtaagtgtctcctccaagagattagctaagaaggaaaggcattttgaaataaagacaaatattaaagaaatttcccctcttagacaacctccacattttctcctttgtataaagacacttgttaacattgccaaacctcttgggcttgagtttattccttaa

SEQ ID NO: 34594 - DNA, 612 bp, Glycine max
  Peptide Sequence Number=SeqID_151372
atgggtgaaactgaaaagatgcaaaagcagataaaggccaacttggaggccatgaaagatcaaatggccacaatgattgtagccatgatgagcatgaagaagataatggaggtcaatacggctgtagtcgccgctaccagtgtcgttgctaaggtggacctgactcctacatttggcctcaaccaaataaatcatgtcatctcggatatggtagggcagagaggcatagaattaggaagtacgggcggcccccattttgtgcatgttcaaaacaagcattctttcccaccatatggcttggctcccaaccatacaccgcctaatgttgcacacactcccaatgaagatgtcgacaactctacacccatacccattgagagccaacaaccccaagttgatcatgcacatgtctctcaatccacgggggagacacatgaaatatcccaccataatctaaccgacttcgagcctcgcctcggatatgccactaaagggcaagcagtcggtggtgtgcccctgcccaacactttggagggccctcagtttcttctacaaccacaccacacccttgcattttacgatggaagaatccttcttgctatggcggagaag

SEQ ID NO: 34595 - DNA, 525 bp, Glycine max
  Peptide Sequence Number=SeqID_151373
atggagccacaacaggaagggatcacgcgggcgttaacaccgggcgaagtcaatctggcgcgttcggtgtttggcagcaccattttctatcagaacgtcttagtccactgcgacagctatctgccgtttgggctgcagaatcagtacacggcgatgagcccgaatggggagctgtactttcgtagggctttatataaaaaggattatgcgattcaggatcctgaagcgcagcacctttttatccatgaaatggcgcatgtttggcagtatcaaagaggtatgtgggtgcgcacccgcgggcttctcagctgggcagtaagctatcaatatcgacttgataaaccctcgctgcaccactacagcatggaacagcaagcatcgataattgcggactatttcattctcaagagatatggggtgaatgccttcttccgcttgccaaacaggaaactcatcgggatagtggacagacggacattgtcacaatttcaccccattatcagaagcgcagggctgccattatga

SEQ ID NO: 34596 - DNA, 783 bp, Glycine max
  Peptide Sequence Number=SeqID_151374
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggacccggctctcaccgttccacatccgaccgggacacatcgccggcccccatccgcttccctccccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattgatatgcttaaactcagcgggtag

SEQ ID NO: 34597 - DNA, 447 bp, Glycine max
  Peptide Sequence Number=SeqID_151375
atgccatttagagaggtatctactgtttgtacgaagattgagtcatttagggcacaacattttcgtatgttaatggagaacctatgtgttttagaagaaacttttgttgattctgaagcactgagcttggaaaaccctattatattgcaactaggaaaggttggtgctcttgagttattcaatgtttgtctatcaagatcagttggaacctcacttgtgtcaaactatgctgtcaaggtggatgactacaaggacaaagataccaagccagtagcaaacttgagtacctgggcagaagcatctagagttgatgagaaggtgctacaacagctattgcatcgtggctattattgtcgggatgagctcatacaaagtagtcgttccttagttgtataccctgcccgaaaatacaggggtatgggaatagctttggatgatttactttag

SEQ ID NO: 34598 - DNA, 503 bp, Glycine max
  Peptide Sequence Number=SeqID_151376
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatcacgttcttcatgtctctgtagcaagggcactcatgcttgttcccataagtcccagatggcacacagttgcacttgctgcagcaaatcccgcagaacttcatgcacctgtccttcatcccagctctagaacacctcttcgagcacttggaggaacagaaagctga

SEQ ID NO: 34599 - DNA, 348 bp, Glycine max
  Peptide Sequence Number=SeqID_151377
atgaagatgagggccttgctggttcaacaaggactggagaaggctcttgaaggggagaagatattgcctgcaaatctatcagagaaggagaagaaggattttctcgacaaagcgcatagtgcattgatcctatctttgggtgataaggttacaaatacgtccaacaacataaaagcatgtgtttttctcccccaaaaccctcacccaacacccccaaatctcctcctccaccacccacaaataccggtgacctccacaagtcgttgttgcttgccactggaccactgcatggagaagaacactttaatcagagaaaaatcctctaaaaccaactcaaggattcgatag

SEQ ID NO: 34600 - DNA, 504 bp, Glycine max
  Peptide Sequence Number=SeqID_151378
atgtctccgatcagcgactccgcgcgccttcctccgttggaagatgcacccgtgagccccgcgtcgccctcccgtcgaagggtagcttttaccttttgcaaactcccaacaagaaagaaccacaactttggaaccaacatgagtcatcattcatctagtgttaatggtgaaggtactagtcataagaaccctctatctacaatcttagatgagttgagttccctcaagttatggaaagaaaagctagaaagaaaagaaaaaggaaacgagagggtagaaataaatcaagatgagaaggaacaaataagggaagaagaaagaaagaaaatactaaaagagttaagaaaaaaaaatgcctcctatagtagtcatgactcttgcaagagcccaagtgaagaacttggtgactattatgaaggaaggcataggtcacattttagacctcactcccataggagagaaaaggaaagaaagcctcaagaggctaacattaacctcccatag

SEQ ID NO: 34601 - DNA, 243 bp, Glycine max
  Peptide Sequence Number=SeqID_151379
atgagtcatcattcatctagtgttaatggtgaggatactagtcataaggaccctctatctagaatcttagatgagttgagttccctcaagttatggaaagaaaaagtacaaagaaaagaaaaaggaaaagagagggaaggaataggtcacatcttagacctcactcctatagaaaatgaaaggaaagaaagcctcaagaggctaacattaacctcccatactttcatgggaaggacaatgtag

SEQ ID NO: 34602 - DNA, 666 bp, Glycine max
  Peptide Sequence Number=SeqID_151380
atgcagttggatgccctgaagctggtggtctataccttcgggaatgtgagtgctgtagaccgtgataaaggtgtttttgccattaaaccaagcggtgttccctacgacattttaaagcctgaagatatggtgattctggattttgatgccaatgtcatcgaaggcagtctcagaccttcttccgataccaaaacccatgcttatctgtataaaaactgggaaaacatcggtggaatttcccacacccatgcgatctattccgtagcgtgggcacaggcacaaatggatattcctgttttcgggaccactcatgcggaccatcttacgacagatattccctgcgctccgcctatgcgggatgagctgattgaaggaaactacgaatacaatacaggaatacagattctggaatgttttaaacaaaaacaactctctccggaagaggtagaaatggttctgatcggcaatcacggcccgtttacctgggggaaaaatgcagagaaagcagtttacaacagcaaagtactggagaccattgccgaaatggcttatctcaccagacagatcaatcctgatgcggaacgactgaaagactcactcatcaaaaaacattatgaacgtaagcacggcaagaatgcttattacggacaggaatttaaacactaa

SEQ ID NO: 34603 - DNA, 1170 bp, Glycine max
  Peptide Sequence Number=SeqID_151381
atggagcactgtgattatctgactttccttttatcagatcataaagacctggctacctttaaaagaagccgttgtgcagctggccacaaagccatgtggcatgagacatgggatggtctgccttccgaagaattcctcaacaggcttgatccttctctgggaacgctcagagcaagattatacagggaaacctatacttcagatgaagttgccggctacctgaatgaagaatgggctgcaaaaaccggtcttaccacccaaaccattattactgtaggaacttttgatgcccattcaggcgcagtaggagccagggtggaagaaaataccctgatcaggatcatgggaacttctacctgcgatattatggttgcctcacaggaagctatcgggaatacaaccgttaaaggaatctgcggacaggttgacggctccgtaattccaggactgatagggcttgaagcaggacagtcagcctttggagatatgctggcatggtataaagatatcctgatgtggccggttcaccagattatgatgcattccgaaaatatttcagatgaacagaagataaagctcgcagatgaaatggaggcagtacttatcagaaaactaacccttgaagcagaaaaaattcctctttcagatagtgttccgattgcactggactgggtaaacggaagaagaacaccggatgcagaccaggaacttaaggcagcgatcagccagctttctctgggaacaaaagctcctcatattttcaaagctttagtcaatgctatttgtttcggagctaaaaagatcgttgaccgttttgaagaggaaggggtgaaaatcaataaagtgatcggaatcggaggagtagcaaggaaatcgccgtttatcatgcagacactcgctaatgttttggatatgccgattgttgttgccgcttcggaccagactcccgcgttaggggctgctgtttatgcagctgtatcagcaggaatttatccgaccgtacaggaagcaagcatgaaaatgggctctgcatttgaagcggaataccatccgaaagcggaagaagtacaacactacagagaattaatgcagcaataccaaaagctcgctgattttgtagaatacaataccaaactgaaaaacaacaggaaggaacttcagaactcctga

SEQ ID NO: 34604 - DNA, 108 bp, Glycine max
  Peptide Sequence Number=SeqID_151382
atgtacgggctagctcctagtctatcgcctaccatagcagatggaacagagcaccatgctaatgatgctcaggttgatcgtccttatgacatgggaaataatcattga

SEQ ID NO: 34605 - DNA, 1496 bp, Glycine max
  Peptide Sequence Number=SeqID_151383
gtgataagcagggtgcactcaatccgggtgaggtgacggatgacgcccagccgaccgtgcgcggcgaagcggagccgggtagcctggtcaacctgtatgacaatggccagctggtgggttcagctgtcacgaatgctgaaggccaatgggaattcacgccaacccgaccgctgctgaacggcgcgcattcactcactgtggaagcagttgatgcggccggtaacattagcgaaccgtccgacagctttgacttcatgctggaggccggcggcgcgccgaccgcaccggcgatcactggcgtagtggacaacgtcggagatgtgcagggcaccatcgaaaaaggcggcgtgaccgatgacgttcgtcctaccattaacggtaccgcgcagccggacagcgtagtcaccgtgtatgccgatggtaaagtgctggggaccgtcctgaccgatgccgcaggcaaatggtcattcacgccggatagtgacctggccgaaggcctgcgcaatctgagtgccaccgcgaccaacgcggccggtaatatcagcccgtcaaccggactctacccgattgtgattgacaccaccgcgcctgatgccagcagcgataatcagctgacggatgacgttggcgacattcaggggccgattaatagcggcgacactacggatgacgcgcaaccaaccttcagcggtgtgaccgagccgggtgcgaccattattatccgcgacaacggccagccgattggcagcgcggtcgccggtaaagacggcaactggcgctttacgccggaccagccgctggcggatggcgatcacagcttcactgcgcagccagttgataaagccggtaataaaggtgcggaaagccagccagttgacttcattgtcgatacctctgcggtgctggtgaccatcaatagcgtttatgacgatgcaggttctgtcacaggcaacctgaccagcggtgcggtcagcgatgacactacgccaaccctcaacggttcggcgacgccagacgcgctgattcacatctataacaacggcacgctcatcggttccgcaaaagccaactacaaaggcgagtggagctttaccccggatgttgcgctggcggaaggtgaacatcactttacggcgacggcgacaaacgccgccggaaccagcgccgagtcgtcaccttttgacctcaccatcgatctgaccccgccagtcgtgggcggtattgatagcgtactggatgacgtgggcacggtgcagggcccggtcgacaacggtggcattactgacgacaccacgcctacgctggtaggcgaaggcgtaccgggcgatgtggtgaccattatcgacaacggtgaaaccatcggcagcgcggtaattggcgagaacggcaagtggaccttcacgccggaaacgccgctcaacgacggcgagcacaaatttgaaaccgtgatcaccgatccggccggcaacagcagccagccgtccgatccgtacatt

SEQ ID NO: 34606 - DNA, 1065 bp, Glycine max
  Peptide Sequence Number=SeqID_151384
atggcattagcagatatcactaatactcaaccaaatagtcaacatgtgtcaaccagacagaggaaaactatcaataacatatttagccttcgtaaaatagatgacattgtactagattatgagaatgaactatcagattgtgttgatgataccattgatgacattagcataggtttcattgacagatatgttgatttaggtgaccattctcaaatatgtgcatattgccaagctgctatgtggtatcaagaaaagatgaggaaaaatagaaaccaagttaatcccaaatatagtctttgttgcagtatgggaaagatacaacttccttttcttaagaatcctccaatgcttttgcaacaactactatgtgatgaagaatcacgcgaaagcagaaattaccaacaaaatatcagggcttgtaatttgatttttgcattcagctatcctggggccaagatagatacaagtctgctaaaaggaaaaggtccatcaatttgcaaaattcatggaaaatcatgccatttgattggaagcatgttaccaatgcttgggaaaccaccaaaatttgcccaattgtatatatatgatatagaaaatgaaattgaaaacaaaattggtgcaattaggcaaaatctacttgattcaaagcttgcgttgaagttaaaagatatgcttgatgaatacaatgtctttgctaagtctcttaggatggagaaagatagatatgataactatcagacagagaaccttaaccttcgattgattgcagacaggaagaaggatggaaggatttataatttgcccacagttttagaggtggctgcagttattgttggtgatgcaagtcaacctatcaatagagacataatacttgaaaagcaaagtggacgattacaaagaatcaatgagcttcatccaagttatcttggattgcaatatcctctgctgttttcttatggtgaagatgggtaccacagtgatatgaagcatagagatatggatgattctcatgaaaggaagagaaacaaactaactatcagagagttcttatgttttaggttgtag

SEQ ID NO: 34607 - DNA, 648 bp, Glycine max
  Peptide Sequence Number=SeqID_151385
atgggaaatgatgttggagatgggaaactaagcaaaggtgatgatggttgttatgagatagaaactccacctgatattttaataacaagcttcactgatcctattgaagcaattgtcaatcatacctacccagatatccagaagaagtataaagatgaggaatttctcaattctagagttatacttgctgcaacaaatgaggtggtagaccaaattaatgactatatcttaaacattatcccagatcaagctgaaggcctcttcaacgggacaaggctaattatctctagaatgaccaaccatgttattgaggaacgaataatttttggaaaaaatgtaggaagtttggttgacattccacgaatgacattatcaccatctcaatctccttggtcttttaagatgactagaagacagatcccacttattgtgtcatatgccatgacaatcaataaatcccaaggccaatctcttcagtgtgttggattgtatcttcctcaaccagttttgagtcatggccagctttatgtgacattctcaagagttcagagcaaaactagattgaaaattcttattcatgataaagaaggaaaacctctaaatacaacaaccaatgtggttttcaaggaagtactacaaaatatgtag

SEQ ID NO: 34608 - DNA, 168 bp, Glycine max
  Peptide Sequence Number=SeqID_151386
atggccaacatcatgttgaagatcacaagaacattagaggagattttaaacactattaatgccaaggacaagacttacgatgaagttaataggtcgtttgccatgaggtggaagaacgtgcttgaacattgctggcatttggttgacaagaatggaaatttgcattaa

SEQ ID NO: 34609 - DNA, 189 bp, Glycine max
  Peptide Sequence Number=SeqID_151387
atgaagattgagccagggttggaagaagaagctagtccatctaacgcgcaagcacaacactttgctccaccatcgtcactatttggcaccctcaaccagccaccagtcacacgtggagccactgcgcctgttatagctctgtgtatcaaagggctttcatcatgccacaagattattatatcagattga

SEQ ID NO: 34610 - DNA, 168 bp, Glycine max
  Peptide Sequence Number=SeqID_151388
atgacactcattataccatcaagtgccaaattctttcactttcaacgtgcttctcaatcagtacaaaattacctacagcagcatgctaagtttgtgaagggccctaattgggtgcaaaaggatcacaattatgatgatgatgaaattggaaaggtgcaacaagtttga

SEQ ID NO: 34611 - DNA, 519 bp, Glycine max
  Peptide Sequence Number=SeqID_151389
atgatgataataagtctggggcttatgtcaacaacccatgacctgccaacttcattgaatgctcttcataccttgagggtgttagatctatcaaataatcaattatctggggaacttcctcgtcttaagaatttggcaaaccttcaagttcttaacttggaaaacaacacatttggacctcattttccttctctccccaccaagttggtttcccttgtgcttagaaataatagcttcaggttaagtgtcccttctaatttaagttctttctatctgctccaaaggctagacctttcattgaatagcaagcgtgttgtgagggcatcaacaaggtccataatagaacatgtatcatcagcaaacacatcaaaacttctcacagatgcaaggtatatattagaaacaatgaagatgggagccaaccttcctgcttataggaccttggctttggatgaacctaaggaagctacaaaaaattttgatgaatcatctttcacaagtgaaggcccacatggttag

SEQ ID NO: 34612 - DNA, 213 bp, Glycine max
  Peptide Sequence Number=SeqID_151390
atgtcaaaggttgaggcacttgctttcaaagctgccaacatggtctctaatctgaaagcagccaccaagagtttcaaatcggatgcattgcttggagaaggaggtttcggaaaagtatacaaaggatggttggatgagaaggcactggcaccgacaaaagctggttttggaatcatggttgctattaagaaattgaatcccaaaagtatgtag

SEQ ID NO: 34613 - DNA, 345 bp, Glycine max
  Peptide Sequence Number=SeqID_151391
atgacgaaacctatgcacctgatgcaaggaatgcaaaaaataccaaaaaagaggggcaaaagggtcttttcattgagtttcctagaccctatctcgcttagactagcctctgactcacctgggcccccaaattacttcaaggtgaaggaaccagctcgcctgggcgagccaattacttcaagagtaggcttaagaaaggttccaggttcagtgcttaagggaattgagagaattaagagagaagaagaaacaagaggaaacaaagccaaggcattgtcgaatcatgactgtgatcaatctctacgtcatttctcgtttggtgttcttcgtatgatcgtcgattag

SEQ ID NO: 34614 - DNA, 186 bp, Glycine max
  Peptide Sequence Number=SeqID_151392
atgaccacattggcctctgctcatcaatcacacttggggtcgctgaatgacgaggtgcggataaccataagaggaaaccctgggtttgacaaaatagaagaaaatcactcaaagtgtatcaatctcgcacagtgcggggcgaggaaaaaagggtcgctagcgcacgggattttggttggtaattaa

SEQ ID NO: 34615 - DNA, 863 bp, Glycine max
  Peptide Sequence Number=SeqID_151393
cccgtaccggcaaggcggccgtcctgctgcgcgccaggaagagaatcgtcgctctggtcctcgcagcacccgtaataatgaagagagcggtcgtccgcgcaccgctcgtggtgacgatgccgggcgttcgcgtggtccacgtgacgatgctggccgttcgcgcggtccgcgtgacgatagcgcgcgcggtcgtcgcagcgatcgggacgatcgcggcttcagtgattcaccgtggcgcaccgtgtcacgtccgcctgtcgccgctgaagcggatgcgggtgacgaagcggccagcagcaagccggttatcgacccggaactgattcgccgtcagcgtcaggaagagacgcgcgtgtatggcgaaaacgcctgccaggcgctgttccagagccgtcccgaaagcatcgtccgtgcctggttcgtgcaaagcgtcacgccgcgcttccgcgaaaccctgcgctggctggcagcaaaccgcaaagcctatcacgtcgtggacgacgccgagctggcgaaagcgtccgggactgaacaccacggcggcgtgtgcttcattattaagaagcgcatgggcatgccggtggcggaatggctgcagcaggcgcagagcaaagactgcgtactggcgctggaagatgtcagcaacccgcacaaccttggcggtatcatgcgcagctgcgcgcactttggcgtcaaaggtttgctggtcaatgatgcctcactgctggagtcgggtgccgcagtccgcacggctgaaggtggtgcagagcacgttcaggcgatcagcggcgaaagctttgctgcgggtctggaagcgttccgcaaagccggttacaccattgtgaccacatccagccacgccg

SEQ ID NO: 34616 - DNA, 567 bp, Glycine max
  Peptide Sequence Number=SeqID_151394
atgactttagcccaggtgtggagtgttctctcatactccaacctggcccccacatctcacacatctaacctgacagtggacagagctaggctaatctttggcttagtctctcgcatggacatgaacataggagctcttatttctggccagatgacttctatagcccaatctaactcttctagacttgggtttcttgctctgatcaccaccctatgtcgagccagaggggttatctctgacaacctcacttttgagcgcctgagcctgatcattaacttggcctacatcaggaagaactattggaatcctgatgatctgacagttgctatacgaggggctaggagggcgagggcgaggccagctgatcttccttccacatctgtagctcctactccagcatccacttcagcatctccttcagtcccagctcagatggattctcagcgctttgaagccatgcttcagagcattcatcagggacaaatcattttacttcagagtttacaggtggtggcgcctccaagatccattccttcaattgagcagtttctggagagggtagcctag

SEQ ID NO: 34617 - DNA, 255 bp, Glycine max
  Peptide Sequence Number=SeqID_151395
atgtcggaaaaaccaaaattggaaaaggttgagggtctgtgtattttgaaaatgagggttcgggagtcatttatgcacgaggaagggtgtttccctcgctcctatgtatcctcgggtgcgatgaggaaatcagacctacgtagttctttaagaactgaaggagaaagagtcgttatggtgttggaccttgaaacgatcttctcaagtttgaaaggcgtagaatcgttaaggtgttggaccttgaaacgaccttaa

SEQ ID NO: 34618 - DNA, 513 bp, Glycine max
  Peptide Sequence Number=SeqID_151396
atggaggacatcccttcatcatccactctagctcctccgtcagtaaccgtaggacaagatgtccaaggctcacaaactttagtccctatgctgcaaagcttatttcgaggacagtttattatcatgcacagcctggaagagttggctcataacaggccaatcataactatggagcattttcttgagcaagtagcctggcttgaagctcaacttgcattggtgagacccagcgaggctgctccacctgagcccacacctatgcaggtcgatccaaaactagcttacccacaatctccagtggtgaatccactgtcttttcctgagcatgaagtagttcccccatctctacctctgattatcatctccgatgcatcattagatgaagcggctacccctcctcattcaccagcaggaaaaacagctgaccttcctacttccctagttggaggaatttccgatctttccgattcgtcatctggagaagctgttgctctcactaattccccagtttag

SEQ ID NO: 34619 - DNA, 723 bp, Glycine max
  Peptide Sequence Number=SeqID_151397
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtgccttgtgcacatcaccgactttcaacggttgttgggcggcattgaaggccaggccgccggcggagaggtcgatgacccgcacttccatgggcgtgcggtcggcgccgaaaaagcgcagcttggccgggattttgacccgggcgtgttggcgctgggcttcggattcgtggacaacgttggcgtttacttggctgttcatagcgtactaattcctaggttaattcaggcttggcagggtcagaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 34620 - DNA, 440 bp, Glycine max
  Peptide Sequence Number=SeqID_151398
ggcgcgtcccattcggcattcaggctgcgcaactgttgggaaggacgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggaggccctcaacgaattactaactaaggaattcagggagaggtttgttggtcatggccttggtcctgtctggtcaattttgacacctggtggccaagggagttcgcaggtttcaggttcaagccatcaagcttatcgataccgtcgacctcgagggggggcccggtaccagcttttgttccctttagtgagggttaatttcgagcttggcgtaatcatg

SEQ ID NO: 34621 - DNA, 489 bp, Glycine max
  Peptide Sequence Number=SeqID_151399
atgcaatggtatatacgtcaaactagacgatatatatcgcgtgaggggacactatgtactgaggtttattatcctggtcatcaccaacaccaatcatatgttgaacctagcgtacctctagttcatgtttctggatatatgcccccaacatcatcaatcacaagcacaatatcaatcaacaagcttctctggatacatgcttcaaggatgtcaacaaagtttgacaccactttcaacactctgtcatctgcatataatctgccactatcgaactcttgttatcgttcattattatctactcaaatgcatgacatgagtcatgaagatgaggaggaagatgatgataataataataccaaaaataacgatgatgatgatgacaacggtaacaatcacctgcaaatccagtgcaacaagatgagagacttcaacgcatatctagaagaactcgttgtgggacatcatctcattattattattttttgttaa

SEQ ID NO: 34622 - DNA, 2232 bp, Glycine max
  Peptide Sequence Number=SeqID_151400
atgaagaatttcttggtttctttgtactacttgtttcctgcaatcattgcaattattcttgtgctgctcactccaattccaagtgcacagctaacaacaagtgagaacagaatccttctccaagttcagaagcttcttgaatatcctcaagctcttcaaggatggaccaacttgaccaatttttgctctctccctcctcccctcagcattgtgtgcttcaatggccatgtaaccgagttaaccgtcgttggcaattcatcttggactctctcagaaagattctccattgagtctttctttactgtcttgacaaagctctcaaatatgaaggtgttgtcattggtgtcacttggtttgtggggtcccttgccttccaagattgacaggttctggtcccttgaagtgatgaactttagctcaaacttcatttatggggaaatttcaccatcagtttcctctttgaagaatctaaaaagtcttgttttggctaataatcttttcaatgggagtgtgcctgatcttggaaaactagcttctcttgaagagctcaatttgagtggcaacaaattaggccctgagttcccttcattgagcaagaatcttgtgagggttatcttgagaaacaactcattgagatgtagaatccctcctcaactcattcatgtttataaacttgagctgtttgatatctcttccaatgtgatatttggaaatatcccatcatttattttctctcttccttccctaaagtacctaaacttggcttcaaaccaattaagtggctacctttctttgaatgtgtcatgtagttcttctctcacatttgttgatatctcacacaacctcttggtgggaacattgccatcttgtatcggttcaaatgcttcaaaccgaacaacactttattatgggaattgtttggtaaccagaagcttattaagtgaccaatatccatcttcttattgccagaaagtggagtccttagcagctgtcaagccatcaattaaaagccagaagagggaaccagagatggaactaggccaaattattggtattgttggaggtgttgtgggaattgcagggcttatggttcttctcatttggtgcatcttcagaaagtctaaactagaaaaagcagacagtaattatagcataggcatctctgctccaaataatttttccatccgtgcatattcaagaccaaatattaatgcaagacgtcctcctctaccaatgaggcaacctgttcttggattcccaccatactgcattttctcaatagaagaaattgaagatgctacaaacaactttgacccatcaaatcttatagcagaaggatcacaggaacagctatataaaggttggctcatagatggttcaatggttatggtcaatcgcaataaactaaagcagaaaagtttgcacaaaaacagtattcagagcttgaaggtattaccctatttaaggcacaggcatttggtgagtgttctaggacactgtgtcattactcatcatgaccatccccaaatgataagcacaatattcattgtattcgaacatgtctcaaacgtgtccttgagggattaccttgcagataggagaaaaagggaaatgctgaaatggccacaaagaatggcaatcagcataggcattgcaagaggaatccagttcttacacactagagttcatcctggcatatttggcaacaatataaagattgagaatattctgttggatgattgcctcaatgcaaaagttagcggatacagcattccatggccatccaagaaaggtcatgacagcaaactttatgatcaaagagcactcaatcaaattggcagcattaatgatgcagaaaaggaagacatctatcagtttggtgttattctacttgaagttatcactggcaaactaattacatcttccagtgaagtagaggagctgaagaatgatcttgagagaggtttagcagaagcttcatcaccatctctaaagggtgcaacaccatcactaaagggtacatcaccgatactaaagggcatgtctgattcttccctccgggatacttgtgtgcatgaatcattgaagactacagttcagatcaccatcagttgtctcagcaaggtttcaagtaaccgcccttcaatagaggatattctctggaatttgcagtactccatgcaagttcaagagccaaggaccagtggtgtacatttctttacagatatgtaa

SEQ ID NO: 34623 - DNA, 1076 bp, Glycine max
  Peptide Sequence Number=SeqID_151401
atgccccaaccaaacgtcgcatctctaaatgctgcactttctggcttctcgcgaaacgggcgtcgcggagaagctctccgggtgttccggcgagctgggttgggccccttgaggcccaactcggtcactattgcgtgcatgctcggcgttcctcgtgtgggtgccaaccacgttgagatgatgcattgctgcgcggtgaagttaggggttgaatttgatgcctatgttgccacctcgcttgtaactgcgtattgtaagtgtggagaggtggtttcggcttctaaggtgtttgaggagttgcctgttaagagtgtggtgagttacaacgctttcgtttcgggtttgttgcagaatggggttcctcgtttggtgttggatgtgtttaaggagatgatgaggggggaggagtgtgtggagtgcaaactcaattcagtgacgttggtgtctgttctttctgcgtgtggtagtctacaaagtattcgttttgggaggcaggttcatggggttgttgtgaaacttgaagcaggtgatggggttatggtgatgactgcacttgtagatatgtattcaaagtgtggtttttggcgttctgcttttgaggttttcacaggggtggaagggaataggagaaatttgatcacttggaattccatgattgcgggaatgatgttaaataaagagagtgagagagctgttgatatgtttcaaaggctggaatctgaagggttgaagcctgattcagctacttggaattccatgatcagtgggtttgcacaactaggggagtgtggggaagcttttaagtactttgggcaaatgcagtctgttggtgtggctccatgtttgaaaattgttactagccttttgtcagcatgtgcagattcatctatgttacagcatggaaaagagatacatgggttatctttaagaactgatatcaatagggatgattttttggtaactgctctggttgatatgtacatgaaatgtgggcttgcttcttgggcacgaggagtttttgatcagtatgatgcaaaaccagatgatcccgcgctttggaatgccatgattggtgg

SEQ ID NO: 34624 - DNA, 162 bp, Glycine max
  Peptide Sequence Number=SeqID_151402
atgacggtcccgaaacaatccctgaaccctcactcacctgagacaccatggttgatgtcggaaatgagaaggggtgaggtttctaccaagcaatcccttgttccccttgtgctaatagaaataaagaaagacaaccaagaaaaggttaaaaaagtttcttaa

SEQ ID NO: 34625 - DNA, 186 bp, Glycine max
  Peptide Sequence Number=SeqID_151403
atggatttaatgtttggttatagaaggttctggtgtttgttttgtagtctggggcgttcaaagtgtccaaggaagagtttggtcaggattgaaattgtgatgggaggttttaaagtcgtgataatggctgctgatgaaaatggttcaaggagtcctggtgtgggtgcggtgatgatgtatatataa

SEQ ID NO: 34626 - DNA, 183 bp, Glycine max
  Peptide Sequence Number=SeqID_151404
atggcgagggttggcggcgtaggcggcagtgagggcggaggaagcataagggtcggaatggaaaccggttttgaggagatgggcatggagggtttgggtgtgggaaggggaacggagggtgtgggaagaacaagaatggaggtgggagaagagggagagtgcttctctgtagaagccatctga

SEQ ID NO: 34627 - DNA, 1848 bp, Glycine max
  Peptide Sequence Number=SeqID_151405
atggggaaaggaagaagtcctgggaaatggttcaagaatttactcttggggaagaaatcgtcttcaaagtctacttcatcaaagaagaatgacatttttaaaccttcaattgacaaggatttgctggtgtcgtctgaggtacccgtgcctgatccaaccatggattcgttgcagatatccacaccaatatctggagctaatgattataaaggagtgttttccgaaaaggaggtagttagtaggtcatcacatgatagggatgttctttcaactagagtcaaagaagctaaggtgcaagatgttgctaattttggatctcaagagaatcttgagaaactccagcttacggaagcaactataaaagttcaggctgcttgtagaagttatctggctcgtcgaacattgcaaaaactcaaaggtgtcatacaactgcaagcttttattcgtggccacttggttagaagacacgctgtttctgcattatattgtgtgaagggaatagttaaatttcaagcattggctcgtggttacaatgttagatgctctgatattgggcttgcagtccagaaaattcgtaaggatactcattgctcaaattctgttcgggtagtttcgtccacacaggcagagaagttgtctgaaaatgtctttgtttgcaagcttctggcttcatccccatatgcagttcctctatcactcaacagtgatcctggagaacctaacatgggtcagaagtggcttgactattggacaaggtcccacttttgggcatctcttcctgaatttaaaaagaaacttgagtcagtgtctgatgagaaaaatggcacttctcagacagttcaaaaggggcaagttaaaaaaattactcggaaatctcctactgtgaaagctgacaatgtctcaaatttaggttctaacaaatctaaacagcatctgaaaaaggattcaagccacccattgccttcagctcaggaaaacccaccaaaagaaactgagaaaagtagttttggaaagactcatgcgcataatgcttcaaatggatctgaggttgttaatgaaaaaagaaaatccggcaataaaaagattttggatcatgctgtcattgatgtttcagagcagggcccaaatgcctcttcagcgaaagagaaagattcgactgtgccaaagtcaaaagagtctgatcctgagaaaggtcatggacagcaaacaaaagacaagaatgataatgagccacataatgatcccattgctgtctcaaagacaagtgtgaagaagggtggaaatgaaggaattcaagtagtcagtgagaatttgaatggtggtgacaattgtatcagtaacaatagccaaagaagagcttcactacctgctaacattaatgaacaagagaatgagttatataacactcctgttactccaagactgcccagttacatggctcctactgaatctgcaaaagctaggctaagaggacaaggctctccaagatttactactgatttggtagacaaaaacagtgcaaccaggcggcattcactttcatcctcacttaatggcaagtcaggttcattttccccgagagctgaaaagctgataggcgtaagcagtagaggagggataaggtctgatagatctctgtcatcttcaagggatgggactggcatgcttttggaatacaatacagtgaacatgcatagagacaaagaagttgatccaacctcagtggagaaggtgattctaccttatttttcgaggcaaggatacttgaagaagatgatcctgaaaaactgcagcatcaatattacactgacaaagtctacttgcggtggtatccatgcagcacgatga

SEQ ID NO: 34628 - DNA, 396 bp, Glycine max
  Peptide Sequence Number=SeqID_151406
atgttgaaaagaaggctaagagatgatgagagagaagttgtggtggttagaaaaattttgtatgactatgcagaggcatctgggcaatatattaatcaacaaaaatttgaagtcacttttagtaggaatgtgaatcaaggtttgaagaatgatgtgaggatgactgaaggaaatggcggagggaaatatctgggcttcctttcttttgtgggaatgagcaagaaggctatttttaacttcatcaagaataaggatttgaaagtgggagttttgatggataaagaggctttgtgttggaactacacactccttacacaaatttttgaagtgcaggatgttgaggccatcttgagaacaccattattgaatgttgatcaacaagacaccaagatatga

SEQ ID NO: 34629 - DNA, 363 bp, Glycine max
  Peptide Sequence Number=SeqID_151407
atgatgagaatagagtatggcttgcagccaaagcctgagcattttggttgcatagttgatcttttaggtcggtctggtcgattgagtgaagctcaagacctgatggaggaattagcagagcctcctgcatctgtttttgcttctttgcttggtgcttgtaggtgttacctagattccaatcttggggaagaaatggccaagaagcttctagatgtagaaccagaaaaccctgctcctctggtggtattgtctaacatatatgctggactgggaagatggaaggaagtagaaagaataagaggggtgatcacggataagggactggacaaactctctggctttagcatgatagaacttgcatga

SEQ ID NO: 34630 - DNA, 1443 bp, Glycine max
  Peptide Sequence Number=SeqID_151408
atgggagaggctagagaagaaaacaagatgttagaattctttgagattcttcaacaagataaacctgaagatgctacaaatgctaaaggtgtgtttagccatgatgaggaaaatgaagaaagtgaacttgtgtcactttctcttgggatatcaatatcaaaaggcaagcctaccaaggatgagaaaatattgaaaaacaaaaatggaattgaaaagacagaagatgaggatgtgcataataaaagacttgtgcttgggttagatatcaatttggaccctgtagatcaagatgaattgactgcaaataattccaccactgaaagtagctttgttggtgagagagggaaggaagaggaaccaactgagatgtggccacccagtaaagttttgaagacaatgaaaagtgtggataaaagtgaagtttctcaacatgatcagcccaagaagactagggtttctattagagccagatgtgatacccaaacgatgaatgatgggtgccattggagaaaatatggacagaaaatggccaaaggaaatccatgcccccgagcttactatcgatgcactgcttctccatcttgtcctgtaagaaaacaggtgcaaagatgtgctgaagacatgtccatattgattaccacctatgaaggaactcacaatcaccctcttcctatgtcagccactgcaatggcctgcacaacttctgctgcagcttccatgctccaatctccctcattgagttcacaacatggattagttgattcagctatatcctccatcatcaactctagtgctccttattacaaccctaataatgctctaaacttctctacacaccaagtttcaagaccacaacaattctacttccccaactcatccatttcaaccttgaattctcaccccacaatcactttagatcttacaacacctccaacttcttcctcaaactcaagcttcacttgcatgccaaaatactcatcaacaaaccttaacttttcctcaggtttctctcctctgcattctagcatgccgcaatcaccttggaacagttatagtggttacttcaactctggaacactttctcaaaatagacaccatggtggtaattacatgttaaacacgggaaatcaaaatcaaccacattctctagggcatctccatcaacctatttacatgagcaacaatagtaccatttctcagcattctttccctaatcccattgttgctgcaactgaggcaataatcacaagcaacccaaaatttcaatcagcactagcaactgctctcacagcatatgttggcaatgaagctagtggtggtaggttaagagaaaatcatgttcttgagaatgcagaactgatgaacttaaagctgctacgcagtgaaaatagtataggaaactcaagtatatttccactaccactaccggagcaatggaagtga

SEQ ID NO: 34631 - DNA, 1344 bp, Glycine max
  Peptide Sequence Number=SeqID_151409
atggcgcaagaacaagagtacagaaccagcaccacacttccaaagtgtgatacctatttcgaaaccatacaatccagaaagaagctaccactgtctctgcaggagaccttgacagatgcatttgcaaagattcctgtttcttcttttccagcagttcctagtggaaaagtgattgaaattctagcagacacgcccattggtgaagcagttaagattctatctgaaagcaacattttatcagctccagttaaagacccagaagcagctaatagttcagattggagaagaaggtaccttggcatcatagattattcagcaatcattctctgggtgctggagggtgcagaacttgcacacaaagcactattggtaggtacagcaacagctgctggagttggtgcaggagccgctggtgctatgggagcgctagcattgggagtgacaggtcctgcagcaattgctgggctaaccgctgctgcagcaggtgctgcactggcaggtggcattgctgcagatagagtggtggctaaagatgcacctcaagcagctgataacctaggagaggacttttacaaaataatactggaagaagaacccttcaagtcaacaacggtgcgatcaataattaaatcataccgatgggctccttttgttccagttgcaagaaatagtgctatgttgactgtcctgctgcttctctcaaagtacaggctgaggaatgtacctgtgatagaaacaggtaagcctgacattgtaaacttcattactcaatcagcagttgtccaaggtctcgagggatgcaaaggaagagattggtttgactgcattgcggaaaagcgtatagctgatctgggacttccatttatgtctactgatgaggcaaggattggtgttattagcatccagagcaatgaattgattcttgaagctttcaagcagatgagggataataaaattggtggtcttcctatagtagaggggccaaagaagagaattgttggaaacttgagcatacgagacatcagacacttacttctaaggcctgagcttttcaccaattttaggaagttgactgtgatgaatttcatgaacaaaattgtctcgtcatcccttcaaactggaaaagttacccaatccataacatgcaagcctgactcaacactgcagggtgtgatccatactcttgcttctcagtctattcacaggatttatgtagtagatgggcaggatgaagtagttggagtcattacactgagagatgtgatctcttgttttgtcaccgaacctccttacaattttgacgattactatggatttgcggtgaaagagatgttgaatcagtga

SEQ ID NO: 34632 - DNA, 912 bp, Glycine max
  Peptide Sequence Number=SeqID_151410
atggtacacggagttggtgtttatgatggccatggtggaagtgaggcctcacagtttgttagtgacaatctcttctgcaatctcaaaaggctcgcagctgaacatcaaggtgtgtcagaacatgttatcaaaagggcttactcagcaacagaggagagttttctgtctcttgtgaagaaacagtggctgagtaagccacagattgcatccactggcacttgttgtttggtgggggtaatttgcaatggcatgatatatgttgcaaattctggagactcccgggtggtgctaggaagattagagagagcaacaagggaaacagaagctatacaattatctacagaacacaatgttaaccaagaatcagtgagagatgaacttcggtcaaagcacccctttgattcacaaatcgtggttttgagacaaaacgtttggcgtgtgaaaggcctcatacaggtttcacgatccataggggatgcatatctgaagaaagcagaattcaacagggatcctctaccagccaagtatagactagcagaaacattcttcaggccaattcttagttgtgagccatcaacatcatcccacacactccaccctgatgatcaatttctcatatttgcttctgatggcttatgggagcatcttaccaaccaagaggctgttaacatagtcagcaacaacccacctaacggaattgctagaagacttgtgaaagctgcacttagagaagcagctaagaagtgtgaaatgagactttctgacctccaaaagattgagcaagggatgaggagacacatccatgatgacataacagtgattgtggtgtttctcaatcccaaactcactgagaatacttctctctgtggttctcctctttcaatcaagggaggtgggtctaccaattcctag

SEQ ID NO: 34633 - DNA, 163 bp, Glycine max
  Peptide Sequence Number=SeqID_151411
atggttcgcgttcgggtttccaacgttgtcgtccttggaggacaaggaggccgtggccatcacagagacaaagaaggagaacttcgtggagagggatgtggggtcggagaaagccaggggctcgcgatggcggaggatgctagagaaggaaggggtggggcgt

SEQ ID NO: 34634 - DNA, 217 bp, Glycine max
  Peptide Sequence Number=SeqID_151412
tgattccaatttccggaaacagcctctttgcatatgcaagggtaaggctgcgtacaacatccctcccccataccttcgcatagcgaagagcctctggtgtatcatgccataccttctaggttggaatgcctttggaaactccataaagccagaggtatatagtcaagtgaatagtaccaaccccagatatggagcagacaatgaatggaacagatag

SEQ ID NO: 34635 - DNA, 1872 bp, Glycine max
  Peptide Sequence Number=SeqID_151413
atgtccaccgttgcattagagactctcttccctctttgccgtagaaaaccttcatttcaccgccataaaccaatccctctcagacccttctttgtgacttgctcttccaacctcaatgatgatgcatccttcatcttccaccaacaacctcgcaaaactctctctcccgtgcatgcagtttcccacacagacacatctgtcctccactcccttcaatgccctcacaccatcaccaacactttcctaatcaacacaaccgaaacggtggagggaaagatttttgtgagattagatcacggaaagggtttgagggatcgggagcttacggtgggttgcaatcttcccggaaaatggattcttcattggggagttacctatgttgatgatgttggaagggaatgggatcaacctcctcgtgatatgataccccccggatctattcttataaaggactatgcaatagagacccctttgaaggagtcatccttatccgccgaaggagatacgcttcacgaaatcaggattgatcttaaagccaacaatggaattgcagcgattaattttgttctcaaggatgaggaaaccgaagcttggtacaaaaacaaaagaagagatttcaaggtttctttggtcaacaaccttaaggaggataatagcataattggacctaaatggggctttgatttatggccagggaatttgggacagatatctaaaatgttcctccagtcagaagaagctgaccaagatgacagcagtgaatctagagttccagagcaagacaataatcaaccagaaagtttttgtgaagaagtgcctataacaaagaaggttttagtccaaaactctatcagtgtctccaccacaaaatgccatgagtctggggcagttaaggaacttttacttttggaaactgatctacctggagatgttgtccttcactggggagtttgtagggatgattcgagaaagtgggaagttccacctcgtcctcatccaccaggaacagtagcatttaaagaaagggctttgagaactcaatttcggccaagagatgatggaaaaggatctttagcactaatcactttagaggaagaattttcaggctttatgtttgttcttaagcaaaatgaaaatacttggttcaagtacaatggacatgatttttatatccccctctcaagttctagtagctttcttaatagtggcaacaaagagggccagtcagaaggtatgcagagggaagtgactcaagaggctagtcaaaagagttctttctttgcatttactgatacaataaccaatgaaataagaaatttggtcacagacaattcctctgagaagattcaaaggacaaaatcaaaaatggcacaacgaagcatttttcaagaaattgaaaggctggctgctgaagcctataatatattcagaatctccattccaactttctctgaggaaactgctgcagaacctgaggtaactattgtggaacctgagacaagtattgtggaacctcaggcaacaactattgtgatacctgagacttcagtggaatcagagacacagtccctggatccaaaaatatgctcaggaacaggcacagggtatgaaatattatgccaagcgtttaactgggaatctcacaaatctggaagatggtacatagagcttaaagaaatggcttcagaactagcatcacttggtttcactgtggtttggttgccaccacctactgaatctgtttcacctgaaggatacatgccaaaggatttatataatttaaattccagatacggaaacattgatgaactgaaagatttggtgaaaagatttcatgaagttgggatcaaagttcttggagatgccgtttaa

SEQ ID NO: 34636 - DNA, 168 bp, Glycine max
  Peptide Sequence Number=SeqID_151414
atgtcaggctcccccttaaattgttgcactgccatgaaaaaaccttcactgcctccaccagctttaatgtattggcataaaaatggtttacaccaaatactgatttgtgaactgaatcaaaccggaagtacagagtatcctaacaacttcaagatggcaggaaagtaa

SEQ ID NO: 34637 - DNA, 537 bp, Glycine max
  Peptide Sequence Number=SeqID_151415
atggcgtatactatactaatagtcatgttcgtagctgcagccatcgtatcttcatggaccttatatatacttctttcttccccatccataataagacacatattgaatactttttctctctttccaatcttacccttacactgcggcttccgtgaacgttctccctccctccgctcccaagtcccaattccgttcttcctccacacttcttattccattcccttgctcaaacccttaatcttcaatggatcgagcaacctcacaatcccaagtttccattttgacgataacccactatgcaaaactaagatcaaaaaccaaaggaagctcttttggatcataatcaccgacaacgacgcctccgatgaagaacaaaacaacccaacaaaaacaccaagagtgaagagagaaattacacataaaaaaatcgtcatcgttctttgccgctggtctggggcgttcaaagtgtccaaggaaggttatgttgtgctccagtttgctccctcagttggtgctgatgagctcatatatgattaa

SEQ ID NO: 34638 - DNA, 253 bp, Glycine max
  Peptide Sequence Number=SeqID_151416
atgttggatcaatttcatccatgcatccaggattctattgaaaacattattgatgtcaaagcggatggtaactgtggttatcgcgcaatagctgccttattgggtatgagtaaagaatcatggtcattggtgcgcaaccatctgcataaagaactcacaagcttgttggaagagtatatcaacctgcttggtgacataaagagatttgaggaattaaagcgttccctacttgttgacggattatctatggtgc

SEQ ID NO: 34639 - DNA, 318 bp, Glycine max
  Peptide Sequence Number=SeqID_151417
atgtaccctccactagaactgatccacaagagatctaccctctcttgttctcagtcaacaacccaagtagatgtaccctctacttgtaccacaaaggatgtaccctccaatgtgttaagacaaagttctcaggcgggaaaaggaagaatcaaaagaattctcaaactgtgtcattttgaattctttgacaagggagaagggagacacaaaagaattcaggcggttagtccttcgttcttttggaaaagggagaagagagacacaaaaggaattcaggcggttagtctttggcgaattctttttgggagaagagaatga

SEQ ID NO: 34640 - DNA, 476 bp, Glycine max
  Peptide Sequence Number=SeqID_151418
atggcatctttcagccagatgcagtcccagatgcaatctcagggacttgcattgcctccagagcctatggttggtccctcaagtccttgtgtcagcataaaggagagttttgttgatccctcagggaacgatcctgagacgggtgactcagacaagtgcgggttgtacatcgaagcaaatcctccccgcctggttgccctaggaagagtttatgagggatcaatagttcacaacgttcctttgttgtctggccaagtgaaggttggtgttgaggaggctaaagatgcacaggctcccgttcctgtacccactgatgaggcagctgtttctccagcaaaacctccacaaaggtcggatcttgaggtcgatgatccactatatctaatgacattaaccatccgagagcttttcttgaagcctttccaggttaactgggatgctaccatgtttggagtgtttaatccagacttcctgct

SEQ ID NO: 34641 - DNA, 308 bp, Glycine max
  Peptide Sequence Number=SeqID_151419
atggctgaagcgtctccttcacgtaaaagcaaacctcaaatgatggagtcagacatggaagttgcgcagcatcttattcaactgagcgaagatagcagcagcgacgacattgcagggaagaggaacacaagctgtgacggagaagaagttcatcaaaggctaagtgatgacatatctgtagagaagaagattcgagagcttttcggggatgacgaggtttctcagccgaagaagaagaagaggaggaggagatatcggtctcttgtgaacatatacatggccactgcatccatctcaatgcttcaaag

SEQ ID NO: 34642 - DNA, 594 bp, Glycine max
  Peptide Sequence Number=SeqID_151420
atgaatcttgcaaaggtgtttttgaagttcttcaaatgtagtccattagcatgtgacccttcagctttgccagtaatccccaaagacgaggatgaacgcttacaaactaagagaggcaaaaggcaaagggtttctaaaagagagcaatcatctcaaacaagtagaagtgatgctagtcagtcagaaaagaaccaaattgctgaacaaccccgtgaagacacagaatcgtcaaaagagaataatatggaacaacacaagcagggtcaagaaacggggcatagtgccagcagcacatcatccggttcaagactcttcatgatgaccgaagggagcatgaatgcatctatgtccccagtttttctctctagtggtagtgtcagaaaatcccccaaaactgagggccaccctaatgctcttaagaacataatgaactatagtgctctcttacaacaggcctctataattgatatgatcaaccgcaatgaaggcaaagaattccctcagcttcgtaaatccttctccgcgttggattttcgacttgattctgacaagctattatcaaatctctatgccttacataataaacatatttaa

SEQ ID NO: 34643 - DNA, 228 bp, Glycine max
  Peptide Sequence Number=SeqID_151421
atgaatgttgaacagattcacatgatattcaaactgtgtggttctccttcaccggattattttaaaaaactgaagctaacaacaagctaccggcctacacaacattacaaacctagtttccatgaaaacttccagaagtttccttcctcttccctgggtctcttggctacatttcttgatctcaaccctgcccatcgtggtaatgctgcctctgctctccaaagtgat

SEQ ID NO: 34644 - DNA, 1002 bp, Glycine max
  Peptide Sequence Number=SeqID_151422
atgggttgcgtttgtggcacgttttctccccctcgagaagagaggccaagaccgcaagtgaagagagttgcgagcaacaaaagttcgaggactacacgttcctctaagcatgtgggagagggggtgaattcgaagaaggagaagactcagagacagagagtgagtgtgaatgttaatgatggtggtgttgcagaaggagaaaaggcaaaaccaattgctaaagaaaataagagttataaagatcgggatgctagggaggagaagatggccagatatgaattcgtggaagggtggccaaagtggttgctcgataatatccctgcaaatgttttggctaatattgttcccaagagtgctgattcctatgaaaaacttgccaagataggacgtggaacatatagcaacgtgtacaaagctagagaaaagggcacaagaaagattgttgctttgaagaaggtaaggtttgacacgtcggattctgaaagcatcaagtttatggcaagagagatcatgatgctgcagatgctggatcatcccaatgtgatcaaacttaaaggactagcaacatcaaggatgcaatacagtctttatctagtttttgacttcatgcagtctgatctcacccgcattatctcgcgacccggggagaaactcaccgaagcacagatcaagtgctatatgcagcagctactttctggcctgcagcactgtcatgagaagggaataatgcaccgagatattaaggcttctaacttgttaatagacagaaatggggtgctgaaaattgcagattttgggcttgcaacttccattgaagctgaagggcctctaacaaatagagtggtgacactttggtatagggcaccagaacttcttttgggttcaaccgattatggatatagcattgatctctggagtgcagggtgcttgttggctgagatgtttgttggaagaccaattatgcctggcaggacagaggtaacagttagtttgagcatatga

SEQ ID NO: 34645 - DNA, 888 bp, Glycine max
  Peptide Sequence Number=SeqID_151423
atgtcttctgtaagtaagggtgataagaaggcttccattgatgcagcatcatggttgttcaatgtggtcacgtctgtgggaataattcttgtcaataaggcactgatggctacgtatggttttagttttgattgtacaactttagtctcttggattaagtcattgaagatgtggattgattgtgctgactataaaaatgacctaataatagactggatatatgatgtagcatctacaactttaactggtctgcattttgccacgacaaccttgttgacactcattcttaaatcactgggatatatccagacctctcatcttccagtatctgatataatcaaatttgtcttatttgcaaatttctccattgttgggatgaatgtgagtttaatgtggaactctgttggtttctatcagattgctaagctgagcatgattccagtatcttgcttcctggaggttgtcttggacaatgtacgatattcaagggacacaaagcttagtattgttttggttttgctcggtgttgctgtctgtacggtcactgatgtcagtgtcaatgcaaagggtttcatagctgccgtaatagcagtctggagcacagccctgcaacagtattacgtgcattttcttcagaggaagtattctattgggtcatttaacttgttgggtcacactgcaccagcacaggcagcaagtttgcttctagtaggcccctttatggactactggttgacgggcaaacgagttgatgcctacggctatggtttgacatccacattaatattctgcacattgattatcatggaactgggtgccaaattctactgcctaaattcagtgtcaggctgcttagtgacattgagaaagaatcttttggttgactaa

SEQ ID NO: 34646 - DNA, 3612 bp, Glycine max
  Peptide Sequence Number=SeqID_151424
atggcgtttcgcaaggaaagaggcctgtgctacaactgtgacgacaaatggagctcaggtcaccgttgtaagggaaggatcttactcttcgttgctgacgatgtcacacaagattccggcgaaccaggtatcactaataataccattgactttgacgataatctgagcaaccctgaccctacatcagactctagttccccccatattagccttcacgccatggcagggtcaccttcaccggaaacttttcgagtttacggcaccattcgaagcgcacgaatcacggtcctaatcgatagtgggaattgtgataagcgttgtcctgacacgccgttgactattcagggccattcgtttccggtaactttccatctcctgcacatcagtggcgcggatgccgttctgggcgttgactggttacggcaattcggccccgtcaccacaaactatgatgacttcgtgatgcgattcacacaccaggggcaggaaatctccttgcaagccgacgtcgccaccaaacccgaaccagcatcagcaaaccaagtaaaacgtatgcttcacacaggttcaacttctactttattccacttatgcattctcgactctaaccccacagattcaactaccaaccttctctcccctataattaaacccatcgccgaacttcttctccgatacgaccaactcttccaaccaccgaaacacttacccccatcacgagaagtaaaccatcgcattcctctccttccgtccaccgccccagttaatgtacggccttacagatacccacattttcagaaggcggaaatcgagcgacaagttgcagagctgttatccaatgggttaatcaggccaagcacaagcccgtattcatctccggtcctcttggtgaagaagaaggacggaacatggcggctatgtgtagactatcggtcccttaactcagtaaccgtacgcgacaggtttccaatacctaccatcgaggaactactggacgaattaggccacgcttcatggttcactaaacttgatctcaggcaaggatttcatcaaatccttatgaacgaagccgacatcgagaaaactgcgtttagaacacaccatgggcactatgaatacatggtgatgccctttgggttatgtaatgcgccttcaacttttcaggcagcaatgaaccaccttctcgcaccatttctacggcgtttcgcagcggtgttttttgacgatattctcgtctacagcgaatcactctcctctcacgtccaacaccttgatctcatctttcaggcactactacgaggtgagttctacctaaagcgcactaaatgtttcttcgctcagagggaattagagtacctcggccatgtagtttccggtaagggagtaactccagaaccatctaaagtcagggctatcacacagtggccaattcccgcaaccgccagggacctacgggccttcctcgggttaaccgggttttatcggaaattcgtacgcaattatgccaccatcacagcccccctaacgagtcttctgtgcaaggatgcattcgagtggaccattgaatcccaagaagccttcaacaagctcaaatccgcaatgtccaatactccggtattagctcttcccgacttcagcaaaccattcgtggtcgagactgacgcttcaggtacagccatgggggccgttctcacccaagcaggtcacccactggcattcttcagtaagaacttcgcccctaagctactaactgcgtcgacatatgtgagagagctacacgctatcacttctgcggtacgcaaatggaggcaaaacctccttggaagcaccttcaccattcttactgatcacaaaagcctccgagagcttatgacacaggtgattcaaacacctgaacaacactattacctatctaaattgctgggtttcaactacaccatacagtataaaacaggagcctccaacgtagtcgcagacgcgctctcccgccgaccaccagagcccagtcagcttctcgtgctatcagtccccaacctggacttcttatgcgatattcagcaaacccttgccatcaatcctgatttccaagccctaatgtccaacgttcagaccaacccttcagcctatccccattatcgtgtccataatggttgtctcctgttcaacaatcgcatctggatcaacaacaccaatccccatatcccgtctcttctatccgaatttcactctacacctttgggtggccatttcggggtaaccaaaacactacgacgactcgaggccagcttcttctggcagggtatgaaggccgatgtccaaaggtttatcaaggaatgcacagtctgccagcaaaacaaatccagcacccgacgtccggcaggcctcctgcaaccccttccaccaccaacaggggtatgggaggacatttcaatggacttcgtcactcacctacccccttcgaatgggttcactgtgatcttcgttgtagtcgacaggttctccaaaggagtacatcttggcgcccttcccactggattctcagccttcaaagtcgccatgcttttcatcgaaatcgtttgtaagcttcacggtttccccaaaagcatcgtgtcggacagggatcccgtatttttgagtaccttctggagagagctttttaggctaagtggaacccaactccgcctaagcacggcgtaccacccccaatctgacggccagaccgaggtggtcaaccgtgtccttgaacagtacctccggtgcttcgtcaactctcagccatcatcatggtaccgctatctctcgcttgcggaatggtgctataatacctcactgcattcgacttccggcatgacaccgtttgaagttgtgtatggcaagcccccgccctcgatacctcagtatctcccaggactaacgagaaacgaagctgtggaatccttggttgagtctcgacaactcatgcatgctaagctccaaaaacgactgaagaaggcccaaaccacgatgaagaagtacgccgatatgaaacgcgacgacatcaccttctccgtgaatcagtgggtctatgtaaagcttcgcccctcacgccagcgttcggtcactggacatatccatcccaagctttccaaacgatacttcggccccttcaggatcagtgctaaggtaggtaacgtagcatacagactcgagcttcccccggagtctcgaatccaccccgtttttcacagctcattattgcgacttcaccacggaccccctccttcgtcatcggagccatggaacttggagatcgtgggtcagaagcccctacaacgcccactttgtatcttggatagtaagcttgatacctctactactcctccgacccgcctcgttctcacccaatgggttggtcaacccccagaagacaccacttgggaaccctggctcgagttacgcgatgcctaccaccttgaggacaaggtggtttcccgggacggcagtattgttagcacccaggataatgaaggcacccacagcagcaccatgactggtaatggacccgataacgccacaacaagacccatacgcacagtaaccaagcccatatacttgcaggattatgtcaactag

SEQ ID NO: 34647 - DNA, 687 bp, Glycine max
  Peptide Sequence Number=SeqID_151425
atggccgagcacggaaccaggaaagcaaccactgaccgcctcgaagacgcgattgcgcgcctcacctccagccaggcaaaccttaacgagcgctacactgatctttccggcaaggtagattccattttggatcacctccggttacgtgatctacagcagcaccctccttccgtcagcaacatgagcgcccaccgcaactccgtgaagctcgatattccacggttcgacggccgtgacccccttggatggatattcaagatgaaccagctgtttcagtatcagaacaccccggaggaggaaagaatcaccgtggcttcgctgtacctcgatggcgctgccctcagctggtatcagtggatgttcacgaatggtttaatctcatcgtggcaaagcttcctcgacgcattagagtcacgattcgccccaactttctatgatgatccaagaggtgccttattcaagctagttcagcgagggtccgttaatgattacttaacggagtttgaacgcttagctaatcgcgtcacaggattacctccaccattcttactaagttgtttcatatcggggctgaaccccgagctccgacgagaagtgttggccctccaaccgatctccctcctcctggccactgccctcgcaaaattgcaggaagataagttgaaggatagaaggtctttatcatag

SEQ ID NO: 34648 - DNA, 3564 bp, Glycine max
  Peptide Sequence Number=SeqID_151426
atgaaagctctgtacagaagctctctcttgctcttgctcttgctcttcatctccgtgtgttttgcatcttcttcttctccggtcactcagcaactcctaagcttcaaaaactctctcccgaacccatccctgctccccaactggctccctaaccaaagcccgtgcacattcagcggcatcagctgcaacgacacagagctcacatccatagacctcagctccgtccctctcagcactaacctaaccgtcatcgccagcttcctccttagcctggaccacctccagtcactctccttaaaatccaccaacctctccggtcccgccgccatgcctcctctctcccactcccagtgctcctcctcattaacctccctagatctctcccaaaactccctctctgcctccctcaacgacatgtcgtttctcgcctcctgctccaacctccaatccctcaacctctcctccaacctcctccaattcggccccccgccccactggaagctccaccacctccgcttcgccgacttctcttacaacaagatttccggccccggcgtcgtttcttggcttctcaaccccgtcatcgaactcctctctctcaaaggcaacaaagtcaccggcgaaaccgacttctccggctcaatttctctccagtatttagacctttcttccaacaacttttctgttacgcttcctactttcggcgagtgttcttcgcttgagtatttggacctctccgctaacaagtacttgggcgacattgcacgcactctctccccttgcaagagcctcgtttaccttaacgtctccagcaaccagttctccggtccggttccttcccttccctccggttcgctacagtttgtgtaccttgctgcaaaccacttccacggccagattcctctctccctcgccgacctctgctccactctcctccagctcgatctctcctccaacaatctcaccggcgctcttcccggcgcgttcggcgcgtgcacttctcttcaatcccttgacatctccagcaacctcttcgccggcgcgttgccgatgtcggttctcacgcaaatgaccagcctgaaagagctcgcggttgcgttcaacggcttcctcggtgctctcccggagtctctgtcgaagctctccgctctggagttgctggatctgagctccaacaactttagcggctcaatccccgcctcgctgtgcggcggcggtgacgctgggattaataataatctgaaggaactttatctgcagaataaccggttcacgggttttattccgcccacgctcagcaactgttcaaacctcgttgctttggatttgagtttcaacttcctcacggggactattcctccgagcctagggtctctttcgaatctcaaagacttcatcatctggctcaaccagctccacggggagataccgcaggagctcatgtatcttaaaagcctcgagaatttgatcctggatttcaacgacttgactgggaacattccctctggcctcgttaactgcaccaagttgaactggatctccctctccaacaacaggctcagcggcgagattccgccgtggattgggaagctttctaatctcgccatactcaagctcagcaataactctttctccggccggattccgccggagctcggcgactgtactagtttaatatggttggatctgaatacaaatatgctcaccgggcccattccgccggagctgttcaagcagtcggggaagatcgccgtgaatttcatcagtgggaagacgtatgtgtatataaagaacgatgggagcaaggagtgccatggtgcggggaacttgcttgagtttgcggggatcagtcagcagcagctgaacaggatttcgacgaggaacccctgcaatttcactagggtttatggaggtaagttgcagccaacgtttaaccataatggttctatgatatttttggatatctcgcacaacatgttgtcagggagtattcccaaggagattggggccatgtactatttgtacattctcaatttgggtcacaataatgtgtctgggagcattcctcaagagcttgggaagatgaagaatctcaacattcttgatctgtcgaataatagactggagggccaaattccgcagagcctcacggggctttctttgctcactgagattgacttgtccaacaacttgcttaccgggacgattcctgagtcgggtcaatttgatactttccctgcggcgaagtttcagaacaactctggtctatgtggagttcctctgggtccgtgtggttcggagccggcaaacaatggaaatgcgcaacatatgaagtctcacaggaggcaggcttctctggcggggagtgtggccatggggttgttgttttccctcttttgcgtctttggtttgatcattattgccattgagaccaggaagaggaggaagaagaaggaggctgctcttgaagcctatggtgatggtaattcccattcgggtccggccaatgtgagctggaagcacaccagtactcgggaagctcttagcataaaccttgcaacatttgagaagccgctccggaagcttacttttgcggaccttcttgacgctaccaatggttttcacaacgacagtctcattggctctggcgggtttggggatgtgtacaaggctcagttgaaggatggaagtgttgtggctatcaagaagctgattcatgttagcggacaaggggacagggaattcaccgctgaaatggagactattgggaaaatcaagcacaggaaccttgttcccctgttgggatactgcaaggtaggggaagagaggctcttggtttatgagtacatgaaatatggaagtttagaggatgttctacatgatcagaagaaagctgggatcaagctgaactgggccattaggcggaaaattgctattggagctgctaggggattggcttttcttcaccacaattgtatcccccacatcattcatagagatatgaagtcgagcaatgtgttacttgatgaaaacctggaagccagagtctctgattttggaatggctaggcttatgagtgctatggatacacatttgagtgtgagcacattggctggcacaccggggtatgttcctcccgagtactatcagagcttcagatgctccacaaaaggtgatgtctacagttatggtgtggttttgttggagctgctaactgggaaaaggccaacggactcggctgattttggagataataatcttgttggatgggttaaacaacatgccaagctgaaaatcagtgatatttttgacccggagctcatgaaggaagaccccaatctggagatggagcttttgcagcacttgaagattgcggtttcctgtttggatgatcgaccgtggaggcgtccgacgatgattcaagtgatggcaatgttcaaggagattcaggcgggatccgggattgattctcagtcaaccatagccaatgacgaggaaggtttcaatgcagttgaaatggtggagatgagcattaaagaagcccctgaattgagcaagcattag

SEQ ID NO: 34649 - DNA, 295 bp, Glycine max
  Peptide Sequence Number=SeqID_151427
atggcggcgggaccggagaggttggtggattttaaggagagtgactggaggtggtccaggctaaggaggaagctggcgatgacggttaggttagtgctgagagggacggagctgaggtctatggatgtgagctctgtgtcgttgcagctgatgccgctgaatgtgcacgggctttggttagggagccagttggggagcagggatgggttcgggagagagtttttgaagcttaggacagatatggaaaccgacaagattaagggagagtttgtggttgtttctctcagaggctctg

SEQ ID NO: 34650 - DNA, 435 bp, Glycine max
  Peptide Sequence Number=SeqID_151428
atgatcacaattaccttgtcaaagaaagaattgggatacgtcatccacaggttgtttgatgacttataccaacctcctcttccagttgatcaagtaaaacctttaaatgaatatgatgaggaaggagaaggctcaccaaggatacgaggaagagggcgtggtcgtggaaggggcaggggtagaggattttacaatgggggtatggaatatggtgatggttgggatggtggacgtggctatggtggaagagggcgtggtcgtgcaagggggcatgcttttcggggacgaggacgaggacgaggctatggtgtgcagccagttggttactatgactatggtgaatatgatgctccacctccaccacgtggccgtggccgtggaaggggaagaggccgaggccgtggccggggaagggaccaggtaccagctgcttga

SEQ ID NO: 34651 - DNA, 531 bp, Glycine max
  Peptide Sequence Number=SeqID_151429
atgaagatatactattccacacagagagtgcaaaaacaaacacagcagttacgccctctttctctctcccacccatatccccaaaacctgcctctgtcatctatggataggtatcagagggtagagaagcccaaggcagagagccctataaacgagaacgagatacgcgttacttctcaaggaaggacgaggaattacatcacctacgccaccactctccttcaggtacaagagatgatacctacagtaacaacagttgagaaggaacaacaacagaagataaagagagaactcacccctgttgtagctaatggattggagaaaggatctagtgaaattgttctcaaagcaatgggacgtgcaataaataagactgtaatgattgctgaactgatcaagagaaggattgttggtctgcatcaaaacacccaaattggatcaactgatataactgacacatgggaaccactagaagaaggccttcttccgtatggatttttgtttcttctatgcaaccttatcaaatactaa

SEQ ID NO: 34652 - DNA, 422 bp, Glycine max
  Peptide Sequence Number=SeqID_151430
ttgaaactcacgttggaagagttaaggagaacagagaaggtggtggtgtggacttgaatttggggacaccagagccagttctctcagacaaaccaccaccaccaccatgtggtggtttgttgttgtctgtgggagaagcaagaaggtcagagaaagaagtggtcatgaaagggtgtgtggagaaggtgaagttggtgaaggagtttgcacttgcagaggtgtctaaactaccagaagaagatgccatgagaggggctttggtttctattgggggacgatatttctgggaaggtaagaaacgaaagggagaagctcgtgggtttgactggatggcggctcggctcgcactgagatttgcttctatgtttgtgtttctaactgctgctgctgggtgtagtctggaatctgctgcaaatgggtag

SEQ ID NO: 34653 - DNA, 144 bp, Glycine max
  Peptide Sequence Number=SeqID_151431
atggtggtcgttaactcgttattgccattaggtgaaagttgggccatcattcggcgtttgcattttcaacgcgggaacagtggaaaaggtgagaagaacgaagaaattaggaacgaatacggaatactagggaaaaaagattga

SEQ ID NO: 34654 - DNA, 165 bp, Glycine max
  misc_feature (121)..(121): n is a, c, g, or t
  Peptide Sequence Number=SeqID_151432
atggaaacaattatccagaatccacaattgaattatgccaaattctatgctgttactgagcttattcctcaaccacaaccatcgtctccacaaccctcatgtccacaactacaactaccgnctccaaaacagttaccgtacaacaacatagacctcaataatcca

SEQ ID NO: 34655 - DNA, 786 bp, Glycine max
  Peptide Sequence Number=SeqID_151433
atggttggaacttttactatcagactctctgactattgctactttattgtgttgattacagatcgtggtgaagtgcagaagggaagtgcagagatattttttcgcaaagtaaagttttgggaagacggaggactgcaggaggcaccacctgtctttgtaggtattatctttctgaatcaggcagagcatattataatgtgctttaagcttgaaagaaatgtggatggtgtaaattactttcatgtgaaagttgttggcttattgtttgttgcaactacaagggttaatacatcaccttcttttgtcttggagcttttacaaagaattgctcgagttattaaggattaccttgggattctcaatgaagactcattacggaaaaactttgtgcttgtgtacgaattacttgatgaagttattttaatattagtagccgctgatagattgaaccgatatgtttacaatatttttcgggtagtgtacaagaaaaagtacaaaccgccaaaagttctggattttggttatgttcaaacaacatctactgaattgttgaagtcctatgttttcaatgagccgcttgtaattgatgctgcacatctgtcacctcttggacctgctgcaatttttacgcaaggaacaaaaagaatgccagggatagctgtcacaaaatctgttgttgctacagagcctgggggtagaaagagggaagagatttttgtagacataattgagaaaatcagcatcacttttagctccagtgttagtaaatacatcttaaaatattga

SEQ ID NO: 34656 - DNA, 247 bp, Glycine max
  Peptide Sequence Number=SeqID_151434
tactctaggtagtctcatgtatgctcaagtatgcactagacttgatattgctttcatagttgtcgttcttggtagataccagtcaaaccctgggagtgatcattggataactgctaagaaggtgatgaggtacttgcagaagactaagaagtatatgcttatgtatagtagagttgacaacttggaggttgtaggatacacaaatttagatcttggtgggtgccctgatgataagatcgacttctag

SEQ ID NO: 34657 - DNA, 783 bp, Glycine max
  Peptide Sequence Number=SeqID_151435
atggtcaatgttgctggtgatgggtttggttgccaaatgatatttttgggagaaaaaaataaaaagggagataggaattgggccaaaaaccccaatgacaagaacaggcctagcagggagaacgccgggaatttagaagcggccatagaacaattgctgaatgcggagaagcaagcgaggctcgccggcgacgtcgccgccaccagaaacgccgtcactgaaattttacggatgtgcttcgaagcgcgtgcctggaaaaccctcaatgaccagattgttctcttgtccaaacgccgtggccagcttaagcaggctgtgacagcaatggtccagcaggctatgcaatatattgatgagacaccagatcttgaaactcgtatagaactcatcaaaatcttgaacagtgtatctgcaggaaagatatacgttgagattgagagagctcggttgatcaagaaacttgcaaaaatcaaggaagaacaaggacttatagctgaagctgctgatttgatgcaagaaattgcggtggaaacttttggtgccatggctaaaactgagaaaatcgcattcattcttgaacaagttcgtttgtgtctagaccgccaggattatgttcgtgcacaaatactctcaagaaagattagtacgagagtgtttgatgctgatgtttcaaaggaaaagaaaaagcctaaagaaggtgataatgttgttgaagaagctcctgttgatataccatctctaccggagttgaagcgaatctactatgaactaatgattcggtaa

SEQ ID NO: 34658 - DNA, 774 bp, Glycine max
  Peptide Sequence Number=SeqID_151436
atgatgaacaaccctgcattattgtcaaggctgtttccgggtatcaatagggagagggagatgtctgccatggtctcagctttgacccacgttgtctccggagaggttccaaccggtgattcttcttcagttcttcatcatcaacctcatgatgatgatgctgttactgttaaaccaaacatgccttctacaacacccttttcatctacttatgttgttgccacctcttctctcaagagaagtagacaacatgatacatatacaccatccttctcacatccaccttcatcattccctgctatgccaacaagtgcagaatgttcaaagagtggaatgggaaatgctgtgtacgaatacagaacaagaggaacagagaatgtaaagaaggaggagggaaggagaaaatatagaggggaaacatttgagacggcagaggcagcagctagagcctacgatgaagctgcccttcgttttaggggcagcaaggccaaactcaacttccccgagaatgtcactctccgacaacctcaattcactgtttccacatcaacagacccatttcaactctcgggtaccaacctttatgatcataggatgtttctgacttctaataccatggcttctcatcatcttcaatcttctttgccgctgccaccagcaacctcctcttctctaacttctcctcctcagaacatcacttcactttcttccttgtattctgcccagttgcccccatggtcggcctctggtcatagctcttcttcctccccatga

SEQ ID NO: 34659 - DNA, 159 bp, Glycine max
  Peptide Sequence Number=SeqID_151437
atggcttcttcacaaaacaagcgcattctatttgtggctttcgtcatcctctgcctcttctcctccccaactatagctgcacgaacattgaaagaaaaaagtaacctaactagcggggatgtcaacacagttcaacataataaggaagcgattgctaag

SEQ ID NO: 34660 - DNA, 336 bp, Glycine max
  Peptide Sequence Number=SeqID_151438
atggagaaaagcgaatccttctcttcctattgttccagttcctatcacgacttcagggctgggttggaggatcaattcacatcttacagcttcaacagtggtccaagaagcagcaagagagatgttctggcccctaatggtaacccagagctcaaaaggaggaaaagggtagcatcctataacatgtacaccatggaagctaagctcaaatcctcctttcgcagctttaaatggatcaaaaacaagctttgtagacgactaataccactattgtgcgtagaagaagcatgcgataataaaagaattgttgttttaccgaaaaacaattgcgcgtaa

SEQ ID NO: 34661 - DNA, 117 bp, Glycine max
  Peptide Sequence Number=SeqID_151439
atggcaaaaataccattgaggcatttcaccgagcacttggtgggcgcactttcgggtaccaacaacaagggaatgggggcaatgtggcttgccccatcatctcagaacacaacctag

SEQ ID NO: 34662 - DNA, 1800 bp, Glycine max
  Peptide Sequence Number=SeqID_151440
atgtatatggcatatgggtggcctcaggtcatccctctggagcaaggactgtgtccctctgcacagaagattgtgtacctcaaagtcatcaatcgcacgttgctcgttgtctcccccactcactttgaactctggagcacttcccagcatagagtgagattggggaagtacaagagagattcagattcattgcagagggaaggagaaaacttgcaggccgtgtggagccctgatgccaaattaatcgctattcttacatctgcgttctttcttcacattttcaaggtccagctatcagataaaagaatacacactggtgggaaacaaccctctgctttgtgcctagctactatttctcttctgcttacagagcaagttccttttacagcaaaggatttgtcagtgagcaatattgttagtgataacaaacatatgctacttggactttctgatggaactttatacagtatgtcttggaaaggggagttctatggggcttttcaattttatccacaacctactgctagctttgacaattctcaaatgccacttactctagagaatggtctttctcctaaaagtcacccaaaggttcttatgtccaatcacattattcctagaaagtctgaaatcaaccaactggagctttgccttccattgaggttcctatttgtcttgtattctgacggggaacttgtctcatgttctgtgagtaaaaaaggcctaaagcaagttgactgtatcaaagcagaaaagagattggcttgtggtgatgctgtctgtgcttcagtagctctagagcagcaaattcttgctgttggtaccaaaagaggaatagtggagttgtatgatttggctgaatcagtatcacttatacgtgcagtctctttgtatgactggggatattcaatggatgacactggccctgttagtttcattgcttggacacctgataattccgcttttgcagttgggtggaagttaagggggcttacagtttggtctgtttctgggtgtcgcttgatgtcaacaatccgacaaataggtttaagttctgtgtcttctccaatatctaagccaaaccatgattgtaagtatgaaccattgatgggtggtacctcactgatgcagtgggatgaatatggatatagactttatgctattgaggtggggtcttcagagagaattctatcgttctcatttgggaaatgctgtcttagcagaggtgtttcaggcactacatacatccggcaagtgatttatggggaagaccgtttactcattgtgcagtcagaagagactgatgaactcaaaatgctacatcttaagcttccagtttcttatatttcccaaaactggcctgttcaacatgtggcagctagccaggatggcatgtacttagctgttgctggtcttcatggtttgatattgtatgatatacgattgaaaagatggagagtatttggagatgttactcaggagcaaaagattcagtgtaaagcattctgcactgccatttcgttctacatccatggtctcttaggtctccttgttttatctcagttatttggtgaattaactccttcaggaaatccagatttacagctttctgcagtacgagaactttcaattatgactgccaagagccatcctgcagcaatgcgattcattcctgatcaacttccaagagaatctatttcaaacaatttggttttgtcagattcattaacaagagagccagcaaggtattctccttgtgaacagcttcacttgctccaatttgttttgccatttctctaa

SEQ ID NO: 34663 - DNA, 351 bp, Glycine max
  Peptide Sequence Number=SeqID_151441
atgtatatgccccaccttggagctacaaatagggacaaaattgaggaagctttaaggctggcagagctatcagctgagaagcctcatttttcacattgtctagagtggcttctttttacagtatttgaagcagatatatccaggccaaatgtgaacaagaaccagatctcagttgttaaacatgctaaaaggtctcttttagagaagacctgtgacctgatcaggaattttccggagtaccttgatgttgttgtaagtgttgcaagaaaaactgatggtcgtcattgggcagatttgttcactgctgctggaagatcaacagagtatgtccttcaagcatctatgctttga

SEQ ID NO: 34664 - DNA, 537 bp, Glycine max
  Peptide Sequence Number=SeqID_151442
gcaacacttgatgaatcattgtacgagcttgctggggagctggtgcggttcttgctaagatctggtagggaatatgaccaagcatcaaacgattcagataaactgtctccaagatttttaggctattttctttttcgttctagtgagcagaagcaatcattggataaaagcacctcattcaaagaacaaagttctcatgttacctctgttaagaatattttagaaaaccatgctagttacctgatgtctgggaaagagctctccaagcttgttgcatttgtaaaaggaactcagtttgatttagtggagtatctacaacgtgaaagatatggaagtgctcggttggagaattttgcttctgggcttgaactaataagccaaaagcttcaaatgggaacattacagagccgtttggatgctgactttctcctatctcatatgtgctctgtcaagtttaaggaatggatagttgtcctggctactctcttaagacgttctgaggtatgtttggcttctgtgtacatgacagagatctga

SEQ ID NO: 34665 - DNA, 774 bp, Glycine max
  Peptide Sequence Number=SeqID_151443
atggatgtagaagcggtgaaaaggtctccttctcaagaaaaatatggcagggttcaatctgcaataaggttgttagtgctggttgtgtttctgggttggattttcgtatggatagtgactccaacaaacacttaccaacaaaaatggcagcctcggcttcaagcaaagactaattctatttttggtgcacaaggtgcaatgcttctggtatacacttttccaatcttgttcatagctgttttgggatgtgtgtacgttcacatagccaaaaaaggaaacggtttcggcaaggaaagtagttatggcaagaaacgtgaggtatctatatggaagcgtttggtgcttgtgagaggccctcttggcatagtttctggaacagaaatggtcttcttgttaatgttcattgttctcctagtttggtccttttcaatctatctgcataatggctttgccaaaatcacccacaaatcagcagcagaacacggtctaaaagtctgggagaagaaactagatattgcatctgtgaggttggccctagttgggaacatatgcttggcattcctgtttttcccggttgctcgtggttcctcagtgctacctctgcttggactcacaccagagagttgcatcaaataccatatttggctaggaaacgtggccatgacccttttcactgctcatggtatttgtttcatcatctattggacagttaccgataaactttcaaaggttcttaaaaatccctactactatctctcttttggtgcattatga

SEQ ID NO: 34666 - DNA, 936 bp, Glycine max
  Peptide Sequence Number=SeqID_151444
atgacaaacaaaagggtatttagccttctagatttgacttataatcccacaagtattatgttcataaatgtaccaagtatatccaaacttcagtggcatccatttaccattacttctaatagtaatttggagccaaaaatgatgagtattgtcattaaaggtgaaggaacttggtcccagaagctctaccagatgctttcaaccccttctgcaattgatcatctcaatgtctcagttgaaggtccctatggaccagcatcaaccaattatctaaggtatgacactattgtgatggttagtggagggagtggaatcaccccttttatatccatcatccgggagctattgtatttgaacacaacattcagatatagaaccccaaaagttatcctaatttgtgcattcaagaactcttactatctctcaatgctagacctcatccttccaaattctggcaccccctatgatatgtccaacatgcaactacaaattaaggcttacatcacaagaaaggaggagcatagattggaaaaccaaattcaccttcaacaaatatggttcaaacccaaggcaacagatgcacccatatcagctattttagctagtgcagctgttctttggaacaagaaatacaacgacagagaagcaaaacagattcagaacttagaaggatcatcatcagcagaatccccaaagttgaatactgatgaaggagataaagaactggaaagcctcccacagcaatcccttgttcaagctacaaaggtgcattatggagcaagacctgatctaagaagactgctattggaacttgaagggtcaagagtgggagtttttgtttctggacccaagaaaatgaggcaagaggttgctgccatttgctcatctgatttaggagaaaatctgcattttgaatcctttagctttaactggtag

SEQ ID NO: 34667 - DNA, 210 bp, Glycine max
  Peptide Sequence Number=SeqID_151445
atggtaccgatcaaccaagaagaggtagaaaccggggagaatagtgcatgcatagaaaatgcccacgtgaaagatgaagaagacaatgaagagggtgtagaggtagtgagtgtagaagaagagctcaaaaacttttcgcctattgcgagggatggttgcaatccacatgcacaaaccagcaagcaaagcaacctctccagctacatttga

SEQ ID NO: 34668 - DNA, 291 bp, Glycine max
  Peptide Sequence Number=SeqID_151446
atggcaagtattccggctgaaagggcgcgtgttgaacggaaaactggtataatctacccggcgataccaattaagaaaggttctggccggaagttgagcaagaaaagcaagtatcacttgtctgatggagaggagaatgactttgagggaattgattctcttggaagagatgattttgaggatgagatgcttcctgatgatattgatgctgagactgatgagaaattagatttggttcaacggagcatgcagattccgggggaaactagtgcggatgatggggaggaaaat

SEQ ID NO: 34669 - DNA, 813 bp, Glycine max
  Peptide Sequence Number=SeqID_151447
atgtatctaatatataaaataccggaatttagacagtctcgaaaattctgtcctgaagcaataatatttcttcgaacttcgctgttggcagctactgaaagtaaacatgtttcagatgaagattcccagttatatcatcttatggaactgaaagctatcaaacctctcctatgcattcaggagacagtgaatgagattagtcctctgaatttcttcaaaataatagacatgccagaagactcttctttcttcacttctgttagtttcagggctagtgtattagttgcagttgttgaaactttacaaggatatgtcaacgtctatgaaggtttaagttcatttcctgaaatgttcctaccaatttttaaattattaaatgagatagcagaacaaaaaaatatgccaaatgtattacgagataaaattaaagatgtggctgagctcattaagttgaaagtggatgagcatcacactttgaggcgaccacttcaaatgcggaaacaaaagcctgtaccaatcaaattactgaatcccaagtttgaggagaactatgtcaagggtagagactatgatcctgatcgtgaacaagctgaactgagaaaattgaagaaacagttgaagtgtgaagctaaaggggctgcacgagaattgcgtaaagacaactacttcttgctggaggtgaaggaaaaagagaggtctttacaggaaaaagatagagcagagaagtatggaagagctaaagctttccttcaagagcaagaacatgcctttaaatcaggacaattaggaaaagggagaaaaaggaggagataa

SEQ ID NO: 34670 - DNA, 906 bp, Glycine max
  Peptide Sequence Number=SeqID_151448
agacataaaagcaagaaggaagtgatggaggaaattatctcaaaaagcaagttttacaaggtgtgggatatttctgtaatcaaggctatggctcaaaaggcaaaggataaagaagaaaatgaaaacttggtggaagaattggataaggatttcacttccttggttcagtctgaagccttgttatctttgactgaacccaacaagatgaatgctttgaaggctctggtgaacaaaagtatttcaaatgatcaaagtaataaggaccagatgtctgctactcggacaatggataattctgtgcaggaaaaacctgatgattatgacaaacttgtcaaacaaatggggttggaaatgcgtgctcgcccttcagataggacaaagacaccagaggagattgctcaggaggaaaaagaaggtctagagcaattggaggaagagcggcagaagaggatggttgcggctgaagattcaagtgatgaagacaatgaagattcagaaaagccatttgaacagaaaccaagatctatatctggtgatgatcttggtgattccttttctgttaatgaacaaattatgaccaagaagggttgggttgatgagattcttgaaagaagagatgaggaagattcttctagtgaagatgatgatggtgaagatcctgacaatttgggaagctctgaagatgctgatgaaggatcagatgaagatcttgatgaacacgagaaggatctttctttaaaagattgggaacaaagtgatgatgatgatattggtgcagatttagaagatgaagatgatagtgatgagaatatagaaacagctgcagaagaccttgatgaggtaaaaggatcggatgctgcagttcatataaaaaagcaaaaagaaatgcttctgttgaaagtgtag

SEQ ID NO: 34671 - DNA, 513 bp, Glycine max
  Peptide Sequence Number=SeqID_151449
atggaaagtagtatagttgatgcttcggctgtttcaagaaaacgtagaagagatgaagaggaggaagaagaacttgaacaagtattttttattattgttagtgttgtcactatgcttttgggtgcactgacttggtatcatgacaagtactttgttaagaaacctgtccaaaatttggaattagaaaggcatagtttcctcaatcgattcaaagtcattcctaattgggatgatattgttgacctatgtgtaaaggatagagctactggactcggagcagaaaatgcattagatgcagatgatatcatgagcaaagaaacaaatgaagaggaagcaattcatagtgtgagttttgacttagagggatcaagttctgccatgagaaaaaacattcgtccaagtaagagtgaagagaaagaagggatgatttcctcaatgaaagaagtagccgagtcattgaaagaatttgttgaagtgactaagaagatggagaacaaaaaaagatggagataa

SEQ ID NO: 34672 - DNA, 522 bp, Glycine max
  Peptide Sequence Number=SeqID_151450
atgcataggtggtggtccaaggaaactgttgctgtggttacaggtggaaacagaggaattgggtttgagatatgtaggcaacttgctggtcatggagtgactgttgtactgacttcaagagatgaaagtgttggtgttgaatcagctaaggtcttgcaagaaggtggcttcacggaggtggcttgtcatcaacttgacatattggatccttcatccatcaaccaatttgctgaatggttgaaagaaaattatggtggtttagacattctgttccatgtcaattggccatttctaaaagcaaagttccaagtacttatgatttggatgttgctacttggctacttggcttccatgaaccctttggatgtaattcaaacaagggacggaggttacttggcttccatgaaccctttggatgttgctatggctagaaaagaagctccaaagctagctatgcagatgtcaaggccttttgtgttggcatcataccaatccttgacagggttcaagttgtatttataa

SEQ ID NO: 34673 - DNA, 282 bp, Glycine max
  Peptide Sequence Number=SeqID_151451
atggtatggatacctaggataactccaccacagattctcccgaaaacctccgcacttgttcagctgtcggcggtggtttctggtgattgcatcggaaaggaagaagaaaaagaaggtgattgtgttaggatttcgataggttctctctcgctccttcattcttgcaaagtttctcactcttctctctctcttggaacaatttctccctctgcattattccgaaaaaggtgccggtcacaagcaaggtcagttctcgcctccaccaatgcacttttcaaatag

SEQ ID NO: 34674 - DNA, 141 bp, Glycine max
  Peptide Sequence Number=SeqID_151452
atggatgaatatcaacagaactggaaggaaatgtttaacacaatgaagaagattaacaaaaaagttgagaaaatgttcaaccctgttcatgttatggatcagcctttcagtgaagtcagtaggtcatttgttgtaagatga

SEQ ID NO: 34675 - DNA, 876 bp, Glycine max
  Peptide Sequence Number=SeqID_151453
ggacagaaaatgcatccttctatgtatgatgatcgtgttggggcaatgtacaatcttagacagaggttgaaatgtgacaagagagttttattgggaaaaactacatctggaggagtctccttagcttcatctggaggaacacatgtggatttggagaggaccccaagttctcatgctgaagatcgtgctgagaaattgttacctgactccggtactgctcactcaagccttgatagatgtgccagagtgcacatccctttggggccaaaccatcaagctgaagtgccagaatggactgtcataacttatgaggttgattcaaagtggttggggacccaaatatggcctccaaaaactgtaaattccaaatgtcgtctttttgaaagggaccccattggagagggaagacaaaattcatgtggctgccaagtacaaggttctgttgagtgtgtccggttccacattgctaagagaagggctaaagttaagttggaattgggtgaggcgtttcaccaatggaatttacataaggtaggtgaagaagttgggggttcatggacagagcaagaagagaagaagttcaaagatgtggtgaaatcaaaccctgcttcacttgataaatgtttttgggatcatcttttcaaaacatttcctaagaagagcagagaagatttagtcagctactatttcaatgtctttcttttgcagcgcagagcatatcagaataggcatactcctgataacattgacagtgatgatgatgaatcagaattcacaccattgaggaaagtttttggacatcaaacaccaaaacctcgcagcttcaccttgttatcccccaaaaaagccacattcaaaagggaaaataacaagtga

SEQ ID NO: 34676 - DNA, 144 bp, Glycine max
  Peptide Sequence Number=SeqID_151454
atggctgtcactgccactgtcaatagcagttatgctgtcggtaacaatcataatggtgattgcaggatagtcatggtgttgataattataacaacgagaaaggagaatgatcttcttatgaaaattattaatctcaatcattag

SEQ ID NO: 34677 - DNA, 315 bp, Glycine max
  Peptide Sequence Number=SeqID_151455
atgagtcttcattcttcatctagtgttaatggaaggcataggtcacatcttagacctcactaccatgggagacaaaaggaaagaaagcctcaagaggctaacattaacctcccatacttccatgggaaggacaatgtagaggttaacttagattgggaaataagggcagagcaacaacttaaaaggaagactactttaaaattttatggctctcactcttattcaaagatagaccaaggtcaaggcatcttaggggtgacaccttctaagcccaaagatgataaggggaagacaatagaaaagcaacccccttaa

SEQ ID NO: 34678 - DNA, 451 bp, Glycine max
  Peptide Sequence Number=SeqID_151456
ttgtgtccgatggcaagcagagaccaagtttggtcattctgcacccaagatacgcggagataccttacggttatccgcacccctttgccatccagaggcgttgtgtccgatggcaagcagagaccaaagactaagtttggtcattctgcacccaagatacgcggagataccttacggttatctgcacccctttgctaggcagacacagttgtgtccgatggcaagcagagaccaaagaccaagtttggtcattctgcacccaagatacgcggagataccttacggttatctgcacccctttgctaggcagacacagttgtgtccgatggcaagcagagaccaaagaccaagtttggtcattctgcacccaagatacgcggagataccttacggttatctgcacccctttgctaggcagacacagttgtgtccgatggcaagcagagaccaa

SEQ ID NO: 34679 - DNA, 1185 bp, Glycine max
  Peptide Sequence Number=SeqID_151457
atggcaagtgcactagagactttatgtgggcaagcatttggtgctggacaagtagaaatgataggggtctacatgcaacgttcttggttaatcttattgggtgcatgcatctgcctcacaccaatttacatttatgctgagccaatcttgctactcctaggacaagaacccgaaattgcagaattagctggggcatttaccattcaatccatccctcagatgttttctctagccatcaatttccccactcaaaagttcttgcaggcacaaaccaaagtggggtttctggcatggcttggttttggagcatttatttttcatgttatacttctatggattttacttaaagtgttttcattgggtacaactggtgctgctgtagcctattgcacaacagcttggattattgctttggctcaaacggcttatgtgattggttggtgcaaggatgggtggagaggcttctcatggttagcattcaaagatctttgggcctttgtgaaattgtctgttgcttcagcagtcatgctttgcctagagatttggtatttcatgatcttgattgtgctcactggacaccttgacaatgcagttattgctgttggttctctttcaatatgcatgactatcaatggatttgaaggcatgttatttatagggatcaatgcagcaattagtgtgagggtttcaaatgagcttggatcaggacgcccaagagcagcaaaatattcagtcattgtcacaattattgagtccctcatcattgggttaattagtgcagccattattttagctacaaaagatcattttgccatcattttcactgagagtaaagagatgataaaagcagtttctaaattagcaggtcttcttggcataaccatgattctgaatagtgttcagccagttatatcaggtgttgctgtaggaggagggtggcaagctttggtagcttacatcaatctattttgctattacatcatggggctccctcttggcttccttttaggttacaagttgggttacagagtggagggtatttgggttggaatgatctgtgggacaatgttgcaaacgctcatcttgttgtacattgtctataaaacaaactggaacaaggaggttgagcaagcatcagaacgaatgcggaaatggaccggacaagaaattgaaattaatttgtaa

SEQ ID NO: 34680 - DNA, 291 bp, Glycine max
  Peptide Sequence Number=SeqID_151458
atggtggttcttctacagagttcccacctctcgcatgattccttttcaccgcaacacaaagcctactccctctctatctcccttgatacaaaaccttctacctatacccaagccatcaaacatcagcattggattcataccatgaatgctgagttgcaagccttagaagctaatggaacatgggtgatcatagaaaaacctgcggctgtgatcccaattggtagcaagtgggtttacataatcaaaagacagatcgctctattgaaaggtataatacaatcaggcacttaa

SEQ ID NO: 34681 - DNA, 348 bp, Glycine max
  Peptide Sequence Number=SeqID_151459
atgcagcatagaaaattgacttctggaaggccttctggaactgatggctctgattactcctaccgtatggtagttgattcaaggtatcaactggttgcaaaggggaagaaatacctgtctctgcactttatcactgaggctgtgttgctgttaataggagcaacacttgcatatttaccaggaatagaagcagatgctccaaatacagttgcctattcatctgttattgtcgaagacgaagccggtccgcatttgcttctgaaggtaaatatgtcagtgtttgacaggagattttataagaaaaacttcattaactatcaagatagaaacacgacagccaagaaataa

SEQ ID NO: 34682 - DNA, 203 bp, Glycine max
  Peptide Sequence Number=SeqID_151460
ttcgtctttgtcgcaaactggcatgcgcttccgtgactgcaaccacattgtggagttcgtgtttgtgaagttcgtctctgccacttatcgattgaggtcgaagaaatctaggaaaggaaagagtcccggaaaggttcgtgtctgcgacttatcgattgagtccattgtggttggctttaagcctcctagggaagccatcgaag

SEQ ID NO: 34683 - DNA, 1602 bp, Glycine max
  Peptide Sequence Number=SeqID_151461
atggatagctacttgcttcagaattttaaacaactaaaaatctggaatttcaatttccttctaaaaggtgagaaattgaaattctcttcttacagtcttcttcaagaaacaccgtctgagtttgtggaatatcgatcgggtacatttgtaaggagaggttcaaccccctttgagtcatattatttaccagttgttggaggagcatcgtatgattctgccaatttccctctcgagccacttttagacgactcatcatacagtggagaacctgataacatttggacttactttcttctgaacattcctcgtggtgcagctggaggaaatattcacatacagctatcctcagatatgaagatcagttatgaagtgtatgctagatttggtggattaccatctcttgatagctgggactattattatgctaacaagacaaggaggagtgatccatctatgtttttcacactatatgactcaagtgataacaaagttaatttttatattatgtatgctagagaaggaacttggggtattggtctaagacatcttaataccagcagtgattccatgaaagggcttactatcatgtctatttcacttgagcgatgcccaaaacgatgctcctctcatggagaatgtaaattttcttttgatgctagtggattgacatcgtacagacatgaaccaagaaagtcctcggcgaagactttcttggttctagacaccttggtaatgattgagacacatggcaaaaaaatcgaatgccgtattgtggacttttctggttgcatcttctgctcttgtgatcgaaaccatggaggcttcgactgtagcattgagattgtaacacatcaaggacatgtacggcaatcaatttttctcattgtatcaaatgctgcagccatacttcctgcctactgggcccttcggaagaaggcattagcagaatgggttttatacacatccagtgggatttcaagtggactatatcatgcgtgtgatgtaggaacctggtgtgcattgaactataatgtcttacagttcatggacttctggctctctttcatggctgtgattagcactttcctttatctagctaccattgatgaagtacttaagagagcaatccacacagctgttgctatccttactgccctaatggctgcaacaaaagcaaccaggtcttccaatgttattcttgtaattgtgattggtgctcttggtttgtttattggatggttgatagaaatctcaacaaagtataggtccctttccttttcaattggaatctcatttaatttctctcactgtttccaaactataaagcagtggctctataatcttgtcaagacacttttgagacggtaccactgggcatttgccttggctggttttcttgcattggccatggcagcaataagctggacacttgaaaccagtgaaacctactggttttggcatagcatttggcatattacaatatacacatcttctttcttcttcctttgttcaaaagcaaatattgaggatactgagaatcagcttcctacaaatggaaactatgaattgactcatcaggattcacttccaagaactggttag

SEQ ID NO: 34684 - DNA, 792 bp, Glycine max
  Peptide Sequence Number=SeqID_151462
atgtcaatcacaacaggaatatgtcaagtagttgctgtttcattgcttttgggattactgagtgtgtattccttggaatgtgatgatgatcgctgcaaaactgggctgtgcaacaacactggtgcctgcatttgcaacctccctgatccttccaccatcttgaatggtgatagaactttcttcggggggaagttttgtgacgaagaaatgaccatgtgtgatgggacaaactccttctggtgtgaacatggggcaacttgtgaggagattgttcaaggagagaagtactcttgcaaatgtcccctaggatttgctggggagcattgtgagcattctggagcaccctgtggtcatactttttgtttccataatgctgaatgcttggctgaaacaggtgatgtttgccagtgcccttctgaatggaaaggcagtgctgattgctctcttccaaccacaccaacagatttttactcaatttcaactgacacaaaatcatctaaagtcagcagcagcagtgactccaataaggcactggctgtcttggcagtttcttcagtgggaggagctgctgctggtgccatttatggcaagaaactattcaacaagaaaaaaagagaggcaaggttccagcaattatctgaaatgcagactcaagggatattggatggtgatggtgatgaggaggatgaaaaccacaatatgtgggcactggtgaaggtgaaacctttactgtttcaagcttcagataccctgcgactaggctcaggccctttgatttgcgctatatcagag

SEQ ID NO: 34685 - DNA, 363 bp, Glycine max
  Peptide Sequence Number=SeqID_151463
atgaattgcgttttcgttcatgcgtcctccacccacgagtttggagccatgcgtagtgattgcttagtgcaattctccattctcaacccttttttggtgctcatgaattgcgttttcgtttatgtgtcctccattctcgagtttggagccatgcgtagtgattacttagtgcaattatccattctcaatctttttcggagccccatgaattgcattttcggtcatgtgtcctccacccacgagtttggagccatgcgtagtgattgcttagtgcaattctccattctcaaccatttttcggagccccatgaattgcgttttcgttcatgggtcctccaccttcgagtttggagccatgcgtag

SEQ ID NO: 34686 - DNA, 562 bp, Glycine max
  Peptide Sequence Number=SeqID_151464
ggcgcaggagatgacattaatctctgcgtgctatcaggctttcatattacagatagcaaaaaggtttatacggataaccactcgggtatttcctcccgtcagcatgactcaaaagtcagtatgacagatcttgtgagcgcggaagatgacgttaatctccgcgtacagcaaaaagtttatacgaataaccactcgggtatttccgcccgtcagcgtgactcaaaagtcagtatgacagatcttgtgagcgcggaagatgacggcgcagaagacgacgttagtctctgcgtgctatcaggcttttcgtcttacagacagcaaaaagtttatacggataaccactcgggtatttccgcccgtcagcgtgtctcaaaagtcaatatgacagatcttgtgagcgcggaagatgacggcgcagaagacgacgttagtctctgcgtgctatcaggcttttcgtcttacagacagcaaaaagtttatacggataaccactcgggtatttccgcccgtcagcgtgactcaaaagtcagtatgacatatcttgtgagcgcggaagatggac

SEQ ID NO: 34687 - DNA, 333 bp, Glycine max
  Peptide Sequence Number=SeqID_151465
atggcattcaagcacttccgggaaagacttgatgctgttgatgaagtggttggtggtgtcctcgtcctgcccgcgcagccagacccgcacgaacaccgtgaagccacggcccaccttggcctcattcagcagggcaacgtagcggtcgatgtagccgccctcctccagcagccgtacccgccgcaggcaggccgacggcgacagcccgaccagccgggccagctccaggttctgcaggcggccgtcgcgctgcagggcgtcgaggatgcgccgatcgaggttgtcgagttgatactgcatgcaatttcgccctggacgccttcagccgcatga

SEQ ID NO: 34688 - DNA, 1085 bp, Glycine max
  Peptide Sequence Number=SeqID_151466
tcctcaccttcagacgactacacatcctcgccttcagagggctacatgccctcacgttcagagggctacacgccctcaccttcagagggctacacgccctcgcctttagaggactacacgttctcaccttcagagggctacatgccctcatcttcagagtactacacgtcctcaccttcagaggactacacgtcctcgccttcagagggctacacgccttccttttcataggactacacgccctccctttgagaggactacacatgctcgccttcagagggctacatgcgctcgcgtttagagggctacatgccctcaccttcagagggctccatgccctcagggctacacgccctcaccttcaaaagactacacgtcctcgccttcagagggctacacgccctcacaagcagaggactacacgtccttcccttcagaggactacacgtcctttccttcagagggttgcacgccctcgccttcagaggactacatgtccccccttgagaggactatacgtcctcaccttccaaggactacacgtccttgccttcagagggctacacgctctctttttcaaaggactatacgccttcgccttcagagggctacacgccctccatttcagaggactacaagtcctcgtccttagagggctacatgccctcgcgttcagagggcaacattccctcgcctttagaggactacatgtcctcaccttcagagggctacttgccctccccttcagaggactacatgttctggcctccataggactacacgccctcaccattagaggaccacatggcctcgtcttcagaggactacacgtcctcaccttaagaggactacccttcctatcctttagagggttgcacgccctcgccttaagaggactacacgtcctcaccttcaatggactgcacgccctccctttcggaggacaacacgtcctcacctttagagggccacacgccctccccttcacaggactacatgtcttggcctccatagggctacacaccctcaccatcagagggctacacgtcctcaccattcagaggactacacatcctcgcctttag

SEQ ID NO: 34689 - DNA, 300 bp, Glycine max
  Peptide Sequence Number=SeqID_151467
atgctgattgaaagagttaggttcaggattgacattataattcaagggctgaccattcttgctccagttgactctccaaacactgatggaatagatccagatgctatatgtgagctaaatctctgttcaaatattaggcgactcatgtttaagaaagaatttgacacaagctatgtgggattcaattctggatcagagcttctctctcgtcagaatttatgtaatgcgtaccttgacttcaaaatacatgtcatcttgctaccttctatatggctgctctgtgccactatatggaattga

SEQ ID NO: 34690 - DNA, 760 bp, Glycine max
  Peptide Sequence Number=SeqID_151468
gactacacgtcctcaccttgagagggctacacgccctcgccatcagaggactacacgtcctcgccttcagaggactacacgtcctcaccttcagaggaattcacgtcctcaccttcagaggactacacgtcctcgcattcagagggctgtacgacctcgccaacagagggcaacacgccctaacctttagaggactacacgcccttaccttcagagcactacacgccctcaccttcagaggactacacgtcctccccatcagagagctacacgcgctcacccttagaggacaacacgtcctcaccatcagaggactacacgtcctcgccttcagaggactacacgtcctcgcctttagaggactacacatcctcgccatcagagggctaaacgccctcacctttagaggactacacgtcctcgccatcagaggactacaatccacacctttagaggactacacagggctgcacgccctcaccttcagaggacttcacgtcctcgccatcagagggcagtacgccctcaccttcagaggactacacgtcctcgccatcagagggctacacgccctcacccttagaggactacatgtcctcgccatcagaggactacacgtcctcgccatcagaggactacacgtcctcgccatcagagggctaaacgccctcacctttagagcactacacgtcctcgccatcagaggactacaatctacacctttagaggactacatgtcctcgccattagaggactacac

SEQ ID NO: 34691 - DNA, 963 bp, Glycine max
  Peptide Sequence Number=SeqID_151469
atggcaaaacctatatctaaaaagggttcgcgtaaaaatgtacgtattggttcgcgtaagcatactcgtaaaataccaaagggagttattcatgttcaagctagtttcaacaatactattgtaactgttacagatgtacgaggtcgggtgatttcttggtcctccgccggtacttgcggattcaaaggtacacgaagggggacaccttttgccgctcaaactgcagcaggaaatgctattcgaacagtatcggatcaaggcatgcaacgagcagaagtcatgataaaaggtcctggtctcggaagagatgcggcattaagagctattcgtagaagtgagaaaataagagtatctactcggacactacaatggaaatgtgttgaatcaagaatagacagtaaacgtctttattatggacgctttattctgtctccacttatgaaaggtcaagccgatacaataggcattgcaatgcgaagagttttactcggagaaatagagggaacatgtatcacacgtgtaaaatcagaaaaaataccacatgaatattctaccataataggtattgaagaatcagtacatgaaattttaatgaatttgaaagaaattgtattgagaagtaatctgtatggaactcgggacgcgtctatttgtttcaaaggtcctggatatgtaaccgctcaagacatcattttaccaccctctgtggaaatcgttgataatacacaacatatagccaacgtaacagaacccgttaatttgtgtattgaattaaaaattgagaggaatcgtgggtatcgtataaaaacactaaaaaactttcaagatggaagttatcctatagatgccacatttatgcctgttcgaaatgtaaatcatagtattcattcttatgtgaatgggaatgaaaaacaagagatactctttctcgaaatatggacaaatggaagtcttaactcctaa

SEQ ID NO: 34692 - DNA, 1347 bp, Glycine max
  Peptide Sequence Number=SeqID_151470
atgggccattttcatgagtacggcggtctcgctggctggaagtggttgtacattattgaaggcgcgccatctctgctcattggcgtgctggtgatatttctgctgaccgaccgcattgcgcaggcgaaatggctgtcagatgacgaaaaagcgttgctcgaggcgcgactgcgcagcgatggcagccataagaccgaacagcatggttcgatgctggctgttttgaagaatccgaaggtgtggttactgacttttatctatttctgcctgattgccgggttctataccgtcagtttttggatgccaacgctgattcataacgccggtgaaggcgatgtgctgaaagtcggattgttaaccgctattccttatgccgcagcgatagtcaccatgattgccgcttcgcgcagcgccgataaacgtagagaacgtcgctggcatctcgccgccatcgccgtcatgagcggcctggggatgattattgcggcgctgttcagccacgatctggtgattgcgatgatcggtttaacaattggcgcagcgggcggattgagcaccctaccactcttctggagcctgccgacggcctttcttggcggcgcttccgccgcggtcggtatcgcggtaatcaactcctttggcaatctcgccggctttgtcgccccgtggattatgggcctgctcaccgatatgacccattcgacgctaaccggcaccttaatcatctccgcgacgctgtttataggcgctgcggcgatattccgtattcctgcccgtatgcgtggttcgctaagcggcccgcagggtgaaacgcaggaaatcggtagactgatcgctatcgaccgcgtggcgttacaggggattgacgatagccgtttaaaggtattaaccggcgacatcagcgatagcgaatggttacgtagcgcgattcccgctcaggtcgatagcgtctttcatttagccgccatcgtttcaagccaggcggaacaggacttcgagctggggatgaaaatcaacgttgatgccttccgccaactgctggagcacctgcgtcagttgccgcagagcgtcaaactggtgaccaccagttcggtggcggtattcggcggcgacttgccggaaaaagtgagcgattcacaagtatggttgccgcagagttcttacggcacgcaaaaagccatttgcgatctgttactggcggattacagccgtcgcggttggcttaatggcagaagcctgcgcatgcccaccatcgtcgtgcgcccggggaggcccaatcaggcggcatcgagttttgccagcggtattatccgcgagccacttaatggggaatccgccgtttgcccg

SEQ ID NO: 34693 - DNA, 309 bp, Glycine max
  Peptide Sequence Number=SeqID_151471
atgggggagacacatgaagtaccccgagaccgtactctagccgacttcgagcctcaccttggatatgacactgaggggcaggcattttgtggcatacccctgccaaacactttgggagggggggctcagtatcgcccacaaccacaacccttgcattttgcgatgggaaaagtctctcctaccatgttatgcctagtgcccgacgtggtcattcctatgaagttcaaggtgccagatttcgataagtacaaagggactacttgccccaagaatcacctgaagatgtactacaggaaaatgggggcatac

SEQ ID NO: 34694 - DNA, 381 bp, Glycine max
  Peptide Sequence Number=SeqID_151472
atggtgaaaggaaatttggagaaatttctagaaacaaagagaattctagaaatttctctaagacaaatcaagaaaaatatcttccatgtgacatctataaaaagaaaagtcactcagagaaggattgttggcatcgtggaaagccaatgtcactattgtaagaaatttagacacatggagaagaattgtcgcaataaaaataagcatcaagcaaattttgttgaagagcatgacaatgggcaacatcttttctatgctacccgagattccagtgatgagatacgtggaaactggtacttggatagcggttgtagcaatcacttggctaatgataggagcattttcaaagaaattgacaacaccgtcaaagtcaaagtttga

SEQ ID NO: 34695 - DNA, 936 bp, Glycine max
  Peptide Sequence Number=SeqID_151473
atgcgtcatcacctcgcgaccgccttgcagtttgagccaccattactggatcaaccccagccgtggcaatgggatgaagatgtacaaactactgccggcggagaaacgtcacaagcgcgctttatcctgaaccgcctgttccaggattatccaggtgcattttcggtgagattatggaatggcaacctgctgaatatcggagaaggtgacccagcatttaccttttgcctgcaacaagcttctgtcttacgcaacatggtgtggttctgcgaccctaaatgcctggcagaggcttatttctcggggcagatccagatactgggcgactttcacgccgccatgcagttacgtgaacattttgaatcgctctctttgccactccatgaaaaattaggcttgatcttccgggcgctgacactggcaaccgattttgcccaacctgaacaaacctcccttcctcagatagaccctactcccaaccagttagacacctcatccccggtagcactcagttacgacaatgtgccagaagacttttaccagtgctggctcgacgaacacatgctgcattcgtgtgcttatttctcaggaaacacgcgtgacctggcacaagcacaacgtaaccagctggacctgatctgcctcaagctgcacttgcaacatggtgattcactgctggatatcgggtgtggctggggtggactcgcctgctgggcagccaagcattatggtgtgtttgtccacggcattacgcaaaacgccagccagtatgcctatgccaccaaacaggtgaaaagattggggctggaacacctggtgacaatagagctgggcaactatcaagacctgcctgccacaggcagctatgacaaagcggcgtgcattggcattgccgaccatatcggcgaggcacattttcccgattacctggccaag

SEQ ID NO: 34696 - DNA, 249 bp, Glycine max
  Peptide Sequence Number=SeqID_151474
atggagcattatctacaacacttggttcgccagcaggcggccaaccaccgcggacaggggcagagttccaccccttctgtgtgccctaccccggagcagtttgcgactgaggtcgcatggccgggagactggcccgatgcccaggtaggggaggagcctgcaggatcccccggtaggatggacgagcccttcatggacgaggatatgattgacctattcgatttcttgggagggagcggagccacatga

SEQ ID NO: 34697 - DNA, 159 bp, Glycine max
  Peptide Sequence Number=SeqID_151475
atgcatattgttgtggtaagacaggggcaggatcatcttgagctaccttccggggtgaggaccaaatgtggacagcagaaaccaatcaaggtacttaagaacggatgcaagtggggatggggtcacgaccgactgatcgttgccctttctctgtactag

SEQ ID NO: 34698 - DNA, 297 bp, Glycine max
  Peptide Sequence Number=SeqID_151476
atggaacaacgaaaatactcgagaaattcaaatggtcataacttttcacacggatgtccgattcaggtgcataacttatcaaggcgtttgaaagtgaacaacagaagctctcgagaaattcaaatgctcataactgttcgcatggttgtccgattcaggtgcgtacgtatcgaggcgcttgaaattgagcaacagaagctctcgagaaattcaaatggtcataacgtttcacacagatgcccgattcgggcgcataatacatcgagacgctcgaaattgcacagcggatgctcttga

SEQ ID NO: 34699 - DNA, 1185 bp, Glycine max
  Peptide Sequence Number=SeqID_151477
atgactacttctgtcagcaccactcagcttaacctgcgaattatttccatcgtggttttcacctgtatctgctatctctccatcggcctgccgctggcggtgcttcccggctacatccactatcagctcgggtacagtacgctaatcgccggaatcgttatcagcctgcagtacatttcaacgctcgtaagtcgacctcacgccggccgctataccgatatctgggggccaaaaaaggtcgttagtctcggcatcatctgctgcatgttaagcggactcttcaccctcgcggcggtgatgttgcaagctataccacttctcgccgtcagcgccctgttgattggccgggttttcctcggcgtgggagaaagctttaccgccaccggggcaacgttatggggcattaaaaccgttggcgcgattcacacctcgcgggtgatttcatggaatggcgtcgcgacctacgtggcaatggccgtcggcgcgccgctgggggtgatgctcaatagttattttggcatcagcggttttgccgtagtggtagtgctggttgcgctaattggcctgctctttgcccgcacgcgacaggatgtcagcgtaaccgccggagtgagagcgccattccatgtggtagtgcgcagaatctggccctacgggctgggactggcgctgggtaccgtcggctttggcgttatcgccacctttattaccctctatttttcggctcaccactggcaaggcgcggccttcacgctctctcttttcagcatcggttttatttgtatacgcctgatccttggcaacaccattacccgctacggcggcgtgccggtgtcgcttgtctgcttcgtagtagagtgtcttgggttattgattatctggcaggcaccgtcggcgtggatcgccggtatcggcgcattcctcaccggttctggtttctcgctggtcttcccggcgttgggcgtcgaggcggtgaaacaggtagaagaacaaaaccagggcacggcgctgggtacctattcagcctttctcgatttggcgctgggtttgaccggcccggtggccggttgggttgcgggttattatgcgcttgatacgctgtatctgctggccgcggtggtagtcgccatggcgtttatcctgctgcttcgggtttgtctgcaacagaccaggacgaacgtatga

SEQ ID NO: 34700 - DNA, 888 bp, Glycine max
  Peptide Sequence Number=SeqID_151478
atggaggctagtctgtgcatttcaggcaagggctttattctaaacacggagggccaaccatggaagctcctcagaaaagatcttaccacccttgctcagacatggagcgtcctctcgtactcaaacttagctcctacctcctgcatttcagatttgaacacagacagagctaggttggtctatggcttaatcacaaggatggacatgaacattggcggtttgatctttggacaaatgaccatgatggctcagtctaactcttctcgcttaggctttctagctttaatcacaaccttgtgtagatcgaggggagtgggatctgatgcccttacctcctatgaaaatctaaggctggccattgacttagcttatatcataaggaactgttggaatgcgaatgaccaaacagttaattttccagaggcaaggaagaccacgctcagagcagctgatgttccttcttcctttgcaccaatagatggcatccttgcatcttctacttcatccccacttccagctttaacagacttatctgccagagctctcagacttcagatgccaaatttcaaagcttgtttgaaggacaaattctcattatacaaagccaccatccctggagctgttgattttgaaaaaagaatattagagacgagatccaatgaggctgctcatcctggaccagtgccagcatcagctgaagcaccatttctaggagtagatccatcttcacctcagcatgcagcagactcttccactcctgtcttagagatacaagaaggtcaaaccatactggtcctacctttggacacttctcctccagctactccagtatggcatctaacagatgagaagaatgttcagatacaggacaaccaggacaagtcatag

SEQ ID NO: 34701 - DNA, 237 bp, Glycine max
  Peptide Sequence Number=SeqID_151479
atggcatccttcagccagatgcagtcccagtttcaatcacacatgcaatcacaaggaattgcattgcctctggagcctgaggttggtccctcagggcctcgtgtcagcacaaaggagagttgtgttgatccctcagggaacaatccagagacgggggactcaggcaacaagcagttgtttctccagcaaaacctccacatgccggatctaagtgatgatccgtatattgatacatga

SEQ ID NO: 34702 - DNA, 135 bp, Glycine max
  Peptide Sequence Number=SeqID_151480
gattctttggaggagcaagcgtcacagggatcatttgtcctaactgctgccattgggcgaccagaacaccctggtcatgtttgtgctgctagagccagtgtcaccataaagaaatacttcggattggctccatga

SEQ ID NO: 34703 - DNA, 309 bp, Glycine max
  Peptide Sequence Number=SeqID_151481
tacatccggagcaacctgcacgcacactttagcagcctgtggagtggatactaccctacacctactccatatcgactagtggagccagttcaagtgatagaggtgtcatcctctgaagaggatcttgaagaggacccagaggagttacctcctgaacttgctgtggatgcccttgacttcccagagggtgatgaggacccactccctgatgttgattctccagaggatattatgtcagcatctgaggcagactctacagaggagcttggccctggagggacagcgaatagtgacgactcttcatcatag

SEQ ID NO: 34704 - DNA, 356 bp, Glycine max
  Peptide Sequence Number=SeqID_151482
atgtcattgcctagcgctgttcatgtgtcctccattatcaagcgcgaagcctctggtgactgggaaatacgttcttctgttgttttccggatcgaagaaaaagaaggagtagagacgaaagtcgtcatcacggaaagggcaggacagacgaaatcagtgtcctatctttgctttcctcttatccccaatgagagtcccgagatgtgtcagaaatcaaaaggaagcaggtttgcgcgatccgtgaaattccgtaatgtggcggaaatcgaaaagagatccttcctccagaaggctgttgcttctggaggaagcaaccttgctcgcctgggtgagctgagcttgcctgggcgagctgg

SEQ ID NO: 34705 - DNA, 195 bp, Glycine max
  Peptide Sequence Number=SeqID_151483
atgaacgacagttcctcgttagggacacttattatgcccctgacatcggaatctcttatggaagaaatggcagagatgaggagatatgaagaggctagaagcatagcctacaaagagttacaggcgcaagatgtcttgcagcagcaaaatgacaaaataaggaagagagtggatgctacccaagcgacgatgtag

SEQ ID NO: 34706 - DNA, 369 bp, Glycine max
  Peptide Sequence Number=SeqID_151484
atgaccaagtccttgaaggacttcttggcttgtttccacacaacgacaatacaagttttagcgccaaatgaaaggatgatagtggtcgctttatgcaagggactgcatgtagaacccttcgaagaatctttagtacgacgaaagctggagaccatggctgatatcctgtcatgtggagggcgatggggctatggcgagcaagaggatcatggagaaaaaggaggcaaatctgactaccacatcaaaattgcactagaaagactacttgaagtagaggaacagttggacaaaagaggtttcgactacggatcgaggcatcatgaagctcattgtccaaagggatttgaaggtggtgatgtatcaagctaa

SEQ ID NO: 34707 - DNA, 522 bp, Glycine max
  Peptide Sequence Number=SeqID_151485
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 34708 - DNA, 349 bp, Glycine max
  Peptide Sequence Number=SeqID_151486
ggtgcggataactgtaaggtatctccgcgtgtcatcgggcccgccgcctctggatgacacaagggtgcggataaccgtaagggtgcggataaccgtaaggtatctccgcgtgtcatcgggcccgccgcctctggatgacacaagggtgcggataaccataaggtatctccgcgtgtcatcgggcccgccgcctctggatgacacaaggggtgcgaataaccgtaaggtgtctccgcgggctaccagctcttgggtcatggtaacagaaagcagtgtggtcgacaaaagcgaggcttttgctcctacgtatcctccaatgaggaactcagacctacgtagttctggataa

SEQ ID NO: 34709 - DNA, 459 bp, Glycine max
  Peptide Sequence Number=SeqID_151487
atgatattgcacaagattagaaggcattactctctaaaaacagtccccagcggagtcaccaactgtcgcaacctacccttcggcgggagggcgacgcggggctcacgggtgcgtcttccaagaaaggaaaatgcgcggagtcgccaccaacgcttattcgaggaaaacgtcagaaaaatcggaaaggtgtggtctacgaactttaagtgtgaaaggttcgggagttgtttttatgcacggggaaggagagaaacattaaggcattggaccattaacgatctcttggtttttgaaaggagagaaacgttaaggcattggaccattaacgatctctgggtttttgaaaggagagaaacgttaaggcgttggaccattaacaatctcttggggtggtcgacaaaagcggggtttttgctcctacgtatcctcaattgcgatgaggaaatcagacctacgtag

SEQ ID NO: 34710 - DNA, 534 bp, Glycine max
  Peptide Sequence Number=SeqID_151488
atggttaaggaggagtgtaaggaggcaagtgtctcctccaagaggttagctaagaaggaaaggcattttgaaataaagacaaatattaaagttatttcccctcttagacaacctccacattttctcctttgtgaaaagacacttgttagcattgccacacctcttaggcttgagtttattcctcaagtaaaggagttgttggatgagggtttggttcacaagagcttaaatccttgtgctttgttggtgcccaaaataggtattattagacatcaaatccctaaaataggtggtatgaatgttttgagtggtgcaacccttttttgtaaaatcactcatgcacccaacatctttatgatttgtctacatagggactcattaggtagtgatcaaggggttcccattaaccctaagagaataaaggtcattcctgagtggcccactccaccaagtgttgaggaaaaaatcccagagtttcaaaaatcttgggatttgaggtcaaatccttttcaagggggagggaacatgatgtag

SEQ ID NO: 34711 - DNA, 291 bp, Glycine max
  Peptide Sequence Number=SeqID_151489
gctatcgatcgtgaaggtttgcctatggctctgtatctacctctgtctgctggtgcttattttgataagctgcaggatcaatggcttaaactactgcttcttcaacgcttctcctgcgacttgttctcctttcgtccttgctcctgcacgcacctaaaggaaggactgctagtcatcaccgagggtatgaccaaggaactgctgctgagagcgatagactttccaactgagatggagagaatgcgctcctactctctttcaatcgccgatgctaaaacaaagagggcgtag

SEQ ID NO: 34712 - DNA, 210 bp, Glycine max
  Peptide Sequence Number=SeqID_151490
atggcttgcacccacattccagtggaagcaaagatggtcatacagtgcttaatggaatgtgtcggggcttctcatgacaagcacacgttgtgttcgagtcgtattcttggagaaatggaggttgatgaaccttggttggggttatggctaccattgaattatcaagtagatatgggagcaagtcagcataggacactggaattggggtga

SEQ ID NO: 34713 - DNA, 1053 bp, Glycine max
  Peptide Sequence Number=SeqID_151491
atgtcgatggaatgtgtggaggatcgcatatcgtgggatttcgggtacaacatatgtaccaaattcctgggggacgatatggttctccttactggactttccgatgatagagctcatcaacttatctcatcggagattgatggcggtaactccattttctactccctagagaagtggcgaccggggattaaaccaaacaatcgggttgtttggatccagctctggggtttcccgattgaggcgtgggatactgaacgcatgacgaaggtcgtttcctgtatcggcgacgtgataggacccgacgacgacactgaagaccgtcgccggttggatcgggcccgcatgttagtccgaactccccttccgtcgacgatcaacagggaagtcattgtccgagtggggattaacgagtacaagcgcaagaggtcccttctggccgatgactggacggacgacgtgccgtctgacgacgagtgtgacggcgccgacgacgatgactccaataccacgttgtcctttctcgccgggagttgtccacgaagaagatgctataaacgttcgaaccactggtcacatgatataaccagtggactcagacgtgaacccagtggtcaagacacttcgttgggtaataaccgctccgatgataattacagagaaaatgcagaggtcacagcgacgcctaaccagggcctccgtttagcaaaggttgaccctggtgaatgcgtttcagaaaagatagcagacaacagcttaattggggaggaaacattggagaacacaaaagctgggccatggcaggtcaatggagagtatttgggaaagttttcgaattgtgagggaagagcagaaaaggtggtagacttatatgaagaaagtaggggacagctaacggttatgggaccccaaccagacaggtcccccttgcagtttcaaaagttttttggcccaagtaataatttgggcccaatagggaatacggaggggtgcaacaagaataattccccaaccaaggctcaatcttctaaaggaagtccagaaatgtttgccaaa

SEQ ID NO: 34714 - DNA, 633 bp, Glycine max
  Peptide Sequence Number=SeqID_151492
atggacatgaatatcggagccctaatcttaggtcagatttctaccattgcccagagtaactcctccagactcggattcccagccttgatcactactctctgtagagctggaggagttacctctgacagtctaacttatgagagcctgagcccagccattaacttggcctacattaagaaaaactgttggaatatggatgatttgacagttaacttcagaggggctaggaaggtaagggctcgaccagcagatattccttcttcttccgcaccacctgctccttccacttctgccactcctacaccagctcctcccatttctgccacccctacaccagctgcccaagactctcagtgctttgaagccatgcttcacagtgcaggagtagagatgagaccaaatgaggttgttcttcttgagccaattgtgccagttatacatgagactgttgaagtagaagatcctcctacagcagtacatgagagacaagcagatcctcctacacccatcatggagatgccagaagaccctaccacaccagtcctgagactgccacccactcctccagctaccccagttttacatctgacagatgaggaggatatgcaggaccaggacacacaaggcacatag

SEQ ID NO: 34715 - DNA, 234 bp, Glycine max
  Peptide Sequence Number=SeqID_151493
atgggtggtttagcctctcattttcatgaaaggcttataaatacaaaaagggatgaaggtagtggaagagataggaggaaaatggggaggaagggaaaggaaagctccaaatgctggataaggggtcacactctaagcatgcacgatgtgctaagtgcgcatgcatgtgacatttggcttcccgtgtggcttcttgcgttgagtgaggataacacgctgagtgagactctttag

SEQ ID NO: 34716 - DNA, 297 bp, Glycine max
  Peptide Sequence Number=SeqID_151494
atggtggcattagacatgatgcataaagagatcgaggtctacgtggatgacatgatcgccaaatcaaggacccaaaaaggaatagaggtagatccaaacaaggtaaaagcaatcctcgaaatgcccgagccatgtaccaagaagcaagtccgcggtttcttgggaaggttgaactacatagcaagattcatatcacagttaatagccacctacgagccttttttcaaatcattgcgtaaaaatcagtctgtccaatgggacgatgattatcaggtggcatttgaaaggattaaatga

SEQ ID NO: 34717 - DNA, 264 bp, Glycine max
  Peptide Sequence Number=SeqID_151495
atgatcggaaacttcatcgacgacattgactgcggcaacttcttcgaccacatcgacgacctcctcgaattccccgacgacgccgccgccgctgacacctccgccgccgctcctgtccctccaccggcgaacttctggtccgccgagtccgactcgctccccgccaccgacacggtgttttccgacaactccgtgacggacctctcggcggagctctctgttccgacaatggctgtccgaattttaaacagtttcattatttaa

SEQ ID NO: 34718 - DNA, 222 bp, Glycine max
  Peptide Sequence Number=SeqID_151496
atggcagggggagtatttagtaaacagggggtaaaatccaggccgaggcgcttccgtaacgcttctgtgggtgatttcgtgaagattttcaagcgttcttcgtcgttcttcggtcttcaaccgtacgcctatttgcccttgcaagatggaggaagtttatacgactccaatcttggaagcaagaaagttgtttcccatggcaaagagaggttttgtgagtaa

SEQ ID NO: 34719 - DNA, 201 bp, Glycine max
  Peptide Sequence Number=SeqID_151497
atgcttccttttgacttctggcatatcacggaacttcacggattgcctaacgatgggtgtcaatcgacgaaagccacggatgaccataatttgtctccacgcgctatcggactcgattgtttctggatagtgaaaaaggtgcgggatcaaacggttccccgcatgccatcaggctcgccgcctctggatgacaaaaggtga

SEQ ID NO: 34720 - DNA, 327 bp, Glycine max
  Peptide Sequence Number=SeqID_151498
atgtggagaatcatatacagggctagtcaagttattgatttgttcccaacagtgtcccccgaaattattgtccgtgaggcaaggttggaggactactgggggagtggcagagactcactgcaaccggattctttaggccaagagattgcagaagaatctgttttggtggctgttattgacagctcacttgatgagtccttttcatttggaagtgggggtctcaagatgggtggttttgatgggaaattcaacctcaacaaaggctatgtggctggtatattaacagtagacaataatgcagactttctaccaagaaaggggttatga

SEQ ID NO: 34721 - DNA, 492 bp, Glycine max
  Peptide Sequence Number=SeqID_151499
atggggtacgaagtttttttttttttacctctgtgcttgctagtgaagggatggaaaggtacaagttggagtttccctcgtggaaaaaagagcaaagacgaagaagatcatgcatgttccattagagaagtcatggaagaaacaggttttgatgtttcaaaacttctgaacaaggatgaataccttgaagttatttttggacaacagagagtgaggctttacattattgctggagtgaaagatgatacggcatttgctcctcttaccaaaaaggaaatcagtttgagtgtgttgtggctgagaactttcaacatgattgcttttctttgttcttatgttaaagatcatggttatcaaaatactgagaaattgtgtaacctgcaggaaattgcatggcaccggcttgatgatcttcaaccagcaagtgatgaagtgatatctcgtagcatcaccggccttaagctttatatggtggccccatttctggcgtga

SEQ ID NO: 34722 - DNA, 477 bp, Glycine max
  Peptide Sequence Number=SeqID_151500
atgaatctaactccggtggccttgatggaagcatcgtactttgctaaaactgtatttggtgggcaaacaatcaagccagactacagtaatattccctatgcagtgttcagcattccaccactttctgtagttggtctcagtgaggagcaggcaatagagcaaaccaatggggatctgttggtttttacatcaaccttcaatcctatgaaaaataccatctctgggcgacaagaaaaaactgttatgaagcttgttgttgatgctgagacagataaggttctcggagcctcaatgtgtgggcctgatgcacctgaaattatgcagggtattgctgttgcgttgaagtgtggagctaccaaggcacagtttgatagcacggcagtgatgggatatttttactggaagggaaatgatataatgacatctggaattggcttcacctatctgaaatacttgctcaagaatgtcaacatttaa

SEQ ID NO: 34723 - DNA, 708 bp, Glycine max
  Peptide Sequence Number=SeqID_151501
atggtgttagagcctatcatagatccattgttgggccacctgcatttggcacgctccaggctagaagtcctaggcgtgagtgggagtgttggaaaagccgccttagttgcagcatctttgggggagttgggtataacatcagacgaggcactaagtttagaggatcttccaaaacatgctgtggttcttggaggaggttatattgcagttgagtttgcatctatatggcgtggcatgggttccacagttgatctagttttcagaaaggaacttccactgagaggttttgatgatgaaatgagagctgcagtggcaagaaatcttgaaggcaggggaattaatttgcatccaaggaccaatttgacacaggacggcattaaagttattacagatcatggtgaagagctgattgcggatgctgtactgtttgccactggcacaaacatgaatgctatttataatagcctttttgtgggttacctgaagtgcaaccttgagggtgctggtttagtggctggaagtcatgggcatgattgggagtgttggaatagccaccttaattgcgagcaccccttagcccgctatagttgtggcctctttgtgggttgcctgaagcgtaatcttaagggtggtggtagggctcctaattctaagaggctgaatttagaaactgtaggtgttgagcttgacaacactggagcaataaag

SEQ ID NO: 34724 - DNA, 765 bp, Glycine max
  Peptide Sequence Number=SeqID_151502
atgctggttattaacaaaagaagaggctttctgttgcaggttttatcagctcgccttggacgtaagcctgaggatatcgtgaagttagatgctaatgaaaatccttatggtccccctccagaggtcatggaagccctaggatcaatgcaattcccatatgtctatcctgacccagagagccgcagattgcgcgcagctcttgcccatgattcaggccttgaagctgaatatattcttgcagggtgtggtgcagatgagcttattgatttgatcatgcggttagaaccaataccttatattgtggactgccctccgaccttcacaatgtatgaatttgatgctgcggttaatggagcacttgttatcaaagttccaaggaggccagatttcagcttgaatgttgaacaaattgctgaagttgttaaacaagagaagcccaaatgcatatttttaacatctccaaataatccagatggaagtataattgatgacgaagttctcttaaaaatactcgagcttcctatattggtgatactggatgaagcatacattgagttttcagcaattgaatcaaggatgagttgggtgaagaaacatgataatttgattgttcttcggacatttagcaaaagagctgttttgacaaagcaagcactaagcagtgaaaaattggggtgtttggtgattgttgaaattatggagtttttaggtataaagggaggaagagagataaaagagaatgaaacagaaattgatattaactga

SEQ ID NO: 34725 - DNA, 474 bp, Glycine max
  Peptide Sequence Number=SeqID_151503
atggctaggaagatgcttatcgatggtgaagctgaattggctcaaggtggtggagaagaagtgtcgaattttgacttcgacttgtttattattggggctggaagtggtggcgttcgtgccgctagattttcatccaattttggagctaaggtggggatttgtgagcttccatttcatccaattagttcagaaacaattggaggagtcggtggaacgtgtgttattcgtggttgtgttcccaaaaagattttggtctatggagcatcttttggagtattgaacccaagtatgtgttgggatagggttatgctcttagcttgtcttggtgttctgcctgagacaacaacagagctgccatctctgatatgcaaagggactcagaaaccttgctgcattcctactttccttttacgttattcagatctaaaggatactttagccttgccccattgtctttacttattctctatttaa

SEQ ID NO: 34726 - DNA, 567 bp, Glycine max
  Peptide Sequence Number=SeqID_151504
atggtgagactggctgaagcatgcatggctgagatatatggccacacatcgcaaaaactgacagctgggtcttgtgtcgcaccagaaatatgcatgcagaggagatcagaactggatagaaattcagctggaaattatctaaaacatgtcggtttagctggacttcgagtgggatatggagcttttcctttgagtataattgagtatctttggagagcaaagcagccgtataatgtatctgttgctgctgaaatttctgcatgtgcagcattgcaaaatcctacctatctagagaatgtaaaaaatgctttgttgaaagaaagagggagactttatgaccttttgaaagaagttccattcctccggccatttccaagccattctaacttcattctttgtgaggttacatcaggaaaggatgcaaagaagctaaaggaggacctagcacaaatgggtgtgatgattcgtcactatgacaagaaagagctgaaagggtacgttcgtgtgactgttgggaagcctgaacaaacagatacacttatgaagtgcctcaagagactctcgtag

SEQ ID NO: 34727 - DNA, 480 bp, Glycine max
  Peptide Sequence Number=SeqID_151505
atggatacagaggagttcagtttccctagaatcagtgatacttgtgcacacaacattgattcacctcctctatggaacctgtcaccagcagcatctcctaatccctactaccaagggaacaaaagaggagaaaatgagtgttttggagcaaaactagtagcagctgaggttcacaggaagagtttttcatgtgtagaaaatagcaggaaaagatttggactagaggaggatgaagacagaatggacatgttgtgggaggatttcaatgaggagttgtattcaacaacaaccacagtgtctgctacctcttcttcaagggaattaagatatgctccagcattaactgttgcaaagaccaataatagttcactatttcccactaagaacaacaagcctagcatggtggtgattgtgagggtcatgaggaagcttttctccatcaacaattctcaaggcaattcgggttcttggaatgattga

SEQ ID NO: 34728 - DNA, 291 bp, Glycine max
  Peptide Sequence Number=SeqID_151506
atggagttgcagcggaagataaaggagaagagtgttggagtcgtcattggagaagtcaaggcaaaagaggtagatctaggtggagtggatttcagatttggagaaagaaacatcaccaccgttggcaaggcaaactccacctttgccgcgagatacgacgttggcgaggcaaaggtgaacggagtcgtaagtcgcaacgacgcctctaacaaggagaagaagttttcgtcactatcgatggagaagaagaagaagttgttgattataaaaaaaggaaagatcggacagtga

SEQ ID NO: 34729 - DNA, 315 bp, Glycine max
  Peptide Sequence Number=SeqID_151507
atggctcccggaggtcgcgcaagttcgtcggcgacggaggagaagaacgagttgtctttaatgggtgtgattgatttctacaacactggtgctttgtgctgggttaagtccaacgccaatctgaagcagcaagtgggtttggcaccaagacccatttgttcatttgaggggaataatcagaggaagtttgtggcaatggcttctaccgttcctgtggagcaagtcaacaatggccccctgcaggtgacaggtgactccttcatcagagagcatctgaggaagttggctccttatcagcccattttgccctttgag

SEQ ID NO: 34730 - DNA, 162 bp, Glycine max
  Peptide Sequence Number=SeqID_151508
atgcagaacctgaaaggaagtaaaagaaaatgcaagtttgatctgaaatttccattagaagcgggtgatagaattgaccctttcaggaactttagtgtaaataagatttacgaaagtaaaaaggaaatgctgaaacaaagatcaactgcacaaaagacatga

SEQ ID NO: 34731 - DNA, 2406 bp, Glycine max
  Peptide Sequence Number=SeqID_151509
atggatgggatttttgaatgtattgatggaagatttgaagtatctttagcagattctacaatgatgtggattgtgcactatgccatgaacaaagctcaagagaagatgaaggagaaaacaggagtcattgaacggttgaatgagatatcaaagttctatgaactagcagtgatgcaacttgaaggttgtctaagcattgttcatgcagagactgaaagcagctttcttgagagcagccatgaagaggtactcaatgatttgagagacataaaagatcgccttcaatggcgtctcaaggaatctgaattagccatagtagagaaggacaaagagttggcacagagattagaaaatgagttgcaactcaggcattctttagagctgaaagaaagacaattggtttctttgggtgttagccatgggattgaaataagtaatctcaaagctgagaatgatgaaacaacaagaaatgagcatggtgttggtaatggtgaaggcggtttctgtgagttgagtactagtgagaatcagcaaaagcttgagccacaacatgacatgtcaagtgaggtacaaaataatggtattgttggcaggaaaaaggttgaagagatgggttctgacatagatatactaaagcagactatggatcttgcttttgggaagatgcaatctgcccttttcaggtgtgagatgaggtcaaaagagagggaatggaagttgacaattgaaaaggatgtaatgtctatatcaattggaagcttcatgagggatttccaagagaacattgaagcaaaagtgaagagggatgagaatcaggttgtcaaagtttggaaggaccattggccgcgattgatgaatgagtttacaaatttgcagcttgaatttgccactttccatgacacatatcctgaggattctgactgttcatcactttcttccccatcaaagccttcttcaccaacaaagccttcttcaccagaaggaagtcatgaaatgcctaacaggttctctcagaagatggaagagacagataaaccacccgaagaggaagaaaatgaggatgggagcagcaaatatgttgctaagttgataaagaatcatgaatctattattcgccgaaagagtgaagaattgaatttgagtaagcatggaatatcacaagaaagaaaggcctcatacgtgaggagaagaaaggaactaaatcgtgtgagagaaagaatccatgttgtcgttgaaaaattggacagttttatacgtcgcaatgctaaacttatcgaatctcttttcaaccaaagagctattcataatgcagaaccgtttccagggagaaagttatcagaagtagatgaaatccatactatcaaggatgttgaaagtcatagaagtgctgaaaaacaggcagttatagatatccgtgcaaatcaagaatttgccttaatcaagggaaatgacggtgaagctgaggaaagttgtttacagtgcttgacatgtagtaaccaggaggatgtgtgtatggttgtatttaaagctatggttaaggaatggaaattggaactagataactattatatggaaaattacatcagagagaatataaatcaagttttcttggctgagacattgaatgatgcctttctcttgttcatggaagccaaatcaatggttcaagacaataccatagaagatagttgctctacctctactatgatgttaaatcaagttcggaaagttcatggagaagagaacttgacaattatattgttagagtctctacttagttgttttgaagcagaggagaatctgatgctaagtgcaaagtgtgagatcaaggaacaatgcagggaacttgacttgggttcagaacgtggagacctacatgagcacgaaatatttgaagatttgataactgcggaagaacagacattctcttcactgaccagcaaggtagaaaatgtcttgcaacaattaggtataagcaaggcacttcttagagagttaggcaccaacttagggcacagtttacgtgactcagaaagttttcataataaaaaatctgctaatgaagaaggtcaattgaggctgtcttcttctgctttcatgccccttttgaatcttttactgacatttgctgaatttgggtcaatgatatgccagaaatttgagatgatggctgtgaggttggcaaagatgaaatgttgtttggatcctgttattgaattggttggttgcttgagaagcaaacagtcactttaccagaaagccttctttaaaaggtgccagaatctccaaaaagccgaggctgaggttgatcttctaggtgatcaagtggattcacttttaacattacttgagaagatatatgtaacccttcatcagcatgcaccagctttgcagcagtactttgag

SEQ ID NO: 34732 - DNA, 867 bp, Glycine max
  Peptide Sequence Number=SeqID_151510
atgatcaatctctcaaagaaccttcctccccctgttccatggaatgcctcatacccaccatgttcatggatgggagtggattgtgaccctaccaattcttctgtaatagggatatctttaattcggtattcactgtctgcttcagactttctgccacttgtttgcaaaattcaaactttggagcattttgatgtctccaacaaccgtctgagctcagtcccagatggtttcatcactgagtgtggaaagattaaggggttaaaaaagctgaatttcagtggaaacatgttagggggtgatttaccatcttttcatggttttgatgcattggaatcccttgatatgtccttcaataatttggaagggagtattggtattcagttagatggattggttagcctcaaaagtttgaatcttactttcaataacttcagtgggtctattcctaccaaactaggaaattccacggttttggagcatcttgtgctttctgtcaatcactttggtggaaaaatccctgatgaattattgagttatgaaaacttgaccgaggttgattttagggcaaatcttctctcagggtccattcctagcaatattgggaagctttctaacctggaaagtttggttctttcctctaataacctcactggtgaaattccagcttcccttttgaacctcacaaagctttcaagatttgcggcaaatcagaacaatttcataggtcctgtacctcctgggattacaaatcatctcacgagtttggatcttagttttaataaattgtctggacccattccagaagaccttttatccccatcacagttgcaggctgtagatttgtcaaataatatgttaaatgggtcg

SEQ ID NO: 34733 - DNA, 2694 bp, Glycine max
  Peptide Sequence Number=SeqID_151511
atgggcaggtttgagtatatccccacttctttcctcagtattttgttcattttttgtttctgtcccatggtgttgtccctgctgtctcaaaaccaaacaaaaaccatgatcaatctctcaaagaaccttcctccccctgttccatggaatgcctcatacccaccatgttcatggatgggagtggattgtgaccctaccaattcttctatagtagggatatctttaattcggtattcactgtctgcttctgactttctgccacttgtttgcaaaattcaaactttggagcattttgatgtctccaacaaccgtctgagctcagtcccagatggtttcatcaccgagtgtggaaagattaaggggttgaaaaagctgaatttcagtggaaacatgttagggggtgatttaccatcttttcatggttttgatgcattggaatcccttgatatgtccttcaataatttggaagggagtattggtattcagttagatggattggttagcctcaaaagtttgaatcttacttccaataacttcggtgggtctattcctaccaaactaggaaattccacggttttggagcatcttgtgctttctgtcaatcagtttggtggaaaaatccctgatgaattattgagttatgaaaacttgaccgaggttgattttagggcaaatcttctctcagggtccattcctagcaatattgggaagctttctaacctggaaagtttggttctttcctctaataacctcactggtgaaattccagcttcccttttcaacctcacaaagctttcaagatttgaggcaaatcagaacaatttcataggtcctgtacctcctgggattacaaatcatctcacgagtttggatcttagttttaataatttgtctggacccattccagaagaccttttatccccatcacagttgcaggctgtagatttgtcaaataatatgttaaatgggtcggtgcctacaaatttttctccaaacttgttcaggttaaggtttgggagcaatcatctgagtggaaacattcctccaggtgcttttgcagcagttccaaatttgacatacttggagctggataacaatgacttgaccggaaccataccggctgaattggaatcatgcaggaaattggcgttgttgaatttagcacagaatcacttgactggtgtattgccaccactgcttggcaatcttaccaatcttcaagtcttgaagcttcaaatgaacaagcttaatggtgcaatccctattgaaattggccaacttcataagttgtcaatactgaatttgagctggaattctctgggtggatcaattccatctgagattacaaatttgagcagtcttaatttcctgaacttgcaaagcaacaatctgagtggttccataccaacatccattgaaaacttgaaatttctaatagaactccaactcggggaaaaccagctaagtggtgtgataccaagcatgccgtggaatctgcaggcgtcactgaatcttagtagcaaccaccttagtggtaatattcccagcagttttggtactttggggagcctggaagtcttggatctctcaaataacaaattatctggtccaattcccaaggaactaactggaatgtcaagtttgacacagttgttacttgccaacaatgcactgctgtctggtgaaattccaaaattcagtcaacatgttgaagttgtatattctgggactggtctgataaataatacttcacctgacaacccaatagccaacaggcccaacactgtctctaagaagggaatatctgttcatgtgacaattctcattgcaattgtagcagctagttttgtttttggcattgtcattcagctggttgtctccagaaaaaattgttggcaacctcaattcatccaaagtaatttattaactcctaatgcaattcacaaatcaagaattcacttcggtaaagccatggaagctgttgctgatacatcaaatgttactttgaaaacaaggttttcaacgtattacactgccatcatgccctctggatcaatctattttatcaagaaactagactgttctaacaagatattgccattgggaagtcatgataaatttggaaaagagctagaagtctttgcaaaattgaacaattcaaatgtcatgactcctttggcctatgttctgtccattgatactgcttatatactatatgaatatatctcaaatggctccctctatgatgttcttcatggaagcatgttagattggggtagcagatatagtatagccgttggggtggctcaaggactttcttttcttcatggatttgcctctagtccaatactactccttgacctatcaagtaaaagtattatgttgaagtccctcaaggagcctcaagttggggatgttgaactctaccatgtgattaatcccttaaagagtacagggaatttttctgaagttgttggttctgttggttatattcctccaggcacaatcacaagatattctggccaatgctttcccatattgcgagaactctggggtgaagctatgttgttgatcaagtggcatgaatttccagactgcaagaactattgggagttgatgatttcattgcaactttatgtcagaaggaaaggagatgagttacaggttgacagaacccaaactcacctcctataa

SEQ ID NO: 34734 - DNA, 780 bp, Glycine max
  Peptide Sequence Number=SeqID_151512
atggctgggaatgtctacagttttggtgtcatcctgcttgaactgataacaggaaaaactgcagtgactgagggaatggagttcctaaagtgggttttacgtaatccaacagaccaagattacattcttgattttaatatccccagaagcaagaccaacaatgaagagcgtgctacatatgctgctaaatgctatatgaaaagacctcttatcctcatcacagtttctccaagcttgttcaagttgaggtttgggagcaatgaactgagtagaaacattccttcaggaaattggaatcacttgactggtgtattgccaccattgctaggtaatcttgccaatcttcaagtcttgaagcttcaaatgaacaagcataatggtgcaattcctattgaaattggccaacttcataagttgtcaatactgaatttgagctgcaattctctgggtggatcaattccatctgagatttcaagtttgagcagtctttctttgttgaacttgcaaggcaacaatctgaatggttgcataccaacatccatcgaaaacttgaaacttctaattgaacgccaactcggggaaaaccagctaagtggtgtgataccaagcatgccgtggattctgcaggtgtcactgaatcttagtggcaaccacattagtggttatattccccgaatttttgataatttggttagcctggaagtcttggatctctcaaataacaaattttctcattcaatccccaaggaactaactgaaatgtcagctttgacagagtaa

SEQ ID NO: 34735 - DNA, 1869 bp, Glycine max
  Peptide Sequence Number=SeqID_151513
ttttctccaaacttgttcagggttaaggtctgggagcagcatctgagtggaaacattcctccaggtgcttttgcagcagttccaaataagacatacttggagctggataacaatgacttgaccgggaccataccggctgaattggattcttgcaggaaattggcgttgttgaatttagcacagaatcacttgactggtgtattgccaccactgcttggcaatcttaccaatcttcaagtcttgaggcttcaaatgaacgagcttaatggtacaatccctattgaaattggccaacttcataagttgtcaatactgaatttgagctggaattctctgggtggatcaattccatctgagattacaaatttgagcaatcttaatttcctgaacatgcaaagcaacaatctgagtggttccataccaacatccattgaaaacttgaaacttctaatagaactccaactcggggaaaaccagctaagtggtgtgataccaatcatgccgcggagtctgcaggcatcactgaatcttagtagcaaccaccttagtggtaatattcccagcagttttgatattttggatggcctggaagtcttggatctctcaaataacaaattatctggtccaattcccaaggaactaactggaatgtcaagtttgacacaattgttacttgccaacaatgcactgctgtctggtgaaattccaaaattcagtcaacatgttgaagttgtatattctgggactggtctgataaataatacttcacctgacaacccaatagccaacaggcccaacactgtctctaagaagggaatatctgtcgctgtggcagttctcattgcaatcgtagcggctattgttcttgttggccttgtcaccctgctcgttgtgtcagtgtcacgacattattacagggttaatgacgagcatttaccgtcaagagaagatcatcagcatcctcaggtcatcgaaagcaaattattaactcctaatggaatacacagatcaagcattgacttctccaaagccatggaagttgttgctgaagcatcaaatattactctaaaaacaaggttttcaacttattataaggccatcatgccgtctggatcaatgtattttgtcaagaaactgaattggtctgacaagatattgtcagtgggaagtcatgataaatttgtgaaagagctagaagtcttggcaaaattgaacaattcaaatgtcatgactcctttgggctatgttctgtccactgatactgcttatatactatatgaattcatgtcaaatggttccctctttgatgttcttcatggaagcatggaaaactctttagattgggctagcagatacagtatagcggttggggtggctcaaggactttcttttcttcacggattcacctctagtccaatactactccttgacctgtcaagtaaaagtattatgctgaagtcccttaaggagcctctagttggggacatcgaacactacaaggtgattgatccctcaaagagtacaggaaatttttctgcagttgctggttcagttggttatattcctccagagtatgcatacacaatgacagtaacaatggctgggaatgtgtacagctttggtgtcattctgcttgaactgctgacaggaaaacctgcagtgacagagggaacggaattggtcaagtgggttgtgcgtaattcaacaaaccaggattacattcttgattttaatgtcagtagaacatcacaagcagtcagaaaccagatgcttgcaattctcgagattgctcgtgtttgtgttagtacatccccagaatcaagaccaaagatgaagagtgttctacgaatgctcttaaatgctagatga

SEQ ID NO: 34736 - DNA, 941 bp, Glycine max
  Peptide Sequence Number=SeqID_151514
atgagtctattagcaggtgcttacgttcaaccccgcttcccttgtaactacaacccaacgctttccgcatcttgcagaacccaaaagacagcaacttcactaaccgtaacaactcccaagaaaacagaaaaggcgttattcactgagtcattcgatcaaacacgtgacgcgcaacctctccccgaaaagaagaagagggtgttcttcttagacgttaacccgctctgttacgaaggaagcaaacccagcttgcactctctcgggcggtggctctctctgtttctcgagcaagtcagccataccgaccctgtcattgctgttattgatggagaaaggggtagtgagcatcgcagaaagttgctaccttcatataaagcacataggagaaaattcacgagacacatatcatctttgcaaagattttcaagtggccatgttgggaggtccctccaagttatcaatgatgttctcggaaaatgcaatgtgccagttataaaagttgatggccatgaagctgatgatgttgttgctactcttgctggacaagttctcaataaagggtttcgagtggttattgcctcccctgataaggattttaagcaactaatatctgatgatgtgcaaatagttatgcctttgccagagttacaaaggtggtccttctacaccttgagacactacagggatcagtacaattgtgacccagaatctgatctgagccttagtgagtgtgatgaagttgacggtgttcctggtatccaacatctggtccctagttttggtcggaagactgctctaaaacttattaaaaagcatggttcattggaaactttattaaatgcagctgcaataaggactgtaggcagaccatatgcgcaggatgcccttaaaaaccatgctgattacctacggagaaattatgaagttcttgccttgaaaag

SEQ ID NO: 34737 - DNA, 2163 bp, Glycine max
  Peptide Sequence Number=SeqID_151515
ttcaagatgttagaaacaagcacgcatatagcatctcccccacaccgcatcagatagaatcagtcaatttgtcaatgccacaagaagtagttttgaatattatgaatgaggaccagacccagcactctgatatggaaaatcttgaaagctgcataaaagcaatggagaaaacttcaacaaatatttggtcaagaagaggtaaagctactagtgctcctcaggttcgaactagcaagagcatactgaagaatgcagccaatgttgaagttgcaatgagcaatgagaaggatatcagaaacagaacaatctcaaagaatctttcctctgttctggatggggaagtagaagaagacgacgaagaaatctacactccagataaagaaaacatcagtcctaatactctccacttgcgatttttaaagaagggtaaaatagaaggaattaaacattccaagtcacaaaggtcacgacacattttaagggatacatttaattgtgatatctatccaaatgaaagcatagatcccactttatgcaacatgaacaagaaggatcttttctctgttttggatggggaagtaaaggaaaaagaaatcttcattcctgaggaggaaaacttaaatccaaatgcccttcaattgcggcttctgaaaaagaagggtaaggtagaagaaattaaacgttccaagtcacgaagatcacccctttcaaagggtacgtttaatcctgacatgtatccaaatgaaaacataggctccactttatgcaacataaaccagaaggatagcataaatagaacaatttcaagggatctattctctgatttggagggggaagaggaagaagaaatcttcactccagataaggaaaacttcagtccaaatacccttcatttgcggcttctgaaaaagaaaggcaaggtagaagaaattaaacattccaaatcacaaaggtcacccctttcaaagggtacatttaatcctgacatgtatccaaatgaaagcataggcccctctttacgcagaatgaatcagaaggatgtcataaacaaaacaatctcaaaggatcttctctctgatttggatggggaagaagaggaagaagagatcttcactccagataaggaaaacttcagtccaaatacccttcgattgcagcttttgaaaaagaaggataatttttgtcccaacttatatccagatgaaaacataatccccacctcaaacgaagagaatcaaactctaaaaggagtccaggatcaaaaattgcaaagaaatcctttcagcagccatatcaagtttgcacaggagcaagatttgaaggaccgagtggaaaggatacccttccaatcactgaggaactcgggagacaagaggagatcaggcacttgttgtcctgtttctgcttccaaaagccttcattttagtaattgtggacaaattttagaccagcgttttaacccttctgatattagtggggtgccaaagaagagaagctgggacatgattgtggatactacatctcttgtgaacaaggaatcaaggaaagctctgcagcttttacaaggtctcaaggggactcgtgttgttgtttctaacaaacccagttatcactatgcaatgtcagtcataagggaactggaccgtatgaagcaacagttcacaattttcagaagaatttcagagtcttctttggcattggaatggattgaagaatgtatggtgaagtcaaactggtggattcatatccagagctcagtggatgagggaaggctaattgctccaaccccacctgcttctcctctgactcagtttagtgaagagagttggacttctctttcaacccagaagttctccatggaaattgcttcaccaacagtagaagatcacatccttgactttgctcttctatacagaagaaaccaaaatgatggacaacttatcctgcttagtgaggatgtcacattgaaaatcaaatgcatggcagaggggttgctatgtgaaccagtgcaagagtttcgtgagagtctagtgaatccattctctgagaggttcttgtgggacaaaagcattcctcgaggacagacttggtcttgccaagacgacgtagtcttaagggagaaattttgtcgtttaaggaagccatcaaagggagttgcaagcg

SEQ ID NO: 34738 - DNA, 990 bp, Glycine max
  Peptide Sequence Number=SeqID_151516
atgggtttagagaatcaatccaaggcagaagaagaaaaagagggcgaaatcccagttctaacggtgctgaagaacaacacggtcctcaaaaacatcttcatcgtcaacaagcccaccgatcagaagcagtcaagtgccgatcacgtgaacgtgcttctcgtgggtcgtcaccccgactgcgacctcatgctgacgcaccccagcatcagccgcttccacctccagatccgctccaatccctcttccagaaccttctccctcctcgacttatcttccgtgcacggaacgtgggtgtccgggaggaggatcgaaccgatggtgagcgtggagatgaaggaaggtgaaacgctgagggtcggggtttcgagtagggtttatcggctgcactggattccggttagtcgcgcgtatgatttggagaacccgtttgtggcgcaattggattcggttgcggaagaggaggaagaagaaaaagaagaggaggaagaaatgcagaacttgagctgctgtcctgctgaaatggaagaaattgaatcaatggattcaattgttgaggatatcagttctttattcctagatgagaatgtggaactaactgtgaaagaggaaattcccttggaaccttggatgttggaagacatgatttctttatgttgtgaggaagaaaggaagagcccatcaaaagaggaagcaattgaaatcccaagtgacccttttggaactgaaacatcatatttgcctacgatatctgatggtgaaaacaatttgtgtgactctgtgagccaggttctatcaccaacttatgtggaatcacttgtggaatgtgatgacacactgacagaaaatttgtctgatacttcatgtttgccagctgtggaagctgttttggagaccaaaatgctgcagttccatactccacctgacatatttacttctccattgccatctggtcatgagaatttgtttgaaaagcattattctagcttgcct

SEQ ID NO: 34739 - DNA, 291 bp, Glycine max
  Peptide Sequence Number=SeqID_151517
atgcattcaaggtcaatgtgctggaatgtcagtagaaatgttttaggacccttcatcataacagggcttggtttggataataggtcaagtggcactactattgggctctatactaagggtaagaaggtgggcatggaggttcattttgttgttaggcttttttgctgggcagagaaagtatttcctctgaggagcttttgctctgggagagggagtgatcctctattgtatctgctcatagaacttgttttcagattcaataaaaccctcagttttgttccaatttcttag

SEQ ID NO: 34740 - DNA, 219 bp, Glycine max
  Peptide Sequence Number=SeqID_151518
atggggcttagggttgtcaataagggtcagctcggtccgttttggcccgtcataaacggcactagcctgtgggttggcctgccccgacccgcctttggcccgtcaggcttgcaggctaaacgggacagacctaaatggtttatggatctcaaatttcagcccaacccaacttttttggagaacagaccggcccagcccgtcaggcctgactcgatttga

SEQ ID NO: 34741 - DNA, 1410 bp, Glycine max
  Peptide Sequence Number=SeqID_151519
atggaggattcagaggaagaagaacttctaaatcttactctttcagttgatgctggtaggaagaggagaaagaaaggaaggacaagggatagtaataataataatagtaacactaattctgttattattcctattaagtccaacgaagggatgatcttcaggctcctccaaatgagggagctgatgctaagacaagaccacagaattagaaaaggagtagttgaagatgggatcaacaacaacaagaatggccttcctttgattcacttgcttctctcaacagccactgctgttgatgatcaaagaaactattgtgcagctcttgagaatctcattgacttgtaccaaacagtttccctaacaggtgactcggttcaacgtgttgtggcctatttcgctgatggtttggctgcaaggcttctcacaaaaaagtcacctttctatgacatgctcatggaggagccaacaagtgaggaagagtttcttgcattcactgatctctatagagtctcaccctattaccaatttgctcacttcacagcaaaccaggccattttggaggcctatgaggaggaggaagagaggaacaacaaagcacttcatgtcattgactttgatgtctcctacggcttccaatggccttctcttattcaatcactctccgaaaaggcaaccagtggcaacagaatttccctcaggataacaggttttgggaacaatctgaaagaattgcaagaaactgaggcaaggttggttagtttctcaaaggggtttggtaatcaccttgtgtttgagttccaagggcttctaagagggtcttcaagggtcttcaacctgaggaaaaagaaaaatgaaactgtggcagtgaaccttgtttcttatttgaacacttcgagttgtttcatgaaggcttctgacacattgggatttgttcattctcttagcccctccattgtggtgttggtgaaacaagaaggtagtaggagtcttaagaccttcttgtcaaggttcactgagtcgttgcactattttgcagccatgtttgattcactggatgattgcttgccacttgagagcactgagaggttgaagattgagaagaaggttctggggaaagagatcaaaagcatgctcaactatgacatggatggtgtggattattgccccaaatatgagaggatggaaacatggaaagggagaatggagaatcatgggtttgttgggagaaaaataagctcaaagtgtgtgatccaagcaaagctgcttctgaagatgaggacccattattatccactgcagtttgaggaagagggtggtgggggtttcagagtttctgaaagggatgaagggagagttatctctttggggtggcaaaataggtttcttctcactgtgtcatcatggcaacca

SEQ ID NO: 34742 - DNA, 297 bp, Glycine max
  Peptide Sequence Number=SeqID_151520
atgcgcctcacatggggcatgccccatctgcccctagttttggctccacttccaattggctttgctgtgttcatggttcacttggcaaccatcccagtaacaggcactggcattaaccctgctaggagtctaggagctgctgtcatgtacaaccaacagaaggcctgggatgaccattggatcttttgggttggaccatttattggagcagccattgcagccttctaccaccaattcatcttgagagcaggtgctgctaaggctcttggatcattcaggagcaaccccgctatttga

SEQ ID NO: 34743 - DNA, 897 bp, Glycine max
  Peptide Sequence Number=SeqID_151521
atggataatgagattcgtgctattaagaagaatgacacgtgggagttggtgggcttgccaacaaacaaaaggtcaattggagtaaagtgggtacacaagactaagtacaatcctaaaggagaaattgatcgcttcaaagcaaggttggttgcgaaaggttataaacaaaaaccaggtattgattactttgaagtatttgttcatgttgcaagaagatgtattaagcagcttgcagaatatgttattgaaggaaaggaagacaaagtctacaggttaaagaagactttgtatgggttgaaacaggcaccaaaagcaagatgtccttatgagcacacattatatgtcaaatctatcgatcatggagatattctcattgtgcgtctttatgttgatgatctaatcttcactggcaacaattcaaagttgattgtagaattcaaggaggctatgataagctgttttgagatgacaaatttaggcttaatgtcctatttttttggcattgaggattcagtatcaggccattggtggttgcatgtagaaggaagtgatggaagtgaagatgttgggtattggccaaaggaaatattcactcacttacgcaaaggatcatctttgattaaatttggaggtgaagcttatggaccccctaatattggaagtcctccaatgggtactggaaaattgccaaagacttcatttcctaactcaggtttctttgcaagacttcaaattgtggattcaaaatttagggaacttgatgtgaatcctatagacatgaagtcatattgtgacaccagttcagattgctatgatttgttgtatcatggagatcaaggggctcaatttaggcaagcttttctctttggtggtcctggcggccaatgtggtgtataa

SEQ ID NO: 34744 - DNA, 387 bp, Glycine max
  Peptide Sequence Number=SeqID_151522
atggatatagtgaggtacatgttgaaggccaagaaaatgcctaagaagttctgggcagaagtagttgctaccattgtctacactttgaataggtgcccgactaagacatatgcacatgttccagatcaacttaggaagaaattggatgataaaggagaaaagtgtattttcattggccacaacacaaagtcaaaagcctacaagctttataatccagagacagaatttgattataagcagagacatgaagttgatgagaaagacatgtgggattggtctttaaagtctcaacaggagtcggtggtgatcgttgacaaccatgaagaaaatgatgaaaggctactagatccaacacctgataagccagaatcatccaagaggccatag

SEQ ID NO: 34745 - DNA, 582 bp, Glycine max
  Peptide Sequence Number=SeqID_151523
atggaggggtctcgagtctcagagtcagagggtcacccctacgtcccacgtgacttgcaccttcctggctacgttccttgcttcctttccgtctctaacattctatctgtctatgtcttctcttctctcctccttctctctctcgtctggatcttctcaggaaatgtgctcgaagtccctgctaacaatcataccacaattaagttattaaccctaattccaaagggacgccttatgaaaaccacagtcgatagactgctgatgtgctggttggccttcacaggcctcacacacacgattattgagggttattttgttttctcacctgagtttttcaaggataggaatggcttctacctggctgaagtttggaaggaatatagcaaagcggattcaaggtatgcaggaaggaatgctgcagtagttggttttgagggcccaacagctgtttttgtgggtccagcttgccttctagcagtcaaattccccctggattgtaataccctcaatcgttgccatccgctgctggaggaagatctgtgcagcattctgagttcaaggaggccagaaaaagaagcctaa

SEQ ID NO: 34746 - DNA, 666 bp, Glycine max
  Peptide Sequence Number=SeqID_151524
atggaggctcacccctacgtcccacgcgatttgcacttacccggctacgctccctgcttcctttccatgtccaacattctttccgtcttcgcctcctcctcattgctcatcgtcactctcgtctggatcttctctggaatcgaagaagacagttttaccttggtaatatgggtaataaaggtttgcattaaagatcaatgtctcacacacattattcttgagggttattttgttttctctcctgagtttttcaaggataaaactggcttctacctggctgaagtttggaaggaatatagcaaaggggattcaaggtatgcaggaagggatgcaggggtagttactgttgaaggaataacagcggttttggagggtccagctagccttctagcagtatacgctatagctactgggaagtcatatagctacatacttcagtttgccatttctttgggccagctatacggaactgctgtttattatataacagcaatcttggaaggtgataatttttctacaaactcgttttactattatgcatactacattggagcaaatgcctcctggattgtaatacccttgatcattgccatccgctgctggaggaagatctgtgcagcatttcgagttcaaggtggccagacaaaaaagcctaaagttcgttga

SEQ ID NO: 34747 - DNA, 354 bp, Glycine max
  Peptide Sequence Number=SeqID_151525
atggattccatccttgatcatcttactgctctcacaatcaatcctccttccccgaaatctctagtgattccttcatcttcagaaccctccaaacctcatatgaaactagacgtacctcattttgatggccaagacccgctaaaataccaaacaccgatgtctcatgagtatggactaattctaattaagcttcgttctcatacgtttcttgttgagcttagcctaaccgaacaacgcgcgcttcgcgccattttcgcgctaagcgcgacgcgtgctgacaaggcaaattctctccaagattcctcttactcgctaagcgagctaatgcctcccttagcggatgaatctcgctaa

SEQ ID NO: 34748 - DNA, 327 bp, Glycine max
  Peptide Sequence Number=SeqID_151526
atggttggaggagtgtgggggcgtgggtgtcatcatctacacctgagccttcatcataatctctccatctgtctagacaacatcttcatcttttgttcaagagaagaaccagatgaattaacttccacctacctgatgaaccctagaggatctcctgtcacccatgccattgatcttgtgatattctttgaactattgtaccttgtggcccagtttctttggaaagttaccatgtcatattcatattactatgtcaaaatattgtttcactcctcagaagcttcgacgagggagcaagtagagaaacagccgtgtagagctgcctag

SEQ ID NO: 34749 - DNA, 783 bp, Glycine max
  Peptide Sequence Number=SeqID_151527
atgtcttccctccaactcagtagtcaacactgggcagcactagacactactactactactctatcattctcttcatccccattgcagaagaagaagaagatggagggatctcattctcaggtctcaaagggtcatccctacgtcccacgcgacttgcatctacccggctatgttccttgcttcctctctgtctctaacatcctctccatctacgtcttctcctctttgctcatcgtcgctctcgtctggatcttctcaggacgccttaagaaaaccaaagttgatagagtgctgatgtgctggtgggtcttcactggcctcacacacatgattattgggggttattatgttttctcacctgagtttttcaaggataagtctggcttctacatggctgaagtttggaaggaatatagcaaagcggattcaaggtatgccggaaggaatgcagtggtagttacttttgagagcctaacagctgttttggtgggtccaccttgccttctagcagtatatgcaatagctactgggaagacatatagctacatactccagtttgccatttccttgggccagctatatggaagtgctttttattatataacagcaatcttggaaggtgataatttttctgtgaactcattttactattatgcatactatattggagcaaatgcctcttggattgtaataccctcgatcgttggcatccgctgctgggggaagatctgtgcagcatttcggattcaaggaggccagacaaaaaagcctaaagtccgttga

SEQ ID NO: 34750 - DNA, 759 bp, Glycine max
  Peptide Sequence Number=SeqID_151528
atgaggaggaggcgaagacggaaagaatgttggacatggaaaggaagcagggagcgtagccggacattgagtgtgtttgatcgtcgggacttgctaggggcacccagcaacattgctgattccgcggaagaagttcttctgcagcaatgcatggaagaacctttttccgcaattgatattaacaactgcggaagaaccttcttccgtgcattgtcgcggaagaagttcttctgcgggatctcatggaagaaccttcttccatgcattgccgcggaagaaccttcttccgtagttaatattacaacggtggaagaaggtttttctatgcattgttgcggaacaagttcttccgtgggatctcatggaagaaccttcttccatgcattgccgttcttctgcgggatctcatggaagaaccttcttccatgcattaccgcgaaagaaccttcttccatagttaatgttacaactgcggaagaaggttcttccatgagatctcgcggaagaagttcttccgcaggatctcatggaagaaccttctttcgtgcattgccgcggaagaaccttcttccgaatgcacggaagaaccttcgtcttctccctcgcgcaacaaacgaaacacaaatgtcgtctaacctaaggctagcatacacggcggaaggtaacaagaacgcaacaaaaaaccttcgtggaggaagcgtggagaagaaatggacgctggaggagaggaaggaaacgcacggaggagaagaaatttga

SEQ ID NO: 34751 - DNA, 591 bp, Glycine max
  Peptide Sequence Number=SeqID_151529
atgcaaaccagactgccgttcatggaaaaaacttttcaaattcataattccaacaaaggatgcccttcaggaaaagtgcctattcgcatgctaaaactgaggcaagaaatcaactataatttttcagaatcacaacctgaaaattttcgtcaatattcccggaacccctatcaacattttgctacccttgagacaactccaagtacaacctatcacggagcaagtgcatggatcagcgccagtgataatctattggtgcaagggacccaatatagcctttcccagatttggcttcaaaatggtcctctttcagaacttaacagtattcaagtcggagtcggtgttaatcccagagtatatggagacgataagccacatctcgctagcttttggacaggggataattttaaaaaaaccggatgttttgatgctatctgcccaggttttgtgcaagtgcatcctcgtattaccttaggacaaaccattgaaccctcatttacaggtggattagatggcaaagactatattgctatcaaagtgacacaggtaaatatagggaataaaaatgtatttagcttttatagggattaa

SEQ ID NO: 34752 - DNA, 1167 bp, Glycine max
  Peptide Sequence Number=SeqID_151530
atgttcttccctcctgtaggtgcatcttggttctttatgatcttctgtaacattaagtggaatgaatcttgtctcaagctgctgagtgctgatgcttttccatgttcaataagacttgctgtttattgtagcgatacttctgtgtctatgcagggggttctccgaaatcagttgcaaacggcaaatgaagagactgaaactaagaatagtgataattttgactcaaatagcgcgctggagaattctttaaatgccaaagaaaaacaaatctctgatttgaacatggaactacacaatattgaaacagccttatcaaatgaaagagatcaacacattaatgaagtcaagaaacttacggccatgctcaatgaaaaggaggctgcccttgaggagatgaagaaagaacttaaagcaaggccaacagaaaagatggttgatgatctgcgcaagaaagtgaaaattttgcaggcagtgggttataattcaatcgaggccgaagactgggaagtggctacaagtggagaagagatgagcaagatggagtctcttcttcttgataagaaccgtaaaatggaacatgaactaacacagttgaaggtcacgctttctgagaaaacgtccatactggaaacagctgaacagaagatagcagaacttacagcaaagtctaatgaacaacagaaattgatacagaagttggaagatgatatattgaagggatatagttccaattcaaaagaccgtaaagggaacttccttgatgattgggatctttcagaagctggtgggggtgaggtttctgagaatactgaccaaaggcaagtatccttagaccaagatcagagctcaatgcttaaagtgatttgcaatcaaagagatcgatttaggacccgcttgcgagagacagaagaggaaataaggcagttgaaggagaagattggggtattaacagtggaactggaaaagagcaaagttgataatgtcaaactatacgggaagattcgttatgtacaagactataatcatgagaaagtggtttctaggggttctaaaaagtatgctgaagatcttgaaagtggtttcatgtcagatgtggaatctaaatacaagaagatatatgaggatgatataaatccttttgctgcattctcaaaaaaggtgacttaa

SEQ ID NO: 34753 - DNA, 1707 bp, Glycine max
  Peptide Sequence Number=SeqID_151531
atggccaccatagatgagttgctcgacgaactgggtttagcctcttggttctctaagctcgaccttcgccagggctttcatcaaatatccatggctgtcgctgacgtcgccaaaaccgccttccgcacccaccaaggacactacgaatacaaggtaatgccgttcagtttatgtaacgctccctccacctttcaggcgaccatgaatgaacccctcaagcccttccttcgccgctttgttgccgtctttttcgacgacatcctggtgtacagcgcttctttagatgatcacgtctcccacctccgccaggtattcgattgtttatctcatgctcaattcttcctcaaggaaaccaagtgtgtcttcgcccaataccaattgacattcctcggacacatcgtctcagcccgcggtgttgcctctgacccttcgaagattgatgctatggttcagtggcccattcccacgaacacccattcacttcgcggattcctcgggttgaccggtttctaccgtaagttcgtcaagggttatgcttccctcgctgcaccactgactgcattgcttcagaaggataacttcctctggacgaaggcctctcagacagccttcgaatcccttaaacgcgccatgactcaagctcatgttctctccctacccgacttttccattccattcatcctggaaacggacgcctccggttccgccattggcgctgtcctacagcaacgaggtcatcctctggccttcttcagcaaagccctgtgccctcgcatgcagcaagcctctacgtacgtccgcgagttacacgcaatcaccaccgccgtcgtgcagaccccggagcagcagtcttacttagccaagctgttaggttacaattatgatatacaatacaagtcaggtaagtccaacattgttgcaaatgcgctttccagggtacctcatcccgaagcaagccagtactggctattatctatccctcacttcatcttcctcgatacactgcgccaacacttcaccaccagcgctcctttccaggccatgcttcaccaagttacgagtgaccccagttcacaccttgagtttgcacttcgcgacggcttgttattcttcaataatcgaatttggttggaacccgacaaccctttcgtcgataccttgattgacgaattccactctactcctatcggcggtcacctcggctttgccaagacactccatcgcgtacaagccagtttccactggaacaccctcagccgtgacgttaagcgtttcattcgacaatgcccgacatgccaacaagtcaaatacgagaccaagcgccctgcagggttactccaacctctgcctatttccagttccccatggcaagacctttcattggactttatcactggtttgcctccctcgcgtggatacacgaccatcctcgtcgtagttgatcgattcaccaaaggcgcccattttggagctctaccagatcgttacaccgcccataaggttgcactccttttctttgacatcgtcgccaaacaccacggcttccctcgtagtctcatctccgaccgcgatccaatctttgtaggccatttctggcgcgatctattccaacttagcggcaccaaattgtgtatgagcacctcgtaccatcctcaaacggatgggcagactgaagtgctaaatcgaaccttggaacaatacttgtga

SEQ ID NO: 34754 - DNA, 768 bp, Glycine max
  misc_feature (698)..(698): n is a, c, g, or t
  Peptide Sequence Number=SeqID_151532
atggcagggtggggtgacggagttggggaaagagggttgatggatatgtggaagaaagcagaagtggagtgggtactgaaattgcatggtgagggcagcgtagtccgtgatggtgggcccgaggtgtttgagccattggataccaagaactatgtccgcgccactgatgggcaaaacatgaagatcaacggtggtgtgggggcaaagttggtcacagggaagggaggtgccgttgccgacggtgacttgcagggggttggtcgtgacagtggcgagttgaaggcggagagcatcgggggtggaggtgccggaaagggcgttgaaactaatctgggcaagggtggggagggttgggagaggatggggtttgcgggttgggtgtttgggtcggcacagtccaagttcgcgcttgcgggtagtctcctctggggtgaggcggcgtacgtggttgcgggagggagggggtcgggaaaggttgaggggtcgaggccggtggacgggggcagaaggaacggcgcctgtcgtcaagtttatcttcctgcagcttggcgagggagatggcctgagggagagagatgggctggaaagcttgaacttcccgacaactgggagatcttaaagatccatcccatggcgtcggtcccgtcgaaaccggctacatcaagcttgatatggtggcgcgacgagggtggagatancggaggaggagttggagctgttcctgcatggcatccaaacagagggacaggtcgtggtgagtctgtgtga

SEQ ID NO: 34755 - DNA, 1161 bp, Glycine max
  Peptide Sequence Number=SeqID_151533
atgggaacggtttgctgctgcataaacaagtttgctactttgagcaacatcaggtcacgacccttcttctcttcacacttcccctctcaccattttccctccacaacaacttccatcaacttcagcatcgcctcttcttctttttcttctgccacatcttcattcacatgggatgatgtctttcgcatatctgaatctcaatctgccactcaagaccgctctcgctacctccaaggcttctcccacaaacttcaactatgcaatcgtgcttctgagaaacaatctgaattccttccatttgtcattgaggaccacgttgttggattcattcacaatgggtttgtggagcatttgagggactttggcgatgtatttgttttccccatagataaaaacaatggaggcccctatggtgactttgtttctttgcatccaacactgaagacagctgacgaaagaaccagcgcagttggatatgtggtagagcgtttgggagaggagcagattccaggcatacgggatgagctttaccccgtgacatcatcatttggtgcacccattttcttttcattagagcgtgctgcagctccttattttggcattaaggcttatggagtccatatgaatggctatgttgaggtggatgggcagaaacacatgtgggtagggaagagaagtgacacgaaacagacatatcctgggatgcttgatcatctagttgcaggaggactgccacacggaattgactgtcaggagaatctcataaaggaatgtgaggaggaagcaggaatacctagatctatctctgtcaaagccatacctgttggtgctatttcatatatggacattgatgggtatagatacaagagagatgttgaattctgttatgatctaaaacttccaaaaagtttcttacctaaaaatgaagatggagaagttgatagcttcaagttgatccctgttacgcaagttgcagaagtcatacgcaagacagagtttttcaagccgaattgctctcttgtaatcattgacttcctgtttcgacatgggtatttctctctttgcctactactttccatacttttttccctatacatcactcctgaatatcttggatatttggatctcctacgaaacttaagaataggagattgctcctga

SEQ ID NO: 34756 - DNA, 2160 bp, Glycine max
  Peptide Sequence Number=SeqID_151534
aacctttcatcggattaccggtctgtcactgatttcaaacttccacgaccatccgcttccaatttgtttgtttttcattctgattcgattctggttatcgccaaatttctcggttttccgcatattttggatttggaggggtttgaagaaataaccgaactttggaaggaaaaacacaaccccatgatgcaacgcgtggttgatcatgttcttggtgttgctaaagagtcattgaaggcaattacttatgagtccttaaacaatattgtgaggctaatcaatggagtatcagcccttttgttggcactactacctgggaaagctaatatacttgaaggcatccatggttgggaactcaagccaactttcaggggaccgcgatttccacgttggatggagaatggtgtatcctctttcaaccagttcatccatgaactttctgtggattctgataattcaagccttgaatactcatctggagaagaagatagtgatagattcgattgccctccatctcccgcatctcagagttctagaacctcagaagctggttttgcaaagtacaccatgtctatcactggaaataagcgcccttcgcatttacatgcacataagagggtgctaagcctcaaggatcatattatccatcgtgctactgataggagacgtggagttgtagaggatcttcatcaaggcatagagttatctatagaagctgtcttcgatgttgttcacaaggcagcacatcttcttatttcgccttcagaagcttttgggacattattcaggttgttttcatctcatgaaagtggcactaaagaagattgtgatggtgttgaggacacccccatttatagtgctacattaggagagaatgacccaacacctacacagaggaatgtaaagtatcagcctctgaatacagatgcccggacatgccaggatgtcataacagaccttgggtatccatatgaagccattcgtgtgatcactgctgatggatatattcttcttttggaaagaatacctaggcgagattcaaggaaagctgtttatcttcagcatggggtttttgattcatcaatgggttgggtatctaatggtgttgttggctctccagcttttgcagcctatgaccaagggtatgatgtgtttctggggaattttcgtggtttggtttctcgggaacatgtcaacaagaacatatcatcacgtcaatactggcggtattccatcaatgagcacgggactgaggatattcctgctatgatagataaaatccatgaagtaaaaactgctgaattgaggcttactaaacctgatatagaggaggaaactgatgatgatcagctttacaatctttgtgccatttgccatagtttgggaggagctggtatgatgatgtatgttattacacaaaggatagaagggaaaccccatagactttcaagattggttttattatcaccggctggttttcatgatgactctaatgcagttttttctatggcggagcttctattagttttactggctcctgttttgtctcttcttgtgcctgccttctatataccaaccagattttttcgtatgcttgtcaacaagttagcccgggatctgcataacctacctgcagttggaggattggttcaaactttaatgagttatgttgttggtggagacagctcaaactgggttggagttttaggattaccacattataacacaaatgacatgccgggagtatcttttcgtgttgctctccatcttgcacagatgaagcgcaccggaaggttcagaatgtttgattatgggagtgcatccgccaatatggaagtgtatggttcgcctatgcctttggacttgggtgaacactacggactcatagacattcctgttgatcttgttgctggacagaaggacaaagtgataagaccttcaatggtaaagaaacattataaattgatgaagggtgctggtgtagatgtttcatataatgagttcgaatatgcacatttggatttcaccttctcccaccgtgaagaactcttgtcttatgtaatgtcatgcttgctgcttgtggatcctaataaaaaacatcaagtgaatcaaagggttgtaaggtcaaggaggaaaggacaagttgcaactagtgggtag

SEQ ID NO: 34757 - DNA, 219 bp, Glycine max
  Peptide Sequence Number=SeqID_151535
atgtcggtgaaaattggtgacatgatggatgagatagatcataagatgtgcatactcctaagtggggtgtgggtgttttatggtgtactcataattttgtcaataatgtggtgctctatgctgaaattcaaagagaagagaattaagaaggagaaagagagagagaatttaccgtcggagtctgcagctattgattccattcaaatgtacggtgcttaa

SEQ ID NO: 34758 - DNA, 873 bp, Glycine max
  Peptide Sequence Number=SeqID_151536
atgggagaaattcaattggctgtgaggttttctggtccatcattgttgaatgttttgcaaacttatgcacaacctttgctcccaaggatgcactatttaagtccatcgtctatatttcagttggataatttgaggaaccaagctgctgccatcaccacattgaggtttaaaagggctgaaccaccactgagcaaagaggttgtggagtacatgctagacatgggggtaaatgtgtggagcatgaggagggcaagagctcagtttttcaggattgctagtcttcttaatgttttagtttctgttgctaaacagtttcgtgagatacatgcttggaagaattcaattaccacggtggttagttacttcatgtttctcattgtcattttctgtccgcaaatagttttgccatcaacattttccttcctactcctggctgggatttggggctatagaacaaggccaaggtgtccttcccatatggatatgagattgtctcaggctgacacagccagtgttgaagaactagaagaagaatttgattcctttccgtcgaaattcagtggtgaaaatttgaagaggaggtatgatcgattaagaggtgtcgcggggagggtgctagaagtgatggcagacttggcaactcaaggagagagggtgcagtctctactcagctggagggatccaagagcaacagctttgtttgttattttctgttctgtggctgtcattgtgacatatttggttcctttccgcattttggtgttcatttgggtgacttatatgttaaggcctccaaggtttcgatttgatattcctgcagtccctcaaaacttcctcaggaggatgcctgcaaaatcagatggcttgctatga

SEQ ID NO: 34759 - DNA, 1956 bp, Glycine max
  Peptide Sequence Number=SeqID_151537
atggctgaaactaagtcaaccagtaagattgtcaagaaacaggactcgaaaaaagtttctggtctcaccaatcagccttctaggaagcaacatcgcaaaggagaaaacccggtgcggttcgtaccagctcctgacccacctagtgattttggacattcaaactcctggatctgtaagaattctgcctgccgagctgttctctctaaagatgacactttttgtagaaggtgctcttgctgtatttgtcacctttttgatgataacaaggatcctagtctttggttggtatgcacatgtgaatcttctcaaggggactcctgtgggttgtcttgccatattgagtgtgctcttcaacatgaaaaagtaggagttgttgatcatggacaactgatgcaacttgatggtggttattgttgtgcatcctgcggtaaagttaccgggatacttggatgttggaagaagcagctaaatatagcaaaagatgcccggcgtgtagatgtactatgttacaggatatatttgagctacaggcttttggatggtacttcaaaatataaagaattacatgaaatggtaaaagaggcaaaggctaaactggaaactgaagttggtccagttaatggggtttctgccaagatggcacgtgggattgtcagcagactccctattgccagtgatgtacaaaaactctgctctcttgctattgagaaagctgatgaatggttggccactgttcccaatgtacatccagaatccagagagggttcacttcctgctgcatgcaaggttgtgtttgaagaggtaacagctttctcagtcaaaatcattttaattgaaatgtcaaatgcatcatcttctgtggacattaagggatacaagctctggtattacaaaagtagggaggagtcacacactaaagatcccgtttctgtgtttcccaaagctcagagaaggattttgatatccaacctccagccttgcacagaatatacatttcggattgtatcttttacagatacgagtgacctgggtcattctgaggccaagtgtttcaccaagagcattgagatattggaaaagaattcatcttcatcagttgccatgaataaaaaaaaggagaaccttcaaactgaatgcaattcttctggctccgaaatggagcccaatcccacaatggaagactctggatttaaggttcgagaccttggaaaaattttgcatctttcttgggctcaagaacaaggctgctttgaggagttttgctgcgctgacaagagaaattgctgtgggaaaagtgaaacaatcaagcctaccaatctacaagagcagttgccttcagtttcacgcgaccttgatctaaatgttgtttcggtgcctgatttaaatgaagagcttacacctctgttcgagtcttctagggatgaagataatggttgcactttgcagcaggctgttgaggcagatgatgatgctgcttctcatgatttagagaaaaatttagcaatatcacacggtagtggtggttcccaaacttggaaccatggaccaaccggagaagttccagcagttgactctcgcggagatgcatgtaggaaaaggatggcaagcaccaatgaagagacacatgattgcgacagcaccttgataaatgattctcctttacgcgcatctgatggtccattctccttagacgagaactttgagtattgtgtgaaagtaattcgctggctagaatgccagggtcatatcaagcaggagtttaggttgaaattgctgacatggtttagtttgaggtcgacagaacaagaacgtagggtggtaaatactttcattcaaactctgattgatgatccaagtagtttggcagggcaactagttgactcattttctgatattatatccaacaagaggccaagaaatgggctctcttccaataaggctgtgtcatcaagttaa

SEQ ID NO: 34760 - DNA, 1326 bp, Glycine max
  Peptide Sequence Number=SeqID_151538
atggcaaatcaaaaccagaaccagaatcagaaccaaaaccaaaagaagaacaaagaggatttctctctgaaggcgacaactccaaacatcagtgctggaagagcgataagtggtgattggctcccaactgcatttgacttggttgagaaaatgcagtttctgtttgtcagggtggtgaaggccaaagacttgcctgaaaaaagtgaatctcaaccttgtaacccttttgtggaagtgaatgttggaagcttcacaggaacaaccagatgcatggagaaaaccaccaccccagaatggaaccaagtctttgcttttgccaaggagaggattcaagtactagttttggagattgtggtgaagaacaagggtgaaaatggtgaccctaatgataatggtgaccttgatgagttcgtgggacgtgctgcattcacaattggtgatgttccaatgagggttcctcccgatagccccttggcgccgcaatggtacaagcttgagaatcaaaatggggtgaagcttcaaggagagttgatggtttctgtttggatgggaactcaggcggatgaagctttttctgaggcttggcattcagatgcatcagaggctagtggtgaaaacattgctcacactcgttccaaggtatatatttctcctaggctttggtatcttagaattaatgtgattcaagcccaggatttgttgctaaaaaacaagagtggcaataataactcggaaattttcatccaaggtgttttggggaacttggctttgaggagccgttctataaagtgtagtacaagcccctcgtggaatgaggatttgatgtttgttgtggcagaaccctttgatgattgcttgtttgtgagcattgagcaggggaataacttcaagcacgaaagcttggcaatttgtgctgttcctttgaagaatgtggagcagagaattgatgccactccaccagctagtgtgtggtacaatcttcacaagccaaaggaaaaggagggagaagagcaggaggttaatttttccagtaaacttaacatgaggatctctttagatggagggtaccatgttcttgatgaggccactcactacaccagtgatgtaaggccatcatctaagtatttgtgcaatcccagtattggtgttcttgaattgggaatcctgaatgctgtggggctctctccaatgagcaaggaaaatcggaccaatgcgttttgtgtagctaagtacggtccaaagtgggtgaggacaaggactattgtagatagtctttctcccaaatggaatgagcaatatacatgggaagtgtttgatccttgcact

SEQ ID NO: 34761 - DNA, 1183 bp, Glycine max
  Peptide Sequence Number=SeqID_151539
cttgtcaatgggttcgtgatgggggcctttccacctaacgtgacagacactaccattgttcatattcgtaaggtggataatcctagaggtatgaaggatcttagatccatactttgtgagatgtcgtatacaagattttatctaaaggttcttgttattaggatgagggaggttattgataaatgtgtatctgaggaacaatttggttttgtgcctgggagatcaataatggataatgcattggtgcttgttgaggatgttggagggagagaaatctttcataggatgaaggagaatgagaccctatttataaagtatattcttgatgaatatgttgttgcttctagtcagttgattaatctccagatgttagaagttatgtttagcaacaatgttgaccccaatatgaacaatttggttatatccatccttggggtgactaaagggctaggcaggggaaagtacttgggattccttactggtatggaaaatgtgaaggtaaatgttcttatagacaatccgttggatgtttggaatgtacctcttattaatcacttatttgagcctggggatatgcaagctttcttgcgagttccaatagtggatgtccccagaggagatatgcgtatttgggatcattctagctatggagggtacatgatgagaagtgcctataaactgatcttgccaaaactcacaaattttgatatgttacagattgtctcccaaccaaggccagactttgctccaggggaattcattggccttcaatttgtcctccatgcgagcataatggagactacctttcacatgtttttttcatgcctcacaaatgaagttgagtatggacaaacacaaatgctttcctatgttgctttgagcatttggcgaagaagaaatgatatgttgtgggagatgatagatgtctctgatttttctgttgttcaccatggagatgatttattccatgggtgggccaaagctaaactgaaatcaagcttctcgaatgttgaaaccggccaagcttcaattgctaagtggtttcccccaccctcaagacatgtcaagtgcaacattgatattgaagaacttcgattatggacattaaggaaggagaaacatgggtctaataacgattatgaagtttgtcatctcccttcgtttgcaacacatgaagttcgag

SEQ ID NO: 34762 - DNA, 1902 bp, Glycine max
  Peptide Sequence Number=SeqID_151540
atggctaagtttacttcacaagaagttagtgcccttcaagaaggagggaatcagcgtgcaaaagaaatttattttaaagaatgggatgcactacgtcattctttccctgatagcaggatccatcattcatttattcttattagcatggttggtgccagtaatgttgacaggctccgaaactttattaaacatgtttatgtggatagaagattcactggagacaagaccaacgacaaaccacaaagaggcaagccgggtgacaaagatgatttttatcaaggaggatctataagtcctcattatgaggacacatatgaacgtcgttatagtgacagatctagtccaggtggaagaagtcctgaatatgataaagacagtaggcaatatggtgatcataagagaagtcctggtcgtcctccaataattaatgattggcgccgtgaagaacgtagattatcagatggagattataagttggaaagccaatctcctgagcgagccaaagatgtggatacttcaagcccacctgtggtccgacctgttagagatattttgggagaaaatgtagtgcctcttcggataagtgaaccacccaaaacaaacagtggaagacctgctgataggtcagcaccaacacagagaactgcatcttccagtagcttggcttctggcaatgaaaacccattagatgtaaagcttgagactactaagagccttattgattttgatgctgatcctgaacctccagtagctccatcaattcctcaagcccaacaaactactgtgcttcaacctgttgtgcagccagcaaactctagtaatgacaattgggcctcttttgatgttgctcctgcaacaaaagcaactccaagctcctcaaatttaagtccacttgaatcaatgttgtcccaattgtctgtgccagcatctttacctgctcaagtttctggagtccaaggacctattccagcatcatctcttacttctacttctggagctgcaagtgttagcggtttctcagctttcccacccagcaatgcttcagtaccgtctcctggattgacatcagtgtcacctcttaataatgcaggacagtgggccaatttgcaacagcagcaaccatttttccctgttgctgttagtcagtctagtacacaacaatttataccaccattaggtggaacagcaaataatcagccatggaatgtaccttctgcacccacagtgcaagggcatccaagcacaccaatgccacatacataccctcatgcctcaaagcctgccaatgagactatatccggtgttgtttcacaacctcctgttgcagaagttagagcaagtggaaggaaagaacttcccgaggatctgttcactgtaaaatattcttccttccctgctccagtcctaggttggcaaatgggtgttccccatggcatgggtatctcaatgcaatacaataatgtgcctgtgccaagttttccacagccatcaaagtcaacaaatccgtttgatgtcagcagtgaaccaactgcaaatcaagccccaacttttccttccatgtcatccttgcaaggtgccctgcctagtgtaccacctgctggtgcagtgcacccttcaagcatgggtaatccaacacatggctggactcctcccccagcatcatcatttctgcctgcacaagcacaaatgcatgcaactgcattgggaccgatgaaaatctcaggggcatatatggagcaacaaattccgactaacatgccaatgccaaggcaagaagttgggaattttggtaaccaaggagctgtttttggcttgtcaaatccaaatcagcagctgatcggtaggttatcaaacactcccacctctaactcatttcctacaggagggaacccattcggataa

SEQ ID NO: 34763 - DNA, 882 bp, Glycine max
  Peptide Sequence Number=SeqID_151541
atggaaattgaggctgctctgtgcatacccggccgagagtttattttaaatgctgaaggtcaccctgggaagatcctcagaaaagatctaaccactcttgctcaggtatggagtgttctctcatactccaacctggttccgacttcccacacctcggatttgactgtggatagagctaggtccagaggagtcgtttccgacaacttagcctttgaatgtttgagctcggtcattaatttggcctacataaggaaaaactgttggaacccgaatgatccaacagttattattagggggaccagaagaccaagggcaaggccagctgaggttccttctacatcagtagctcctcatccagcttctacatcagcagctcctcctccagcacatatgacagcagctccttataccctacctcttgcagattttcaacgttttgaggccatgcttcggagcatacatcaggggcaaattattttactacaaagcctacaactggtagcgcctctagactccatcctgacgatagagcaatttaatgaatgggtagcctggccagggactcagcctcctcttcatagggaagatgaagatctcgccgctcaggtaccccatcagtcagaggatgagtcattagagtcttccactcctgagcccttgataaggaaaagaagggtagttgtaacccaggaagctgtagccacctctgaaaagtctcttgaagctacttcggagcttctggcactagtggcagataccacttctccacaacaggcagcaaacccttccacgcctgaggatcaaaccaccccagacctatctctgaacacctctcctgtagctactcatgtacttcatttgttggaagaggaggagggttag

SEQ ID NO: 34764 - DNA, 174 bp, Glycine max
  Peptide Sequence Number=SeqID_151542
atggtgggtggagggcaattaaaaatatacacatcgttatcttacaacccacttccaccggctaacagcatgactgattggttggcagattctgctcataatgcttcgttgggagtgaatgcctgggcttctccccctgcgggttgttcgttaaacgatactgttattgaatga

SEQ ID NO: 34765 - DNA, 1350 bp, Glycine max
  Peptide Sequence Number=SeqID_151543
atggctgctcctcatagtgagggtgtaatggaaggttggctctatatatttgcctccaataggatagggttgcattgctcacgcaagagatactttattctcaaagaaagttttcttagaagcttcaaagataaacccgtttccctgatgaaggagccaaatagaagtgcaataattgactccagcgttcgggtaattgacaatggaagagagactatcaacaaaaaagtattcttcaccttcacagtatataatgcttcaaatcaaatagatcagcttaagttgggagcaagtagttcagaagaagctgccaaatggatacgtttattgaaggatgctgcattgaaggagaattcaaactcagaattgaatcttgtgaatacttcaaagaaaaagcattcatcattgagaatgggaggctcaaaaaggacaaattggaaacactatgttgaatggaattttcagtcatgtatatacactgaagcaatgatctctgatgttattgctccctcccaatggaagatttttagtattaacaatggactaaggatgttcaaagaagcaagggattgggattcccatggaaataaatggggcactcacccagtaatgatggcagtaggtgtagttgatggaacttctgaagaaattttccatactcttatgtctctggggtcatcaagatcagaatgggacttttgtacataccaaggcagtgtggtagaccacattgatgatcatactgatattattcatgtgaagctgtacaatgattggctaccatggggcatgaaaccacgagattttctgctacgacggtattggagaagagaggataatggcacatatggtggaggatttctagtaactcctattaacaaaggaaagcagtctcttgtaaaacacatgcttgctattgattggaagttatggaaattgtatctaagctcctcatctgctagattctcaaccattcgcatgcttgagagagttgcagcactaagagagttttttaaggctaaagctggaaattgttcctctgaacctattgaaatagcagtagatactaagaatgaagttacagaagagaacagcaaagccgtggaaggtgtattggaaggagaggtcgatggagaaacttctcgccgtacaagtttaatgggattggatgattctgatgaattctttgatgtttctgaaccaaagaactatgatgaatttgagaatgagtggcactctgccccgctttcagaacagcactctcagagactaaaatggtatttagctgtatgtaaagacaaaaacagagaaagttcaagaggaaaaaagacaaagggattgaaagaaaag

SEQ ID NO: 34766 - DNA, 471 bp, Glycine max
  Peptide Sequence Number=SeqID_151544
atgcggttcagtgccgctgaagagtgtggtgcttttgcagcgaagaggataagcaaagaacggaaaaacatgaacataattgaaacacctggaaaaaaaaagagtaatggaaatgatgaaacaaaacctacaagataccaagtagtgtcttcattcatgtgtaagcatatgattgtggcatgcacaaaggaatcttgtgacacaacaagtccaatggttgcattacattttgtggacatgaggaaaaggatgggagagcctttctcaaaaggtgccattggaaacttgttatggccagcaatggttctcttggaggatgtcgacaaaaacactaacattagagatttagttagagttttagaagaagggcttggaaagctcactaaggaattgtttttgaaggtgcaaaatgatcctagatttttggggagtgatgagtgtgcactaatgcttgaaggtattgccacttaa

SEQ ID NO: 34767 - DNA, 318 bp, Glycine max
  Peptide Sequence Number=SeqID_151545
atgtttggtttgtccgcttctttgaagtcctctacctccttcgttcagtgccgtcgatcatcgctacaagtggaagtaagcactgtcgttagctccatgaggatcttctcttccatggcgagattaggagtcgccgatgagattcacggagccaaagttgttgatggcgcgaccgatggtttgaagaagcatggtgatgagtttgttggaaggggggaggttgcgaaggttggaccaggaaaggaactagaggaggaagtggtagcgatcgaaagatgtcagcaagggcagctagggagaggtggttgtcgacagtga

SEQ ID NO: 34768 - DNA, 267 bp, Glycine max
  Peptide Sequence Number=SeqID_151546
atgatgattgggagatgggctgcacaggggccaaataatggttgccacaataaattagaggtgttcaaaggttggggtgggaagaaattccaaaaggctatacacaaggttttaaatatcggtcacggtcgtcacggtcacattgtgaatatctgcacttgcataggagataaaccttcactggagaagcctcacaacacacatgcagttcaagaaaactgtggaagatcacgaaaaccattcccaaagcaacaccctacggaatag

SEQ ID NO: 34769 - DNA, 1254 bp, Glycine max
  Peptide Sequence Number=SeqID_151547
atggagactggtgaaaacaacagtactagtagtagtaaccaaagttgtgcagtgatgaaggattctaaatggtacactcaattcagaaatgtatccaatccttggatggcaagatatgtgtatggcttgattttcctagtggccaatctgttggcatgggctgcccgtgacgaactttctagtcttagtgctttaacagaaatgaaggcttcaattctaacgtatattgaacccgcagggttaaagggatgcaaggttggaaaaaactgtttgggtgcagatggtgttctgcgtttattttatatgataatgttttggtcgactgctggcacttctaaattgaaggaaggcagagatgaatggcactctggatggtggttagtgaagattgttgtcttggtccttgtgacaatattcccatttttacttccttctgagttgattgatctctatggacagattgcacattttggtgctggggttttcctcctaattcaactaataagcataatcagcttcattaactggttgactgattgttttggctctgaaaaatatgcagaaagatgccaaatccaggtgatgttatttgcaactatttcatattttatctgcttggtggggatcattttgatgtacatttggtatgcgccacaaccatcttgcctcctcaacattttcttcatcacttggaccctagtgcttctccaactcatgacaagcgtatctcttcacccaaaagtgaatgctggcattttaagtccagggttgatggggctctatgttgtcttcctttgctggtgtgcaattagaagtgaacctgagggagctgaatgcatcaggaagtcagaatctgcaaacaaaacagactggcaaagcatcattagctttgttgttgcaatactagcacttgttgttgcaacattttctaccggcatagattccaaatgctttcaggttctccaatgcatatctaacaaatccttacagttcaggaagagtgatccaccagcagaagatgatgttccatatggttatggtttcttccacttcgtttttgccacaggagcaatgtactttgcaatgctattgatcggatggaatagtcatcattctatgagaaaatggacaattgatgtgggatggaccagtgcatgggtcagaatagtaaatgaatggttggcagtttgtgtctacttatggatgctggtagctccaatcatatggaagagtagacatgctgattctacatga

SEQ ID NO: 34770 - DNA, 681 bp, Glycine max
  Peptide Sequence Number=SeqID_151548
atggaagttcagaagaagggatacatggatttacaagagacttccagcagggataatagtgagccatgcccttatggagccactcttcaaaaagattcaagctgtaatttaccatgcagttgggatgaatctgatgcatctttattttatattcgtggaaaaacttatttaaaagataagaaaaaggtcaaggcagaaagaaccttgatgcaaatggttggtgcagattggattcaatctaactcgcgacaagatgatctatgcagtcgtcctggtagcatagttcaggtgcctggaagttccttgtattccattggactctattacatgatgaaaactcctttggaggacaatcctttattgcatagctttgttcatggagatgatgcttacagaaactcaagatttaagctaataccatatatttttaagggaccatggatagtcaagcagagtgttggaaacaagccatctttgctaggcaaagctctagacatacgttatattcgtgggagaaactatctagaggtggatatcaatattggatcttcaactgttgcaaggggggtggtcaacctagttcttggatacttaaacaatttggtcgtaggaatggcatttctgatacagataaccagggatacaggtccaatttctgtggaggcccactttgaattgtaa

SEQ ID NO: 34771 - DNA, 468 bp, Glycine max
  Peptide Sequence Number=SeqID_151549
atgatagatccaggttcacatctcatgaagcttgggagagatatacagatattatggtgcctaggaaatgtagtagtttattacactgagtttgacgagttcaaggaggaactcgagagaagacactgggatgagaagttgactgattttgctgacaacaacatagacattgctattgtgaaggaattttatgccaacctctatgaccccgaggataaatcacctaagcaggtgacggtgagaggtcatctagtgaaatttgatgaggataccttgaacacatttctgaagaccccgataattttggaggagggggagaatttgtgtacttattccaggtttgcactcctaaggcctgatcctcaggagttggatgctaagctctgtatcccagggaggggattcgagctaaatgctgatgggcagccgttgaagatactaaggaagaacatgaccaccttagcttag

SEQ ID NO: 34772 - DNA, 342 bp, Glycine max
  Peptide Sequence Number=SeqID_151550
gagcgtgttgttgaggatcttcctacggctgtagaggaattgaacaaggagcaacaagaagcacctgttgaagaagttgttactgatgttgagggtttttcaggtgaaccccatgacacatcagttatgagagattttgaacatcacattgctctgagagtttggaatggagaggaacgtcctgagctaaagctatcttcccatggaaggaagatgactaagttcgggaggcctgctccagagattgaaggccttatggctgccagcagacgaagtcctttgatcgcatgttccctagataccggcgatcgaggactaatgtctacttttgtggaacactga

SEQ ID NO: 34773 - DNA, 252 bp, Glycine max
  Peptide Sequence Number=SeqID_151551
atgaaccctcccgtgcttatgccgccggtgcccaggagacctctcatcttatacatgacgattttagaggagtcgatatggtgcatgctggggcaacatgatgagtctgggaaaagggagcaagccgtctactacttgagtaagaagttcacggcctgtgagatgaactactccctgctggaaaggacatgttgtgctttagcctgggcgtcccaccgtttaagacagtacatgatgagtgtcataccctaa

SEQ ID NO: 34774 - DNA, 462 bp, Glycine max
  Peptide Sequence Number=SeqID_151552
atggacgcagattctcagctagtgtacgagatgtgtcgaacatggacacaggagttcccacagttgactttggttgtgaatgaagcactgaagactgggcgaatcacaccatcaaacagatttggttcaagacttcaacccctcgcggaggccaccagtgcacgacgagcggtgcacggtttgtggtggcgcgttcagacgatgccaacaaacatgagcagaaacaccagagacttctattctggtaaaagccctacgagattgtcgtcttcgaggccgtgctggttccaattatggcaacaaacacgagcaggaacaccagagagatctatgaacagatctgtcacctctaaagctccatcaagaagatttgttgcctctagatctctcttgcagtgtttggggaggaagctgaggggcttggagaatgagaagaggaggatgatggaagagctgaagtga

SEQ ID NO: 34775 - DNA, 335 bp, Glycine max
  Peptide Sequence Number=SeqID_151553
atgaatgaaagttgtttgagccctgcgtgtgaggaagacgaggaacaattcatacaatttgcttcaaaaagaagtcgaccagatgaaaacgagaagtttttttgtccatgcataaattgtttgaacgggagacggaaaaaagtcaatgacatacgggaccatctattgtgtgatggaattcagaggaattatacgacgtggatatggcatggtgaaatgacagacatgcagagtgggcctcaatctgaaccatttgatgtagaaatgggagatcacttggaggatatgattcgtgaccttggacaagagtgttttcaacaagcacatgcccctat

SEQ ID NO: 34776 - DNA, 680 bp, Glycine max
  Peptide Sequence Number=SeqID_151554
atggctcgcatgaaggaaactggtcaaatgacgtctgaggctgcaaaggaaattgcaaaaaggattgtaagattccttggaggagcaggcctcacagggaagctttttcgcccatggacgtcaaaatgtactgactattgccattgggcaatagagcaccttggtcgtgtccgtgctcctggagccggtgtcacgatcaaacattactttggaccggcttcaaagggctcttgcacctcttcgtccatggctaccaaagacctagagcagctgacacaaaagatcagagaccagctggagatgcaatcacaaggactcgcactacctcttgaggctgaggttggtccttttactgttcgtgccagcacaaaggaaagttgtgttgatccctcaggacaggacccaaaaatgggtgactcgaaaaaatttaggttgtatgtcaatgatagtccttcccaactcgttgctcttggaagagtttatgaggggtcgacgaccatccacaatgcacttaacaccttccttgcttggccgacacatcttgtaaagcctttttcagaacaagataaacaggaagttgagggaccaacaaagcctatagatatgtcggatcctgacgttgatccctcgtacctgatgacattgaccattccgcagcttttcctcaagtcgttgcacat

SEQ ID NO: 34777 - DNA, 228 bp, Glycine max
  Peptide Sequence Number=SeqID_151555
atgcttgtttttgagggttccgaaggaagcaaagaaggttcaaggaccaacctttatacaaggacaaaaatattttccatcgtcatccagtcgacttctttcaaaggcggattccaagaactattccatgtcttcctcatacatagggcttatgcgacttgcgttcgtccaacttcgatccatctaattaataactttgtgatactcacaaagtttttcgatgcataa

SEQ ID NO: 34778 - DNA, 1307 bp, Glycine max
  Peptide Sequence Number=SeqID_151556
tgaccttgggtactagtaccctcaccttcagaggcctacacaccctcgacttcagagggctacacgccctcgccttcagaggactacacgtcctcgccttcagaggactacaggtcctggcctttagaggactacacgtcctcaccttaagagggctaaagggctacacgccctcgccttcagaggactacacgtcctcaccttcagagggctacacgccctcgccttcagaggactacacgtcctcgccttcagagggctgcatgccctcgctttcagagggctacatgcccttaccttcagaggactacacgtcctcgccttcagaaggctacacgccctcgccttcagagggttacatgctctcaccttcagagggctacacgccctcaccttcagaggactacacgtcctcaccatcagagggtagtacgccctcgccatcagagggctacacgccctcgccttcagatggctacataccctcgccttcagaggactacacgtcctcgccttccctcgccttaagagggctgcacgtcctcgccttcagaggactacacgtcctcaccttaagagggctacataccctcaccttcagagggctacaccacctcgccttcagaggactacatgtcctcaccttcagagggctacacgccctcgccttcagaggactacacgttctcgccttcagagggttgcacaccctcactttcagagggctacatgcccttaccttcagaggactacacgtcctcgccttcagagggttacacgctctcaccttcagagggctacacgccctcaccttcagagggctacacgcccttaccttcagaggactacacgtcctcgccttcagagggttacacgctctcaccttcagagggctacacgccctcaccttcagagggttgtacgccctcgccttcagaggactacacatcttcaccttcagagggctgcacgccctcatcttcagagggctacacgccctccccttcagaggactacacgtcctcgccatcagagggttgcacgcccttgccttgagagggctacacgctctcacattcagagggctacacgcccttaccttcagaggactacacgtcctcgccatcggagggctgcacgccctcgccttcagagggctacacatcctcgccatcagagggctgcacgccctcgcctttagaacgctacacgctctcacctttagagggctacacgccctcactttcagaggactacacgtcctcgccttcagagggctacacgccctcactttcagaggaatacac

SEQ ID NO: 34779 - DNA, 411 bp, Glycine max
  Peptide Sequence Number=SeqID_151557
atgtcaaagaattgggtgttgaaaaagcacaacaagactttctgtgaatggtttaaagatacaatctttgcagatgagaatgcttcaaaaacattaagaaagctagcatatgggcctaaaagaaatgttataacctggcaaggatacaacatgtattcattttacacaaaagcacaagatgacaaaagtacaatgcagaatagcggggtcaccctaagggctgaagctcaacacttcacaactttagttttagcaacctctaataaatctgagatttataaggaggaagcacagaatacagcacagaagcataaaccaaagagggtggagagtgtcaatgctgatgcagaagcctttggtgatcactggaaagttcagattggtctatgcattctgaagctgaagcactag

SEQ ID NO: 34780 - DNA, 741 bp, Glycine max
  Peptide Sequence Number=SeqID_151558
atgtgggatgctatcgtgttcgtggtgtttaagcaagacttccccttgtacataaagcacgaagatctgtctgaaataccagacagtggtcaatgtctcagcatctctgttatacagttgtggattctgcatccgactaagacaagtatgcgagcaggaaattctgatgtatatggattcctcgagccacagtccattcatagatctgggcaatcacaatttgaatcagaaagttacatgaagagttggatgcagaattcaaaatgtgatgtctaccttcgagcctacctgaatggcgatcactggcaaatggtcatcattttgcctaaggaaaatcttgttgtctggttttgttccttgcataacaggccatacaactaccttaaaagaataattaacaggtcagtgttgtttttcaatacatttgcattagtattactcaacaacatcaatattttaatgttctttgtattcaacactgctttgaaaggacttgatgatactccacaacctaaatctaaggctggtgctaggtggattgtttttaagtgtaatagacaaaaaggtagcactgagtgtggctactacgtcatgcactggatgtccactataatcttaggaagtttcaggaataattgtgaaacgtattttaatgatgttagtccattggaagcaaagagattgaaggcgcttcgcatccagtgggcacaatattatctcaaagttagaaatcaaacttag

SEQ ID NO: 34781 - DNA, 575 bp, Glycine max
  Peptide Sequence Number=SeqID_151559
atgggtgactcagacaaatgtgggttgtatgtcaatgacaatcctcctcaactgattactcttggaagggtttatgaggggtcgatgaccatccacaatgttcctttgggcaattatcaagtgaaggtcggtgttgaggaagttcgagatgctaatgttcgccttcctgtaccgactcaaaaggataaaaagggagctaagggatcgacgaaacttgtagatatgtcggatcctaacgtcgatcccttcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 34782 - DNA, 195 bp, Glycine max
  Peptide Sequence Number=SeqID_151560
atggcctccatgtcggccttcatctgctcttgcacctcctcttcttcacccattactctagctctagcacaggacatggggttgaatcaatttagatttttcaacatggtccatgacatcttggtcaaggtgaaactggaagtaacaaggacatcaccagtcctaaatgtgtttggcagtagacaaagcagtgat

SEQ ID NO: 34783 - DNA, 166 bp, Glycine max
  Peptide Sequence Number=SeqID_151561
atgttggatgagtacaatatccatgcaaaaagttttagaatggccaaggacagattggcagatactcaagtcgataatgtaaaattgagattgatagctacacgtgagaaagatggtcgtacatacaatctcccaaatgattctgaagttgctgctctgattgttg

SEQ ID NO: 34784 - DNA, 405 bp, Glycine max
  Peptide Sequence Number=SeqID_151562
aggctgctagggctgagacagggcagtgttgtggaccgtacgtatgcctgtaatgggtacatgatatatacgagaaccgatgccaggaaggcctttcgtgacctcagtcagaccgggaggtacacctggggagtggctactctggtgcatatgtacgaccagctcaacgatgccagccgacagcttggtggttacatcacactactgcagtgctggatttacgagcactttccctcaatcgcggagtccactactgatcaggactacggtgaggattccccgcatgcgtgtagatggattgcgacgaagaagactgtgaagagcatacatacaccggcatacagggagcggctagaccgactccagattctggatgtctgttggatcccatatggggagcactga

SEQ ID NO: 34785 - DNA, 327 bp, Glycine max
  Peptide Sequence Number=SeqID_151563
atggggttaactctacccttcatccctagcaattttccatcagcaatttcagcatataaacatcacaagcatcatcatacaagccctaaacagaatggaaacctagcaaaactacccatcatatctcccaaagccccatacccacgaaaatcaagtgagaaagaagtctacccaaacctgaaatttcgaagtcccacacgtagagatgcgcttcacgactctaaaaatgctttcctttcgcgacttggagcagaaatggtgaccaaaggttggagctttgttgggcaacaatggtggatgagagaaaagaagaagaaggctgcgtga

SEQ ID NO: 34786 - DNA, 252 bp, Glycine max
  Peptide Sequence Number=SeqID_151564
atgcctcgtactcatgacgcgatcctgtattacaacgggaaatggaacatgccaccgcagaacaaatttgttggatgcgcgttcacaggaaaaaatcctaagaaatttcaaattccttcaacatgtaccatcgatgaattgaagaatttaatcaagcaagttgcacctaaagggattccccctcttggaattcacgaatcacaaacgttgacggaaccggggaacgggactatttttttttggattctttga

SEQ ID NO: 34787 - DNA, 283 bp, Glycine max
  Peptide Sequence Number=SeqID_151565
ggggcaagtgcagatccatgagtgtctctaccagctcagcctcagtcagcagagccagggtttcgctccttttgcgtgccctattccaaatcagtttagggctgaggtcgcatggcccggagattggtccgaggaccagacagaggaggcacctgcaggagctcccgatggtgcagaggacgcccgcatggatgaggagatgacagatttactcgatttcttgggaggaagtgtgacatcctggaaatttctacccggaatttttgtaaacggtgtattttga

SEQ ID NO: 34788 - DNA, 297 bp, Glycine max
  Peptide Sequence Number=SeqID_151566
atgaacgaagaaggagaggagaatgaagaaaagagaggtggggtgggaaggaacttgatgccggtgaatgaaagtccaaacagggtggttgagctgagcgagaaaccaaaaggagttattagaggacctggtagaagacactccaatgctatcaattcttattctagttgtgaggagagagattgggcgaaggtgatgcaatcctcccaaggaggggacccatcactagagccatggctaggagactctaggaagattgggccagggatgcaggagaagaccttaggattctcatga

SEQ ID NO: 34789 - DNA, 318 bp, Glycine max
  Peptide Sequence Number=SeqID_151567
atgggtgcaccaaagtccgtgaaatctaccgagtgtgaaccttcaatgtgggagcatgtcgatgaaatgaacataatggttggtagttcaagaactccaactatggctcgcaagactatagagttggaccttctttccacttacgggtttcgtgccagcaaagccctgtctcatttccattggacttgtagatggaaatcactttatccagaagctacttcacacccgaaacccgctcatgacaaaggcattacaatcaacgcatacaagctttcaactcaatacaatttcaatcatttagagaatcccaatatatag

SEQ ID NO: 34790 - DNA, 1160 bp, Glycine max
  Peptide Sequence Number=SeqID_151568
atgtaccatggtgcatctgaagtgaatgaggcccaggggttgtcaccagattcagggaaaattggaacacctactcatgcttctccatccttgggcaattcattgaaccaggtcaatgtgtgttcttctaatgagcaaggattatccaaagcatcaaatgttgcttttatttcgatacctcccatgcatatcaatgagcaagtggaacctggtgatttgcgaattttgccaatgtgtggtggaggtattgattcaaattcattttctgagcccactggttgcagagggtcatctggaattaataaaaacaaggactcagtaccttgtggtcaaattgggctttgtggccaggaaaaatattttagtccacactggtctgtagaggctgttgagaaggaattagaggagggtgatgtttttaaagctctctttcatgtcaatgctcacaatagactcgaggcatactgcaaaattgatggaatgccaactgatgttttcattggtgggattccagcccagaatagagctgtggaaggtgatgtcgttgcagtcaagtttgatcccttgccattgtggacaaaaatgaaaggaccaaacgggtcttgtaacaacactgcaacaccagaaggttgcaaccttacagaagataaagaagtgggcggtaatatttgtaaagggaaagctaaagtagatgctgagtatgagtctgctcatggcagaagctatcctggtcaaaacaaggaggatgctgatcaaaactccttgtataaaagttatccttttactgaaacaacaatggtctatgatgatattacctcccggggttctactaatcatttagatctacatggaatggccaaccatgacagcattaatggtcatcactgtgctgctcctaattccttaaagatcaattcttgtagtgggcagagcaatgcagtggaaaagatgtgtttgttggttaactctttcccttctaaaagaccaactggcagggtggttgctattattgagagatctccacgtcgagagggtattgttggtcacattaatgtgaagcagtgggtttctttcagggacacaagcaaaaaggatgtgaagaagaataagaatttgatttctgagcatgaatacatccaactgataccaactgatccaaa

SEQ ID NO: 34791 - DNA, 420 bp, Glycine max
  Peptide Sequence Number=SeqID_151569
atggtggatggcagaacgtggcgaaaaactgaaatttcgccatataaacacaccattgtgccttatggcacaaccatggcggccctcccttcacaaattgcctatggtggtgttgtcaaatcaaagcgatcaatatggcggcttaaaacaatcactgattttttctgggccattgttaactacataggcttgttttttgcaactatgttctcgatggaaaagtcagatgcctacagaaaaggttctgttggtaagaaatgggatggcggtgctcctggaggaggtcctggtggtggtggcggcggtggtggcggtccccgaggtcctcctcgtgggggtcttgacaatgttcgtgggctagatagtataaggggacgtgatcatagttcacttcctgcctgcggttcctgctgtggctga

SEQ ID NO: 34792 - DNA, 1611 bp, Glycine max
  Peptide Sequence Number=SeqID_151570
atgctgcctgcattattgtcagagaatatcggttcacttagtcctggagtggatcggcttgcagtatccatgctcctggatataaatgttgcaggagatgttgtagaccgttggattggtcgtactgtcatacagtcttgttgtaagctttcatatgaacatgctcaggacatcattgacaaggcttttgattttgagggttcaaatttcattgaagatggctatcctagagtgtatggccattttgaatggcctgatgttattatgtctttggagagtctttatgaaatttcaaatgtcttgaaacagaagaggtttactgatggggctctacggcttgaaaaccccaaagttgttatcttgtttgatgaaaatggagttccttacgatagtaggctttctgaaaggaaagaatcaaattttcttgttgaggaatatatgcttttggccaatagaattgcagctgaagtcatatgtagagcttatcctgatggtgcattgttgaggaggcatcctgaacctaatatgcggaagctgagagagttcatggcattttgtcagaaacatggtttagaattgaacacgtcttcatctggtgagttacattggtcgttagagcagatcagggaaaagcttaagggtgatcctgtgctttacaatatacttatttcttatgctacaaggccaatgcagttggcatcttacttctgtagtggagatttaaaggacagtgaaaatgaatggggtcattatgctttggccgtcccattttacactcatttcacatcacctctgcgtcggtatccagatattattgttcaccggacactacttgctactatagaggctgaggagttgtatatgaagcatcagaaggctttgcagggttccaaggaagtaaaagtgcaaaaaagatgtttcacaggcattaattttgataaaagtgctgcagaatccacggaaggtagggaagcactgtcagctgcagctgtgaagcatagtgttccatgtgccgaaacacttgcagatattgctacttattgcaatgggagaaagctagctagtagaaacgttaaggatgcctgtgataaactttacatatggtttctcctgaagaaaaaggaggttttattgtcagaagcaagaatactgggactaggcccaagattcatgtcaatttatattcaaaagctagctattgagcgacgcatatattatgatgaagttcaaggtttgactgtggagtggcttgagacaacatccactttggtgcttagcatgtctactaataagtgtgcatataggaggggctgccctaacaagttgaggccatttgaagaagttgcattgcttacttgtccatataacctggattttaccacggataattctaacccaagtgaagtaatgaaagtggatgatagtatatctgccatggacagggagcccatttcaagatcagacgcattggaaactttaattgaccctgcatttttcccactcacagtacgtcttctttcaacaattccagtagcacttcatgctgttggtggtgatgatgggccccttgatattggtgtgaggctgtacatgagctcctatattgggtga

SEQ ID NO: 34793 - DNA, 231 bp, Glycine max
  Peptide Sequence Number=SeqID_151571
atgtcacgcaggcacgcgctcagcgcgtcattagctcgctcagcgagtcgtttgtcaccttccaggcttagcacgagtttggcattgagcgaaaattcacttactcacgataagcgcaagaatggtgctaagcgtgacgtcgagggctttagcattgaaagatgtattgtctccttagaacttgatagagcaggattaggttaccgtatgtctggacacggagtgcggtaa

SEQ ID NO: 34794 - DNA, 126 bp, Glycine max
  Peptide Sequence Number=SeqID_151572
atgtgtttgtgttcgcactctgggatactacttatttgtgtggatgcgaaatctatcggcaagtacaccgggtcgtcaagtacatcgggtcgtcaagctcaagtactaaacactgatgtctcgtga

SEQ ID NO: 34795 - DNA, 399 bp, Glycine max
  Peptide Sequence Number=SeqID_151573
atgcaagaacgtaagggaaataaaaggaaactgacaaaagaggaagtcatgatattgcacaacctaccctttggcaggagggcgacgcgagggcttacgggtgcgtcttccaaaggaggaaggcgcgcagagttgccaccaatgtttattttaggaaacatcagaaaaaccaaaaaggtgtggtctacgaactttaagtgtgaaaggttcgggaattgcttttacgcacggggaaggagagaaacgttaaggtgttggaccattaacgatctctttgtttttgaaaggagagaaacgttaagacgttggaccattaacgatctcttggggtggtcgacaaaagcggggcttttgctcctacgtatcctcaattgtgatgaggaaatcagacctacgtag

SEQ ID NO: 34796 - DNA, 480 bp, Glycine max
  Peptide Sequence Number=SeqID_151574
atgggtgtcattgataagttgtccgtagtccatactgtattgctatacgtctgggatgaatcagattacatgccaattcttgttaagaacagggccgaagaaatcttgtttggaaacatcaagactggaaaagtatattcagcttataaagaacaaacgcagaaccaaaatcttggtcctagtaatgaatgcaaggataaagatgccagtgaaagacttgctattaatccaagaccttctggggaaggacttccgagtgccaatacattagatgttggtaagagcttgcaattgcaggaaaaacatcttcctgataagttcaacttttactgtgtatggttaattcttctgaaaatgttgctgaaacaaggaaagaacggccctctgaaatttgagatcattgttggtcccagcttagatattgaaaatggaaattttgaacgggtttctgcaacaatgccttgctttggaaccaaatga

SEQ ID NO: 34797 - DNA, 315 bp, Glycine max
  Peptide Sequence Number=SeqID_151575
atggtggacctctgcatttctggacactggctcttctctgcactgggttttctaataggcttattatgggaattcagtgcaactttggtaacagctgagttcaagcatggtggcagtgatgctcagttctggttcgcttgcatagtaggacctctagaggtgtggattagatggttcttagcatggttcaatggatttggatcaggaagaacaggaatattgaaggggattcccttcggtactctagctgccaataaatctgctgctggtgttatggctgcactagctagtgtgcataaagcggcaagtttctaa

SEQ ID NO: 34798 - DNA, 777 bp, Glycine max
  Peptide Sequence Number=SeqID_151576
atggcattgcatcttcaaacgatcttaccattcattttggttctagcaataattttatcagggcaaagaacatgtgacagtgctagagttttcaccatagtaaactactgcaaggagacactttggccggcggtgacacccggggaaagcttcaacggcggtggcttcgtcctaaaaccgggcgaatccgcggttttcacggccccggttagctggagcggccggatatgggctcgaaccggttgcaagttcgaccaaaacggaaacggaaattgccaaaccggttcatgcggcacaaccctaaaatgctcagcctcggggaaaacaccggcgtcgctagcagagttcacactagcgcaaccggacttctacgacgtgagcctcgtcgacggcttcaatgtgccgatggccgttaagcccataaacggaaagggaaactgcagcaccgctggatgtgattctgaccttagaaacagttgccccaaggaactttcccttagggctaacggcaagaccgttgggtgtcgtagtgcatgtgatgtgtttaacactgatgagtattgctgcaaagggaattatggaaacccttctacttgcaagcctacgttttattccaagaagtttaaggaggcgtgccctacttcttatagctatgcttatgatgatccaactagtatttttacttgtacagggacggattatgtcatagccttctgctcatccaggaaacaacagaacactggaatagctgccacagtccaggaatattccgtttga

SEQ ID NO: 34799 - DNA, 252 bp, Glycine max
  Peptide Sequence Number=SeqID_151577
atggaagaagaagaagaagaagaagaagaagaagagggtgatgatgataataagagaagtgattttggagtctctgagtttggcgagtgctcctggtttgaggaacttgtggaacaatctcgggcttcttctgtttgggtgttgtggacttgttgtgcccataatggctggttgttttggaaaagaatcgtgagaataagagagagagagaatgaatggggtgtaagaaaaatggatgcaagggctttttaa

SEQ ID NO: 34800 - DNA, 228 bp, Glycine max
  Peptide Sequence Number=SeqID_151578
atgtcaaagagaggaatcagaggaccccttctatgcattggagatctcctaaacgacattggagaagaagaagaagaaggacgaggacactctctccttcgtgaagcatctccctctccctcttcttcccttctcaacaacctcaccaaactcttccaggaacactacgaccacttaaattctacactctccggcaccgaccactcctggacttctctcaccctcaag

SEQ ID NO: 34801 - DNA, 321 bp, Glycine max
  Peptide Sequence Number=SeqID_151579
atgaataagcaagtaccaaagaattgttctagacatgggagtgataaatatgtaaagtttgatgttcatattgatgatgatgaagataatttgagtgaaccagatcagacagagtttgtgggaacttttgttaatttgttccatggacaaggccataatatcaaagtaactagttttaaggtagggatatcgaaagtgctcgattgtttagaagctaaagaagacgatgttgtgctagttactttggtgcctaaggttggaaaaggagatgtcatcataggaggcatcaaagttgaatttattccaaagtacaaggattag

SEQ ID NO: 34802 - DNA, 285 bp, Glycine max
  Peptide Sequence Number=SeqID_151580
atgggcgacaccgtgagtttgcccaacttatcgaccaaagtagtagctattgctgcaggggaagcacacactctccttcttacaggggatggacgtgtttattcctggggaagaggaatactgggacggcttggtcaaggttctgaacatgacaagcattttcctgttgaagtcaagtttggatcagaagaagacagcgtaagaatagtgggaattgccgctggtgcttatcatagtcttgctctagcaggttctaacacttctcagttatcttatcacctctga

SEQ ID NO: 34803 - DNA, 327 bp, Glycine max
  Peptide Sequence Number=SeqID_151581
atgaaggatattgctacgcagaactttcagcaaatatgcaaagcatatgagattctctcagatccaaacaaaaggagaatatatgatatctacgacatggaagggttaacctctaatttggaacttggtccaaatcttaatggagctgaaaagatcaaggcaaagctcgagagattgaagaggatgaaggaacgagagaaagtggcagcgcattttctaccctttggtacaattctggccaatatgtctttgccacactatgtagatggaaatggcctactcattggacagtttctgagtcctgacaatgaaatgttagttgcatga

SEQ ID NO: 34804 - DNA, 528 bp, Glycine max
  Peptide Sequence Number=SeqID_151582
atggccctttatttctctgaatggttatgcgtgggtctggatgtggacgccctcgacagcgtcaacaaggaggagggcattgttgttgagtcgagcgacaatgaagacctcactgtagaagttgatgtggtccgacaatggggaaccttcttgctcttcttgcccttcggcggtgccttcgtggcccacgcctgcgacatcataggtgacgcgaagggcaggaacgacaattcgtggatggcaatcggcttcgccttcgacgtacgacacaccggaatccccgattatgacggcactgtccatgtcgtcgaaggagggtatttggggattgggattggtggttatgaagtggcagagacagtggtggtgggatctaggggtggcgatgagaatgttcaagaaaaagacaatgtcgaagacaaagaagaagatgaagatgaagcagaagagaaagagaaagagaagggtaaatgtaactcgtccccatcgaagagcttacttgacctcgcccgaatcattccttactga

SEQ ID NO: 34805 - DNA, 348 bp, Glycine max
  Peptide Sequence Number=SeqID_151583
atgaggccaattttggataaaattatttatgagaggtattgtgcttttattgggggaagacatcttttaaatgggtccttttttgtcaatgaggtgcttgatgatgcaaaaataaggaggaaaggattgtgttgttcaagccacgatctctattctggtgaatatgggagccctatggaggagtttattacttctagaggattgaggcaatgtgatcttattgctccattcttgtttttacttacgacaaaggttttgagtgagatgatgaggaaagctttgagcagtgaggtgttatcaggacatgaagttggtacacttagtggatgtatctcttatgcagtttag

SEQ ID NO: 34806 - DNA, 216 bp, Glycine max
  Peptide Sequence Number=SeqID_151584
atgaaaaacatatccaagttgtttgaagagcttgatgtatgtgccaaagtgactataaagtgtaaacttcgggatattgcctaccctgatctaaattctatatgtgctcctccagaaaaggttatcacggataagtggataaatataaccgacatgagttatgtgattgcatcaaagaagtcaacaaccgagagattgttctatacatcgcgttaa

SEQ ID NO: 34807 - DNA, 480 bp, Glycine max
  Peptide Sequence Number=SeqID_151585
atgacattggtgcaatggtactgtttaaaggggcctgtggtatttactgatgctgttacatggttttgtgaggattgtgcaacaaagcttggggtgccacttgctcttgaccaatctacacctatcttatctgtatcaagaaacaattcgaaaaaagaagcgaaaaagaagcataaggaaagaaaagctaactctagcttagttgctaaaacaaaggaagtgttatctggtcgtcacatttcacctgagcctgagcatcctcaatgtagtaatagatgtgaagaatgtgaggtgaaagatgaatgtggaccaagggatgtagctaattttgatgtaggtgaagaagaaagtgtggcaagggatttaataaattctgatgaaggtttcaaatttgttccagtttctcaaggagctatcgataatgattcaggttgtgtagaattagatggtcatgtttatgcacatcctactattgattaa

SEQ ID NO: 34808 - DNA, 1419 bp, Glycine max
  Peptide Sequence Number=SeqID_151586
atggacatgctcatcatggacgaccctgatttcctcgacttctccgatcacagcatcacaaccaccctttcctcccacgaagactgcaacaagaacaacaacaacctctggtcccctcttatcgactgggaatccctcaacgcatgcgaaaatgacttccaaaccctaattgactccgtcatgatcgacaacaacgacgacgttttgaccccagaagaatcagatcaaagcgccgccgaagaatcagaatcagactccaccggcggcgacgagaggggcctccgcctgctgcacctcctcatggcggcggcggaggccctcagctccggcacagagagccacgacctggctcgagcgatattggttcggctcaacgagttggtgtcccccacccagggtaccaacatcgaacgtctcgcggcgcactttagccacgccctccattccctgctaaacggcaccgcaagtgcgcacacaccccccatcgacaccctcaccgcgttccaactcctccaagacatgtccccatacatcaagttcgcacacttcaccgcaaaccaagccatcttagaagccgtggcccatgaaaaaagagtccacataatcgactatgacataaccgaaggggcccaatgggcctcattaattcaagctctttcctcagcaggcccaccaggcccacacctccgcatcaccgcattgtccagaggcggcggtggaggaggaaattcctcctctgcctctggacagagatctacagcctccgtccaagaaactggaaggaggctaacggctttcgcggcctctgtggggcaacccttctcctttcaccactctcggctggaccccgacgaaacgtttcgcccttctaatctaaagctggttcggggagaagctttggtgttcaactgcatgctgcatttgccgcacctcaacttccgagcctcaggttcggttggttcgtttttaagaggcgcgaaagagttgaactcgaggctggtggtgcttgtggaggaggaaatgggctgtgttgctgcggattcgggctttgtgggcttttttatggactcgctgcaccactattcggcggtgttcgactcgcttgaggttgggtttcccatgcagacatgggcccgagctttggtggagaaagtgtttttgggcccgagaataacgggctcggtggcccggatgtatgggagtggtactgaggaggagaaagtgtcgtggggggagtggttgggtgcggcgggtttcaggggagttcccctgagcttcgctaatcattgccaagcgaaccttttgttgggtttgtttaacgatggatatagggtggaggagttggagaataataggttggtgttgggttggaaatcacggcgtttgctttcggcttctgtttggagttctaactcttga

SEQ ID NO: 34809 - DNA, 153 bp, Glycine max
  Peptide Sequence Number=SeqID_151587
atggaacaagagcttgaaggaaatggaatgtacacacctgtggaccttaaaactagattggtcaatgctaaagcttcttctattgagaaaggggtggatatgtgtcaagttttaagagattgtgtttgtgattacattttggccactgaataa

SEQ ID NO: 34810 - DNA, 696 bp, Glycine max
  Peptide Sequence Number=SeqID_151588
atggttaggttcggtgaaggtgaaggtaccggtgttcagtgttgcggaggtcggcggcggcatacgatgtacgcaatgttgggtttgcgttgtggtgtaccgcagatcgcgcggatcaagttgatccgtaagaagtttatggatcaacttgatctacatatggacgaagatcagtggatgtatgaaagtataatgtttgaagaagtgaatatagattatgaaaatgaagaagaatgtggtgtgaatgaaccacatgttgattattcggatgcgtttaatacttctcagataataatgttcatgattccgagaggatgttgtaggtgtataggtaaccttcttcgttttcaatgtatgcaacgtaaaaatgatgatgatgttaacacaatgttaatgtgtaatcatcaattttcaagtgttggtctgattgagttattatgcaccattggtagaacaccagatgatatattaaacatacttgaagccactatgatccctactcatgatgccctgctatattacaataggaggtggaacatgtcacgccaaaatgagtttgttggttactcattcacagcaaaagatcccaaaaagtttgacattcctttcggatgtaccatgaatgaactgaaggatttgatcaagcaagttgcgccttatgggattcccccttatggtatttatgaaacacaaacg

SEQ ID NO: 34811 - DNA, 522 bp, Glycine max
  Peptide Sequence Number=SeqID_151589
atgacagaaaataatgttttgaagaccttcatagagcaaaacaaaggaaaatgggaggttgagagggtgggggtgtttccatgggtaggggtgccagctgaaatactggggtgccaggagaaacactggcgtgccaatagcaaccccttaaccaaacccggaagaaatcgggagcttcatattaatttttcccagtatgagcatccgactattttgacagtggaggaagggggtaataagcgtttaaagaatgaaaagtatgttggacatttggggggtggagtgactaaaagtttgtgttttgaaggtaatgacaagaaacgtcggttttatcttgtttctgctttaaaggatacccaactagatataaaagtgttatctcagcggcttggtttaggaaaaggaggtctaagaatgacaccttcagaggctttgggtgaaatacttcagaaaataaggattaaatgtggaaagaaaatgaaccatgtacagaaatccacttcccatagaaaccgcaactga

SEQ ID NO: 34812 - DNA, 384 bp, Glycine max
  Peptide Sequence Number=SeqID_151590
atggccgtacttatttcaggggacttttggaaactgagaaagcggtgtaaggacgagggaggagaggggaagagaggattaggcaaagatcgtcgtggacatggattcaagcatctcgatctccagcagggtgagaaatttaaggaatttggagcacctgagtttcatcatgactgtgcgaaggaactcgaaattcataccatggctgatagtaactctggtacccccaattcctttaatttctcacactgcaaaaacaacaatcaaaggccaagaatatcaattcatcatattgaaattcaaccggaagatatatccatccatttggttttcaatgctgattctggacaccaaatgagtttcatggtgtgtgactgtgtgtga

SEQ ID NO: 34813 - DNA, 540 bp, Glycine max
  Peptide Sequence Number=SeqID_151591
attatagagaaaggacctcttagagactacatgggacgtccgttaatgactgcaaccgatgattccaatccatggtggtcagttttcaagcaagctatcacatctgttggagaaaagctttcaaggcctgaaattcttgcatccacaactgatgctcgatacctcagacagaaaggaattcctgtgctcggtttctccccaatgaaaaatactcccatcttgcttcatgaccacaatgagcacttaaaggatactgtgttcatgaagggaattcagggaaaatctgagcgattggataccccacctccaaataataagtggagtaaaagcataaatagcaacgttgttatcggacaccatgaaaaaaggaagaaaaaaagtcctctgttgttccaattcgctcatggtggggactgggaatgtttgatacaagcttcacaaatttataagtacattaaaggagttgctggtttacatacaggtgtgcgatcaagaattgtatctatccgactgatgagaaatgctggcaacactttttaa

SEQ ID NO: 34814 - DNA, 288 bp, Glycine max
  Peptide Sequence Number=SeqID_151592
atgtctctcaatcaagttcttgtgaaaagaaagaaagcagaatggtgtgataaaaatactgagattatgttgaaagtctgcatagaagagcttattggaaaggacacatgtcttggctgggatggggagatgaaaaccattgctgctagtgatgaatggtgggaagccaaaattcagaaattagcgactgaaaaattttggtgtccggcagcgaccgaagtagcgaccacactgttattggtgcaatttgcgaatgaatttgcgaccgaatttgataatgatgcctaa

SEQ ID NO: 34815 - DNA, 1000 bp, Glycine max
  Peptide Sequence Number=SeqID_151593
gaagcacttggaggagaaggcgaatgctttggcggatcgaggtgaatgggcttcgttcattgatgtcttggcactattggtatttggagtcgtcctctttccaaatgtggatgggctagtggacctagcggcgatcgatgccttccttgcttatcactatagcaaggaaagtctggtcgttgctattttggccgatgcctatgacacatttgaccgaagatgcgaaaagagcagtgcaaggatcatctattgcacacctgctctttatgtatggctggtctcgcacctctttcgtcatgaaagtagacccatctgtcccttgcaaggtcactgcacatgtgctgagaaagggaaggccaattgggagcaactcttggctagtatagtggggacatccgttaattggttccctcgatggaaggaaggaagagtcggagttttgtcctcatgccagggattctcaaacatccccttgatggggacgaggggttgtatcaattataatcccatccttgccataagacaacttgactaccctatgagaggagcttcgtcggaagaaagtaccatgcccttcatcgcatggggtttcagtgaccccaatgcaagaatatttcaaagggtccgaaaggcatggagtgtgttagattggctctcgaagttcaaggtctcaagtgaggaagaggttgaaaccctggaggagagtgaggaggtacaagccttaaaggtggaacttgaaaaggcgcaagtagtcaaggaaaggttcaagacaatgaccatcaaggtccgaaaagagtgtgatgaactgagagacgtcaatatggccacaaccgaagcattggaaggggaaacaaagagggcccgaaaggaagaatgggtccaaaacaagttccgaggggcgttgtggggtagcaacgacgagcttaagcttcgaagggccaaaagagaccagtcgagagttgaaggcatgatattggaaggcaagttaaaggcttgttga

SEQ ID NO: 34816 - DNA, 642 bp, Glycine max
  Peptide Sequence Number=SeqID_151594
atgaatgtaggagctctcatctctggccaaatctcatctatggcccagtctaactcctctaaacttgggttccctgctcttatcacagctctatgtaggtccaaaggggttgcttctgacagcctagtcttcgaatgcttgaggccgatcattaacttggcctatatcaggaagaactgctggaaccctgctgatctgatagttactattagaggggctaggagagtgagggcaaggccagctgaggctccttccacatctgcagctcctcctccagcacgtaccttagcaactccttctaccccatcttctacaaactttcaacgtcttgaagccatgcttcaaagcatacatcaggggcagattgttttattacaaagtttacagctggtagcacctccagactctatcccttctattgaacagtttaatgaatgggtagcctggcccaggactcagcctccccttcacagggaggacgaaggtctcaccgctcaggtagcagacccctccactccagaggatcagactacaccagtcctgtctccgaacacctctcctccagctacccctgtgcttcacttaacaaatgaggaggatgttcagacacaggatactcaggacagatcacaggatttttaa

SEQ ID NO: 34817 - DNA, 330 bp, Glycine max
  Peptide Sequence Number=SeqID_151595
atgcataaggcattgcggtctggtgcacctctcccttaccctcaacttgtgactttatttcttcgacattttgaaattcctttggattctgagccttttgttctagttaaacgctcctttgctattggtgccagtgcggtaacctcctttggctaccgtaaggacgtagatgggcagtggctgaagaaggacgcgcaacctccgcaagatgagcgtactccctctcctccgcctccacaagatgattcctcagccctcatgaatgaaatgccattgatgctcgctttgaaggaatggatacccacatcactcagcttgaagaggatgtga

SEQ ID NO: 34818 - DNA, 216 bp, Glycine max
  Peptide Sequence Number=SeqID_151596
atggcgaacgtggtgctcaaatttcacgaagatccaacagtgaatgagtccgagatcgtcatttttctgagacaagttaggtggcctgcgggaaaaagagagggttttggcagaaaagagaaaaaacgaaattgtgaggcaaaggaagctaaggaatcatttacaaaaattgagatgttacaatttttgcggacaaagcttgattttgtgagttga

SEQ ID NO: 34819 - DNA, 291 bp, Glycine max
  Peptide Sequence Number=SeqID_151597
atggctagggacagaaactctcgaattggaatttctgtggtgatgttgttatgcttcgcggctcatttttatgtgttgcccctggcagaggctgtgtggttaacactccccacttcggggactaagtgtttgtctgaggaaatccagtcaaacgttgtcgttttagccgattactatgttgttactcaagagggtgggcttcaaacactttctgtcaagtttggttggtttagagttgctggctacttctcttgttgtttgattccttatgcattgaaattggtctattag

SEQ ID NO: 34820 - DNA, 1755 bp, Glycine max
  Peptide Sequence Number=SeqID_151598
atggcgaagagcaaccgttccgatagaagaaaagttcttccggagaagctaccagaagaacttgttccggtagcttctccaaaagaaggttcttctggtagaacaaaaaattcttccggagaagctaccggaagaacttcttccggggaacttcttccgatcatggttagaacacgaggtttaggtcatgctttagctagggttataggcagaggtagacatgatgagcatgatgcaatcgatgttccccagaggcgtaggcctactgcatcaaccagtaggcgacgagtacatattacgattgatgagggtgttcctcaggtgactgaggatgttcctcatatggcggaggatgttcctcaggtgactgaggatgtccctcatgtggctgacgatgttgctcagatgagtgaagatgcgcctcagatgatcgcggacgtagatgcgactattgtagaggacttaggtcgtgatggtgctaaggggtcacatgctgatgagggattccctggtgggccctgtgacccatcagttccgacttcatttgcggagcatgtcgcacatgccatttggactagacaggagcgtcctaagctgaagttggtgtcgcatgggaggaaggtggcattaattgggaggccagtgcctgcgattgaagggctggttgtcaccacaggattaagtccattgatcgagtgtacagttgtaatcggcaatcctggacttatatccgtatttgtggagaggtggcacagggagaccagcacattccaccttctagtaggagagttgacgatcacactagatgatgtgtcgtcactcctccatctccctatcagtggcgctttccacagcttcgaggctatttccgtggatgagacggtatttttgttgatggagttgctcgaggtgtctggcacgacgatggattgtagcaactcgtgcttatctactacacctggcttttcgcgacctgggtcaaagtgggggtatgcctggggagctgcggccctgattcatatgtatgaccagttagatgaagcttctaggaccacgacacggcagattggggggtaccttactttattacagtgctggatctatgagcattttccgagtgtgcatcagtgcgtcaccgatgatgcgtatgaggagacgttccctcgtgcctcccggtggctgacgatgaaggctcatatgaagggaattataggagcgttgtaccgggcacattgtgatgctttgacagtcacagacgtgtgctggttgccttatagtgaccatcgaggggttagggtgtttgagctgatttcatcgttccagggtcagctaaaatggggtcctacagcgagcatcccttcgctgcctgttagcgcttcgttgtcatatgatgatatagatgacaggtggatgcatttcttggaccacgtagtagctgtgggttacctttgtgtagtgtctgggcaggcaagtgaccagcccagacatgcacctgccccagaccatgaggactacatgcagccggacatcccacaggttccagtggcatttgacccccctcgacatgcagtggatgattacaaaggttgtgaggcgatcgcaaaaaggttggagcgtgtgctcaaccttaggatggtcactgtagggacagagttacatgatatcatgcaagattgcctgaggatcgccaaggggttgccagcgcagatggaagtgttagggctcgacaaagacgacgcacagagcattgatgat

SEQ ID NO: 34821 - DNA, 360 bp, Glycine max
  Peptide Sequence Number=SeqID_151599
atggatggtaaacatcaagaagaagcaactgtaagccttgactggaaaacaggaatttatgccaaggattgggagtctgttgcaaagaaagaaaagatagagggtgttgaacttgagctcaggaaacttgaaggagcagtggaggccatccacggctatctagtttatttgaaggataaggaagcaaggatgagggaagtcagtgaaagaacaaatggtagagtggcttggtttagcatcatgtcgcttagtgtctgcattttggtttcggggtaccccttcaagggaatgtgtacttcggcgttaaattacatagatatgctgatatgcagaattgaagagctgttctattggggctaa

SEQ ID NO: 34822 - DNA, 306 bp, Glycine max
  Peptide Sequence Number=SeqID_151600
atgagagacaaggagattgagggcaatcccactgtaggaaactccccctctagaaggcacatcccttcccaatcaagaagatgcagactgcaatcaactgaggggaattcgtcttcccctaagccaagaaactatgcttctcccagtcagccagtcattaactcagaagtggcagggaatactgattgtcgtaagatcatttatgaggtctggaagacaaccataatgggcttccctatgttgattcaatctcaaaagctgaagattctgaagagtaagctcaaagaacaaatctacctttggtaa

SEQ ID NO: 34823 - DNA, 375 bp, Glycine max
  Peptide Sequence Number=SeqID_151601
atgactcttcatcccttatgcaaagcattctcgatagaatggatggactacacaacatggatactcgtattgatcggcttgaggaggatgattagtcatcataaaaaagggggagattgtagaagcaaagcttccaatattattttgatgatgccaaagatttttaaaaagatacattcaaacaagattaaagaaatcaagaagattcaagtgaagattcaagagaagactcaagatatgcaagaacctcaagaaaagcatcaagataagtataaaaagaatttttcaaagaaaagattgaataagacaatttgtccaaaagaatttttcaatgaaaaatcttttaccttactctctggtaatcgattaccataa

SEQ ID NO: 34824 - DNA, 501 bp, Glycine max
  Peptide Sequence Number=SeqID_151602
atgatcgactcgaacgagtatgatggagttaacggtggatgtatggacatgacaatgtgtctcatggaggccagacaacgtgtctcatggtcgtggaacgatagagagtgtggcagtgcaagtggcaaaaagggttgcgtggtatatatgatgtcacaagctattgagaggaacctcttttctagttttttggtgggaaagttgaaggtggaagtaaatttactacaatatgtagatgatactttattttttggtaaggcaagcctagctaatgttttgaccatcaagagcgtattaagatacttggagcttatttcaagattgaagagggatgagaatgtgaggaagattcaatgggttaggtggaggaagatttgttggccaagaaaccatgaaggactaaaggatttagggagtttcaatgagactttactaggtaaggggaggtggaattttattctatcaagagggatacttacgggtggaagtgttaaattctaa

SEQ ID NO: 34825 - DNA, 927 bp, Glycine max
  Peptide Sequence Number=SeqID_151603
atggcttctgaagagaaaaagttagaaaatcagcttttaaaagtgggaaacaagctcttaaaacctccatcatctaccaatggtctactctatcttttgaatcgggttaagagtctcttagaaagggttgaacaatcaccaactaaatctttacaggatgctctatcaccatctttgaaagcgttaattggtgatgcccttttaaggcatgccgatattgaggttaaagttacagttgcctcttgtgtaattgatatagtaagaatctctgcacctgaaataccttatgatgatgatcaaatgaaggaagttttgccaattgctcgaaggttagcggagagtgttcttgaaagttgtgcaaccatacttagaccttatttaaagcaagtagtgaatacattgggtatttccttggatgattatagtgatgttctagtttcaatatgccaagaaaaaattggtagcttgaagcaaaatgatgaatttcttactaacgatcacatggaagatgaaattgaatcaagaaaagagttagtagaagaatcaacacaggataaacctatctctttaaaattgttggaggcttctaagagttcaaatcttactattgagaaggaacccaagaaattgattgactttagagagggtactaaggatatggataagatgtctaataccaaagcatatggtgcaaaacttgttggtacacgtgttaaggtttggtggccagatgataaaatgttttatgaaggtgttgtcagttatttttatgcccctcgtaacatgcataagattgtgtatgatgatggtgaagaggaatatgtaattcttaaagaggaaaaatggaaaataattaaaactagtgataatctagacacgggtgaaggaacttattgcacgtgtcatgatgctttgaaagatttgtag

SEQ ID NO: 34826 - DNA, 177 bp, Glycine max
  Peptide Sequence Number=SeqID_151604
atgggtgttaagtacctcgaggcggtcgagcaaaggttgcatgccaccaaacaatggtcctcggatgaaattaggaccaggcttaagcaagatgacttgcaagggaaaatgagctactggatttcaagcttaagcgtggagtcagccaagcttaagcatagagagagccaagcttaa

SEQ ID NO: 34827 - DNA, 276 bp, Glycine max
  Peptide Sequence Number=SeqID_151605
atggagaaaacatgtgatgctaggtttagcataatgttgaatcaggcaaagccttatttgttgactgtggggttgcaatttggaatggctggaacattcatcatcatcaaggccactcttgatcatggaatgagtcgttttgtgttaactgtttatcgaaatgccattgctgcgattatgcttgctccttttgctatcatctttgaaaggaacgttaggccgaaaatgacaatgtctgtcttcatgcagatactagcccttggatttcttgagtaa

SEQ ID NO: 34828 - DNA, 2406 bp, Glycine max
  Peptide Sequence Number=SeqID_151606
atggcgagtcctgattcaaaatgtccagcaccaatgaaggccacgtccaatggggcattccaacatgaaaatcccttggattatgcgcttcccctattaatcctccagatatgtgtggttgtggtctttaccagattccttgcattcatttgcaaacctctgagacaaccccgagtaattgcagagggaggaatactacttggaccatctgcaatgggaaggagtgagaaattcctgaacacaattttccccaagagaagcttaactgtgcttgaaactgtggccaacattggtcttctattcttcttgtttttggtgggtcttgagcttgacttgcgttctatacgcaaaactggtcacaaggccttattcattgctctttcaggcatcacattcccttttatacttggcattggcacatcatatgcgcttcgagccaccatatcgaagaatgctaatccaacctcgttccttgttttcatgggtgttgctctctcgatcaccgcattccccgtccttgcgcgaatcctcgctgagctaaaactcctcacaaccaatgtcggtcgcatagcaatgtcagcagctgctatcaatgatgttgcagcatggatactacttgcacttgccatagcactttctggctccaacacatccccacttgtttccttatgggttatactttgtgctgctggctttgtcctctttgctatgtttgccataagtcccttacttggaatgatggctaagcgttcgcccgagggcgaaccggtgcaggagatctacatatgcatcaccatgacactagtcctggcttgtggtttcatcaccgatactatcggcattcatgcgctctttggagcttttgtggttggcattgttatgcctaaggatggtccctttgcaggggcgttgattgagaagatagaggaccttgtgatgagcctcttcttgcctctctattttgtgtcaagtggtttgaagactgatgtggcaagtataagtggagctctttcttggggtatgctagtgcttgttattttcactgcttgctttggaaagatcattggcacattccttgtgtcactgttatgtaaggttccttttagagaagccttggcccttggatttctcatgaacactaagggcttggtggagctaattgttctcaacattggcaaggatcgcaaggtactaaacgaccaagcatttgcaatttgtgtattaatggcattgttcaccactttcatcacgaccccaatagtgatggcagtgtacaaaccagctcggacaggatcacgttacacgcataaaacagttcaacgcaacgatcctaacaccgagctacgagtgttggcatgcttccatagtacccgcaatattcccaccttgatcaatctaatagagtcatcacgaggaaccaaaaagagggcaaagctatgtgtctatgcaatgcacttgatggagctctcggagcgaccatcagcgatcacaatggttcatacggcgcgcaacaatggcatgcccttttggaacaaaaagcatgacaatagagaccaagtggtgattgcatttcaggcttatggccatctaagtagtgtcaatgttcgccctatgacagccatatcagctttcagcaacatccatgaagacatttgcaccagtgcgcaccaaaagagagcagcaatcatattcctcccattccacaaacaccaacgcttcgacgggacaatggagtcggtaggaaactcgttgcgcgcgatgaacggcctagttctcagccatgctccttgctcagtcggaatcttggttgatcgcggccttggtggtacaagccaagtccaagccagtgatgtgtcatacaaggttgttgtaggtttctttggtgggcgagacgaccgcgaagcactcgcctatgggatgagaatggctgagcatcctggtgtttcaatcactgttgtgaagtttgtagttccacctgggatgacattggcctttggtgccaaattgattggtgtaacagcagacaaggatagaaaggtaattaaagtggctgaaggaactaccactgatgtagagaaacaagaggatgagcacttttggtctgagttcttaggtgtgtgttgcaaaaatgcagaatcaataatgtatgaggaaaggttggtagaaagcaaagaagatattctgacaacaatgagggagatgaataagagcaatctaattttggtaggtagaatgcccccggtggtacctttggtagacacaagtgattgccctgaacttggtcctgttggaagctacttggcttcttctgagttctccacttctgcatcagttatagtgtttcagcaatacaatcccaaaacagatatatatgccaaggttttgaaaaatggtcctccactgtga

SEQ ID NO: 34829 - DNA, 210 bp, Glycine max
  Peptide Sequence Number=SeqID_151607
atgaaggcgcaagtcctcaataccgacaaaggaagcagtcaatggtggtgtcgccgaagaagaaccaacaagaagacgggtgcagggactagaaaacgaaggaagaacatgaacgcgcaaggagggagaaggaaaggaagcgacggcgtacggaatgtgaacaatggtgctgcacaggtacacctagcaacacccgagctattctcctag

SEQ ID NO: 34830 - DNA, 474 bp, Glycine max
  Peptide Sequence Number=SeqID_151608
atggaacaacccatttattcaagttcatatgatgtgtttaacaattgtggatcgtctctccaaacaagtatgcagggtggtgcggttgatgtgtctgcttatgacaaagacaattggattagtggcccttcgagcatgctttctgatcaaagtgaagacatgggtatgatacaaagaattaatcgggagatgattgaatcatggcctgaatattcaggccaattaaaagatgataactcaacatggcagtttgaaaaggatactgttggacaggaaacatttaaaactataatgcctaactacattagggattcaactgttgttaggttccgagacattgccctccctaatttgatgcaatcctaccccttaagagcattggatagaagactccaagaagattgtgccaaagatgcaagagaaggccctaggactctcatgagccttagtatagatttcgaacccatgggctaa

SEQ ID NO: 34831 - DNA, 150 bp, Glycine max
  Peptide Sequence Number=SeqID_151609
atggctgtagaaacgggaactggggtccctttgttgatgtgcaaggaagatgatgcactagatcctgttcaacctgacatggtgggcctcatcagtggccttggtggcaggggtacaaacatgaagaaagggagtggagagtggagctag

SEQ ID NO: 34832 - DNA, 174 bp, Glycine max
  Peptide Sequence Number=SeqID_151610
atgtttacatcgcatctctattctttgtggctagaactggtaattagtgtcggtgtgagtaacagttggagtaaccgcaaagagtttcttgcggctgaggcaaccggggcgatggagattgatggtgaaatcgaagcacggaacgtcgttatcctcgttataggttggggatga

SEQ ID NO: 34833 - DNA, 192 bp, Glycine max
  Peptide Sequence Number=SeqID_151611
atggccccatattttgcttctacactggagaccgagcaaagtgtttggcgactacgacgagtcagcaactgcaaaggatggtggccaccagtgaacgaaagagcagaggggtgccaacaaggatttctggaacgaaaaaggaaagaggcaagggcttctggagcaaaagagcaaagcgatgagtgtttctga

SEQ ID NO: 34834 - DNA, 417 bp, Glycine max
  Peptide Sequence Number=SeqID_151612
gggtgagaacgcgaatgataataggcctttgaaggagtatgcagccccaacaatccgagacccagttgatcacttggagggattcttagagatttgtgagacccaaaacttccatagagtcacacaagatgcattgagtttgcgccttttccccctcactcttgtgggaaaggcatgggcgactttccttgacaagtactatccatcttcaaagattgatgagatgcgaaagctgataacaaattttggccaaggccagattaagtctttcgccgatgcttgggagcgagttttaaagctactcttggcttgccctcatcatgggattgagagacccttgacaattcatttcttccatgatgggtggaactacctaagcaaaatgttgttgcattgtgcagctggcggatcattcat

SEQ ID NO: 34835 - DNA, 288 bp, Glycine max
  Peptide Sequence Number=SeqID_151613
atggtaattagtgtcggtgtgagtaaaagttggagtaaccgcgaagagtttcttgcggctgaggcaaccggggcgatggagattgacggcggaatcaaagcacggaacgccgttatcctcgttatactgttgggttggggaggagggagatcggcattgattttggagtctctgagtttggcaagtgctcctggtttcatatacttgttgaacaacctagggcttctccttggagaggacgtgcttttgcttgtgcatgcctttgtcattgtcatgatggatggttaa

SEQ ID NO: 34836 - DNA, 216 bp, Glycine max
  Peptide Sequence Number=SeqID_151614
atgagcaatgagactacaaagtgtagtgagatgttaggatccaattctaaggcacaatcacaagatattctacccaatgctttcccatattgcgagaactttgaggtgaagtgctttgtgaggagcattgatagggaaccaatgattaaacatttttatgtcagaaggaaaggagatgagtcacaggttggcagaaaccaaactgacctcttatag

SEQ ID NO: 34837 - DNA, 111 bp, Glycine max
  Peptide Sequence Number=SeqID_151615
atggcgctaagcgcgacgtcgaggggctttagcattaaaagatgtattgtctccttagaccttgatagagcaggattaggttaccgtatgtctggacacgaagtacggtaa

SEQ ID NO: 34838 - DNA, 345 bp, Glycine max
  Peptide Sequence Number=SeqID_151616
gagagagggggaggggtgccgccattgctgttggcgggatgggatgagaaggctagtcccgccattggagctggcaggacaggggtgactaggagagagacgagggctagtcccgccattggagctggcgggataggctctgcacctagggttcacgctttaacgtctgcacctcctgcacctagggttcacgctttaacgtctgcacgttccaggcttaaaggcttgcagtgtttagttttcagttctgaaaagcctatgcttgttgttgttgctgttgtgctttcatccttcaagtgtccttacccttatcttggacataaattcctgatattccaatgttag

SEQ ID NO: 34839 - DNA, 257 bp, Glycine max
  Peptide Sequence Number=SeqID_151617
atgaaagatcaacaaagagtgatccgtcttactgagagtatgttgatgcattacattctgttcaaaatagtaattcttcagttaaaagtaatgcatcatcatctgagcaagcaaaaccaagaaggatcatgccgatgttggatcaatttcatccatgcattcatgattctattgaaaatattgttgatgataaagctgatggttatcatggataagtggatgaatataactgacatgggatatgtgattgcatcaag

SEQ ID NO: 34840 - DNA, 360 bp, Glycine max
  Peptide Sequence Number=SeqID_151618
atgccccgtggcttctccatgacaagcacacgttgcgttcgagtcgtatcctcagaaaaatggaggttgaggaaacctagcaggggttatgactaccattgcattatcgagtggatatgggagcaagtcagcataggacaccagaattggggtgaattctacaggtgggttttgtggtttgatttagggatggcctttgtggataactgggtggtgggtaaggagaagggttgttattggctgagtaatgacattgtttggccggtgggaagtttccatgtaggaacgacaatcgcagcatgggtttctccttcatctcaccctcttcatttgcctcagttttctcattcgtccaagtag

SEQ ID NO: 34841 - DNA, 391 bp, Glycine max
  Peptide Sequence Number=SeqID_151619
atggcagcgcaattcatccatgaccgagtggagatggagtgcctagagggagtttgggataccctcgaaggcaatgcgaggtgccgattccgtggcacgatccgactcacggcaacttcgttggtacatccagaggaaccagcacgcacgcttcagcgcactctggagtggatattacctacacctactccatatctactagtggagccagtccaagtgattgaggtgacgtcatctgaggaagaccccgaggaggacccagaggagctacctcctgagcctgctgtggatgctcttgactttctagagggtgatgaggacccactccttgaggttgattctcccgaggacgtcatgttggcatatgaggcagactctacagaggagagcg

SEQ ID NO: 34842 - DNA, 234 bp, Glycine max
  Peptide Sequence Number=SeqID_151620
atggagcagtatctacaacacttgctcagcctcagtcagcagggccagggtttcgtttcttttgcgtgccctactccagatcaatttaggattgaggtcgcatggcccggagaatggcccgaggcccaggcagaggaggcgcctgcaggagcacccggcgatgcagaggaggcccgcatgaatgaggagatgacagacttgctcggtttcttgggaggaagcagagccgcgtga

SEQ ID NO: 34843 - DNA, 189 bp, Glycine max
  Peptide Sequence Number=SeqID_151621
atgatctcgcttagtgagacgagctcgctaagcgggagtctacttttggtgctaagtgcgacaatttgcgctgagcgcaattcctcttgtgctaagcgcaacaattctcgcttaagtcaaatcatagggaaatgtcttaggaacttccagcccaaatttgaagacaatccaatggttaatgaatcgtag

SEQ ID NO: 34844 - DNA, 405 bp, Glycine max
  Peptide Sequence Number=SeqID_151622
atgaagatgaaagccaacaaaacaagaaatgaattgaaagtctcggattcaaaaacttactggttgaagaccgaagaacacacaaagaacgtacgaagaacaatgaagaacgatggaaaatcttcacggaaacgtctcagaagctttacggaagcacctcagcttggattttcttcacggaaacacagtttttcactcaaaacagctgaaatgcatagcatagggttaaggaagtattacggaagcctatcagacttgattttattcttttttgtccttcctctcaccaatcttaagtggaaaaggcttacccagggttacggaaattttacggaagcattacgaaagcctcggaggtccattttcagaaaaagcagggaggtgcttgctgccctgctcgcctag

SEQ ID NO: 34845 - DNA, 711 bp, Glycine max
  Peptide Sequence Number=SeqID_151623
atgaagatcgttgccaaggcagatccatttggcagcgacgagaatggcatagacggtgaagaggaaggggtggtggagattggtgtccctgaatatggccgcaaacacaacggaaagggagaggtggaggtcggagggaaggatgcagcgactggggggctcgtgcggaatcggtgggaagctgccatgggaaggggaggcagcgtgatttctgctggtggtggtggctttgcaaaggaagaagatgggaaagttgggtggttaccttgggaagcagaggcaacatggttccggctgggggtggtgacttcgcagaggaagaagatggagagggttgtctgggtaccatgtttgaccatggaggcctcgaggcgatccacacaggcgacagaatgttcggcgtcctccattgaagagcagcaggctggaccaattgttaggaacagaggacacaagccttgtttcgaggacaaggaaaacctccttactctaaaaattgctttcaacaaattctgttatggcctatggctagatggtgatggtactgtaatcattgctgcttcttcctatcacactgtcagtgttgtctttatcaaaactttgaaattgaatacgaggctggtcttagtcacagactcacagctaacacaagtcaccattagaatgatcattatagggaagagtccaagtagaattgtcgatataggatga

SEQ ID NO: 34846 - DNA, 321 bp, Glycine max
  Peptide Sequence Number=SeqID_151624
atggtccacgtcgatcctgtgaccgggaaggccgacaatccccacaagaagaaattaagaacatatctggggattgtcgctcgtgataaggtcgacgtgacatacaagaattggaagcaagtccttgttgctctgaaggatttgatatgggaggatattctgtttaagtctaacttgacgtcaaaatgggcatttgcagtcgacaaggacaatgtcgatgtcactgtatgcaaaaaattcagcattagcaaagagaaatgggcccaattttgccagagccacagagacccctcgtgggaggatgtgcggaaaaaggcatag

SEQ ID NO: 34847 - DNA, 477 bp, Glycine max
  Peptide Sequence Number=SeqID_151625
atgttgtgtaatcgattaccagaggagaaaacccttgagatcgcgatggcagcgcaattaatccatgaccgagtggagatggagtgcctagagggagtttgggagaccctcgaaggcaatgtgaggtgccgattctggggcacgattcggttcacggctacttcattggtacgtccagaggaacccgcacgcatgcttcagcgcactgtggagtggatattacctacacctactccatatcgactagtggagcccgtccaagtgatagaggtgtcgtcatctgaagaagaccctgaggaggacccagaggagttacctcctgagcctgttgtgtatgccattgactttccagagggtgatgaggacccacttcctgatgtggattctccagaggacgtcaagtcagcatctgaggcagactctacggaggagagcggccctggagggatagtgactaatggagactcttcatcatag

SEQ ID NO: 34848 - DNA, 726 bp, Glycine max
  Peptide Sequence Number=SeqID_151626
atggagaaactggtgggcaatgaaaatctgcttccaggactgaaatttctatttgcctttattgaaagtgtctttagtgattgtggatccagtaagatttccttgcaaaagacaactaagaagtcttcttctggcaatagtcttgcggtaggacattcttctgctagactggttggatccagaaaaaattctgagacatttatcctttctgccaatcaagaagggggatcaacctctctcgaatgtgatgcaacttctatggatgaggatgaggatgatgcaacttctgatggagaggttcttagcatagataaggacgatgaagaggatgctaacagtgaaagagcccttgcctctaaagtttgcacatttacttccagtggcagcaatttcatggagcaacattggtatttctgctatacatgtgacttgactgtatcaaaaggctgctgctcagtctgtgccaaggtttgtcatcggggtcatcgtgttgtctattcacgttcaagccggttcttttgtgactgtggagctgggggtgtgaggggtagtaattgtcaatgcctgaaacctcggaagtttactggagatagcagtgcacctgttcgtggctcaaatacttttcagtcatttttacccttccctgaggatggagatcagctgccggacagtgattcagattttgaagaagaaatcagttcagatgcagataactctctcagttat

SEQ ID NO: 34849 - DNA, 751 bp, Glycine max
  Peptide Sequence Number=SeqID_151627
ccgatcattatgccatcgccgatctgcagctggacgtgctgcgccgccgggcggtgcgtcaggaacaggtgatcccgttgaccaacaaggagttcatgctgctgcacctgctggtgcggcgcgagggcgaagtgctgtcgcgcacgcagatcgcctctcagcgtgcgcggcatcggctatgtctgcgagccacgctcgtgaacgggcgcacttcacgtcggccggtgtcgctgacgctgcgcaccgccacgctgttcgcgctggtggccgctttggtggacgtgctgattttccaaattccggggcaaaaaccgctcatcaacgtgaacccggccggggtggcattgccgccgatcgcgccgacgccggccggccaggcgcagacgttggccgccgtgcgcggcggggaaacggcgcagggggtgccgctgcgcgcggcttcagcgatggtgcgcctggaagacggcagcctgttgcagatctccgccgcgcacgtgatggtcaacgagcagaagatgctggcgcgttacctgtggcgcatcgtcgcggcggtggcggtggctttcctgctgattgcgctgttggggtatggggtcatgcgccggggattgaagccgttatggcgcatggcggcgcaggcgtcgcagattgcgcccaatacgctgtcgacgcgcctcaacgagcagggggcgccgaaagagttgcagcagttgacccgttcgttcaatgcgatgctcgatcggttgaatga

SEQ ID NO: 34850 - DNA, 264 bp, Glycine max
  Peptide Sequence Number=SeqID_151628
atgcaccagctgcagaccctgagcactacatacagccgcccagccccccaggttccagtagcatttgacccccctccacatgtggatgattacgagggatatgaggcgattgcacagaggttggagcgtgtgctcaaccttaggatagtcactgcaggcacagagttatatgacattatgcaggactgcctgacaatcgggagagggggacccagtgctaatgggactgtcagggctcgtcagagatgccgcacggaccattga

SEQ ID NO: 34851 - DNA, 374 bp, Glycine max
  Peptide Sequence Number=SeqID_151629
atgggtacaactgatattggacttgtctaccatggagacacgtcttgtgctcttgctggttatttagattttgactatgctgtagatttggatgcaaggagaactgtgacaaggataagaggtgagaggaggcgccatctactagaggataagccattgaaggagaagcttcaccaccaaaagagtgccttggataagaagcttaaagaggaagcttcaatgaaggaagagaacgagagagatagagtgatgcaatcctaccccctaagggcattggatagaagactccaagaagattgggccagagatgcaagagaaggcgctacggttctcatgagccttagggtagatttcagggcaatgacatgggctaa

SEQ ID NO: 34852 - DNA, 305 bp, Glycine max
  Peptide Sequence Number=SeqID_151630
atggcaagtatggacaactctttcaaggagtgttttgtaaaaggctgcaaagaaatgaggcagaagacaactgcagaaataaagtacctgaactttgtcaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 34853 - DNA, 1387 bp, Glycine max
  misc_feature (150)..(150): n is a, c, g, or t
  Peptide Sequence Number=SeqID_151631
aaccagctttgacaggaagaattgctcgttggcagatgttgttgtccgagtatgacatcgagtaccgcactcagaaagccatcaagggtagtattcttgctgatcatttggctcaccaaccaattgaggactaccaacccatcaagttgnactttcctgatgaagaggttatgtatttgaagatgaaggattgtgatgaaccattgcctggagaaggtccagattccgagtctagatggggcttgatatttgatggagcagtgaatgtctttggcaacgaaattggggtagttattatcactcctgaaggtaatcatctccctttcgctgcaaggttacagttcgattgtaccaacaatatggcagaatatgaagcatgtatcctgggcattgaagaagccattgacttgagaatcaagaatcttgacatttacggggattcagcgctggtggagcttcaccacatcccttgtgatgaaaaccagatggcggatgcgttagcaactttatcctccatgtatgaagtgagtcaccggaacaatttgccaacaatcagaattcagcgcctcgagaggcccgctcatgtgtttgcagtcgaagaagttgtggatgataagccatggttccatgatatcaagtgttttctccagagtcaggaatatccactcggagcatccaacaaagacaagagaaccttgagaagattgtctggtaacttctttttgaacggtgatgttttatacaaaaggaactttgacatggtactactcaggtgcgtagacaagcaagaagcagaacttttgatgcatgagatacatgaaggctcctttggaactcactccaatggacatgcaatggctaggaagttgctaagagcaggttattactggatgacaatggagacagattgttgcaagcatgccaggaagtgccacaaatgccagatttatgctgacagaattcatgtaccaccaactacacttaatgttctttcttctccatggcctttctttatgtggggcatcgatatgattggtagaatcgaaccgaaagcttcaaacgggcatcgtttcattctagtggctattgattacttcaccaagtgggttgaagcggcatcctatgcaaatgtgactaagcaagtggtagttcgttttatcaagaatcagatcatctgccgctatggtgtgcccaacagaatcattacagataatggaacaaatttgaacaacaagatgatgaaagatctgtgtgaaaaattcaagattgagcatcacaattcttctccttacagacctcagatgaatggcgcagttgaagctgcaaacaaaaacatcaagaagatagtgcagaagatggtgatcacatacacagactggcatgagat

SEQ ID NO: 34854 - DNA, 557 bp, Glycine max
  Peptide Sequence Number=SeqID_151632
atggattacataagggcaagtataccctatgcacgcattaatatcgtcactactagaaaagcgggattctacattagtgtcgcaacgtgcccttcgcgggcgagcgagggcatgttgcgacagttggcgactcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 34855 - DNA, 267 bp, Glycine max
  Peptide Sequence Number=SeqID_151633
atgagccatgggcgcctgtatcaacaaaggataaagaacacgttcgacaagaagctgtgttcgtgcaagttcaacgagggggaccttgtgctgaaaaaggtatcccacgctgttaaagataatcgagggaagtgggccccgaactatgaagggcctttcgttgtgaaaaaggctttttctggaggggctctggtgctcaccaacatggatggggaggagctaccctcacccttgaactccgatgttgtcaagcgatactacgcttag

SEQ ID NO: 34856 - DNA, 438 bp, Glycine max
  Peptide Sequence Number=SeqID_151634
ggcgtcctcaagatatgttttcagatacggctatacaattacaaccggtctttgctcaatggatacaaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccag

SEQ ID NO: 34857 - DNA, 453 bp, Glycine max
  Peptide Sequence Number=SeqID_151635
atgagagaacttcatgaagggatctatggtctccacaccggaggacactccctatccaccaaagtggtgcgagccggctactattggccaacactcagggcagacaccttcgactttaccaggaggtgtagacgatgccaagagtttttagacgtgttgcgcactcctcttgacaatcttctcaatttgagctccccttggcccttcgccatgtggggaatggactacttcactaagtggatagaagcaagaccaatatgggaaattgtggcaaacgaggtagagaaattcacctggaaacacttcatctgcaggtatggcctctcatacgccattgttatggacaatgacactcaattcaaagctcaaacttacgaagacttcttgacaaggttaggcatgaagcacctaggcacctctatcaaacaccctcagactaacgaacaagcatag

SEQ ID NO: 34858 - DNA, 204 bp, Glycine max
  Peptide Sequence Number=SeqID_151636
atgtcgtttatatcaccagtagtggatggagaatttagaaggaaaaacaacaatgattacatgaaaaattacttctgtccccatgtttacccaaaaagctgcatttataggcttcagcagtatgcaaaatatgcagaagttgtgattgaagagttatctctgaatttagtggtagtcgttggatacaggcaggaaagggtgtaa

SEQ ID NO: 34859 - DNA, 153 bp, Glycine max
  Peptide Sequence Number=SeqID_151637
atggatcaatatgactttttcggggatggcgaggatggacattctcaccctgggtcatggtttatggtgagttgggattttggctcaaggcttgtagaacggatggacatgatatatgtcagagtgttggtttggccagcgattcagggataa

SEQ ID NO: 34860 - DNA, 411 bp, Glycine max
  Peptide Sequence Number=SeqID_151638
atggaggagacgcatgaaattccccaccacgatctagccgacttcgagccttgcctcggatatgccgctaaagggcaagcagttggtggtgtacccctgcaaaagactttggagggccctcagtatcatccacaaccacaaccctcacgttccacaacaagtaaaaaccctcgtgctatgacagaaatggaaaagttggatcatttagaggaaaggctcagggccattgaaggaggtgaagattatgcctttgctaatctaaaagagttgttcctagaacccaatatcatcacccctcccaagttcaaggtgctcgactttgacaagtacaaggtgactacttgccccaagaaccatctaaagatgtattgtcagaagatgggggcatacgcaaagatgaggaactgctaa

SEQ ID NO: 34861 - DNA, 975 bp, Glycine max
  Peptide Sequence Number=SeqID_151639
ttacgagaaaatggttgcaagtgcaccaacggacttcaccgaaatggtcaacatgggggtgcgattagaggaaggtgtccgagagggacgtttgactggggaaagtgcccctgccgcaagaaatgccaagaagtttggaggccacttgcgaagaagaaagatcaagaggtgggaatgatagctcatggtaaacctcagcagaatttcaccccatatcgtcaggttgcgaatgtcgcatccactatcccaaacccatcatatcaccaacaaaggccacattacccttaccctccacaacaataccctccacaaccataccctccacaacaataccctccacaacaataccctccacaacaataccctccacagcaataccatcagccacaataccctcaaaaacaacaaaatcgcccgcagaccccccaacaaccatatcactcacaaaaccgccagaaaacaacctttgatccaatcccgatgaaatatgctgacttactccccgccctgctcgccaaaaaccttgtccatgtcagaacaccccctcgtacaccagatgttttacctccctggtttcgtcatgatttaacctgcgctttccaccaaggggccccaggtcatgacgttgaaaactgctatgtcctgaagaatgaagtgcaaaaactagtccgggccaacttgctatccttcaaagatcagaatcccaatgttcaggcgaaccctctgccgaaccatgggcctgctgtcaacatgatacaagattgtgatgaagacggtgtcatcctgaacgtccaacacgttcgaactcccctggtcccaatacatatcaagatgtgcgaggcagctctgtttgaccatgatcatgcagcgtgtgaaatatgtcctgtgaatgtaaaaggatgcccgaaggtacaagaggacgtacaagggctgatagacagcagagaacttatcatcacgaggaaggacaaagag

SEQ ID NO: 34862 - DNA, 219 bp, Glycine max
  Peptide Sequence Number=SeqID_151640
ggttcccctcggtgtggggtttcaacggagaacaacggtggtttgtggtggctaagggtggatgtgggtgatggagaaagttcttgggacaccaaatttggagacgatccaacggttaacgaaggctgggcagcgtttataccgaggcagcttcatgtggcttccttgagaagcttcattaagaggcttcctcaagaagattcctcgtggcttctttga

SEQ ID NO: 34863 - DNA, 303 bp, Glycine max
  Peptide Sequence Number=SeqID_151641
atggggatcgcacccacaagacacccagtggacccggaaaagtccaacagggccctggggtttccagctctggttacgggcctctatcagtcctacaggatgcccgtacccccccggcaaggttatgtcatcatagggatcgcacctgcaagacacccagtggacccgaaaaaagtacctgtaacctccagcaagggcatcaggccccctactgatcgagcttcatcaagaagtactgcgtccctaggcaggcgcagggcgaaacaccacagcagcattgggatggccggtagcgggcaatag

SEQ ID NO: 34864 - DNA, 279 bp, Glycine max
  Peptide Sequence Number=SeqID_151642
atgcatatgacacagatgcaatctaggaatgcgggggcccgaggaaatgtccccttcttagataagacgtcaagcggtagcaaagtgccccaacgtagagaggatccagacagaacccctatgcgatgcatatgcaagaggcgcaacaacatgacaatatccactgaacataagcaaaaagggtatatgatatttatgcatggcagtgtgaaaaatggcacgcagcgggtttgctccgtgcccctatttaagggacctataagggagagaactaactag

SEQ ID NO: 34865 - DNA, 417 bp, Glycine max
  Peptide Sequence Number=SeqID_151643
atggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggacttttgaaaagagagtcaaagagtgcttgaaattgttcgggagggaagcggatgggggccggcgatgtgtctcggtcggatgtggaacg

SEQ ID NO: 34866 - DNA, 291 bp, Glycine max
  Peptide Sequence Number=SeqID_151644
atggctcagaaggaggagacttctacagaccagatcccagagccatccccaacacccttacctgatgatgtcataccatctgcaccaacatctgagttagagcaacctatctctcaggattcaccagctgctcaagtgttggaccttaatgagtttgcacaggagcaaccacaggagcaggacgcattagaaaagaatgagcatgtgattggaagtatgactgaaaatgttagtcagtttgtcagattgattgtgaaggaattcattgaccgtatctcagtgagagtgtga

SEQ ID NO: 34867 - DNA, 294 bp, Glycine max
  Peptide Sequence Number=SeqID_151645
atgacaaaattttgtctctgcgtgtcatcgggcccgccgcctctggatgacaaaagggtccggataaccgtaaggtatctccgcgtgtcatcgggcccgccgcctctggatgacacaagggtgcggataaccgtaaggtatctccgcgtgtcatcgggcccgccgcctctggattacacaagggtgcggataaccggtcagtatgacaaagattatggggcggccgacaaatgcaaggctcttgctcctacgtatcctccaatgaggaactcagacctacgtagttctagataa

SEQ ID NO: 34868 - DNA, 108 bp, Glycine max
  Peptide Sequence Number=SeqID_151646
atggcttcacctcggctaagcgagacccaatgtcaccaagtccaattcattgcggtcagaattgagggccatagggatgagcaccttagcaccactgatggtcgttga

SEQ ID NO: 34869 - DNA, 135 bp, Glycine max
  Peptide Sequence Number=SeqID_151647
atgcctcaactcgcggttttgatctcccatattggggagttgtatggctgcaatgattcctacacaagggatgaggccaagtgtaccctgggcggtagcaatagtggactcgacagtatagatatcataccttag

SEQ ID NO: 34870 - DNA, 252 bp, Glycine max
  Peptide Sequence Number=SeqID_151648
atgacacccactccctcaccttctgtctataaggagtgtggggagacaggttatgtggttaaagactgcctatacacccaagccctggaggaagtgaactatgctagtggaaagaatattgatactttaatacctacaaccaagggtggagagatcacccaaacttctcttggaaaaagtagagagatcaaaggcaaagttagagtcagaaccagaataggtctaagcaggaggagaggagaccaaccttga

SEQ ID NO: 34871 - DNA, 441 bp, Glycine max
  Peptide Sequence Number=SeqID_151649
atgtcacgaaatgttcgccgaggtggacaaatatgggtacgcatatttccagacaaaccggttacagtaagacctactgaaacacgtatgggttcaggaaaagctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaaggaactcgaatcttttgtgcaatcgcccgggaattgagacagttcaatttcactaaaatagtttcattagcacccgaggtattataa

SEQ ID NO: 34872 - DNA, 552 bp, Glycine max
  Peptide Sequence Number=SeqID_151650
atggcatctaagaagaggaaagcaccctctacacttacccaagccagatttgataaatccaggttcacatctcaagaggcatgggagagatacacggatattgtggagttgaaaaactttgtggatggcagtattgatgtggccatcgtaaaggagttttacgcaaacctctatgaccctgaggataaaccacctaagcaggtgaaggtgagaggttgtttggtgaaattcgatgtagacaccttgaactcattcttgaagaccccagtgatacttaaggagggagagaactttccattaaacgctgatggactgccattaaagatcttacggaagaatctgactacgctcgctcagacatggagtgttctttctttttctaacttggtccctacctctcatacctctgataccgcattagatagggccaggcttgggtttccagccttaatcactgctttgtgcaaggccaggggagtcgtttctgattcattgacattggagagccttggtgcagctattaatgtggcttatgtaaagaaaaactactag

SEQ ID NO: 34873 - DNA, 117 bp, Glycine max
  Peptide Sequence Number=SeqID_151651
atggaggaacgtcgcaagagaaaaggggctgcgcagggatttctggaaaatgtgatatttatagagcaggacgcgtggccatctgttctagtgtcatcgattacagtattcatgtaa

SEQ ID NO: 34874 - DNA, 214 bp, Glycine max
  Peptide Sequence Number=SeqID_151652
atgggtgccaagcaccttgcaaggaccaaagaaaagtcgcatgtcatcaagcaaaggtccccggacgaaattagggatgccaaattggctgtttattatccagatgaacatcagacaccaactgacactacacaacatgatcaatttgtcggctatgacagctcagattccagtgatgatgatgtaaatatgacacaggaaaacattgatatag

SEQ ID NO: 34875 - DNA, 267 bp, Glycine max
  Peptide Sequence Number=SeqID_151653
ggtgtgcaaatagcaatcaggcccacttggaccttccagggtgttccaacaaaaggtggttccttctggtggaaacaacccatcttgcccgggcgagctgagctcgcctgggcgagctgggcgacaaccacctccctcttttcccctataaataggggaaagagggcagagcaaattcgttcaaccctcctggtatctgagattcacttgaaattagtgagaaaaattgtttccgtgaagaaaatccaagctgaggcgcttccgtaa

SEQ ID NO: 34876 - DNA, 240 bp, Glycine max
  Peptide Sequence Number=SeqID_151654
atggatggccaatgggtgcgtaaacaagaccttccacctccaattcctgatgaacacacaccctccccaccaccacaacgagattcctcctcttccttattgaatgatgttcgcactgagctttgggatctccgggctttcgtcggtgatcgtttcgatgctatggactcccgcatcacgtgtcttgaagacgacatgagcttcattcgtcattgctttgatcctcctgcagatccatag

SEQ ID NO: 34877 - DNA, 732 bp, Glycine max
  Peptide Sequence Number=SeqID_151655
atgtctcgttttagagttagtgatatcgtagtgacaagacggtcgttacatactcattctgattatctaaatttggttaaagaagcttggaatagggacgatggaggagttatttatggtcttaataatgttggcaaagactccatagttttcaatgttgaagtgaagtattattgcaaggaagaaaaatgtgggtctgccaaaaatatagggactaatgtctgtcctcttcctcaagaggtgattccaaatttggtaaagcttgttactaaggaagaagttggagatgatgtttggagatttgttagagaagcgattcagaaggtgaggtggaagccagttaagttgacctcaaatggccctagtgtttctcatttactgttcgcagatgatgtcttactgtttgctaaaggtcaggcatctcaagctaagcttattatgaatattttgaatgatttttcatctttgtcgggattgaaagttagtcttgagaaatctaggatttttgcttcttctgcttggaaaggtaggcttctaaataagccgggtagaatggttatggcaaatgttgtgatgtcttttattccttcttgggatgcgcatttgatgaattgggagattatttcaaggcctaaaaggaggggaggtttaggtgttagagtggcaaagttgcaaaatacgtctcatggaaatatttttttggctaagaagactaaaggctttaagacttag

SEQ ID NO: 34878 - DNA, 375 bp, Glycine max
  Peptide Sequence Number=SeqID_151656
atgtctcattttcaaggatttttcaaaggaagcgtggttacctcgaagaaaccacgaaagaagagtcgagagcttcatttctctatcgaatccttgaggtggattctgaagattctgctccaattaaagtgttcctctccatgtagtggtctgaaggcaagcaacggaagcttgtggtggccaccggtggtcatgggtaatggaggagaaggaattgcacttagcgcgcttgtctcgctaagcgagctgtccatgggtgttatttgcaaaatcacaacggtcaaaactcgtagacatgagtcacgaaacctacagtttaagtttgaaggcgatccaacggttaacgagtttgaggtcatggttttactgaaatag

SEQ ID NO: 34879 - DNA, 318 bp, Glycine max
  Peptide Sequence Number=SeqID_151657
atggcagggattgagagttttaacgaaagtctggatgatatggttgaagaggcacatctggtgtttgattccatgcctcagtgtgttacaatgaaggttttgaaggatgtcaagtttgacccagaaacctatttcagtaaaaccatgacctcaaactcgttaaccgttggatcgccttcaaacttaaactgtaggtttcgtgactcatgtctacgagttttgaccgttgtgattttgcaaataacacccatggacagctcgcttagcgagacaagcgcgctaagtgcaattcctaacccaagagtgaaattcgattag

SEQ ID NO: 34880 - DNA, 2229 bp, Glycine max
  Peptide Sequence Number=SeqID_151658
atgaaggccgtgcccctaccctatcaggaatttagagggaacggggtgctagattttgcttctggtgctgctgctgctgtttcagattcgttgttacttccacagcaagagcaatttctgcaaaggtggaacccccaaagggaaaacttttgctatgtgggcattgagccctcttctggtttggaccgcaaaaggaaaacaagcagccctcccacatcctcctctacactatcttcctcacgcgccagcagcggctccacggatagcacgacaggcacggccacggcgaccgcggctgagaaggagaacaacccacctcaagcagggttagaggttggacaggcaagatgtgggctgggaatggaggattgggagagtgtgttgtctgagtcaccaggtcaagatcattccattttgaagttgattatgggggacattgaggacccatctgtgggtttgaccaagcttttgcagggtggaagtggctctcaggatgttgaattcaatggggttggagtgggttttggtttggtggatcagagttctgtgcttttccctattcctagtgtgaactttgtgagcagcagcagcagcattgacccttctggtactgggaattgttctgatttccctttcaattctcaaactaatgttagccccaatgttcctagggttggttctggtgtgaatccaaacactactgggttccctgcttcagctagcaatctctcaccagtttcactccctcagggtgtgtttctgcctcaacaacaacaacagcatcatccaccaatagagcctctggatgagaagctacaagttctcaatcctcagttcattttgaaccaaaatcaatctcagtttatgccaaacgcgggtttggttttgcctttgacatatggccaactgcaagaaaatcatcaacttctccctcagcctccggcaaaacgcctgaattgtggcccaaattatcaggttccaaagacaccctttttggactctggccaagagctgttacttcggaggcagcaacagcagctccaactgcttcctcaccatcttctgcagaggccatccatggtggtggcaccaaagcaaaaaatggtgaactccggtggccaagacttggcgacccaccagcttcaacaggctataactgaacagcttttcaaagctgcagagctgatcgatgcaggtaatctggaactcgcgcacgggatattggcgcggctcaatcaccaactttctcccattgggaagccttttcagagggctgctttttatttcaaagaggccttgcaattacttctccattcaaatgccaacaacagttctttcaccttttcacccaccggccttctgctcaagattggtgcttacaaatcattctcagaaatctcaccagttctgcagttcgctaattttacttgtaaccaagcactgcttgaagctgtgaaagggtttgatcgcattcacataatagattttgatattgggcttggtggacagtggtcttctttcatgcaagagttagcactcaggaatggcggtgcacctgaactcaagatcactgcatttgtgtcaccctcccaccatgatgaaattgagctcagtttcactcaggagagcttgaagcaatatgctggggagttacgcatgccctttgagctggagattctgagccttgagtctttaaattctgcttcctggccccagccacttcgtgactgcaaagctgtagtggttaacatgcctattggctctttctcaaattacccatcatatctacctttggtccttcgttttgtgaagcagctcatgccaaaaattgtggttacattggatagaagttgtgatcgaactgatgcaccatttcctcagcatctgatttttgcacttcagtcttattcagggctgcttgagtcacttgatgcggttaatgttcacccagatgtccttcagatgattgagaagtattatcttcagccatcaatggagaagcttgttttgggtcgacatggtttgcaggaaagagcacttccttggaagaaccttctcttgtcatctgggttttcaccattgacatttagtaactttacagaatcccaggctgagtgtttggtgcagaggactcctagcaaggggttccatgttgagaagaggcagtcttcccttgttctttgctggcaaaggaaggatctcatctcagtttcaacttggagatgctaa

SEQ ID NO: 34881 - DNA, 210 bp, Glycine max
  Peptide Sequence Number=SeqID_151659
atgtggttattcatgattttggtagaggaagtagtgatcacttggttgaaaatggaagggataggaagtgatgattcatttaagttgccagcttatttttatgtttgctctcttattctcaagattcatccatggaattcttatgttttgatggttgtttgttggatcaaaaaaccaagccaagatgaagagcaaaagggtcatttttga

SEQ ID NO: 34882 - DNA, 225 bp, Glycine max
  Peptide Sequence Number=SeqID_151660
atgcatcaccaggatcctaatccttacccttggcctactccagagcaatttagagctactattaaatggcctagaggcgggcctatttttcaagaggaggtaggtcctgcaggtgagaaaggtcctatagatgaccaaggggatgcgcatgaccaaggaggaggaagagcagatgaggatgaagacatggcagatcatgctgattatttcattggagaagactga

SEQ ID NO: 34883 - DNA, 267 bp, Glycine max
  Peptide Sequence Number=SeqID_151661
atggcctctggtaatcgattactaagggtgggtaatcgattacaaggcttaaaagtgaagacaggaagctacgatggcctctggcttagaaatgggtctggaatgttgaaggggcctctggtaatcgattaccaatgttgtgtaatcgattacacagaggaacaagccactagtaatcgagtaccagttatgtgtaatcgattacacagtgcattttacaggttttcatgttctgaagctgtgaaattcgtgtttggcctctggtaa

SEQ ID NO: 34884 - DNA, 213 bp, Glycine max
  Peptide Sequence Number=SeqID_151662
atggcaacgcaactaatccatgatcgagtggagatggagtgcctagagggagcttgggagaccctcgaaggcaatgtgaggtgccgattccggggcacgattcgattcacggctacttcattggtgcatccagaggaacccgcgcgcactgtggagtggatattacccacgcctacaccatatcgtctagtggagccagtccaagtgatcgag

SEQ ID NO: 34885 - DNA, 297 bp, Glycine max
  Peptide Sequence Number=SeqID_151663
atggggaaatttgccgttaatgaacctatgaatgaatctgtgaatgaattgttgaatgaatctatgaatgaacctgtaaatgttaatggacaattttatgaggatgaggtgaatacaagtgatgatgataaaagttacgaaatggatgatgtgaatttattgagggcacttttccaacagatgagagtgataatcagtcttatgaaagtgagtatgatcttgttggtgagtatggagattggagtgataaaaatcagagtgattgtgttagtgattttgaggaaacccgcgatgtga

SEQ ID NO: 34886 - DNA, 450 bp, Glycine max
  Peptide Sequence Number=SeqID_151664
atgcctgaactggatgttaagaaaaggggaggttaccccaatattgatccttctgccttgaaaaggttaccagaaaggtctaggaaaactaggaggaagagtgaagttgaaggagaatctggtgctgacaattctgaatctgtccaagctaattttgcatgttcacaacaatctaaagtcaccaaccagcaaacacaaatacattcacaagtgccagatgaatcttcaagtggaggagtgaacactacagaggatacaagagcacacttaaaaaaaggcaaaaacttagagctaaaaggaagacaaggatgcaggatgcaggattgtacaacgtctatattgttactttatttattggctgaatttaagagtggcggaagtacaataatgactatcgctgatgttgctgcacggggccttggtaggatcactgcgtgtttagaagcttag

SEQ ID NO: 34887 - DNA, 582 bp, Glycine max
  Peptide Sequence Number=SeqID_151665
gacggtgagactgttggggcagctgggggtggcagagtggcaaaccaacttctcccaggcactgaacgcagaggagaggaagtagtgggagtgggcatggacatggtcgtggcagtgggttgcatcggtggcgacgaggaaagggtagttgaaggtgaagaggaagacgaggatgagtgcgaacaagagagtggttgttgtatcgctttagctttatgctcttgctgtaagatatgcaatgttgattcgaataagtttggaatgttcgatgcacatgattgtgtgaacaacattgctaatgacttagacttgccaccatgtcacccttttattttgtggtttcgttctactgttaatggtaaaattctttcctttaaggttgatgctgatgtgtcgaacataaaggatgggttctggaacttacctgtgatagaaaatgtgaatgaacctgtgaatgaaaatgttaatgaaggcaaattttcctatctgaggacccaaatcgccagaaccagtggcgagtttggtgtcgttgagcaaatcgccagcgtcaatggcaataccagtgaccaaatcgccacttga

SEQ ID NO: 34888 - DNA, 747 bp, Glycine max
  Peptide Sequence Number=SeqID_151666
atggctccagatagagtgcaactacaaaacatgtgcaagagatatattgaatctgtcaaagaatgcgctcaaaggtggagagatttggtggctcaagtagtgcccctaatgacgaagacagagatgataaccatgataatggacgcattaccggtgttctattacgagaagaaggtaggttgcatgtcttcgaattttgtagatctagtgtttgttggtgagatgatcgaagtgggtcttaggaaaggaaattttgattatgctgcttctacaaattctagtaataggagacctgcaatgagtggagggaagaagaaggagggagaagcccatgttgtgactacagacttactcccgtatttgctcaacaatgaaatggtggcaataagcccaacaaagattcctcaacctacatttccccaaggatacaacccgaatgtgacatgtgcttatcatggtggagctccagggcattccattgagcactgtatggccttgaaacataaggaagacaatcccaatgtgcgaactaacctgctcgcgaacaatgggagttcttctatgagtgttatagaggatgaggagacatgggaattgaagagaagggctgataaggttgattataagggtgatgaggaggattggtgcctgttgcatccaaagacacttcatgatgtacaagtatgcccaatgtttaaggagcttttaaagggtttgatgaatgagagtgatagctgctatttatga

SEQ ID NO: 34889 - DNA, 378 bp, Glycine max
  Peptide Sequence Number=SeqID_151667
atgatacgcggagataccttacggttatccgcacccttttgtcatccagaggcggcgggcccgatgacaagcagagaccaagtttggtcattctgcacccttgtatcatccagaggcggcgggcccgatgatacgcggaaatacccgagtgacagaacgcttgatagcatgcagaggctgacacagtcttctgcaccttttgttcctccgggaacagcaagtcatttacatgcggaaattttcatggtcacccgcgactctcgtcaaccgagaggagcgaaattagtgtcatacactgatttttcgtccggggacctttgcttgatgacatgcgaccattctttggtccttgtgaggtgcttggcatcccatcattag

SEQ ID NO: 34890 - DNA, 303 bp, Glycine max
  Peptide Sequence Number=SeqID_151668
atggattcacgcgctaggagtggtcccttcaatgcttcactagaaatagaaattcgcgaggatatgttggtaagctgcccctcctcaacagcatatgtagaggcagcggaggaatcattggaaacagctttgcaatccttcgaggtggtaatgctcaagcacggttatgagcccggaatgggtctgggcaaggacagtcacgggaatgtcgatgtggttgacattaggggtaacccgtacaaatatgggttggggtatgaacccgggaaacctggaagaaggaatgcaccatcaagactttag

SEQ ID NO: 34891 - DNA, 162 bp, Glycine max
  Peptide Sequence Number=SeqID_151669
atgcaaaacagtggggttaatctaagggctaaatctcaacaatttgctactgcacatgatgacaatcctcatgtagttaccatgccttactttggagtcattgaagaaatcgaggagatctcaagaagctcgcttattagaatgagtttttcatcatggtag

SEQ ID NO: 34892 - DNA, 273 bp, Glycine max
  Peptide Sequence Number=SeqID_151670
atggataagtttggagcaatacaaggttcaaatcctccttttctattttgggagatgacaagcgctggtttatttccatgtaaacttcgtggttttcaggttttggcaagtccttgtgcattacaaattttgacgcaaaaccacaacgagcaagacatgctggaagatgatgagatgtcattctttaaccaagaaagatttgatatgcctgatgaggagtctgtttcacagataaccctcctatatatgcccctgctaccacgccaaagataa

SEQ ID NO: 34893 - DNA, 919 bp, Glycine max
  Peptide Sequence Number=SeqID_151671
gaagaagtttaagatcttccttcagctaaccattcagaagaagattgagaattgcctaatacctttcttgatgatgcatccaaagctggagctgaggtggacttgcaagatgcctttcagaggttcacctttgacacttcctgcaccagtgtttttggatatatatgatcctatttgccttccaaacatgttcactaagctctcacactttgcttatcagaaagctttaattgtgatggaggatgtagcattccacaggcacatcacaccaagatgtttgtggaagctgcaggagtggcttcaaattggtcaagaaaagaagtttaaggaggccataaaagcttttgataagttcttgcatgaacgtattgcatctaaacgtgaagagcaaagtagatgcaataatcacaccaaaaaagaagatgacaatactcattctgacctgataagggtgctaatggaggaaggagctgaaaaagggaaaataatggatgacaagtatcttagagacactgcatttacccttgtttctgctggaagtggcacagttagtgcagagtttggcaagctagtttacctccatggagctatatgcgaagccttgaggctttttccttcaattccctttgaccacaagtgtacaatcaaatctgatatactccttagtggacaccatgttagtccaaataccatgatattttactctttgtactcaatgggaaggatggaacgaatatgggggcctagaagttgtttgggtaaagacatcacttttattgaaatgaagatggttgcagttgctttactatggaggtttcacatgcaggtggtggaaggccatcctataaccccaaggctttctattacacttggaacggaacatggcttgaaggttaaagttactgaaagatgcatttga

SEQ ID NO: 34894 - DNA, 1503 bp, Glycine max
  Peptide Sequence Number=SeqID_151672
atgtttatgtacattggagtatttgtatccattctctccaccatcattttcttccggaaacacaatagagatgaacctattacaaattggccaatcattggtatgctcccttcggttctacaaaatttgtccaatatccattatcttacaaccgaagctttgaaacattatggaggcaccctaatgtttaaaggaccctggttcacaaataccaactttatcctcaccagcgatcccatgaacgtgcaccacatcactagcaagaattttggcaactatgggaaagggtcaaatttcaatgagatttttgaagttttaggaggtgggattattaactctgatgatctccatgcatggaaacaagagagaacaatgctccactcattgcttaaaagggaaagctttaagatcttccttcaaaaaaccattcagaagaagctggagaattgcttaataccctttcttgaccatgcatccaaagctggagctgaagtggacttgcaagatgcctttcagaggtttacctttgacaatgcttgctgtatggcgtttggatatgatcctaattgccttccaaacaagttcagtactaagctctcacactttgcttatcagaaagctttaattgtgcttgaggatgtagcattccacaggcacatcacaccaagatgtttgtggaagctgcaggagtggcttcaaattggtaaagaaaagaagtttaaggaggccatagaagcttttgataagttcttgtttgaacgtattgcatctaaacgcgaagagcaaagtagatgcaataatcacaccaaaaaagaagatgacaatactcattctgacctgataagggtgctaatggaggaaggagctgaaaaagggaaaataatggatgacaagtatcttagagacactgcatttacccttgtttctgctggaagtggcacagttagtgcaggtctcagttggttcttttggctcgtttcaactcatccagatgtggaagctaaaatttttcaagagataaaagataactgtgtgaatcaagatggagattggattgcttcaagtgtggaagagtttggtaagctagtttacctccatggagctatatgtgaagccttgaggctttttccttcaattccctttgaccacaagtgtgcaatcaaatctgatatacttccaagtggacaccatgttagtccaaataccatgatattatactctttgtactcaatgggaaggatggaacagatttggggagatgactacttggactttaagccagagagatggatttcagagagaggaaacattatacacattccatcttacaagttcatagctttcaatgcagggccaagaagttgtttgggtaaagatgttacccttattgaaatgaagatggttgcagttgctttactgtggaggtttcacatgcaggtggtggaaggccatcctataaccccaaggctttctatgatacttgccatggaacatggcttgaag

SEQ ID NO: 34895 - DNA, 1002 bp, Glycine max
  Peptide Sequence Number=SeqID_151673
atggatcaaaattatgaggcaaccctcttcaactcctcatcttcatcatccccatcgtctcctgagagcagttcagccaagagattttcttattcatcacgagttactcccaagactgtaaagtcaactttgcctaacaaagcagggtggtttgaggatttggctactttacccccaaagatcattgagaagattctccagacaattggagcttacaaaacagataacaacaacttaattatcacaagatttctgcttcattatctgaaaatagtgactccaacaagagaggttaattgcaacaacagtgttgagtatgctggtctagcagaaacagctgtttatggggtcatatttgttggtaacaagagtttttcttgtagaggccttttttgggtattaaggattgtgtcaagatttgggatgagtagagattgcagaattgaaattgagaaattgattggtggggtgcttgagcaagcaactttggatgatctactattctctgggcatcatatgggactatattatgatgtaacatttgtgataagattgattaaacaatttgttgatatgaatggctctgatggggtatgtgtacaaaagttgaaaaaagttggtagattagtagacaagtatttgatagagatatcccctgatcagaacctcaaggtcactaaatttcttgcagttgctgaatgtttgccagattgtgctagggattgctttgatggggtgtacagagccattgacatctatcttcaggaatcgaaaacaagtacagggcaactcagcagacccccttggtcacataccctttttctattgcatctgttatgcattattaactttctgaagaaccatatgaattgtgaaatttctaaaactcaaacaaaaataaaagataaggggaagtactccgaccagatgggaagtgacttggccaaatgttggcattactataaagtttcttttgttcttattatctgcaactttgactaa

SEQ ID NO: 34896 - DNA, 132 bp, Glycine max
  Peptide Sequence Number=SeqID_151674
acacctcctgcgcttagcacactgatctcgcgcttagcgcacggccttgatgctgatgccatgccagattcttctgttgtgctaagcgcactgaagctgctcttagtggtggatgcgcgcttagcctactga

SEQ ID NO: 34897 - DNA, 774 bp, Glycine max
  Peptide Sequence Number=SeqID_151675
atgtcaaatgcaactcaagacaagcatgaagctgaagagttttatgaattagccaaagatgaagagccaccattgtatgaagggtgtacaaaatactcaagattatcttttttagtaaagttgcaccatatcaaatgtggaatgagcgacaaggccatgacaatgattttagaactattgaatgatgcttttggacatgcaaagattccaagctcattctgtgaggccaagaaaataatccctcatacatttgagtttgactccaggacggttgtaaggaacagggatgaggtggaatcacaacaatgcaccaaagaagaaatgtatccaaactctcatagaaagaaggatggatcatttgttaatgaagcagctaggcaagaatatgaacaattgcataatgaaattcaaaagacttcttccaaaaataaggcctttgctagagcttttgaaaaggaacatcctgaatatgttggaggaatggaacttggggtaacaccatctcatgacactgagtctatttcacactccacgagatcagtatcttcctctgagtctgtaaagatgagaaaactgcaagttgaaatcaacgcacttaaggatcaagttgcacaagttgacgtcttgaaggaacaagttgattttcttatgcaaaatgtcaagggaaacaagttgggacaagagattcaagatgttcgtctaactttagtaatgtgcttgaaaatcatggaacatcaccacggaggacaatttaaatatttcttttatttataa

SEQ ID NO: 34898 - DNA, 501 bp, Glycine max
  Peptide Sequence Number=SeqID_151676
atggctgcagggtcaaacactggttttcactgtgatgatatgggttctgctttgaactggcatggtgctgttagtagcctacctgagatggttccaatggggaattattttgggttgaatagtaacacctctgggatgacgatgatgatgtattctgggaattcaagcgtcaataacaatgtctatgaacctgtcacaagtcaacctggcaatgcatctggttcttctctgcctcttgattcagcccctggactgaggaatgaagaaaggttggctgctgagtggtctgttgatgagcagtgcaaattggaggagggccttgcaaagaaaaagaaaaattatttgagggaaaggagaaacagaactagaagaaggacaagaaactgtaaaggaaagaaaacactagatacaactaggaaagtgaaaaaactcaaggaatacagctataatgcctcatctctgtgcttatcagaaggagccattctccttagactattgtag

SEQ ID NO: 34899 - DNA, 369 bp, Glycine max
  Peptide Sequence Number=SeqID_151677
atggctagatatgacgatgagccaagtttcatgaagtatatcaaaattgcttctacattgcatgataaaactgttcgtgatgttgctttgaggtgtacatggatgactaggaagcgaaggaagccagaagaacccatggtaaagatggttaacaataggaaggataagctagtgaagtcatcttcaaagcaatattttcagtcaactccaaccccaagcatgaccacatattctcttatatcaaaccatatgaacaaaagtcaagggatactctggcaagatggtaagtatatcataagttctcatcattgcaagtgcaacaccaatatctctgattttgaagttcccattcagtttggtcaaggatga

SEQ ID NO: 34900 - DNA, 879 bp, Glycine max
  Peptide Sequence Number=SeqID_151678
atgggttccgaagtagtagaagaaccaacggaaacgacgtcgttgagttccccccgaaaaattcaaaccaacgacgctcccaccgcaaactgtcacgtgtccgttactcccaccacgctctcaatcgtgcagccacattcacttctcccaaagccagtgcctccaacaaccacttattctccaaacgacgtcgtcgtttcctcctccgccacattcgcaaaattcctccgccagcgccgcaacgacctgtcgtccgcgatcagcaaggggatctccacgctgaagcactccatcaacgaccaaaacgactgcaactgcgtgacggagttcaacctctcggggctaaaggtctttgtgacggtggaaaacaaaaacgacgcgtcgtttgcgcggggaagaatgagaatcagcttcttctcgcgctccaactgcagagagtgttgcgcagtgcgaaggttcttcagagagagagcgttgaggttcgtcgagataaacgtcgacgttttcgcggagcgggagaaggagctgagagagagaacggggagcgcgacggtgccgaagatcttcttcggcgagaaactgatcggaggcttggtggagctgaacgcgctgaggaaggacggcggcgaggagttggagaggaggctgacggcggcggtaggcgaggggccgtcggcgccggcgtacggattcgacgaggcggcggaggtggaggaggaggaggaggaggaggaggagattgggagggtagttagggttttgaggcagaggttgccgattcaggatcggtggatgaagatgaagattgcgaggaactgcttcgcggggagcgagttggtggagcttctcgttcgacaccatggctgtgctccttccaag

SEQ ID NO: 34901 - DNA, 291 bp, Glycine max
  Peptide Sequence Number=SeqID_151679
atggaggagtttgatgcgcaggtagcctggctaggagcccagccttctccttctagagggggtggggcctccgcagcccaggagcctgcttctgaggagccaacagcagcagcaacagagggggaggatgagctcacccctcctgagcccttttattttgatgcatgtatacacatggcccaggaagaggatgcttctacagaccagatcccagagtcatccccaacacccatacatgatgatgcctcaccatctgcactagcatttgagttagagcatcctatctcttag

SEQ ID NO: 34902 - DNA, 327 bp, Glycine max
  Peptide Sequence Number=SeqID_151680
atgtatgtcggaggacctcaaagaacatctttgaatgcattggtggagaatcaaagtggtggtaggttacgcataataagatcagataatgggaaggaatatgtaaatgacacctttcacaaattttgtgaagaagctgacatagagcaccaactcactgtaccgtacaccctacaacaaaatgatgttaaaagagacaagttggacaagaaggcagaaccaagagtttttatcggatacaacaaaagcactgctactccaatgaaccaaagggaaaaattcaataaagaggacggggctgataaggtagagaggagcatgatataa

SEQ ID NO: 34903 - DNA, 441 bp, Glycine max
  Peptide Sequence Number=SeqID_151681
atgttgattgttcagacacttttaatacttctcaggtctgacacagatactggtcgtagagaaagaagttcgtttgtgttaattgcctgtgaaaggagcggtcaatacaagtgtaggaataaagaatttgttagaagagacactagtactaggaaatgtggttgttcctttaggttgcatgagaaaccagtgcgtggaggggaaggttggatggtgaagctgatttgtgggatgcacaatcatgaattggccaagtccttagttggacatccatacgccgggcgattaacgaaggttgagaagaatattattgaagatatgataaagtcgatggtgaaaccaagaaacatccttcctaacattgaaggaacacaatgcccacagttgcaccacaatcaaacaaatttacaatgcaagaagtgcatatcgttcttcaattaa

SEQ ID NO: 34904 - DNA, 504 bp, Glycine max
  Peptide Sequence Number=SeqID_151682
atggagcacttcaacaacgacgatctcgagtacgttgtcgacgagtactacgacgttcccgattttgcagtcgaagacacctcctccgacattgttcctgaactaacctccgatgttgactccgacttcgaagacgagtttccaacgagtaatgcgaagactgataccactgcttccgaagccagaaacgggaaagatatacaaggaatcccgtgggagaggcttaattatagcagagacaaataccgcgagaccagactcaagcagtacaaaaactaccagaacttctctcgctctcgtcacgacctccgcaaggagtgtttggaagtgcagaagggggagactttctatgacttcttcttcaataccaggcttgtcaaatccactattgtgcactttcagataaatggattttttgctttaatacgtgcagggagttcttactgttgttcgcagccatacctggctgagttatcagactgtgaaaagttttgttatgcataa

SEQ ID NO: 34905 - DNA, 156 bp, Glycine max
  Peptide Sequence Number=SeqID_151683
atggaggaggctagaagggtaatgcgaacaaggagaatggggttattgtgtaccttcgccatgagcgacgacaagacagcattgaattggactccaacagctatagaaattgcattcttgcctgaatgggcagattgggatcatatcagatcataa

SEQ ID NO: 34906 - DNA, 324 bp, Glycine max
  Peptide Sequence Number=SeqID_151684
atgttaagaacgttgtttatcatcccgaagtgttctttggctcaaatagatcaggcagtggaagttgcaaagaaactggaatatgtagtgctggttatgggattggatcaaagtgaagagagggaagaacgtgactgcgttcatcttgacttgttggccaagcaacttgaactcatcaacagcattgctgaagcttataagaaaccaattattttggtgctccttagtggtgggcctatagataccagttcagccaaatggaagactaccaattacttggtacccaaaagatattacatcaaagtaccaatgactgacatgtga

SEQ ID NO: 34907 - DNA, 613 bp, Glycine max
  Peptide Sequence Number=SeqID_151685
atgcagagggggtcccaatctgaaccatttgatgtagaaataagagatcgcttagaggatatgattcgtgatcatgaacaagagtcttttcagcaagcacatgcctttatgtatgatacattgcaaattgattcaaagaagcctttgtatctggggtgcaacaattcgttgacattgttgttagtggtgttaagtctagttaatgccaagactagatatgggtggagtaacaaaagcttcagcttactgcttcaactagtgcatgatatgcttccagaggaaaacacgttgccaaaaagttactatcaagcgaagaagatattgtgtccgatgggtatgaagtatcagaagattcatgcttatcctaatgattgcatactgtacatacatgagtttaaagaaatgcacaaatgccctaggtgtggggtatcacagtacaaagtgaaggatgatgacgagtgtagtaatgacgaaaactcaaagaaaggaccccaagcaaaggtgttgaggtatcttccaatcattccaatgtttaagaacctgtttgctaatggagatgacacaaaagaccttacatggcatgcaaatgggagaaactacgatggaatgtgtt

SEQ ID NO: 34908 - DNA, 402 bp, Glycine max
  Peptide Sequence Number=SeqID_151686
atggacaacgaatggaaaatagaggttatgggaaggagatcgtggtcaaggaaagatttgtccaaattgaaagggatgatcccaattcctagcctatacctctgttttacagctcctattgggcatgtcagccagtgttcaaaaattaaaatgagaatgaactggaagaaagggaatcaccaattcacaaaacttttcatgcttaagatcagagtggaggcagtgttttcatcactagggaagagtttcatcgagttcaagaaacaaacatcaaacttccgcgagagaagcttgaacacctttgtagttcgagctttctggcaaatcaattttggatgcagacaagatggagggaggtttgaagaattcaccaggactatggaattgctttatcggatctaa

SEQ ID NO: 34909 - DNA, 222 bp, Glycine max
  Peptide Sequence Number=SeqID_151687
tgcaacaaaatccctgtggtacgacactcggcttaccgatagattattactacgagcgatttggtacacttgccaaagagctaacagtgggcagccactgctccctagccctgaagaagcacgacgacaatgtcattttgcatgtcaacatcgccaacccccaacctgctattgtctatgcttcatccagctctatctacaaccacaacacccaaaggaaaa

SEQ ID NO: 34910 - DNA, 639 bp, Glycine max
  Peptide Sequence Number=SeqID_151688
tgctggatctatgagcactttccgagtgtgcatcagtgtgtcataaatgatgcgtacgaggagaagtccctacgtgcttcccggtggctgacgacgaaggcgcatatgaagggaattacaagagtaccgtaccgggcacgttgtgatgctttgacggtcacagatgtgtgctggttgccttacactgagcatcgaggggttaaggggtttgagctgatttcatcattccagggtcaactgagatggggtcctatggtggtcacagctcgaccggagagggtgctacggcagtttggttacattcaaagcatccctccaccgcctgttagcgcttcattatcatatgatgatataaatgacaggtgggtgcattttgcggaccacgtactagctgtcggtgagctttgtgcggattacatggagtggtttttccggatatctcacccattcatgatatcgacccaggcaggtgaccagcccagacatgcacctaccccagaccatgaggagtacatgcagccggccatcccacaagttccagtggcatttgacccccctccacttgcagtggatgattacgaaggctatgaggcgatcgcagaaaggttggagcgtgtgctcaaccttaggatggtcact

SEQ ID NO: 34911 - DNA, 186 bp, Glycine max
  Peptide Sequence Number=SeqID_151689
atggcagaggatcttacagagcatgtaattgatttttgggcggaattgcctcgtgctgatgaagattttttaggttcgatccggagctggaaaaatcttcagattgctttggaggatgagacgatctggcttaaaggatttactgaagagcaggctgcttctccggaggataaggctaaaacctga

SEQ ID NO: 34912 - DNA, 396 bp, Glycine max
  Peptide Sequence Number=SeqID_151690
atggctttgcgggttttcatccttttcgatggtcctgttaatgatcccttccagaatttcaatctgctcttccgtatcccagatatgtttcaatacccaaaggtcggaaagtattgcttcacttctcccgcaaatcaaagcacttgcagcaataaggttctgaagttttaccgctctacggtcggaaattgcaattccggtattccggagactgattacggtattgaggtaaacttcataaataggtttcagatccactgttttacaaaggttctgaagctctcttatttcctcggccctaatttcaggaatatccctttccctctgcattttctaatcttcttcctgctaaaagaacctgttgaagcagctcaggattcacataatctacattga

SEQ ID NO: 34913 - DNA, 207 bp, Glycine max
  Peptide Sequence Number=SeqID_151691
atgtgcttgatctttgatgttttaagggtggggtgcgcaaagctctcctggacttgcatttctctcgtttacgttagcatgttgaagctgataggaatggattattctgtggtacaactctctgagagagactatggacatactaaagcagacagtaacctccaaatctcctctcagcaacgtattataaggaaatggagaatctaa

SEQ ID NO: 34914 - DNA, 1410 bp, Glycine max
  Peptide Sequence Number=SeqID_151692
atggcttccaagcaagaaccaaagctctctttgacccttctagtggacaaagaaagaaactgtgtggttgtggctgaagcaagtggagacttgatagacatattgttcagttttctcacccttccactcggaactatcataaggcttgtgtcgaaaaagcaagggcacgacgaagcagacgaaattggttgcataaacaatttgtaccaaagcttggaaaattctggtgacgaggttttctggaaccatatttgcaagagaatgttgctttgtccacgcaacccttgcgaagcactttgccagaaactgaaggtgaagttggatgattcaaagccaatgaagtacttcatgtgtagcagcaggtgtagaaggggtggtgattggttcttgagtacttttgctgaggctagttgccactgtgggaaattgatggacaaagaaatgaagcagcatggagattctaatgagggaactcatggagatggtgtttttgttaagggacaaaccatgtacttgatctttgatgatttaagggtgttagaaagctctcctggtaactctgctcagcaacttgtccaacttggctacaaaaacttccagaagctgataaaaaggtccctaaacgttggaataaaggagattttggacatactaaagcatgcattaacctccaaatctcctcttagcgacgtattcttaggaaatggagtatctaagcggatgtgcgctttctcaccaaaacctagaccagaaaatcaaggctggaaaaattacaattccatgataaacattaaggtaacagtgagaaaatcaaagaaaacgatactgtatgctgaatctgagggagattttgttgattttctattcagcttcctcacaacacctcttggatctattctaaagctattggatggaaacttttctctggggtgtatgaatagcttgtacgaaagtgtgaaggatctcaatccatcatggttcacaaatccttcaggaactcctttacttaacctcagggtggctcctcaattcggttgcaagaggcagccaacacaactttgtgaagaagacactccttgttactggtatggcacaggagtaattaaaagtaacatatgctattccattgggaatggagtggtttcaaaagatcatagtctgatacaacatccaggggccatgaaactttttgatccaagatcccctaatggcacaaaagagtcctctgtaggctttgtgaggaggccatcactatttgttgtgtgggatgatctgcaagtaacaccattggcaaatacttccagcatttcattgctgcaaaagctgaatgttccattggataatttggaggagcatgagctgagaattggggaaatagaggtaacagtccattctttactgattttatag

SEQ ID NO: 34915 - DNA, 573 bp, Glycine max
  Peptide Sequence Number=SeqID_151693
atgccacactttcaatttttggatgacctcaagagagaattgcctaatattgatgagtttgtgaccttgctcaaggttttcttgtgcttggccgagtggtgctacaataccacttgtcactccactaccaatttaactccatatgagattacctatggcaaacctcctcctagcattctccaatacatatcaggaacctcctcagtggaaggtgttgatttcctcttagcttcacgtcaagatacattccaacatctcaggaagaaacttaaacgtgcccaagatcagatgaaaaaagtagctgaggggcatcacagggatatggtctttgccattggtgattgggcttatgtgaagctgcgtccataccgccagtcttccttatttggaatcacttatcaaaagctgggaaaatgcctcatcatggaccagtccattttgagcaccccttcctccaacagttgtagagggaaagcctcctatccagccgctaactattctggatcacaagtgggattctttcgatccatccaagcgcttggttctcgtgcaatggctcagtttgcaacttga

SEQ ID NO: 34916 - DNA, 438 bp, Glycine max
  Peptide Sequence Number=SeqID_151694
atggctgataacaatcaaactctcaaggaattggctacactagatgttgtgtatcaaccttggtgtattcaatatcctgagactaagatgttaatggatagaagtatgattgatgcagccagtagagccactttaatggacaaaactcctattgctaccaaacaattgatttccaacatggtagcaaattaccgacaatttggtactagagttgctacaccatccagagttgctgcaccatccagagttgctgcaagtgaagtttctgtttctatggttactgacaatcaaaagctagagaataaacttacagagttgacatcccttatgagacagctagccattggtcaacagaatgtgatggcagccaatcaaccaagactgtgtggtatttgttgtgcacctgatcatccaacagatgcatattccacactctag

SEQ ID NO: 34917 - DNA, 1260 bp, Glycine max
  Peptide Sequence Number=SeqID_151695
atggctaataacacttgttcccaaactctcacccgccttggccttgaagaagctgtcactctccttacccaaaaccagagctccctccactccaagattgatgaggtcatttctcgcctcaatgccctcaaaatcggttcggtcggtcatcctccttggagtcaccctcccagaatgaaacttgatgtctcgtggtttgatggctccaatgctatgtcttggaccttcaagatttctcagtttttcgagttccatggcactcctgatgatgaacgtcttcaggctttggagatgtgcttcgcaccctcattctatgacaaccttagggagttttcttcaaacttttatcacccgagattcgcctcgaggttcaggctttctagactttatccctcgttcaggaaatcactttggccaaattgtaggaggataaacagaataatatcaaatacactacgtgttgatggttccattaacgagcacaatgtcgtggtcctcattgatgggggtgtggaaaaatgtttctgttactatccaagggcactagttctctgtggacctataagttatggcccttggggtgctgatcttatttttggagtggaatggctcaaacatatgggcccaatcactactgaatactcttcacttactatgtctttcaattggggcaatgaattagtgaagctccgtggttgtactggacctagcccaacagaagaaactcctggcttggtcaagcacatgctccacattaacggtgttgctaccttcttccaacttcagctttgtgcctcttccgataacccatatgaaccctccaccatccttttaccgtcgcaacttcaacttcttctaaacatctactctccaatttttcaacaacctactacccttccccctcagtggactatagaccacaccatacaccttataccaaattcccagccgcccttactcttccctagtattgctttaaagaagaaggatggtacatggtgtttctacatcaactatcatgccttaaataccataaccgtaaaggaaaaatttcctttacccaccattgatgagctcttggatgatttgggtcacgccacttggttttctaaatctgatctcacccagggttttcatcaaattcgtatggcttctgcatatgtttccaagactgttttccatactcatcagggtcactacgagtacaacgttattccacttagcctctgcaatgcttcattgatgttccagcaacaatga

SEQ ID NO: 34918 - DNA, 207 bp, Glycine max
  Peptide Sequence Number=SeqID_151696
atgttggacttcatgaaagtggcatggttgattagaggttgcagatatgagctgttttgggtggtggtgatgggtggcaatggtgggggtaaagaaaaggataaggaagaagaaatttacattttacggcaatttttagccgtcaatatatttgttccattaacagtaacattagatggacaaaaggactattttgagcttatttaa

SEQ ID NO: 34919 - DNA, 942 bp, Glycine max
  Peptide Sequence Number=SeqID_151697
atggaagtaaatttgtccgaatcggtcactaagttgaactataagctttgtcgctctgatattaatggtcgggaaattgaggtattgtggaaaaatgtggcagtatataattgttgcatgagtgtggatttgaacaaaactgcctccaacggtcatgataaaatggtaatatcacaagaacatcaggcaaagatcactaaggttagagggttgatagggccactatcagataaggaatctgtgtactgttctgatgcttccatctcaaggtatttaaggtcccgaaattggaatgtcaagaaggcagctcaaatgttgaaacagagcctaaaatggagaaaagaatacaaacctgaagagattcgctgggaagaggttgctgctgtagcagagaaagggatgttgtatagaccaaattattgtgacaagtatgggagaccagtgattgtaatgagaccttgcaacaagaaatcaacaccagcacaggacatgattaagtattttgtatactgcatggagaatgctattatatatctgtcaccacaccaggaacagttggcctggctgatagatttccagggtgccaagatgtcagatgtatcattcaagacgtcacgtgaaactatccatatattacaagaatattatccaaagcatctgggtttggcaatgctgtacaaagcacctaggatcttccaaccattcttcacgatgctaaggccctttctagagactgagctttacaataaagtaaagtttggatattcggacgacctgaacacaaagaagatgttggaggatttgtttgatatggataaacttgaatctgcatttggtgggaatggtgacacaggatttgacatgaatagatatgctgagagaatgaaagaggatgaaagtaagatcatttctttctggactcaggccaagccagtgtcttaa

SEQ ID NO: 34920 - DNA, 268 bp, Glycine max
  Peptide Sequence Number=SeqID_151698
atggcccaagcctcttccattgagagggacactttaaaggcctcctccggaaattccatcagaagtcttgaagaaatccatataagatggataccacccattcctccttggcacaaagttaatgttgatggtccttacagaaaagcctcctcatctgcggcctgtagaggcctgattagagatcacatagggaggtttatcaaagggttctcaaccaacttgggctgttgtaatgctctttgggctaagttgtgggctttgtacaaag

SEQ ID NO: 34921 - DNA, 1032 bp, Glycine max
  Peptide Sequence Number=SeqID_151699
atgccacctttcaatgatgaaaccaaaattaacaatatcctagaattcactttggttccctcgaagtttagcttgcgttacatcggtggatcacataggttttgtttaagtatgagtcaggagctgaaaaaagctgcctctaagggtcatgagaaaatggtaacatcacaagaagagcaggcaaagatcactgaggttagagggttgatagggccactatcagataaggaatctgtgtactgttctgatgcttccatctcaaggtatttaaggtcgcgaaattggaatgtcaagaaggcagctcaaatgttgaaacagagcctaaaatggagaaaagaatacaaacctgaagagattcgctgggaagaggttgctgaggaagcacagacagggatgatgtataaaccaaattatcatgacaagtatgggagatcagtgcttgtaatgagaccttgtgtccagaagtcatcgtcaacacaaggacaaattaagtattttgtatacagcattgagcatgccattttaaaccttccaccacaccaggaacagatggtctggctggtagatttccagggtttcaagctgtcagatatatcattcaaggtggcacgtgaatctgcccatattctgcaagagtattatccaaagcagctgggtttaataatactatacaatgcacctatgatcttccaaccatttttctcgatggtaaagccctttttagagactgagactgttaataaaataaagtttggctattcgaacaaccacaacacaaagaagattatggaggatttgtttgataaggataatcttgaatctgcatttggtgggaatggtgacacaggagttgacataaataaatatgctgagagaatgaaagaggatgacaataagaagcattctttctggacacaggccaagtccatatcatcagttgcacaaaatgctccgtcagattcaatcaggttagatgcagtttctgatgcttctaacactaagaaaatagactgttcccgtgtccctaattga

SEQ ID NO: 34922 - DNA, 957 bp, Glycine max
  Peptide Sequence Number=SeqID_151700
atggctgctgaagtatattaccaggctattggtactttgcagtcccattcttatctgaataatttaaatcatcaccaaaagcatcaaaacaatttagtaacattggtgtctagggattttatcagcagtaatggcttgtcaacgagaagaagtaactgcactggccagaggaattgtagtgtaattcgatctctagcttcgcaaacatcagtcgttgatccagtgttgtccccttcaagaagcaatgctggtgacacttacaagaaatcaaatgaagcagctttaatccttattcggcatggtgagtcgttatggaatgagaagaacttattcacagggtgtgttgatgtccctctaagcaagaagggtatagatgaggcaattgaagctggaaaaagaattagcagcattcctgttgatgtaatatttacatcagctttgattcgtgcacaaatgacagccatgcttgccatgacccagcaccgtcgtgggaagtatactagtaaaatgttatttcctaaatcatcaacttcccagcaggtccctatcatgatgcacaatgagagtgaacaagcaaggtatggggagctgcagggtctcaataagcaagaaacagcagacagatatgggaaagaacaagtccatgagtggcgacgaagttatgacatacctcctccaaatggtgaaagtttggaaatgtgtgctgaaagagcagttgcctatttcagagaccaaattgaacctcaacttttatctggaaagaatgttatgatttcagcccatgggaattcattgagatccattatcatgtaccttgataaattaacttcccaagaggtcattagtttggaactgtcaactggaattcccatgctttacattttcaaagagggaagattcattaggagggggagtcccataggaccttctgaagctgggagtttatgcctatactag

SEQ ID NO: 34923 - DNA, 477 bp, Glycine max
  Peptide Sequence Number=SeqID_151701
atgaggaaattaggtgtcgaaagagctaaagatgtcttggaactagtacatacgagcatttgtgatgactactctggatacggttatctatatttgatacatgagaaatctcaatccctaaatgcttttaagagtttcaaggttgaagttgaacttcaacttggaaagaaaattaaagttgtcaaatttgatcgtggtgagtcgcttagggaagaagccttaaagaccgcaacttacatccttaataggggctataagtttcacggtcccattttaagatccttttttgaaatgggaaataagagatttcttgagaaagttgagtttaggaaggaagagaacataaggaatgttgcctttaaggaagaacctgttattgacaatgctcaagtccttatacctattactgttcaagaaacaactctaataatagaaaacaatgtcccaattattgttgatgacattgttcaagaataa

SEQ ID NO: 34924 - DNA, 267 bp, Glycine max
  Peptide Sequence Number=SeqID_151702
atgtccaacttggcatcaaaactaaaagcacttacgctagagcttggtgaagatctgctaaataagaaaactaagggtgttgtggaagggtcttctcaacaaaagaaacaaaagaaagatgaaaattttacctactacttcttcaagaagtttggacacatgaaagagtgtccaagggttgtctatggagccgactacatgacaagtgacgatgaaagattcatatttatgggtgacgacaaaagggttgcagtgaaggctatatga

SEQ ID NO: 34925 - DNA, 195 bp, Glycine max
  Peptide Sequence Number=SeqID_151703
atgaagacgacgaagggcggcaaggtcatgaaccctaccgatgcttaccgaaaggagcttcggaagaaagaattgaaaaggaataagaaggaaagaaagaaggtgagggaggtggggattttgaagaaagatcctgatcaattgaagaagcagattgacaacttggaaatgatgaagagcagtatcaaattttga

SEQ ID NO: 34926 - DNA, 4848 bp, Glycine max
  Peptide Sequence Number=SeqID_151704
atggggcacaaaaagcgaaaccctgcgccgcgctcgaaacaatcccccccggccgccgccaacggtggtagtgctacctcgccggacgccgacagcgcgttcaataatgtttccgatcacaaccctaggaagatcgaattggcctcgccccaatccgagggttccgattactccacagtcaagctcgaatgcgagcgcgcactcaccacgctccgccgcgggaaccacaccaaggcaatgaagcagttgaaggagatttgcgccagggaagagggctctccccacgccgcgttcgtcaaccgagtccacagcctaatgtgcttcaagacggccacggtcatcaccgaccctagctcgaagcagcggcatttgaggaacgcgctcgagtcggcgcgccgcgcggtggagctcatgccgaattccgtcgagtacgcgcatttccgtgccacggtgatgttggaggccgcgagtgaagggaaggattatgaggaggtggtgcatgagtgtgagagggggcttgccattgagaaccctagcgatcctgctaaggagacattgcaggatgagagcgagcataaagcattatctcttgaggaacggattgggcacgtgcagaatgagttgaggcagcttattcagaagtcaaatatagcttcattgtcgtcttggatgaagaatttgagcaatggggaggagaggtttcggttgattccgataaggaggacaccggaggatcctatggaggtgaggctggttcaaactaggaggcctaatgagatcaagaaggtgaccaagacacccgaggagaggagaaaggaaattgaagttcgagtggctgctgctaggctgatacagaagaattcagagtcgccacaattgccgaatgagggagatagggatgacaggccgttggattcatctgtagggtctggtcagaggattggcgataggaggaggcatgtaaatgcgaggaagagtggcttttcagctgagaggatgaagtgggtgcactcgtattggaattcggttagtatggatctgaagaaggactttcttagggttaaaatttatgatcttaagtcgcactatgggtcttcaaaggatactttgccgaacgatatcttgtcggaagctttgttttatgctgaggccaataaaacatggaaattctggcgttgctgcaactgtgaagagaaacattccaacccggattctcacaggcatcatgttgtgcaggaacacatggggagtctttcaccacaaatgcagagacttctgccccaaaatgttgatagtgaatggattgaaatgattcttaattgttcttggaatcctctggatgtcctagctgcagttagaatgcttgataataaagcaaagttgaaaagttcaccacttcctgaggatttgtacttggatcatcatgctctggactataatgattgttttaaagatgcaagcagctcttacattgagaaggaaagttcaggggacagtcgtcgtaattgttcggtagaatgcaacaaccattgtaaaattgaaaatgatgtgagagaaggtgttgaagaccaactatctatggctaatcccattattgactgttggccggtgtctgatgaccctgagcgtgcaaaacttctggggaaaattcatgccatttttgagactcttattaggcacaaatgtcttgctgctagtcatcttaataaggtcatacagtttactatgggtgagatacagggtcttgctgctggttctcaacttctaaatcatggcgtggaccaaacaccaatgtgcatatgctttctaggagctacacagcttaagacaattttccaatttctgcaggaaatatctcatgcctgtgggttggccagaaatgctgataaaggtggtagtcccacaaatgatttgctcaatatcagtcaaggtcccgagattaaagacaagattgtacttgatggagatgcatcatgcctcctactggatgagtatttactgcaaacacaagtcactgctggtacagttcagggggctatcttggatgatgtgaccaccccaagctctcctgatggaatttcatgctataacgatgctttgctatcctggatattttcatgttcacctattggggatcagttgacatcatggctgcggaccagagaagataaactaaataaaggaaaggaaattgtccagttgcttgagaaggagttttatcatctacagggcctatgtgagaagaagggtgagcgaatagcttatgaggaagctctgcaaacagtggaggatctttgtcttgaagaaggtaagaagagggaaactgttggtgaatttgtccagcgaagctatgaatctgtcttaagaaagcgaagagaagagctcattgagagtgagaatgatatgatgtatgtcagcaataagtttgagttggatgctatatcaaatgttttgcaagaagcagaagcaagaaatgttaatcaattcggctatgatgaaacttatgctggtgtgacttctcagttatgtgacttggaatctggtgaagaagatgaatggagaatgaaagattacttgcatcaaatggatggttgtattgaaaatgctattcagaaactgaaagagcatttatctatagagcttagcaaaattgatgcccgaataataagaagtgttacagagatgcagcaactggaattcaagcttgggcctatttctgctaatgattatcgagcaatattagtgcctctagtgaagttgtacctaagggctcttttggaagatttggctgagaaggatgcgagagagaagtctgatgctgtaagtgaagcacttttggctgaacttgctcttgattccaagaaggctgttaaggggggaagtgagagtgcaagacatgtcgagaaaacaaaagataagaagaagaataaagatcacagaaaagcaagagattttaaggtcacaagtggtcatgcacacttctcactaggatcaacaactcctgattccaatctagttgcacctgaaagtgacttcccagataatgaggttgtttctatgaatgatgatgacttggaacaacttgaagaggaatttagacgtaagattgagttagaagaggaggagaaaaagcttgaagaaactttggaatttcaacgaaggatagaaaatgaagccaaacagaagcaacttgcagagcaacaaaaaaaatcatctgggttatacttggaaggagtggtagacaaacttcaagattctgaaacaaaggtggatgcttatccaccagatgcacatgaacatgttggagtacctgtgcaggaccaactggtaaaggagaatggatcccaaagtagtctggatggtgtgcttacacccacagcaaatggttcccttgataattattcgcatcagtcaaatacaagtttgcctaatggagttgttccagagaacggtctagatcgccgtgcaggaaaaaaacataaacggaaaaattcttccagacaagttgatggaaagtttgaatttatctcatcagcaaaagacaacattgaggatacacatactgattatcacccgagagagcaattcaaatttgataacaatcaagatgttaataatgtgtggcaaaataatggatcaaaggtgatgggagagttgcaagtagaagatgcagaggaggaaagattccaagctgatcttaaaatggctgtacgccaaagcctggacacatatcaagctcgtggaaattcacattctgtttccagtttaagaatgtcacagagagcttcttcacaggaggatagtgtggattgcctgcctgtggaggactcaactgataatgtgaatggggctacattgcttggtactggactgaagaatgaagtgggtgaatataattgttttctcaatgttattatacagctccagtcattgtggcatttaagacgcttccgggaggaatttcttggtagatcaagatcagagcatgatcatgtgggtaatccttgcgttgtctgtgcattgtatgaaatctttactgcattggacactgcatcaaaggattcaaggagagaagcagttgcacctacatccctacggatagctctaagcaacctgtatcctcacagtaatttcttccaggaggctcagatgaatgatgcttctgaggtgctggcagtgatatttgactgccttcatcagtcatttactcgtggttcaagtgtttctgatgcagaatcagctgaaagcaactgcacgggatcttgggattgtgcaaatgggagttgtatagcacattcactttttggaatgaacatttttgaacaaatgaactgctatcactgtggtcttgaatccagacatttgaaatatacttccttctttcacaatataaatgccagtgccctccggacaatgaaggatatgtttgctgaaagttccttcgataagcttttgaatcttgtggagatgaaccatcagttggcttgtgatctagaagctggtggctgtggcaagctcaaccacatccatcacttactttcaactccaccccatgtttttatgacagtcctaggttggcaaaatacatgtgagagtgccaatgatataacagagactctggcagccctgagcaccaatatagatatcagtgtcctttatcctggtttagatcctaaatgcatccataacttggtgtcagtggtttgctactacggccagcattatcattgctttgcttatagccataaccatgaacagtggattatgtatgatgacaagactgtcaaggtaattggtggatgggcggatgttcttacaatgtgtgaaagagggcatctacaacctcag

SEQ ID NO: 34927 - DNA, 529 bp, Glycine max
  Peptide Sequence Number=SeqID_151705
gcaagcttggggaggaacctggacaacgatgctagtctaccattcaacttctagacttcctggatctaaggcgcaagccatacttatggatttctctgaatacctcttccaagtttgctacatgttgatctatgctttgagacttaatgaccatgtcatccaagctaaagggcatgaccctacagcagaagatagcatcctcaatgatgaatgtcgttttctcttcatccaggacgctccatcaactagcttgtcgatgctgggcaaaggatatgtatccttggggcatgccctgttgatttttgaccatgacgatgttggcaagccaagtaaaaaattcatctatgcatttgtgcttgtggttggtgaggtacttactaagttgtgtacactgcccgggtttgtgttcgagttacagtttgaaaagttcttcaataggctttgggcctttatcaacagtgtcatcccgcagatctacattgaatacgttgtccagacttgcttggtagacagtcagggctcagactag

SEQ ID NO: 34928 - DNA, 395 bp, Glycine max
  Peptide Sequence Number=SeqID_151706
ttgtgatgatttggatgttgaattacctggatgttggggaagcttgggaggattgatggggacccggggatggtgggtttatgcgcgatttgtggatgtggaaaacttgttgtggaccatcgcccgaccgccacctagtaccacatgtgatggagtggtacctggagatatgtcccgggggtcaggagaccttggggacgtcaggcgagctcctggcagtcaacagataaaaggaacaaagaccacaaagcaaggaggcttgtgtggtggctggccagctgtgaatcttgtgcttcaaaaagggaactgggagattgtggaggcctctggtaatcgattaccagtctgtgtaatcgattacacagaggaatgggtcactggtaatcgattaccag

SEQ ID NO: 34929 - DNA, 779 bp, Glycine max
  Peptide Sequence Number=SeqID_151707
aattttatgctaacctctatgacctggaagacaaatcgcctaagcaggtgagggtacgagagcacctaattaaatttgatgctgatgccctcaacaccttcttgaagacaccagtggtcatagaggaaggggagagctttcctgcctactccaggtttgctaatttgaggccagatcctcaagagcttgcaacctgtctatgtatccctgggaaggaatttgagcagaatgcagacgggctacctttgaagattttgaggaagaatcttactactctggcccagacctggagtgttctacctttttctaacctagccctgacatttcatacttcagatattactttggatagggctaagttaatctacgggcttgtaatgctgatgaatatgaacttgggatccctcatctcatgtcagatttctctcatcgcacaacattactcctcgaggataggttttccagcccttattactgctttatgcaaggcccgaggagtcacatctgattctctaacctttgaatccctgagcccaatcattaatttggctaatattaacaagaattgttggaacttggatgacccttcgatcactttttgggtaacccgcaaatctaaggccaaaggatctaaggcaccatctacttcagctccccctacctcagctccttctacctatcctctccctccaccaccagcagctccagttcatcaaggtccctccgctcagagccttccttgtctatgctgcagagcctacatcagggccaactcctga

SEQ ID NO: 34930 - DNA, 1221 bp, Glycine max
  Peptide Sequence Number=SeqID_151708
atggtgtcgacgttcgagaagaagaagaacctgagcaagctcatcatcccttcatcttcttcttccccaaatccatccccatcaagcccacacgtcattttcagtaggtcccactccttcgtgggcccctctcctcgctttgtcccttcctccacccctctcttcttcctcgaagaagaagaagaagaagaagaagaagaagaattaccatttggtcccgaccccccaaaaattggaccttccgatttccatattcttcgtgttgtaggacagggtgcctttgggaaggtctttctcgtcagaaaaaaaggtgattgcttcgacgacgctgatggcgtgttcgccatgaaggtgatgaggaaagacaccatcattaaaaaaaaccacgtcgattacatgaaagccgagagggatattctcaccaaagtccttcaccctttcatcgttcagctccgttactctttccagaccaaatctaagttgtatttggtgttggacttcataaatggagggcatctcttctttcaattgtatcgtcagggtatcttcagtagtgaggatcaggcaaggctttacactgctgagatagtgtctgctgtttcacaccttcacaaaaacggcatcgtgcatcgagatcttaagcccgaaaacattcttatggatgctgatgggcatgtcatgctaactgattttggactgtcaaaagagattaatgaattggggagatccaactctttttgtgggactgtagaatacatggctccagaaatcctactggctaaaggccataataaggatgcagattggtggagtgttggtattctgttgtatgaaatgctaacagggaagcgtgaacattcaaaggatatgaaaaagaacataggagaatgcagggatacaggcaaagttcctgctctgggacatgatttgctacaaaaggatccatcgacaaggttaggcaatgggccaaatggagatggccatatcaaaagtcataaatggtttaggtcaatcaattggaaaaaattggaggcaagagaactggaaccgaagttcaaaccagatgtgtctgcgaaagattgtacatctaattttgaccaatgttggacagcaatgcctgctgatgactcgccagcacccacacctacagcaggtgaccatttccagggctatacttatgtagcacctaacccttggctttcatctagatcactagattga

SEQ ID NO: 34931 - DNA, 291 bp, Glycine max
  Peptide Sequence Number=SeqID_151709
atgcagagtaagcaaaaggatttagagttggaggacaatgcattaatttttgtgggaggaaaagtttccgttgatatattactattgatgaagctgctaagctttgcggtgggtgttcttcctgatcatgttcccaaggtttatgaaactcccagctatagggtgcagtttatgtttagagagtcaaatggagcaacatttttaaaatcacaacttcaaacgcctgaccctgattcagttgatgcatcagcaattctttggaaaaatctccaagataaaaaacttacttaa

SEQ ID NO: 34932 - DNA, 832 bp, Glycine max
  Peptide Sequence Number=SeqID_151710
gctaccctatgagaggtgcgccccggaggagactatcgcgcctttcgtcgcacggggtttcaatgaaggcaatgcaaaaatacttcagagaatctgcaaggcgtggaatacagtggaaagaaaggataaggagcttagaggaagcagcaatggtgtcatcagtggctatcataaatggctgaaggctaggacacaagggataacttggctcccaaagctaagagatccaagtaagaaagaagttgaagtccccgaggaaagtgaaaaagtgaaagccttgaaagcagagcttgaaagaacgaaagtgatcaaggaaaagctaaagacgacagtcactagggtcaagaaagagtgtgacaagctaagggatgtcaacatgactacgaccgaagcattaaagcgggaaacaaagagggcccaaaaggaagaatggagcaggaacaagtaccgaggggctctatggggtagcaacaacgagctcaagcttagaagggtcgaaagggatgagtcaaggttggaaagcatgtataaggagaaggtaaacctagctgctagtcatgggcagagactagaggatgagcatgcgaaggtatcagctctgcaaatggaaagggaagcaagagaaagggtgatagaatcattgcacggggaggttgtgaaatggatggatagattttctctcactctgaatgggagtcaagagcttccaaggctgttagctagagccaaggcaatggcggatgtatacctggctcccgatgaagttcatgggcttttcgattattgccaacacatgatagagttgatgtcccacataattaggaactgctga

SEQ ID NO: 34933 - DNA, 1095 bp, Glycine max
  Peptide Sequence Number=SeqID_151711
atgcaggccaaaccgcattttgattgtcagattatccttgcgccctatttcagtcggggcgcaaaagcaccggattacactgcacagcgtgatttattaaatgataagggtatccggtataccgagtatcacgagtatgagattacggcgcgtaagccgcatgtggtttttttacaaaatccttatgatgatgcacgtcccaatgaactgcaaagtttgacgcttaatcgacgcaatatttctatcgcctatattccttatggattagatatgggtgatggtgagagaaaccgtgtttatcagtataatcttccctgtcaaaatgttgccaggtggatattcgttcgctctcagcggcataaagatgagtttgctaaatattgcggaaatggcaatcatcacgtctatgttagcggacatccaaagctagataactatccatcacgctttggcgtccagacggatggcaaagttaataaaggcaagccaacgctattatgggcgccgcatttcgtcatgcctgatgatgaaaagatgtggtctacgtttaatttatatacacaggcaatgctcgatatcatcaaacgtgatgacgtcaatttgattattcggccacatccgctttttaaacaatttctggatattcgtaaagagcgcggaacacacagcgaaactgctcagaactggcaaatgctgcgcgaatactctcatctcaaatcacatgtggagtgggatttttctgcagattatcgctacgccttttcacaatcagatgcgctgatggcagatgcaggatcgtttttgctggagtatttaccttcgcgtaagccaatccttttcctgactcatgaaaattgcctcggtattaacagtagcgctgaatttatttatgacgcttatgacgttgcgaatgaatccgcagatattaaaactttcgttgataatcttgtttcaggcaaggatcccatgcgtgataagcgactgcaggttttacgtgatgaacttcatatgccagagcagggcgcaggcagtgagattgtaaaaatcattgaaaaaacccttatgcccgctggagttcatcacaatgtcttctaa

SEQ ID NO: 34934 - DNA, 333 bp, Glycine max
  Peptide Sequence Number=SeqID_151712
atgtcatggaagtacaccgcacaaggacccgacgaaaggaaggatgcgtccgtcatacatgtaaagaataatctgtcctttgctaaagtaacaaacatattcggtatgagtgacatgaatcatagtggatggatcttcgtggtgcccgaactaccggtgcggtccaaagacccaaaagggaaagcaaaggcaaatgtgagcaagagcgataaggcgggcctgaccccaaatgacgaggtcccaattgaaaagattgtcgaggaagggaacaacttcagtaagaagggaatatccgttgaagaggcgactgagttcttgaggatcatccaatag

SEQ ID NO: 34935 - DNA, 336 bp, Glycine max
  Peptide Sequence Number=SeqID_151713
atggctccaaagaagattttctctaagagggcaaggaaggacgccacgggagaaggatccagtgctgctccacaagcggacatagaatttgacggacatcgattccgaagtgaggaacaccaacgtcgctttgaagcaatcaagagttggtctttcctcaaggagagacgggtcagactgagagagggagaatacactaagttccaggaggaagttgccaagaggcaatggactcaactcacagggcccatggctaaatatgacccagaaatagtcatggaattctatgctaatgcatggcccacagaggaaggagtcagggataagcgctcttga

SEQ ID NO: 34936 - DNA, 501 bp, Glycine max
  Peptide Sequence Number=SeqID_151714
atgggatcaagtcaaaagccttcgcttaagaagaggttctatcaagtcaaaatcaagagcttagagggtagaagtctccatggaaccgtaggcccgtctatccgctacaaggtcaccgctcgtgcgtcgaaaaagggaaagcgaattgggaccaactcttggctagcatggaggggcgattctatcttcatgcgaaggatgtccaaatgttcccttgatggaacaaggggttgtattaattataatcccgtcctcgccataagacagcttggctaccctgacagagagcttagggggagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcctgggtagtcgaagagaagttcaagtccatagccatcaaagtctga

SEQ ID NO: 34937 - DNA, 195 bp, Glycine max
  Peptide Sequence Number=SeqID_151715
atgaaggggatcaatggaattctgttgagaaaaggaaaaatagttaaggttggtgattttggccttttgggagataatgaacctctaaatgaaggagaggtaattgctatgggagtggatgaagagaataaggaagaagcttcttcccactttcagccttggggacgaggccgattttttagaaggagctactga

SEQ ID NO: 34938 - DNA, 273 bp, Glycine max
  Peptide Sequence Number=SeqID_151716
atggctttgcttccgaaacttcctcatcaaccccaattacttcaaacagtgtgtttaactattggagcttattcaaaatggctagattctgcatcttgtggactgtctgtactgccctcagttttagatatcctaatgaatggcatgggtacatctgaagaatgtgcagctgctgctgctttggcatttagacacatctgtgatggtatagtcaacttctatttgagtacatttttgcactttctttttatcccttggaatgttgatgaataa

SEQ ID NO: 34939 - DNA, 1170 bp, Glycine max
  Peptide Sequence Number=SeqID_151717
atggaccttcagaacactgtgaaggaagccctaaatgcactgtaccatcaccccgatgatgcggtgcgcatgcaagccgatcgctatctccaggatttccagcgaactttggatgcgtggcaggtggctgataatttacttcatgatcccagtagcaatctagaaactttgatattttgttctcagaccttgagaagcaaggtacaaagggactttgaggagctcccttccacagcttttcggccgttgcgtgactcattgaataccttactgaaaaagttccacaaaggtcctccaaaagtcagaacacagattagcattgcagtggctgccttggctgtgcacgtgcctgcagaagactggggggatggtggtatagttaaatggcttagggatgagatggattcccatccggaatatataccgggattcttggagttacttacagttctaccggaggaagtattaaattataagattgcagctcgcccagaaaggcgacgtcaatttgaaaaagagcttacatctcaaatggaaattgctcttaatatcttgacagcatgtttgagtatttctgaacttaaggagcaggttcttgaggcatttgcttcatggcttcggctaaagcatgggattcctggatcagttcttagttctcatccgctagttctcactgcgttgtcaagcttgaattctgagttactttcagaggcatctgtaaatgtgatttccgagttaatacactacacaacagcaggaaacattgatggtgtttctgcaaatatgcccttaattcaagtcattgtacctcaagttatgaatcttaaagtccagcttggtgattctacgaagggggactgtaaatattacttcatgctgaaacctaggtgggctttgctggaaaattggttggctgctgcctactgggattctactaggaaatgcatcatatatccttttgtaagatactggtttaagaaagaaagaaaactgaaaagagaacacagagaaagagtcttctatttggatacccaatctcccaggacgaagcttcattcagaagatggaaaagatacaatcagggaattcgagagacatctgaactactccccaaaactcctcccccctcctccccattgctatttacttccctcttactatcataactaa

SEQ ID NO: 34940 - DNA, 786 bp, Glycine max
  Peptide Sequence Number=SeqID_151718
atggcagaagatcattcttcttcgcatatattgccttcaggagctacaagttttcctggtgtgccttttgcagtagctacagccataactcttgctcttggtggaagatctaaattgagtttcattgatgagaatagttctcctccagatgaagcatctccttatcatgaatcatggttgtccaaagaccaaaaagtgcgatcatggattcttaattccatgagcccacatcttgctgagattttcagctattcagattctgctacgcaactatggaccacagttcgtgatatgtatggtcaacaatataactctgctcgcatctttgaactccaacaagacattgtcaacttgcaacaatcaggtaaaccctttgttcaattacttggcaatctaaaaagaaggtggaatgaacttgaggtgcaccgtccacacactgttgatgctgctatactttgtaaatgtgttgaagaagacaaaattttccaattgctagcaagtcctggtcctgaatatgaagatcttcatagtcatattcttatgtccccggaactcctgtcattattgtttgtctgctctacgattcaaagagaagaagccaggaagaaagtcatgaatgcaaaaaataagtcaaagctattcgacactcatgcctacacttccatttatatagtttatcttgacagtaattttacttcatgtggaacttcaacatttttccttttgctcaggattaccccgccatgtaggcacaaactaagagcatgtgttgtcttacgattgtaa

SEQ ID NO: 34941 - DNA, 1050 bp, Glycine max
  Peptide Sequence Number=SeqID_151719
atgaagatgagtgagatgtgggcaacaatggggtcaaccttagccagcttcatgttcttgtggacgatcatgaggcagtactgtccctacggtgttcaacgtttcttcgagaagtacacacacaggatcatgagttacttctacccctacattagaatctcctttcatgagtacatgggagacaggttgaagcgaagtgaggcctatgcagctgtggaggcatacctcagtgccaacacatcaaagagtgccaaaaggctcaaagctgaaatgggaaaagatagcagcaacttggttttgaccatggatgaatacgaaagagtaacagatgattatgatggtgtgaaagtttggtgggtctctaacaaagttatgtcaccaacaaggtccccaatgtcttattatccagaacaggagaaaaggttctacaagctcacttttcacagcaagaatagggacacaataacagagtcctatttgaagcatgtgatgagggaagggaaggagattcgtttgaggaacaggcagaggaagttgtatactaatagtcccggctacaagtggccaagttacaagcaaacgatgtggagccacattgtgtttgagcaccctgcaacttttgacacaatggccatggagcctgagaagaaaaaagagatcattgaggatttggtcactttcagcaagagcaaggatttctatgcaagaattgggaaggcttggaagaggggttaccttctctacggccctccagggaccggaaagtccacgatgatcgcggctatggcgaatttgctggcctatgatgtctatgacttggagctgacagcagtgaaggacaacaccgagctgaggaagcttctgattgagacaacaagtaagtccataattggcagaggaagaagaagggcgataagtcctcgtgggacgaggacgaggccgagaaggatgttattggaaggaaagaggccaaggaggaaggagggagtagtggctgcagcaaagggagaggttgattgtgttcacaaccaattatgtggagaagcttga

SEQ ID NO: 34942 - DNA, 1725 bp, Glycine max
  Peptide Sequence Number=SeqID_151720
atgaaaagagggaacaatttggtcgcattgagcagacaacgatccattcagattctcatcgccattgcgttcttgtacgtcctcttcttcaccctcgaaatccccctcgtcttcagaatcgcccaaaaacaacgacccactcacacccgccgtcaactcgttcgccgccaaaacggcgtcgtctccgccttgatcctaaacgacgccgcgttcgattcggagctctaccaatcctcctgccgcgccggaaaagccatctgggaagaactaaaactaaaatcacggagcccgcgaggcctcatttctaagcccgagaaccgatctgggccgtgcccgggatccgtctccgtgtccgggcccgagtttctgggccgcgggagtttgatgatgattccgtgtgggcttacgttgggttcccacgtaacggtggttgggaagccgtcaagggtgcaacggaagacgtgtcagttcgtgatggagttgctggggctgaagacggtggagggtgaggaaccgcccagggtgctacatttcaaccctaggttgaaaggggattggagttggaagcccgtgattgaactcaacacgtgttaccgcatgcattggggtactgccttgcgatgtgatggttggaaatccagagctggtgaagatactgttgatgggttgttgaagtgtgagaagtggattaggggtgatgaagataatagggatgcagtggagaccaaggcagcgtggtggttgaagagattgatagggcgaacaaaacgagtaaatgttgactggccatttccattttctgagaacaagctatttattcttactcttagtgctggatttgagggtttccatattaatgttgatgggaggcatggatttactcttgaggatgccactggtcttactttgagtggggacattgatgtccattctgtatttgctgcttctttgccttcggtgcatcctaatgtttcttcgcagcagcatcttgaattttcaaccagatggcgtgcgccaaatcttcctcgctatggtgtggaattgtttgtagggatcctttcagctggaaaccattttgctgagcggatggctgtgaggaagtcatggatgcagcatagctttatcaaatcttctaaagtggtcactcgtttctttgtagcactgcacccgaggaaagaaattaatgtggagttaaagaaggaagcagaatattttggtgatattgttatagttccttacattgataactatgaccttgttgtgttgaaaacgatggccatatgtgaatatggggttcacacagtttctgcggagtatatcatgaaaggtgatgatgacacttttgtaaaaattgatgctgttatgaatcaagcaaggaatgttccacgttctatgagcttttatattgggaacattaattaccgacacaaacccttgcgctggggtaaatgggctgtgacatataaggagtggccagaagaggaatacccaccctatgcaaatggaccgggttatattttgtcttctgatattgcacactacattatatctgaatttgagatgcataaattaaggttgtttaagatggaagatgtgagtatgggaatgtgggtaaagcaatttaacagatcgaaaccgattactcgattttgtttcagcatgggagtgggattggaagatcaacgtgagggtgggcgggaactatgggtaggcgtaggaccatag

SEQ ID NO: 34943 - DNA, 347 bp, Glycine max
  Peptide Sequence Number=SeqID_151721
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgcccc

SEQ ID NO: 34944 - DNA, 1182 bp, Glycine max
  Peptide Sequence Number=SeqID_151722
atgccctacggatcccctccttcagttcccggcgaacgatcctcgccggaacccaatcctccgaaccatgtctccgatttgaaggaggaaaccaccgccgccgctcctcctccgctcaccaccaggagcacccgcccctcccgcgcgtgcaccatgcgcgcctcctctcgcctcctttcctcgccggcgccgtcgaagaaggtggcgcgtgcgaggaaggagggttcgccgcggccaccgtcgcaatgcagcaagatcgtgactccgctggtggagccgccgtcgccgtcgcagttgccgcggtggaacctgcggtcgatgtgggagttcgcttccgtgctgaatttcttgcacctgtttaggcctcttttgaatatctcgttggaattctctgcggaagagttcgagacagctcttcttgctcccaacgatactttgtttcatatacatatgcctttgctaaaggcaatccctcctattacacgaatggcactcacacgcgatacttggataaccgtattatgcaggaaattgagagattggtggcattgggttgctgatggggatcttccaattgttgcttcacatggggcggagattgaaatatataaattacttgatccaggggtccgtgttgttatcttaaaagtattatgtgatattcgtgttgagcaagaagatatccgaagttatattgacaactcaatgaaacacggtgttcaactttcaacattccgtaaagagcgtattggaggtgattcaaatggaatttcttattggtatgaagatgaccccattattggtcataggatgtatcgagaaataaggaaaaccgaagtggtacaaatgaagaaagggaaaccaagaggttccctggttctttctaacacatcatacctgtgggaagtaattgctaccaattttgatgaatttgaagatgtttctgagaagcttttctcaagtaaaaacagaacagagacttctgtggggaaaaggctgaagatagacatgcttcctgaaattgagaaagttcataagaaaaaggagaagttgctgaaaaagcaacacagacaagctcttctgcttgataattacttggttgttgacgggcttggtcctgggcgttctcttcgtgacaggaaacctgttacctacacttttggtaagaacttgaaagtttaa

SEQ ID NO: 34945 - DNA, 1404 bp, Glycine max
  Peptide Sequence Number=SeqID_151723
atgcgggagaagggtgagaccccagttatgttcagttcacacattctagggtgtctttttggcagtcatttggggcttcctcgaaggagaacaactgcagaagaagaagaaagggactctgtttattaccatcctacattaaaccctacaggggctccaccaccagggaaacctcctatgtttaaatcatctataggacccagaattcctttgtctggtgcttcatcaagtgctggtgcatcatcctcaggaacagagttggaggatgatgtattaactgtacctccacctcccccgccgccaccactgcctgatggtagcagtgcgagttcagcagatgatgctgttttacctgaatctttgccattgcctcctccccctcccatgcctccaaagcctgctactactgtgcctacatcattaccaccacctcctttgcctcctccacctcctggtcccccacctaaagaacaagttgcaaatcgtactcttccccctccacctccgcccctacaacagtctcaacctcctccacctggtaccaatggaggtgaacggagaaatcagtctgcattgacagatgattcaccttccaaggagcctggccagctttttgcatattcatgcttaatagataggaaggtgcagcttcctccacctcctccacatagtcaggtgccacccatggctggtgtcattcagtctgatggtgctgtgctttctactgagaataagaattcactttcaagccaggagatcccaaaaatggttgccgggcatcctcctccaagacaacaaccccctgttccaggacccatgttaatcccaagtttacagcctgatgtattgttaccccctggaatatctcgtttccctccacccccaccaccacctgatatgaaacctcctttgccggttgcaggactacctgctcaggcaccaccacctcctggaatgatggtccccctaatgccaaggccaccatatggtcctccacctggtcctcctccaatgatgagacctccacttccgcctggtcctcctccaaacttccaggaagaggatcatatggcaactaggccacctcctcctcctccgaaaccatcatatgttaaatctgctgcttctactgttgttaaaaggccattagctcaacacactccagaactcacagctatggttcctgcatctgtgcgagtgagaagagaagcggcggtgtctaaaacaaagccaaaaccggcagtgccaggacctacctccaggacagtctctggtacatcaggaccaactattgtaaaatcagagtcggtgagctcgtcatcagctccaaaagcacagagcattgatgactcatatacggctttcttagaagacatgaaagcccttggtgcacttgatggttga

SEQ ID NO: 34946 - DNA, 258 bp, Glycine max
  Peptide Sequence Number=SeqID_151724
atgtcttcatctagtgctctcaagaattttttactatgtcgtaaaaattacgggataaactatttttttaacacagtagagtacttttcttccttttatgcagaagtggtaaggagaaagaacaactcaccagtgacgacgacgctgggttatactccggcgaaaggcggcgacggagctgaggctacggttccacggcggcggcgggggaggttcttcgaaagggcgcctcactttgctgacagcttagaagattag

SEQ ID NO: 34947 - DNA, 732 bp, Glycine max
  Peptide Sequence Number=SeqID_151725
atgaatgcccctcgtatgaaggggaagatccaaacgactgtgtcagcacgcactgtgaggatgagcgatagcagcaacagtttaaggcagacgcaaggccaactgttgataggatcattggacctccacttggaagaggtgacaccaggagatgtcttccttccacctacctatcggatgactatcactctagatgatagagataacgaagatcctgctaatgactcatcttggcattccacagcagcggcgacaaacataggttccagtgtgaggttgacattgctggcagacctatatctccgctatattgagtcaagcttctatgtttgggttgccatggcttatctcttgcaattgattgacactataatatttgacgacaagtcctcgactcatcgtgcctctacgaccatctctcctatgcgagccaatataccagcaagcagtatggagtcatgtgtgtttgcacatctacctagtgttgactacttagagtcggaggattggagagactggatgacctacaaatggatgttatcgtctggtgtccatatgaggagcatagaggatggacgtgaggccttatcgttcaaagagggtgctgaggtagttttagccatgtacagacaattctacgccagcaacctccttgtcatacgaatcaactttatgataaggcatggacaaagttgcaacaacatatcattcctttgggcgatgttgtactag

SEQ ID NO: 34948 - DNA, 255 bp, Glycine max
  Peptide Sequence Number=SeqID_151726
atggtgatcctgggaatcggttcagctggtgtagatatggattttaacggcgaggatgaggacatagtagagcgcgaagaagatgagcatgtggatgaaaatggctttgtcgttggtcttcatgctaccgaactcaagctgctccccattcccaggaaaggagaaaagcaacactggttggagcagcacgaacagaaccaccccgatcaacactggtgcccaatcactcattttctctctgactcagaaaattaa

SEQ ID NO: 34949 - DNA, 1615 bp, Glycine max
  Peptide Sequence Number=SeqID_151727
cataggatatgctactttagcaaaagttgctcctgaatatggcctgtgtaagtatgtggcttcagtctacactgctactgattggtttgataccagtgttgttcctcctcttatttatgctatgatgggaagctcaagagaaattgcaattggacctgtagctgtagtgtcaatgctgttagcctctctggtcccaaaagtggaagatccagttaccaatcctaatgcctacagaaatcttgtctttactgtgactttcttcaccggaatttttcaaactgcatttggtgttttcaggttgggttttcttgtggattttctttcacatgctgccttagttggatttatggcaggcgctgccatcattattggtcttcagcagctcaaagggttgctggggcttagtcactttacctccaaaacagatgtagtatcagtgttggcatctgtttataagtcactacataatcaaattgcccctggacaaaaaggcagaagaaatagaaagcttttctggttgcctgctatttctcctcttctctcagttatactatcaaccttgattgtgtatttgtccagagctgataagcatggggttaatataataaagcatgtcaaaggaggtctgaatccaagttctcttcaccagttgcaattacatggtccacatgtcggacaagcagcaaaaattgggttgatttgttctgttattgccctcacagaagcaatagcggttggtcgatcttttgcttccatcaagggataccatcttgatggcaacaaagaaatgttgtcaatgggaatcatgaacattgcaggatctttgacttcatgctatgtggcaactggttctttctcaaggactgcagtgaatttcagtgctggatgtcaaacagctgtgtcaaacattgtgatggctgttacagtgtttttgtccctggaattgtttacaaggctcttatactacacccctgtggctatccttgcctctatcgtcctctctgctcttcctggattaattgacctaagtgaggcttgctatatctggaaggttgataaattggactttcttgcttgtattggtgcttttcttggggtcttgtttgcaacagtagagattggccttcttgttgcagtgataatctcgtttgcaaagatactgatacaatcaattcgacctggaatagaagttctaggtagagttccaagaacagaagccttctgtgatgtgactcaatatcccatggccataagcactccaggcatcatagtgattcgcataagctctggctcactctgctttgcaaatgctaatttttgggtctcacaagatgaagatgaccttaaagaaaccaccaagggtagggtccaagcagtgattctggacatgacaaacttgatgaatgttgatacttccggaattctagcacttgaggaactgcacaagagattgctttcccgtggggtagaattagctatggtcaacccaaggtggctagtaattcacaagcttaaacttgcacactttgtagacaaaattggaaaagaatgggttttccttactgtcggagaagctgtagacgcatgtctcgctaccaaaattgcaagagcttga

SEQ ID NO: 34950 - DNA, 302 bp, Glycine max
  Peptide Sequence Number=SeqID_151728
atgagagaacaaggggtctttcatcttgaggaacatggccagacagagaggtcccagtgggtgcttgattctcccaaccctcctcctctctggaagaagctatttagttctgtcaaggaaaccattctgcctcatggcaacaagttctgcttctcatccaagaggaaaaccatcaatggacatgcactctcatgcctgcagaatttgttcccaatcattagttggttgagagattacaaagtctccaagttcaaagatgatctcttggctggcttaactcttgccagtctctgcatacctca

SEQ ID NO: 34951 - DNA, 691 bp, Glycine max
  Peptide Sequence Number=SeqID_151729
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcactgagataccactctga

SEQ ID NO: 34952 - DNA, 563 bp, Glycine max
  Peptide Sequence Number=SeqID_151730
atggcgggacggatggctgttgagcggcgattctcagtggtggccgtgcagcacggtgccgggcttgagcttgtactcggcgccgcaataggcgcagcgcgccgagccggtgtgggcgacgtccaggaagacgcgcgggtgcatgctccacagcggggccttgggacccggacagaacacaggcaggtcttcggcgccgacttcgatgacttcgtggggggcggcggccggggcagcggcgtaatgccgtcccgccaggcaggacggcgcgaatcagactttgctcagccagtgatggtacttcgggttgcggccattcaccatgtcaaaaaaggctttctgcagcttctcggtgatggggccgcgccggcccgagccgatctggcggttgtcgacctcgcggatcggcgtcacttcggcggcggtgcccgtgaagaaggcttcatcggcaatgtagacgtcgtcgcgcgtcaggcgcttggtcaccacgcgcaggccgaaatcggcggccagcgcatggatggtggaacgggtgatgccggtcaggaccgaggcgatctcgg

SEQ ID NO: 34953 - DNA, 384 bp, Glycine max
  Peptide Sequence Number=SeqID_151731
atgttcgccacgcccgaagaagcagagcacgcgttctacgaagcccttgagcagggggacgccgtccgcctgatgcaagtgtgggcggacgacgaggaagtcgtctgcatccatccgggaggcctgcgcatcgtcggccactcggccgtgcacgaatcctggcaacacgtgctggcgaacggcccgctgcacatccggccgctgcgcccgctggtcatgctgagcatgatgtgcgcggtgcacgtgctggtcgagcaggtggcggtgcgcacgcgggaaggcacgcagttcgccaactgctacgccaccaacatctatcacaagggccccacgggctggcgcatggtcatgcaccacgcctcctcggcgcccaccgaagccggg

SEQ ID NO: 34954 - DNA, 378 bp, Glycine max
  Peptide Sequence Number=SeqID_151732
atgacgttgttacttagcaacattctgcccagcgaccgtaatgccgatctccccctacggaagtatcagttgggatcgcacccacaagacatccagtggacccagagacgtccaacagggccctggggtttccatctttggttacaggcctctgcaaatcctacagggcgcccgtccccccatcaaggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 34955 - DNA, 498 bp, Glycine max
  Peptide Sequence Number=SeqID_151733
atggaggcaccagctgctatagaggacattgtggcagaaattcctgcggacacaggcgcagaggctgctgaggatgagcatgagagatttctgggtggtccgagcgacccatccgtgttgacccagtatgtggagcacgttgcttgcagcgtatggacgggagaggagtgtcctaaattgaagctatcctctcataggaggaaggttcacagtttaggcaagtttgtccctgccattgagggacttgttgctggtacaggactaagtcctctgatcgcatgtttgagtctgctagggctgagacagcccaatgtcgtggaccgtacgtacacctgcaatgggtacgtgatatacatgagcgccaatgccaggcaggtcattggacagttacggctcgtgtatatctacttcatcttctgggttgcactctgcttgctaacaagagtgcaaccaatgtccatgttgtctacttggaggcccttcgtgacctcagtatga

SEQ ID NO: 34956 - DNA, 216 bp, Glycine max
  Peptide Sequence Number=SeqID_151734
atggttacctcaaaggaaaacgaaagaaagaccttggagcattggaaatggttttggaagaaagaaggagaagaaatgacgtttttccaaagctacttggactacaaggctcaaaacgcacaagtgactaatgctctcggaagccgaaacgtcgtgcacactccagacatcttctcaaagatcccaacggtcagatcatggacaagtgttccgtaa

SEQ ID NO: 34957 - DNA, 1002 bp, Glycine max
  Peptide Sequence Number=SeqID_151735
atgcaggcccctgcgaacggctccgcaccgctgccgccagtggtaattttttatgtcggacagccactgagtctggcaccggtgctcagcgccgatgcggaatggcagctgacgagcgaaagcggcgaaaactggtccgggcgctgccagccgggtgaagcgttggtgttgcccgcgttgcccgccggttatcaccagctgacattgacccaggagttacagtgtcactgttgcccgattatagtggcaccccgccgctgctacgaacctgcggaactgctggcgggcgaatcgctgtggggcagctgtattcagctgtatacgctgcgctctgcggctaactggggcatcggggatttcggcgatctgcggcagatgatcgctgaaaccgcgcggcgcggcggcgcgtttgtcgggctcaatccgctgcacgcgctgtttcctgccgcaccggagagcgtcagcccttacagtccctcttcccggcgctggctcaacatcctctatatcgacgtaagcgccgtggcagattttggcctcagcgacgcggcgcaggcctggtggcaagctgaggagacgcagcaggcgattcgggcagcgcgtgatgccgcgtgggtggattatactgccgtcacccggcttaagttgcagggactgcggcttgcctggcagcagtttcgccggcgcacggcagatgatggacaggcgcaggcgtttgtggagtttgtgcgtgccgggggcgacagcctgctgcatcaggggctgtttgatgcgctgcacgcggcgcgcagcgcccaggatggcacgggctatggctggcaacactggccggccgaatggcagcaggcccacagtgcaacagtgctggcgtttcgcattgagcacagcgacgaggtgcgtttctacatgtggctgcagtggctggcggcagagcaattcgccgcctgctggcagctgtgtcagcagcagcagatggcgatcgggctgtatcgcgacttggcg

SEQ ID NO: 34958 - DNA, 270 bp, Glycine max
  Peptide Sequence Number=SeqID_151736
atgaggccccataatcaaacccttgaactctatggtaaactctgccgtgaaaggacaaacaagtatatggtcaaaagtagacagatacaggttattgacaacgatagtggggcacatatgaggccaatgccagggatgataagtttttccacttctggacccagtgtaaatggcttattctgtttcttgctaccaattacagtcctccacgatttcatgctaagagaaaccccttttttggcatcatggcagttcatcatcattatataa

SEQ ID NO: 34959 - DNA, 534 bp, Glycine max
  Peptide Sequence Number=SeqID_151737
atgaccactattacacagatatggacgacgttgctacttagcaacgttctgcccagcgacagggtcgcacccacaagacacctagttgacccaaagaagtccaacgggccccctgttagtcctacaggatgcccgttcctcccagcaagatcacgccatcatgacatagggatcgtgcccacaagacacccagtggacccggagaagtccaacaggaccctagggtctccagctttcgttacgggcctctatcagtcctacaaggtgcccattccccccagcaaggtcatgtcatcgcgacatagggatcgtgcccacaagacacccagtggacccgaagaagtccaacagggtcttggagttgccacctctgattacgagcctctatcagttctacggagtgtctgtcgcccccagcaaggtcatcaggcccccctactaatcgagctttcgtcaagaagtactgcacccccaggcaagcgcagggcgagacaccacagtagcgctactaggaggcaacctagtaccttttaa

SEQ ID NO: 34960 - DNA, 654 bp, Glycine max
  Peptide Sequence Number=SeqID_151738
atggtgtcaccgcaagggaggaacacatggacagtggatgatctcgtgccttatgtggagaagatcacgattttatcagaagagcaagagagaatcactgagccggcggcacatggtccaacatcagagcgtcgattcccaccgcagcagtttcacatgcttcagtcaagtgttgaaactcgcggttttgacagacgaagggagactgtggaagcgcaagaatatgagaaacaaattgaggagcatggccatggaatgtattacacgccaccaacatttgcggagtatccttcacagatgtatcagtatccgttccaaggtcatcacactgatatgtctgcaagctcacattggtttggtggtgttgcggaaacacaacctcatttttcatggccgactatgactcctacacagcaacatgatgccccaatggtgacacctgacgccccattagctccgcaatggaatgtacccggagcaatacctgatatgggtgacttattaggtgttgatttgcgtcaggagttctctgctgaggctgaggaagtacaaccggcgaggcatcgtgacagaagaaatcccgatcgtcaagcgcgaagatgggatcgaccatgtggcacatcctcacgtcaccacagacatgataatgaatga

SEQ ID NO: 34961 - DNA, 536 bp, Glycine max
  Peptide Sequence Number=SeqID_151739
aaaattgggggagaagcttgccacccagctcgcccaggcgagctcagctcgcccaggcgagcagggttgctttctccagaagcaacaaccttttggaggaatcttctggagggcccaagttggcctgcatatcccggaacttcacaaactgcctaatgatgggtgccaagcacctcacaaggaccaaacaaaagttgcatgtcatcaagcaaaggtatagagcagagaatgctgggaaattcccaaaaatatcacatacccagaaacaagttggtggcagttattttgttatccgggaaatcgttctggagctagaatatgagtctaaaatgaattcttcaaataatgtggataagttttttgtgggaaagaaatttgatgagagtaaactacttaccactgaatctatgaatgttccatctggtaatattgagattgcaaaagaaagccctgtcaaagatgattctcaatcgatagttttagatgacaaggagagtgttaacactggatatgagcatcttgaagaaaacagatag

SEQ ID NO: 34962 - DNA, 405 bp, Glycine max
  Peptide Sequence Number=SeqID_151740
atgtacctcttcaaaaagattttttacaaggttgaaagaaaatctcaaggaccgcaggtcgcttggggactggaggtaggcacgggttgttgccgaaccagtataaaaactcttggttcaatgcttgaaattgaaacagcaaatacgttgagggcaagcgagaatggtgaagggttcaatccaaggtcacaaggctgtctacagggttcaatgcttgaaactgaaacagcaaatacgttgagggcaagcgagaatggtgaagggttcaatcgaaggtcacaaggctgtctacagggttcaatgctgaagggttcaatgctaggtctcagtgttgtctacaggggttcaaagaaaagacaatacgttgagggcaagcggtttaattttgattttttttttgtttaa

SEQ ID NO: 34963 - DNA, 694 bp, Glycine max
  Peptide Sequence Number=SeqID_151741
atggtggtgatgacaacaatgatcatgacgaaagttgtgacggttgacgattgtggtgatggtagcaggatgatcatgatggttgctgtagtagtgatcatggtaatggtagcgacaatcatgacagtgatggtggtgccttctgcaatccttgcgatattaatccacccttatacaactcaccggagtttcactcgaattgttttcgcattcagtatgtatttggaagctggtttctgttctccctcaacttcgttttttgcagaatgcaaagggtattatgtaatcgctctcggtgtttcaagattcttggcagtggctcattggataattctggtgagtggctatttctggttcttggcagcttttattgcagagatggttcaatcgttcatcttagctgacttctgttactattacataaagagcattgaaccctgtagacagccttgtgaccttcgattgaacccttcaccattctcgcttgccctcaacgtatttgctgtttcagtttcaagcattgaaccctgtagacagccttgtgaccttggattgaacccttcaccattctcgcttgccctcaacttcgtgaagaaaaacattgatctcacttcgaagaaaccagggaagacgcgtgcagctcatcgagttgttgttgaagaagctggaaccttgtttactgggctgcaaatgg

SEQ ID NO: 34964 - DNA, 906 bp, Glycine max
  Peptide Sequence Number=SeqID_151742
ttgtggtggaatagcaacaacttcacactgaagaccaccttgaaaggaactgagattctaatctcaaaacaactccttactgatcttttgggagttcctactgatagctctaggatctatgatggttggtgtgaaatcatgggccttagaaagaccaagatcataaagatatttttgaaggataaggacaatgacttcaaaaagattcctcttagcctatcccatttgatcatcaatcagatgatcaaggaaacctctagtgtaccttgtaggatgctaatgaccctagttttgaggcattttggtgtattcttggaggatgagaccaaggatgatgaggaagatgctgaaaataaggaaaaggagaagaagaagaagaaaaaggcaaaggagaagaaagaaaagaaggacaatgtgtctaccaagagatcctcaccccttttcattgagcttatcagaagtgggaagaggttgaaggttagggctagaataagccctcagtccaattctgaggaggtctctgaacaaaatgaaaaatttggtgatgaagataaggtaagctttgaggaagttcaaaactctgaagaagaaaaaccttctgaaggccattttgagggagctcaggatgaggaagaaaaggaacaatcccctcaaggtgaggaacaagtgtcgaaagcggtcccttttaagaagccactggactatggctctttttatgaaacctcaaaacacttttctatgaaagagaagaaggatgaggaataccattttgagcctcaaaatgagaatgaatacattcacccctatgagggtgtaaaggctgttaaagctcataagactatgggttctgaacctatacaagaggatgcaaatgtgaagatcattctaatgttttggccaagctaa

SEQ ID NO: 34965 - DNA, 600 bp, Glycine max
  Peptide Sequence Number=SeqID_151743
atgtcacggcctgaatttgatctgtcggtttacctcgtcaccgacaccgcccagtgtggcggacctgacgaggttgttgagaccgtgcgccacgctatcgccggcggggtgactctggtccaattccgcgaccacgacttgtccgatgacgagttcgtcgctttggggcgacgcgtcagagagatctgtgtgtcgggaggggtgcccctcatcattgatgaccgcgtacatctcgttgccgaaattggggccgatggtgtccatgttgggcagtctgacatgccggtcgaccaggcccgtgcgattctgggcgacgatctactcatcggcttgtccgctcagactcccgcccatgtggaggccgcccttgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattagcgcggcgggtgtggtggttacgcgcagcgtga

SEQ ID NO: 34966 - DNA, 588 bp, Glycine max
  Peptide Sequence Number=SeqID_151744
atggaaggtgaacgagaacggatgagtgaacaagtcatggtattagaaaacaagttgttggaagcactagattggaaatttatgcatgaaacagatctgaaaaaaaattctgatttgatgatcgaagatgtacataatgatggtaatctcatctccaaacaggctatacaaaaccagcctttgggttggggagggtatgctctaaaatgcaaacttcagaacctaaaacataaactaaaatcctggagtagagatatctgtggagatctaggcagcaaggtgaagcaaactcagaataggtcactgcaaggaaggcatagtattttttatatgtaccgaagacttaatgccccacgacactttgggaatgataatagaaattatttgccatcatctgtgtttatggaacaaacaccttatgaaatcagtgctcatggctcttcaagattacacccgacagcactcttcaatagtaaaatgatgataagatcaagttcagggtgggacaaagatttatataattgtcagtcgtatcaacgtagtttctgcagtcctaacctcactgggcacgcgaagtttgatgctgag

SEQ ID NO: 34967 - DNA, 303 bp, Glycine max
  Peptide Sequence Number=SeqID_151745
atgctggcaaaggagaatgatgaactcaagatgaaacttaaagccttgattgaggataatagtaaactaattgaattgtatgaacaagctgctgctgagaacaataatagaaatgttaataaaggggaggatggtcaagaaattggttccaagattgacaatggggagttcatgtccacctcaaatgcaataaacaatgaaactataactgatagaacgaatgcaggcagaaggtaccttagattgaacaacacacgatgctggcctctgtgtctgctggcaggaatgacgacctgcgattaa

SEQ ID NO: 34968 - DNA, 255 bp, Glycine max
  Peptide Sequence Number=SeqID_151746
atggtgacatctccagaaagggtgcagatgacgacattggtctttgcttgtcaatccgacttggggtctccgaatgacgaggtgcggataaacgtaagcaaagggtgtgtgcgggtcaccgtcgggtgtctccgcatgccaccggactcttgggtcacggtagcaaaaggtagggtggtcgacaaaaatagggcttttgctcctacgtatcctcaatttgcgatgaggaactcagacctacgtagttcttgctaa

SEQ ID NO: 34969 - DNA, 738 bp, Glycine max
  Peptide Sequence Number=SeqID_151747
atggaggccatgaaagagaaaatggccacaatgattgaagccatgatgagtatgaaaaaaatgatagaggtcaacacgaatacagtcattactacatgtaccaccactgaggtggacccgattcactcgtctggcatcaatcaagcaagtcgtctagcctcagatatggtagtgccccgagactgcactctagccgactttgagcctcacctcggatgtgccactgaagggcaagcatttggtggcatacccctgccaaacactttgggggggaccacagtatcacccacaaccacaatgttgcattttgcgtttgcgttggaaagattgcctcctgccgtagtggaaagagagaaatttaatcatatagaggaaaggctaagggctattgaaggaggcggagattatgcttttactgacatggcagaactatgtccagtgcccgacatcgttatccctgcaaggttcaaggtgttggatttcgataagtacaaggggactacttgccccaagaatcacctaaaaatgtacagcaggaaaataggggcatactcaaaaaatgaaaaattgttgatgcatttcttccaggcagatgaccatgattgtctttgcgagaagcagatgaccatgattgtcactgcgggtgtagatgaccttgattgtcactacggggagcagatgaccatgtttgtcactgcgggggtagatgaccttgattgtcactacgagtgtagatga

SEQ ID NO: 34970 - DNA, 2835 bp, Glycine max
  Peptide Sequence Number=SeqID_151748
atgcagcccatagcgggaaccacaaaacaaccaacaacacttttgaatcccatcttcgccacaccagaatcacgcgcaccgaacagctacccaggcctcagcaccagcactggatctgcatcaaacagagaacgaagaagaaatcagaaaaaaaaaacagctcaaacaccaacatcgaatgtgcatcagaaaaagccaagagaaaaacgaaaaagagaaggaaaaaaatcctctgagcgcttccgctctctcttttcacgatttcaacccatttttctcatctcccacgtccacaatgatgaactcatttactccttccacgccttttttcaacgctgcttcactctccaacaagctcgtcagcttcactcccaattggttctcaccaccgcgcatcgtttacccttcttggccgctaggctcatagccgtttacgcccgctttgcctttctctctcacgctcgcaaagtctttgatgcaatccctcttgagtcactccaccatcttcttttgtggaactccattatcagagccaatgtctctcatgggtaccatcaacacgcacttgagctttatgttgaaatgcgaaagcttggatttttgcctgatggtttcactcttccattggtaatacgggcttgctcgtctctgggtagctcttatctctgcaggattgtccattgtcatgctttgcaaatggggtttcggaatcaccttcatgtcgtgaatgaactcgtgggtatgtatgggaagcttgggcgaatggaggatgcacgccaactgtttgacggaatgtttgtgagaagtattgtctcttggaatactatggtttcaggttatgccttaaatcgtgattctcttggtgcttctagggtttttaagcggatggagttggaaggtttgcagccgaactctgtgacgtggacctcactcttgtcgagccatgctagatgtgggctttatgatgaaactcttgagttgtttaaggtgatgaggacaaggggaattgaaattggtgccgaagcactggctgtggtgttatctgtgtgtgctgatatggctgaagttgactggggcaaagaaatccatgggtatgttgttaaaggtggatatgaagattatttgtttgtgaaaaatgcactaatagggacttatgggaagcaccaacatatgggggatgcacataaagtatttttggaaatcaagaacaagaacctagtgagttggaatgctttgatatcgtcatatgctgaatctggattgtgtgacgaagcctatgcagcatttttgcatatggagaaatcagattcagatgaccattccctggtgaggcccaatgtgataagttggagtgcagtgattagtggttttgcgtataaggggcgtggtgagaagtcactagaactgtttaggcaaatgcagcttgccaaagtaatggccaattgtgtgacaatttccagcgttttatcagtttgtgctgagttagcagcattgaaccttggaagggagctccatggttatgccattaggaatatgatgagtgacaatattttggtgggaaatggtctgattaacatgtatatgaagtgtggggatttcaaggaaggacatttagtgtttgataacattgagggtagagatttaatctcatggaactctttaattggtggttatggaatgcatgggcttggtgagaatgctttgagaacttttaatgagatgattagagccagaatgaagccagacaacatcacttttgttgctattctatctgcttgcagtcacgctggacttgttgctgctggtcgtaacctttttgatcagatggtcacagagtttaggattgaacccaatgtagagcactacgcatgcatggttgatctccttggtcgtgctggacttttgaaagaagcaactgatattgttcgaaacatgccaattgaacctaatgagtatgtttggggagctcttctgaactcatgcagaatgtacaaagatatggacattgtagaagaaacagcttcacaaattctaaccctgaagtcaaaaataactgggagcttcatgctgctgtcaaatatttatgctgcaaatggaagatgggatgactctgcaagagtgagggtgtcggcaaggacaaaagaaagaaatgcaacaactcagcttccttccaatttgactggggttaagattgccgaattgagattaaggagtggcaccatgaggagaagggggtttcccatttacaacaagtttgagattcccataggggtcattaccaaaccatatgtaaagaggctggttttggtgaaccaatatttagggaattggcccatcagctactaccctttgcacaattacacatacttggctccagtcctgggactcatggcttccaatgcctccaatttgtcagctactaatttaccaatgctccatgttaattcctgctctggctccagtccctatcaaggtcaagttccaccatgtcaaacttcctgctctgggtgctgttgcaaaacgtgttggtttgatttgcagggttcatccaatttcagcattgtaacaggaggtaacacttgctccacccactcgcagggccatttttttaccgttgccgagtcttctgctcttccaccaccggctccttctcaaccgccgtcaccagcagcagctgcagcagttgttccaaaggagagcaagagtagcaacaagatggaaagggctgcagattctggagaagcacttaatatggcctctgttggggatactaaagcacctgctgccacggttactcgaacgcagcctacccttgaacatgaatatgcgccctga

SEQ ID NO: 34971 - DNA, 1158 bp, Glycine max
  Peptide Sequence Number=SeqID_151749
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgctcagtctagccaagccaggtcccttgacgcaattctgcaagaatatgccttcaaggctttggtcaaacccagaacaggtaccatttacaacgcaacagcaactcagcttccttccaatttgaccggggttaagatttccgcattgagattaaggagtggcagcatgaggagaaaggggtttcccagttacaacgagtttgagattcccataggggtcattgccaaaccatatgtgaagaggctggttttggtgtaccaaaatttggggaattggtccaacagctactaccctctgcccaattacacttacttggctcctgtcctgggactcttggtttacaatgcctccaatttgtcagctactaatttaccaacgctcaatgttaatgcctctggtgaccctatcaaggtcaagttcctccatgtcaaagttcctcctctgggtgctgttccaaaatgtgtttggtttgatttgcagggttcttccaatttcagcaatgtaacaggaggcaacacttgctccacctcctcgcagggccatttttctattgtcgccgagtcttctgctcttccaccaccggctccttctcaaccgccgtcaccaccaccaccaccagcagcagttgttccaaaggagagcaagagtagcaacaaggttggggttattgtggggtctgtcttgggtggatttgcattcttagttttgctgagtttgctggttttgtggctgcttaagtacaaacaaaaaaagaaaatacaacagatggaaagggctgcagatgccggagaagcgcttcatatggcctctgttggggatactaaagcacctgctgccacggttactcgaacccagcctacccttgaacacgaatatgcgccctga

SEQ ID NO: 34972 - DNA, 444 bp, Glycine max
  Peptide Sequence Number=SeqID_151750
atgatgaagcagaagaatttgccacattccttttggggtgacgcagttaccacaacagcctatttgctcaatagatgtcccactaaaaggctcaaagaaaagaatgatgcaaacagaaagaaattgcaagataagagtgaagtcatgattctagttggctatcatgccattagagcatatagacttttcaatccagcaaagcaaaaaatcgaagtgagtagagatgtgatgaaccaaaaatcacaaagggacagggagtttccagccaagtatacaaactttgaaatgcttcatgaaattgaagtaacacccgaaggtgatttagtgcattttgctttactggcagatgcagaaccaattgatcatgaagaagccatgaaggaatatgtttggaagaaagcaattatggaagaattaaaggctattgagaggaaccacacttag

SEQ ID NO: 34973 - DNA, 348 bp, Glycine max
  Peptide Sequence Number=SeqID_151751
atgatctgcacggtggcgagattgtcggaggagagggcgatggcagactggaggagctggagacgggtcgggttcgtagggaggggttctgggatggggagagagaggcttcacattgctgcgggaagcgcgtcgcggcacaggcttgttggagaacgagtgaatgaagtgaaaggaacccagcccaagtttcttggatgtgtggaccaattatacggtgcaatgtgtcatctaggcattcagagggcaaaaccggatatccactgttcattctaccgcacacatcaaaacttaagtggtgggctgcaattttggacactacatttcacatctgaatttcatccttga

SEQ ID NO: 34974 - DNA, 755 bp, Glycine max
  Peptide Sequence Number=SeqID_151752
gacacatcctcaccttcagaggactgcacgtcctcgtctttagaggcctacagaccctcaccttcaaaggactacacgtcctcgccttcagaggactacatgtcctcgccttcagagggctacacgccattaccttcagaggactacacgtcctctcctttagaggattgcatatcctcgcctttaagaggctacacgccctcaccttcagaggactacacgtcctctccttaagagggctacacgccctcaccttcaaaggactgcacatcctcgcctttagaggattgcacgtccttgccttaagagggctgcacgtccttgccttcagaggacttcacgtcctcgccttcagagggctacacgccctcacctttagagcactgcacatccccgccatcagagggcttcacttcctcgccttcagagggctgcatgccctcgccttcagaggactacacatcatcgtcttaagacagcttcacgtcctcaccttcaaagggttgcacgtcctcgccttcagaggactacaagtcctctcctttaaagggctccacgtcctcgcctttagaggttgcacgtcctcgccttcaaagggctacacgccctcgcctttagaagattgcacgtccttgccttcagaggactgcatgtccttgccttcagagggctgcacgcccttgccttcagagggctacacgccctctcctttagagggctacatgtcctcgcctttggaggactacacatcctag

SEQ ID NO: 34975 - DNA, 183 bp, Glycine max
  Peptide Sequence Number=SeqID_151753
atgggttttaaaaaccggcccaggttgccgggtttacccttaaccgatcgggttatcccgagccagatgcatggccggtccaacaaccaaaccgacttagttatgccacaaggttccggttggactgcttcaaccagccgcattggaccggaaagaagtaataataaccgacttcctaaataa

SEQ ID NO: 34976 - DNA, 271 bp, Glycine max
  Peptide Sequence Number=SeqID_151754
gaccatggctactccatctgcctcgcctcctcctcctcctgcagtagcattagcgtctccgtgtaccttgaaatggacacgcaaagccacatggctacgatccttggccactagaccacctggggcagagagaccagtggtccacgtcgatcttgtgaccgacaaggtcgacggtccccacaagaagaaattaggaacatatttagggattgtcgctcatgataaggtcgacgtgacatacaagaccaggaaggaagtccctgctgcttag

SEQ ID NO: 34977 - DNA, 606 bp, Glycine max
  Peptide Sequence Number=SeqID_151755
atgaggttgaagataaaaattgtgcagcgaatagttgcgggactaacatatttgttagccttattaaccaaactagtattgatgaaccaaaaggtaaaggttcagaagaaaaccgatgatgagtcagacaggtatggtctgagttggaggctggcggttgaaacaaacaatgcgtatccatggcgaacggtcccagagaagtgctacaaccacgtccagaactacatatctggcggtcaataccacaatgacctcgaagttatcgtggaacatatcttgtcatatgcctctaagattcctcttgccggtgatggcatggatgcctggattttggatgttgacgacacttgcatctccaacatatcttattacaaaggaagaagattcgggtgcgacccatttgactcagcgatattcaaggcatggattatgaagggaatgtgtcccgcaaatcctgccgtgcagcgattgtttaatgagttgatagagagaggattcaaagtgttcttgttaacaggtagagacgaagcaactctcggtgaaatcaccattggcaacttgcgtaacgagggattcatcggctaccaacgtcttattttgaggtaa

SEQ ID NO: 34978 - DNA, 356 bp, Glycine max
  Peptide Sequence Number=SeqID_151756
acacgggacatgtaatatcacgtgtatttgaaaaacaatatcgtttgagtgttttgttctgttccgcacccacttcaactcctccaccacctccctcacgtccgagcggtcatccttatccgccgcaactcaccagaatgcaagcttcgcgatggcagcgacgaagtcaccaccgtcaagaatcgggtcaagcactcaatgcaactaccccatctagacatgtgaaacaaccaaatccgcaagcgccatttcttttctctcacttctccgtagatctactttcacgattgatagtgtcggggagcgataaactagatattttattagcgatagctactagaacactagcagagtag

SEQ ID NO: 34979 - DNA, 3294 bp, Glycine max
  Peptide Sequence Number=SeqID_151757
atgggcacggatgaaagtgacagcatggttcaaggttcatctcctatggcagaaagtgacagcatggttcaaggttcagagcaggagaaggaggttagggaagttcttgggggtttgagaagtgaagagggtagttgtggggttactgtgaatgggggagggttttctagcagtgaaaaccaagggttgcatgatgatggtgtcattgacgttgtcgtcaagaatagtagtgtcttggagaccaaggtttcagttctgagagagaatgattgtcaagttttggctgattctgaggtgaatagggtgtcctcttggttaggaatgcaagaaagtgatatggatgcggtgttttccagtgagggtactcaaaagttggactttgtttatggttctgagaagctggactacatgtttgcttctgagagtagagtgccagaggtttctgttttgagcgtggacggttcggttggggttggtggagaagatggaagaggaggaaagccggaagaggaaggaatagatgaagatttggatggggaagtagacagtactgcttctgagggtagagtatcagaagtttcttttttgagtgtggatagtttgataggggttggtggggaagacataagagatggaggcgaaagtggagaggtagaaaaagaggaagactatgatggcaacattgtgactcttgcatctgagagtagagttgcacaagctgccaaattgagtgtggatggctcggtaggtcttggtggggaacatggaagggaagggaaaaacaaagacagtgatgggaagattgtgactcctgcatctgaaagtagagttgcagaagctgttgattttattgtggatggtttggtaggtcttggtggggaagacaaaacagatagagatgaaattgaagggaaagtaaaagatgaaaactatgctgctgggaacatcatgactgttacttctgagaataaagtagcagaagctgctgttttgagtatggatggtttggtaagggttggaggggaagacattagaaatggggggagatgggaaggggttgcaaaagatgaagattgtggtgggaacattgtgactatagaggttccagttgcagagacaagtgagaacatggatgtggatgtggaggactcgagtgttgaagggtgtggttttgttgttggtgattttgtttggggtcaagttgagagccatccttcatggcctggcctgatttatgacccatctgatgcatctgactttgcattgaagctgaaacaaaagaataaacttctggttgcctacttcgggaatggaacctttgcatggtgtcaaccgtcacaactaaagccttttcaggataactttgatgatatggttaaacagagtagttccatcgattttgccaatgctgtgcaagaagctgcaactgagtttggaaggcttctgtatataaagttaagtcgtccatttgttactaagaaaactggtccagaatccagtctccccttggcgaaaaattctggcatcaaggaaggagttcttgtgcctgaaaatgacatagagagacttgattttctaattgaacccgcagaattactttctaatgtgaaacgaatttcgcaatttgttgagtttggtagtattctggagcttgagatattaaaggctcagctttccgcattttatctgtcaaaagggggttataaattagctgattatatggatccccagccggttcttggagttgaagatagtgtaatggatgaaacagttgctgtagttaatggtaaaagtactgtggaagcacctacccaagggccatttgatgaactgggtcattctccagggctttcagggagcacatcaaaccctgttagaaagcagaaaagcattgctgaaattatgggggaggacaaagatgttcatacagcagcaaatagggaggtggatgcaactgttgaaatggtgaatgcaattgggttaaatgttggaaagaagagaaaaggtagtgaggataatgggatggcattgaaacctgttcaaaagagaagagagttgcttgtagacactgatggagatgtgttgagtgctaaaaacgatggcaaaggtgatgaggaaaacagcagcattggctcactgcttcagtcaatagagaaaaagacagaagcttttgatgaagggaagagtgaagaacgaaatgggaagggtaatttgtcaagagaaaggaagagaagcaagtacttgtcccctcctttcactattccaatcagggggcaaagggaggtatacatagaaccagaatcccttaaagtttccagaaaagctaaagtatcacagagaagtgcaggggccgatggcccgagttctcttccagtgtataaggggaggtctttcgatagctcgaattaccaaacacaagatgatggggaaacgattattgatccaaagaaaatccaggctcctgtgaaggaagtcctgtctcaagtcctcgatgcagctactagtccactaattcgtagggaaggcacttctcttgaccaatttgttgactttacttatgccttcagaagttccttatatagccagggatcgttatgcgaattatacaagaaaaatcaacctggaaggaagagaaagatgctggaatctgaagaagatggaatgttgaaagaactaaatctgtctgctgatgaacatttatcatcactgaagcaaaattctgggccaaagaagagaagaaaggaaactgcttcaggcaagaaggggaacgatgaaaatgctgcaggtgctgttctttttgtttcattttggccaggatcctctatgccttcaagatctgatcttgtctcggtgtatagcaagtttggagctctgaatgaagcagaaactgatatgttccgcactaactacacagctagagtgtccttccttcgaacttctgatgccgagaaggcatataaccattcccaaaacaataacccttttggatctcctactgatgtcacttttcagcttcagtattcctctgatggatccaagtctggtgtacaacaacagggtgaaagatcaaacaacaagcctttgccagcagcagctacagcacctgttgcattctcacagggtactgaagcatccaaattgatcttcatacagcagaagcttcaaggtatgactttgatgctagaagaagcatcaggtggtggcaaatctcctgatatgatggcaaagttagagagcgagatgaaggctcttttggaggatgttaacaaaatggttgaagcttctttgttttag

SEQ ID NO: 34980 - DNA, 714 bp, Glycine max
  Peptide Sequence Number=SeqID_151758
atgggatctgctggagcccttaggaacattgttcgctctctctcagtcgcatcatcaagagctttattgcctcgaatctccaccaatgcttcgatggctccaatttgttttgctctgccatctccctgcaaacctcctcaacggcttcttcccctttggagtcacttccacagcttgacagacactcgcttccccaagagacgcccctctgaaagacctcgtcgaaagagggccagcttgagaccctctgggccttatgcttgggttcaatatacacctggccaaccgatacttccaaacaagcctaatgaagggagtgtcaaaaggagaaatgagaagaaacgcatgaggcaacgccgtgcctttatattggtgcgctctccctttactctgtacacattgaattttggagggtttatgagtgttgtgtgtgttttccgtttgcgtttaaagaaaatgacaactgggcttcaaaatttgtctaggctaaatggagttggttataaccattttttctgtcaggaggtgcttgttttagttattaaggaggcggaaaggaagaaaaggaaagctcagctgcaagaggccaatcggaagaaaaatattcagagggtagaacgtaaaatggctgcagttgcaagggaaagggattgggcagaaagattggctgagttgcagcgacttgaggaagagaagaaaaaatctatggcttga

SEQ ID NO: 34981 - DNA, 201 bp, Glycine max
  Peptide Sequence Number=SeqID_151759
atggagaatataaaaactggagtgcgcagtttgcgcttaacgcgactgaagacacaagcgctaagtgagggcgttaagcgcgaggagctcgctaagcgtgaggagctcactaagcgtgatccaacagaacagaacgcgctaagcgagagaaactcgttaagcgcacgatctacacatgctaagcgaggaagaacgcgctaa

SEQ ID NO: 34982 - DNA, 408 bp, Glycine max
  Peptide Sequence Number=SeqID_151760
atggctattagacacatggatgtgaggaacagctcaggaactcttcgttcagttccaagcgccacactctatcctcagagcattcgaacttcaactcccaagacacaccacactagaggtttgagtgttccagtgtcaatgaacattaacggaagcctccaaagcagaaataataataataacaataataggaaaaatggaagagagataggtgaaaggcaaaagcaatacttgggaaaattgagtgaagtagtggatgtgtacgagagttatcgttatgattcactgttgcttaaagaagacttaaacaacacaaactggctgcgtagtgttgatgataaatgtgatcaaggacccatctttgacaatggatttgagtacctgcctgaaccttttggactcttttag

SEQ ID NO: 34983 - DNA, 561 bp, Glycine max
  Peptide Sequence Number=SeqID_151761
atgaacaaaacgagacagagagaagaaagatgcgtgaatggtgatggttcatcaggggacatgcagtatacattgagaataatgaagaagaagaagaagcatcagagtgaggagaagaatccacgtggcaggttggcgaaggaggaggagggtggcgaggaaaagataaagtgctcgagcaagcattgtggttcatgctgcggcggctacgtggctgattgcgtggcagtgtgttgctgcccttgcgcggtgttgcattgttgtgctatggctattgtcaaggggccttctcttgtggggagaaagtgtttagggttgggaaagaacaagaacaagaacaacaacattaaaagggttcaagaggggtgtgaagatgatgttgatgttgatgttgttgttgagaggaacaacagcaacattgaaagggttcaaaggggtgtgagggaaattgacagtgtcattgtcaatgctggatttgatgcagagaaggtttggaaggaactctatcagattggtcatatggattttgggagggtttctagttcctcacatgatgattaa

SEQ ID NO: 34984 - DNA, 927 bp, Glycine max
  Peptide Sequence Number=SeqID_151762
atggtccttcccaatacattgttttctgaggcagtagttgaagacttagcagatcttctagcaactacctcagaggcatcagcagcattggcatggccgcggctttttgctgtgtactctgacagtctgcccctattggcaataggagatggctgtctccttgacatgttaactggggcttgcatttctgagtttggcttcgaaggaagagtaacaacagcaccaggacgagacctgcctgcagagacaggcctatcagcaggcaatgttgttctgaggtttggtggtgtttcaaggggaaaatcaggagggacaactggctggagacgcggtgtagctggattacgccccacacgtgtgactgaaggcgatggagatggcagtgaatggcgtcgagtgggggtagagggccgcaaagtggcaggaatggatggctttgaagttgagcttggagtggatggccttgagccttgtgatgttctagttttgttggtgtcagttgatgatgtgttgattggacttggaaatgagcgtggtagtagtactctggggggtgttgatgttgatgttgtgcgagaggttggagtggaaagccttgccgcagttatgggggaggatggccttgtgttaaggatggaagaggatctgtttggactgcgagtcactgaaccacttcttgatggtctagattactccaaggaaccggtgcatgtcataggcatgtacatacaagagaagcttaacccccccaaagccaacccttcttcacttaagcatcagtatggttatgccaatggaatgaagggaaatgagaatatattacaggagcatacccttgagacactaatgtttgactttaatctacccaaactgcttcttggaggcaccaaagttggttgggattcaccttctgatgatggtaaatga

SEQ ID NO: 34985 - DNA, 192 bp, Glycine max
  Peptide Sequence Number=SeqID_151763
atgacccttctaaattggtttcctggggtggataacccagcctgggttggtgacccagaaaaggttgatgatttcttagtggttggctctggaagagccagtcttgatcctttgcctgtacttcatcctccccttagggagattcctgatgccttaggaggcattaccacttttctgattctaatgttttga

SEQ ID NO: 34986 - DNA, 252 bp, Glycine max
  Peptide Sequence Number=SeqID_151764
atggtaaagaaggaggcaggtgagacacaagttagacaggaagttgctgccattcctgagaggtcacgagaagtcacatcggatccacccacaccagtggtggacctatcctcacctcagcatgaagcaaatccctccactcttatactcgagataccaaaggacccaaccacaccagtcctgactctgaacacttctcctccagctactccagtacttcatctgacagatgaggaggatgttcagacatag

SEQ ID NO: 34987 - DNA, 507 bp, Glycine max
  Peptide Sequence Number=SeqID_151765
atggaggctatgaaggagcaaatgatcacaatgatggaagccatgatgagtatgagaaaaatgaaggaggtcaacatggctacagtcattgccaaaagtatcgccactgaggttagggaagcgaagcattgggaagtacgggtggcccccattttgtgcaagtctagagcaagcattccttcccaccatatggattgcctcccaactatacaccacccaatgttgcacacgttcccgatgagaatgtcgataactccgctcctatacccattgagggccaacaaccccaatctggccaaagaagagaaggttcaagcagctgatgactcgcttagcgaggtagatccgctcagcgagatgaatccgcttagcgaggcatccagctcgcttagcggatgggaaaccctagaagaggataagccagagatgtgctcacccagtgcacaacaagctcgcccagcgtggatgtcgtctcttctcgcgctcagtgcgcccactctcgcttag

SEQ ID NO: 34988 - DNA, 258 bp, Glycine max
  Peptide Sequence Number=SeqID_151766
atggtgcagctatggtttgggattagggtgaaaaaacccggtggaccattcggtcctgccaacaaatcttatccggagccccatgaattgcttgtcattcatgcatcctccaccatcgagtctggagcctcacgaattgattgcctagcgatgttcgtctatcctccaccctcaaatcttatctggagccccatgaattggttgtcattcatgcgtcctccaccatcaagtccagagccccacgaattgattgcctag

SEQ ID NO: 34989 - DNA, 342 bp, Glycine max
  Peptide Sequence Number=SeqID_151767
atggtaatcgattacaatactcatgtaatcgattacatgctttcaaaagtattcaaaatcattttaaaagcatttcaggaagtattttggccactggtaatcgattacatcctctgcttaaattctttggccaaacctcttgttgtttcaacttggaattcccttcctaagtttctagagattatcttgatcatatatcttgaatttcttggattcttgttgatgcaatcctaccctgcaagggcattggatagaagactccaagaagattgggccagagatgcaagagaaggccctagggttttcatgagccttagggtagatttcaggcccatgggctaa

SEQ ID NO: 34990 - DNA, 231 bp, Glycine max
  Peptide Sequence Number=SeqID_151768
atggccgagagtgggcacccagcggcacaattgagagcgaagcaaggggaaggcctttcggtaccaccacttcaccggagggaggcaacatgcaatcgaagatggcattggcctacagctacccgaggagcgaccactcctgtcctccagccacgtcacgcaccccaccagctacggctttgttcgcacgacatcgttcacgcggaaccgctcttgccccttgcacactaa

SEQ ID NO: 34991 - DNA, 1512 bp, Glycine max
  Peptide Sequence Number=SeqID_151769
atggcttctctgctcctccctccaactccaactgctacttcttccacagttaaacacaacaaaatccaaacgaaactgaaaccaaacagcaatgctcatgcagctacatgtaatttcttcttatcatcgaattcaaacgcaaaccaccgtttcaactctgcaaagtgccatgcattgttggatgacgtggccaaagggttgttggagagcagcagcagcgttggcgtggaccagttccagagactgaccgaaggcttatcccacatgcagaggtgggagatcctcgtgtttggaggcttgacgtggatttacctgactgcaagaccaggtgttcttgttggtgccattgatgcgtaccttttggcacctcttcaactgggtttggacaacttgtctggaaggaggaacttgaagaggagtgactttgttgttggagacaagctcggtgaagggtcctttggtgttgtctattcgggtattttggtcccaaagaatgtggatctggatgtggtgcagaagagggggagaggcaagacaacacaggtggatgccaagtctaaggataaagtcattcttaaaaaggttaaggttggaatccaaggggctgaggagtttggtgattatgaggagtggttcaattacaggctatctagggcagcacccgaaacatgtgctgacttccttggaacttttgtagctgatcaaactaattcacagtttacaaaaggtggaaaatggcttgtttggaagtttgagggagatcgtactcttgctgattacatgaaagatcgcaactttccttcaaacttggaatctgtgatgtttggacgtgtcttgcaaggagtagactcttcgaaacgaaatgcattgatcatcaaacaaataatgcgccagatcattacatctcttaggaaaattcacgatacaggcattgttcatagggatgtaaagccagccaacttagtggttactaaacgagggcagattaaactcattgattttggtgcagcaacagacctgcggattggaaagaattacgttcccaatcgtacccttttggatcctgactactgccccccagaattatatgtactccctgaagaaacaccaagtccaccaccagagccaattgctgctttcctttcaccaatcctgtggcagttaaacagccctgatttgtttgatatgtattcagctgggattgtactcctgcaaatggcaataccaagcttaaggtctcctgctgctttgaagaatttcaacttggaactgaaaacctgtggatatgatttgaaaaaatggagggactatactcgcctccggcctgacttccaaattctagatagtgaatctggtagagggtgggacttagcaacaaagcttgtatctgagagaggttccctaagaagaggacgtttatctgccgctgctgctctgcgacatccttattttcttctgggtggtgatcaagcagctgcagtcctttcaaaattaagcttgaacagaaagtga

SEQ ID NO: 34992 - DNA, 921 bp, Glycine max
  Peptide Sequence Number=SeqID_151770
atggagataagaaaaacgttggtggttgttgtgatgacacttatgttttgttcggtttccgattcattaaggttgtttaacaatggtaagagtgagagccaacacaggagaaatcttgttgccaatggccttggtgccactcctccaatggggtggaatagctggaatcattttcacttaaaaataaacgaaacagtcatccgagaaacagctgatgcccttgtttctacgggtctatccaagctaggatacacttatgttaacatagatgatggctggggtgaaatgacccgggatgtcgatggtaatttggtagcccataaaaccaaatttccttctggtatcaaagctcttgcagattatgttcatgggaagggtcttaagcttggcatttattcagctgcagggtattttacttgtgcaaatgtgatgcctggttcacttggtcatgaagagcaagatgccaagactttcgcatcatggggtgttgattatctcaagtatgataattgtaacaatggtggaataaagcctattgatagataccctattatgactcgatctttgatgaaggcaggccgtccaatctacttctcgctatgtgaatggggagacatgcaccctgcattatggggttatcaagtgggaaatagctggagaactactgatgacattagggataactgggatagtatgctttcaaaagcagatatgaatgaagtttatgctgattatgcaagacctggtggttggaatgatcctgacatgctcgagataggaaatggagggatgaacaaaagtcaatatattgttcacttcagtttatgggccatttccaaggtactatccatcgcaaacattctaatgtacttcttctatgtatataacttctatgaaagcatacactttagagtgaagtaa

SEQ ID NO: 34993 - DNA, 1155 bp, Glycine max
  Peptide Sequence Number=SeqID_151771
atggaagaaaatgaatggcagatggtgcaaacgaaaggaaaccaatttgtggtgaacgaccaacctttctatgtcaatggattcaacacatactggttgatggtatttgctgctgatgagtccacacgagggaaggtcactgaggtgttcaaacatgcatcctctgtgggtatgtcagtttgtaggacttgggccttcaatgatggccaatggcgtgctcttcagaaatctccttcagtttatgatgaagacgtattcaaggccttggactttgtggtaagtgaagctaggaaatacaaaatcaggctcatattatcactggctaacaactgggaggcttatggtggcaaagcacagtatgttaagtggggcaatgcagctggccttaacttgacatctgatgatgaattcttttcacatccatctctcagaagctactacaaggctcatgctaaggcaatcaatacattcacaaatatcacttacaaggaagatccaacaatctttgcttgggaactgatgaatgagcctcgatgcacctcagactcctcaggtgatgtgttacaggattggataaaagaaatggcattctatgtgaagagcattgatccaaaacacctagtggagattggactagaaggattttatggcccctcgacacctcagaaatatcagttcaacccaaactcatatgctcaagaggttggaactgattttatcaggaaccaccaggttctaggtgttgacttcgcttctgttcacatatatccagactcttggatttcacaatcaattgctgattcccatcttccatttataaagtcttggatggaagcccacatagaggatgctgaaaagtatcttggaatgccagttgtttttgctgagtttggtgtatctgcaaaagctcctggctacaattcaacatatagagacaaccttataaacactgtgtacaagaccatcctgaactctacaaagaaaggaggtagtggggctggaagccttgtgtggcagctctttcctgatggaacagattacatggatgatggaaatgccgttggggttgtaagaagagaaatgagttggaaaaagtactcattcatgacgaactgtaactccgtatgtggaaagttgccaactagtgctatgtaa

SEQ ID NO: 34994 - DNA, 450 bp, Glycine max
  Peptide Sequence Number=SeqID_151772
atgaggcttgagaatcaaggaagtcactcaatccattatgtaagccaccaagggaatcaaggagccagaaagaaatttttgaagaagcatgaaaaatgcaaagagccattaaagatcaatgatggtcttgtgaaaatccaaaagaaggcatcaatagcaataattgtcatttctatgggaaatctggacacttctagaaggattgcacaaagcgcaagtattgatggtttgtatgtggaagcaatgacttccaagattattttgatgatttcagagaatcaagagttaagcaagttccaaagaatcaggagtcaaaaagcttcaagaatcaagtttcaaagaatcaagtttcaagatttaagaacaatcaagtttcgagaatcaagattcaagaacattcaagatcaagattcaagaatcaagagaagactcaatcaagataagtactaa

SEQ ID NO: 34995 - DNA, 1052 bp, Glycine max
  Peptide Sequence Number=SeqID_151773
atggaacttaaagcccaaaacattcccccctttgaaatttcccatcctcgacaccgtcccagaagcagcgtccaatttgatgatactgccctctttcatgatgacaatgccagcctcatctatgttaatgatcccatcaagacaaatgaaaattttgagtttgccgggaatgagatccggaccagcagatacactcttctcaccttcttgcccaagaatattttcattcaatttcacagggttgcttatgtttatttccttgccattgccgctctcaatcagcttcctccgctcgctgtttttgggcgaactgtctcccttttccccctcttgtttgtgctttgcgtcacagctatcaaggatgcctatgaggattggcgcaggcacaggtccgatcgcaatgaaaacaatcgagagtgtctggttcttcaatcggctcagttctgccccaagaaatggaaaaatatacaggctggtgatgtcattaaaatctctgctgatgagatgattcctgctgacatggtcttgttggggacgagtgatccaagtgggattgcctatattcagacaatgaatttggatggagaatcaaatttgaaaacaaggtatgctaagcaggaaactgcttcagccgtgttgccagatgcttgtgctgtttctggagttattagatgtgagccacctaatcggaatatttatgagttcactgccaacatggaattcaatggttgcaaatttccccttaaccagtcaaacattgtgctgcgtggttgcatgctgaagaacacaaattggatagttggtgtggtggtttatgcaggacagcaaacaaaagcgatgttgaacagtgcagcttccccttccaagagaagcaaactggaaagctacatgaacagagaaactttttggctgtcggtttttctttttatcatgtgcgcagttgttgcccttgggatgggtctctggctggtacgccacaaggatcagcttgataccttgccttactacagaaaaacatacttcaatggaccggataatggaaagaaatacag

SEQ ID NO: 34996 - DNA, 369 bp, Glycine max
  Peptide Sequence Number=SeqID_151774
atgggtgttgtacggacgtgggagagcaggagggcggagctggaggcctttcgccggagcctggtggcagccgccggcatccagcggcggaaagacgatgagggggggagaacccacaagtttgtttcctcctatgaacatgatgatggaaagggtaccttaatctgtgtcacttgtggagtttcctactttggtcttgccttggtcaaccatctcttgctcttaggttactctcttcgagtcaccgttgacaacccagattcaaggtgtgaacgagggaggaactttgactctttgaatagtgatggtatgcaagttggtggtgattctagttttcttgttaaattacggtttgaaacagaggtttaa

SEQ ID NO: 34997 - DNA, 2178 bp, Glycine max
  Peptide Sequence Number=SeqID_151775
atggagtttcagagagctagtgtacatggaaagaaatatgggagctccttgcttacggctgataataatacagcagcagccaatagtggtaaacgaagatggaagctcaaatctgaaattgctgttgattctgaactaatggcattgttgcagaaagactcagatagggatgaaagaattgctgctcatgagtttttccttacattggctgcttgtaatactgtgatccccattattagtagcagtacatcttctagttgtggaaaaggagaatcaaatgaacccagagaaagtattgattaccagggagaatctcctgatgaacaagctctagtttctgctgcctctgtatatggatatactctatttgagcgaacatctggaaacattgttattgatgtcaatggtgagaaactcaggttggatgtattgggcctgcatgagtttgatagtgcacgaaagaggatgtctgttgttatccggtttccggataatgttgttaaggtgttggttaaaggtgctgacacttcaatgtttaacattttagcacctgacaattcaggcaacaatggcatacggcatgaaactcagagtcatttaagggaatattctatgcaaggtttacgaactcttgttgttgcctccagggatctttcagatgctgaacttgaggagtggcaaagcatgtatgaagatgcgagcacttcattgacagatcgagcagcaaaactacgtcaaacagcggctcttatagaatgcaacctaaagcttcttggagcaactggaattgaagacaagctacaggagggtgtaccagaagccattgaatccctgcggcaagctggaatcaaggtctgggttcttaccggtgataagcaagagactgcaatttcaattggtctttcttgtaaacttctgagtgcagatatgcagcaaataattataaatggcacttcagaggttgagtgcagaaatctcttggctgatgccaaaacaaagtatggtgtgaaatcttcaagtagagaacaacagaatctaaaatgcaaaattgattctagacatggaggccctgatattcccaatgatacaaaatccttgagcatgcccaagtggaatccaggaaaggaagaagaaactactgctccattggcactcataattgatggaaccagtttgcttttcgaccttgcaacttcctgtagggttgtgctatgctgccgtgttgcacccttgcagaaagcaggaatcgttgatctgataaaaagccgcacagatgatctgacattagctataggtgatggggcaaatgatgtttcaatgatccaaatggcagatgttggtgttggaatatgtgggcaggaagggcgccaagcagtgatggcatcagattttgctatgggacaattccagttcttgaataaattacttctagttcatggacactggaattaccagcgtgttggttatttaattctgtacaacttctaccgaaatgctgtctttgtgttgatgctattctggtatatattatgcactgctttttctacaacttctgcattaacagattggagtagtgtattttattctgtgatatacacatctatccctactatcgttgttggtgttctggacaaagacttgagtcacaagacactcttgcagtatccaaaattgtatggtgcaggtcaccggcacgaggcttacaatatgcagttattttggttcacaatgattgacacactatggcagagtcttgttctcttctacattcctgtattcatctataaggacagcacaattgatatatggagcatgggcagtttatggacaatttcagttgttatccttgtaaatgtacacctggctatggacattaaccaatgggcactagttagtcatgttgctgtttggggatctataatcattacatatggttgcatggtgatattggattctatacctgtctttccgaattacgggactatttatcatttggcaaggtcccctacatattggatgacaattttgcttataataattgtggcattgctacctcggtttctttgcaaagctgtttatcaaatcttttgtccttcggatatccagatagctagagaagctgataccatgagaaaacagcatggtgatttgcaatcaaggctaccagtttccaattaa

SEQ ID NO: 34998 - DNA, 261 bp, Glycine max
  Peptide Sequence Number=SeqID_151776
atggtgaaaccatcgaagaagcgcaagggttctttgagtagaagccaacggcactccgaggctcaggatactccaattccttcctccatttcctcctcctcattgttctcatcgaaagaacaacgtacaaagtacataaacctcttctcctcttgttctatcattgaccctaagttcatagatatggatttcttttctgatgagagtttcgagtgcattcaagcatttcagaactcaaatctcattccctttatgtcttaa

SEQ ID NO: 34999 - DNA, 798 bp, Glycine max
  Peptide Sequence Number=SeqID_151777
atggatgatagaaaggtattggaggagcttgtgaaagggcgtgagtttgctaatcaacttcgacaagtgatgattaatggaaaagataatgattcaccatttgttcgaagtcttgccaagaacgtgctcagatccttcaccaacacgctcttcctcttggacaagtatccctcttacgaggtttctcccagtactaaatctgaggactctcaagaaagttgcaagagttttaacagtaagaacaaaagaggctgctacaagagaaaaagaaatacacaagaacgggaggaggtgtctcaaactccaaaactggatggccaccaatggagaaagtatggccaaaaagagatcctcaatgctaagtactcaaggaactactacaggtgcactcacaagtatgatcagaattgtcaagcaataaaacaagtgcaaagaattcaagaggatcctcccttgtacaagaccacctatttgggccaccacacatgcaatgactttctaaactctgcaatcatacttgattccaataatgatccttcggacacttccatattgctaagctttaacaacaccttccctactccaaccaaacaagagtgcccctttttatcatcttttccctcaccatcatcagggaaaaaagaggaggtgattccctcttcttccccaccagaaacctccttagatgattcttcaaggcataataatgtcactctaccaccacctgatttctgggatgttatgtttgattctgttgaccttgatgatgtcaaccttttgttggattgtgatgactaa

SEQ ID NO: 35000 - DNA, 2523 bp, Glycine max
  Peptide Sequence Number=SeqID_151778
atggatacagacagtttttctatcaaatatggaaagataacaagtacttttgcccccctgcaattggtgatccaatatgttaaacaccgtgctgttcttggggccagatatcatcgtataaattggaagtcaatttctgatctcccagcttctccaagtgcttgtatgaggagaatgaatttgttgaatagtaatttgaggtttaggacagctgtgaatggactctgtaacatggtcagtgaacgatatgcaaagcaactcgaaaagtcccaaaagttgtcattaaacaaagatgattgcaaacagtttgtgcgatcccagtcctgtgaaggtggtatcctcaatcattttagtcctgatgttgaaattcaaatgacgagtctaaatagagatgcttgggatgactttgagaacaaaagtatcaaggcagcccttgacgagattctccgttgcaagatgatggctaagctggatgcctcctcctcccaaaaagttcaatcgcaatatgaagggtgggcagatgcaaatgaatctcaagaaaacgaagaaattacatcagctattccttgtgaaattattcagagtcatcatggtaatagggccaatgtttatggacaagtaaatgaatcattggctgtttcaaatgctgtagagctagttaaaattgtttttttaagcacctcaacacgtctccaggcaccaaatttactagccgacattcttcggcgatactcagagcatgatctaattgctgcatttaactatcttagagagaaaaaaattatgcctctttgcatatgcaagggtaaggctgcgtacaatatccctcccccataccttcgcatagcgaagagcctccgggcaatggggtacaaagttgggggcactggcagtgaatgtgttgaactgtcacaacagttcttgcacagtgtttcgaagtcaccatttccatttaatactggaaagcaagctgttaaattttctgcgtggctggaggaaagagacaaggacctcacagaagtgggtgttaatcttgctgaagatctacaatgtggggacatttttcatttatttgctctagtctcatcaggtgaactttctattatgccatccctaccacataatggtgttggagaggcagacttgagaagtgcaaagcgtaaatttgatgccactgagttttcatatagtaataaaactaaaagaccaaaatccttgtttggaatagatggtgaaattatttctcgtcgggaaaaaggttttcccggtatcttcatttctgcacaccgtacagcaatttcaagagctgatattttaaatttgttcaaggataatgataacaatggccaaccttttgagggccaaagcagtaattattcacttcctgaccatatgttggaaatcattaaatcgtttgaccctataactctggaagaaaatcataccaaatcaccctgggaaagtatggcaggctatgcacagcatttgttgtcagagtctttcaatcaagaacatgcacgtgccatttgtgctgagctcttcagagtcgtttatgctgccattcaaaagtctggtgaccaaggattaagcatgggagaaatttctcaggttataaacttgccaggagcagaggtagatggattgattgttgatgctcttcaagcatttgggcaagccttaaaggttcctccccctttccttgtttcaatagtgtatagcatgcccggattagagtttgcaactcttggtctgacccaacgtaaagtaacttcttcccccctacttctactcaaaccatgtttgagggcaagccctggtgcagcggtaaagttgtgccttggtgacttgttggtcatgggttcaaatccggaaacagcctctttgcatatgcaaggaatacttaaatataaatgggccaaaattaatttttcatcctgggcccgtgaaatctcgggaccagccctgcatctacacttcccctcagtggaagctataatacaggtcaatgcttatgatactgtccgtgttgttgatgccttacaccttcacaagtacttttttacacctgtgtctgattttcatcaacatgttgtacaaccttcctcaacaaaaatcattgagaaaagtgatcatatatgtgagctttacaaatcagaagaaaggaacactacttctattgatactctaagggaaagaaacactggtattgataatgtgcacaaagtgacaattcttaatcttccacatggggatgtagatcctgaaaatcaagcttgtgataggattgaaggctctaagcaagacagacttggcttatccagtgtcaatcatgaaaaagaaacacttaaattttctgctggtgaattttgtgtgccaatattgccatggatcaatggagatgggaccatcaacaccattgtttacaggggactcagacatcgtgttgttggaatagtgatgcaaaacccagggatattggagaatttagaaatgggattagctgtgagtgttgctgcgtattaa

SEQ ID NO: 35001 - DNA, 306 bp, Glycine max
  Peptide Sequence Number=SeqID_151779
atggtggccaaacgtgtggctaactcaatacttgtgctgaggatagttgctcttgtaaccgcggctgcaactatggctttactggttaatgacaactacaaatttgataatggtggagagctgaaatatcaagatttcacttcatacagccttgtggtagctattgcagcaattgcctgtgcatattgtatagtgcagcttccttttgccatatattatgcgatacgacggaagaggttgataagcaatggattctttccagaatttgacttctatggagacaaggtatataaaagtttagactga

SEQ ID NO: 35002 - DNA, 354 bp, Glycine max
  Peptide Sequence Number=SeqID_151780
atggaagtgggaaaaggaggttctggaagtaagaaccaaaacgtgatttcgcccattaagcctcgcgctaagcgcatctttggtcatgcgctaaaccaagagtctctggcgattagcgcccaacccttgcatctcaagctgacttggtccactaagctggccaaggcagagctaagcccatttcaattcgatctaaattgggctaagcgatggccttcccgcgaagcacattgcattcactggctaagcgtgacacacaaactcgctaagcgcacctactgtgctaagcgagtgcatctttcgaggatgaacactcatccccctgttgagatacctatggctaagcgaggctga

SEQ ID NO: 35003 - DNA, 648 bp, Glycine max
  Peptide Sequence Number=SeqID_151781
atgctgaccgatgattcgtcaccgtgtgttgaatcacacacactaggagtgccttgtccgaattattgcgagtctaagcatgcagagaaagcagatagtgaagttcaaaccttgaggaaaggcctagccaaaatacagtctgacaaggatgctatatttcttcagtatcagaagagtatggacaagttatcagaaatggaaagagatctcaataatgcacaaaaagatgctggaggccttgatgacagagcgagtaaagctgaaattgaaactagagtgttgaaggaagcactagcacaactaaaatctaaaaaggaagctgttttggaggccaagataacccttactgaggagaattccaggatgttaagtgagcaacttgaaaaagttgaactggaagttaaagcactgagaaaaaatcttgttgaactgaatggagagaaagaatctttagttgtcctttaccatcaatgcttggagaagataactaaaatggagaatgaaattttgcttgcacaacaaaattctaagaaactaaatagagaaattgagaaaggggctgaaaaacttaagactgctgaagaacattctcatatgttggagaaatcaaatcaatctcttcggctagaggctgaaaatctgctatag

SEQ ID NO: 35004 - DNA, 288 bp, Glycine max
  Peptide Sequence Number=SeqID_151782
atgtccctcttcacaccaaaaacccgatgtgcaaaggaagaagggggaaggtggtggtgtgacgtcatgaggaggatgcaggggttggtgccgtggaggacaaggttgttgtcgtcacaggagggtgaaggaggtggattaaaatacccttctcatgtccctttcatgtccaaaggaacaatgcctttgttgtacttgatcccttttaactccttgtgtcaacctcgctggaaaatgtattgggtaaagatccacatgctcttgacccaacttcctatgaaaatgtaa

SEQ ID NO: 35005 - DNA, 315 bp, Glycine max
  Peptide Sequence Number=SeqID_151783
atgagaaaatcaggtctatccccacttagttacgagaaggagaagagaactacagagcttgatgagatttctcatgagattggtctgcaagtggttttaggaggctatcgtttctcattctatagtttacaagtcaacttttcaattaactactataggagtgcacaagactttgttcagcatgaagatctctcgacagtgtggagcaatgtcaggagacaagttgcaatgagatgttatccaagaatagggtggtcttccaatgtatcattcctgcatgtaaggacaaccaaaatgccaaagataaacgtctag

SEQ ID NO: 35006 - DNA, 207 bp, Glycine max
  Peptide Sequence Number=SeqID_151784
atgttggcacataataacaacttagttataaaggatgtcactacaaatggcgctctggagaaatgtccaagcttaggagaatcaagtgggaagggtaataggaagaggatcattgatggccctcctaaagagcacggcagcaatgacgaggaccaccatgatgcgagtagctcaacacccaaaccaaacttgaacaaggaagagtga

SEQ ID NO: 35007 - DNA, 183 bp, Glycine max
  Peptide Sequence Number=SeqID_151785
atggcttcaagagcggaacaacccatcaatgaagtcaagcactcaagtggagaatggcgtggtggtacaaatgttgggaattttgttaccgcaacaaaggtggaagcaggtcagaatgttaaagaagaacctgaagcgatggtcattagctctgatgatgaacctgaagcagttaagggataa

SEQ ID NO: 35008 - DNA, 171 bp, Glycine max
  Peptide Sequence Number=SeqID_151786
atggtggaaaagcacaatcagagagttttgtccatgagaacaaccaaaaatatggagaaacaacaaaaattgattaaagagctcaaatttgagcatgttaaggctaatagaggtagatctcatctaaaacgacgagattacaaggacaatggtgattcttcgatggattag

SEQ ID NO: 35009 - DNA, 375 bp, Glycine max
  Peptide Sequence Number=SeqID_151787
atggaggtagatatgaagaaaattaagcaaggattgtgggaacctttgagaaagtacattgtgtggttcaactgggaagcaaaaggaggcacaaaatctaaacccaagcatagtcttaatgttagtaaatcatggtgtgcaaaaaggaacattgttttgtgtctctatataaaaaatgcttctagctaccatcgaggaattcttgaagaagaattcaaacaagcaagtttggataatcctagatcgattagggtgcatgtaaacattgatcccgggaagtattgtcaatatcataaggcaattggacatgaatcaaggagtactatagacaccttgctaaagcaactgaagatctcattcaacaacgacaattag

SEQ ID NO: 35010 - DNA, 342 bp, Glycine max
  Peptide Sequence Number=SeqID_151788
atgaagattgttagggtagaatctaagttgccaccacctatcttgaaaaagttgtctcgctttttggcagaaaatgtagatatttttgcttggatccccacaaacatgcctaaaattgacccagggcacttctgtcacaagttaatggtagattctgaggaaaaactctatgccaaaagagaaggaagatggattggtccaaatttagaggactacgtggacaacatgatagtcaaaagtagacaagaggacaagcatttaactgacttgcaagaggtcttcacgctgttaagaaaatacaatatggtactcatccctaccaaatgcactttcggggtttga

SEQ ID NO: 35011 - DNA, 699 bp, Glycine max
  Peptide Sequence Number=SeqID_151789
atgatttatatcaagaaatgcaatagatgccaaagatgttcagatctacataattttcccatcgagaagcgaaaggtaatgaattctccttggcctttctcttggtggggcatcaacattttaggtctttttccccaagcagtagaaactatagttaataacaatggaactcagttctcaagaaaaaggtttaacgagttgcttgaaggtttaaagataaagcataaatattcctccctccaacatctggagacaaataaattggtagaagctatgaataaagtaatttcaaagggattaaagaggaggctggatattgctaagggatgttgggctgaacaactcccgcacgttctatgggcttatagaaaaactctatgttctacagttggggagtctcctttcagattagcatatggaatggaagcaatgatcctagctgaaataagggaaccttcatggagagtgctcaactatgaccaggagaccaaggaggaaatcatcaggtttgaactagatttagctaaagaaagaagagaaatggaatgtattagggaggcctcattgaaaagaagggtaaaagctagaaataataagtgggttatcctaggaagcttctcggagggaaatctagttcttaatagggtagatattagtggaagaaatgtcaaggaagcaaagttagctgaaaattggtaa

SEQ ID NO: 35012 - DNA, 1028 bp, Glycine max
  Peptide Sequence Number=SeqID_151790
ggacgccagctgatggcatagggctttctgaagtcaagagtgaggcatctggcatagacattagtacagcagaagatcatccaccagaagctgcacttgaaaattctattgtttcctcaagcactagacaatacatgcagttcatcaataggcttcctacaaaggaacttcctatttacatcactgcttacttctcagaagtgatgaaaagtgcagttggcaaaagatccattcagatgtacatagacaacaagccctttttaagtccaatagttcctccttttggaagcgtgaaagaagtgtacatcaccaacatgacagcttcagcagagacttcgtttgttttgcaggcttcagaaacttccacccttcctcctataatcaatgctgttgaagtttatacattaagtgacacattaactgcaggaactgatagcagagatgtggaaggtttgttacaactgcagttggcatttgaagtgcttgtggagtggagtggagacccttgtctaccatatccgtacaactgggattggatacaatgcaccactgatgtcaaacctcgagtaattgcattgtatcttagtggttatgaactgcgaggcacacttccggatttcagttccatgaatgcactcgaaaccattgattttcacaacaataccatggaaggccccattcttgatttccttggtctcctgcctaacctcaagacactgaatttgtcttacaataggttcaatggtaccatacccgcatctctacaaaataaaaacattgagcttgatacaacaaacaattgcctctcgggaatgaagtgtcagcctctcagtgacttcctaattccaccaccaccaccacctcaacctttttcaggtgatgaacaaaatattccgtcaccaccatcagaacttcatgctggggatgaacctttgggagctggaagtctgaagattaatgatctgaacataccattcatagtagctatgcaaactttgctaccactgctcttcattaaatttctatga

SEQ ID NO: 35013 - DNA, 426 bp, Glycine max
  Peptide Sequence Number=SeqID_151791
atgccgcgggcggcaaggctgaccagcaacacgaagacagtcagcaccagggcaccggcccaggccagcacctgccaggattcatacgggctgccggcgaactggttcatcaccaccggcaccgaggccatcggctggaagatgttgttgttccagtactggttgccgaaggcagtgaacagcagcggcgcggtctcgccggaaatgcgggccagcgccagcaggatgccggtgatgatgccggccgatgcactgcggtacagcacctgcacgatcaccttccactgcgggatacccagcgacagggccgcctcacgcatctgcgagggcaccaggcgcagcatctcgtcggtggtacgcaccaccaccggcagcacgatgaaggccagtgacagggcaccggcgaacgccgagaagttgccgccg

SEQ ID NO: 35014 - DNA, 689 bp, Glycine max
  Peptide Sequence Number=SeqID_151792
atgactgacctttccgtggataacgccatgaacgacctttccaacgccgtgccgatgcagcgcatcgccgtgccgtcctcgcacgagagcctgcacacgccgtctccggtgaagctggctgcgcgtggactggacttctactacgacaagttccacgccctgaagggcatcaacctggagattccggaaaagcgcgtgaccgcgctgatcggtccctccggttgcggcaagtccacgctgctgcgcatcttcaaccgcatctacgcgctgtacccgaagctggaagcgcgcggtgaagtgctgctggacggcgagaacatcctgtcgccgaagtacccgatgaaccgcctgcgcagcaaggtcggcatggtgttccagaagccggtgccgttcccgatgaccatcttcgagaatgtcgcctacggcatccgccaccacgagaaactgagcaaggccgacatggccgaccgcgtcgagcaggcgctgcgccagggcgcgctgtgggacgaagtgaaggacaagctggggcagagcgcactgggcctgtccggtgggccagcagcagcgcctgtgcatcgcccgtgccgtcgccctgcgcccgtcggtgctgctgctggacgagccgacctcggcgctggacccgatctcgaccagccgcatcgagcagctcgtgaagaactcaagcacga

SEQ ID NO: 35015 - DNA, 273 bp, Glycine max
  Peptide Sequence Number=SeqID_151793
atgggatgcggcatgaagaaaggacagagagcttatgggaagcaacacaaggattggatttggctcccaaatctaaagactgtgagagacaatgaggttaaagcttcggaagaaagtgatgaggtacaagccctaaaggcaaagcttgaaagagcccgggtagtcaaagagaagttcaaggcagcaatagtgagctcaagctccgaagaggtgaaaggaatcatcacgggtcaaaggcatgatcttgaaggacgagctaaaggcttgccttag

SEQ ID NO: 35016 - DNA, 282 bp, Glycine max
  Peptide Sequence Number=SeqID_151794
atgtgtggcatctcttgtcaaatgtcaggatttacacgcgattctcctcaaatttcagccagcccacatcaattagaccttgcaccttacgcttcagagccctacaatgctcaatggaacgtcccggggcttctccgtgacaaagcacacgttgcgttcgagtcgtattctcggagaaatggagggattgcctttgtggataactgggcggtgggtaaggataaggaatggcagtcacagcatgggcttctccctcattctcaccctcttcatttgccctag

SEQ ID NO: 35017 - DNA, 615 bp, Glycine max
  Peptide Sequence Number=SeqID_151795
atgacaagccctccaataagttttgttttagcaatagcacttttggtgctattattctcaaaaccttctctcacagtgtttgtaagtattgattgtggatcctcagaatcttccattgataaaaacaatataagatggattggagatgatgactacattcaacatggagaatctcatcaggtctatttgggttctaacccattgagcactctgagggtgttcacaaatagaaagaagaattgctattccatcagagttggaaaaggagaaaaaattcttaccagagcaagcttttactatggcaattacgacgacaaattctctccacccgtgtttgatcttcagtttgatggtaactactgggctacagtcaatacatcaagttattattattatgttgattatgaagcaatatatgtaacaaagggaaacttcaccagcatatgtgttgctcaaacaaggcctaaccagtttcccttcatatcatcccttgaagtgcgcagcttggaccccaaaatgtatagtcatgttgattccaatcacgcattgattttgaaatggagatatgcttctggtggaaatcagactataaggtattcggaattacaatgctaa

SEQ ID NO: 35018 - DNA, 3138 bp, Glycine max
  Peptide Sequence Number=SeqID_151796
atgagaatggatattgcccgatacaagccttacaatcccttgaaactgtctgggctacatgttcgaggtttgtattggtggaatcggagtggttcactattggaaagagatggtgatgtcgatgcattggatgctaaaatgaagtgtgctggtcgttactggtctggaaaatacatggctttggaacgacataagagctttaagcgtattcatcttgttgctccaaaattgtctcctgtcactatgcaagatgagtttatacctttatcagaatcagatgctggggcatctcatggagctgttgacagtgattcagtctccaaaacttcagcatcacttgaagaatcatgggaagatgaaatgttaaacaaaactagggagttcaacaaactaactagggaacacccccatgatgaaaaagtttggttagcttttgcagagttccaagataaggttgcagggatgcaacgacagaaaggtgctcgcttgcaaactcttgcaaagaagattagcattctggagaaggcagttgagcttaatccagacaatgaagagatattgctttgtcttttgaaagcttatcaaatgagagacagctcagatgtgctaattgcaagatgggagaagatacttttgcaacactctggaagttataagttatggagagaattcttgcacattgttcagagaaatttctccagatttaaggtttcagaggttaggaagatgtatgcacatgcaattgaagctctatctgcttcatgcagcaagcactctaggcaggtgtataaattagttactttatacatcagaggtcacaaagttgatgttcttcaagctgccaatccttcttcaccagatcctgtatttgttcagttagaacttggtcttgtggatatatttcttagtctttgcagatttgagtggcagactggttatagagaattggccactgctttatttcaggctgaaatagagtttagtttattttgtcctcctttgctgctcactgagcagagtaaacacagactgtttgagcatttttggaacagtggtggtgctagagttggggaagaaggggctcttggttggtccacatggttggagaaagaggaggaaactaggcaacgggttatgaatgaggagctctcacgtgaaaatgaaggtggtggttggactggttggtcagaaccatggtctaaagataatgagggtattgccaatgttgaacatgaaaccatgaatgacgtggttatggaggatattcaagatgaagaggaatacacagaagttgagccagaagttgatactgaagatttgctgaagatgctaggaattgatatgaatgatggggatggtggtgaagttaatgacactttgacttggatcaaatggtcaaaagaagagtcttctagagattgtgatcagtggatgcctgttcgtgggaaatcaggtacaacctctcctgctaacgaagcagacaaaacagatgaggatgaacaactcttgagagttgtattgtatgaagatgtgaatgaatacttgttctccctgagcacaacagaggctcgactatctttgttgtcccaattcatagacttctatggtggaaagatgtctcaattgttttgctcaaacagcccaacaagggctgacaatatccttagtttggaggatttgccagattctatgttggagaagttgaaatgcatccatgaagttttgactaaacaacagaacagtcttgctggtttcagttttgaattcctatcaggcagtctctcgaggaatgctgatattatgaaatttatacggaatgctgtcttactttgtttaactgttttcccacgtaattatatgttggaagaagctgttcttatttctgaagagctttatgttacaaaaatgaattcttctaatggtatgattacaccatgtcgatctttagcaaaatctcttctaaaaagtgatcgacagatgattaaaatgttacgaaggttctcaaagagtgatatgagagggccaaatggaataattatggatttgttgctatgcggtgtatatgcacgaagagaggctacttatggtaacattgatcacgcaagaaaagtgtttgacatggcattgttatctgtagaagcgcttcctgtggaactacagtccaatgctcctcttctatatttctggtatgctgaggtggagcttgcaaataactctgctaatgatcgtgaatcttcatctcgtggaatacatatattatcatgcttaggaagtggtacaaagtacaacccatttaaaagtcaagcatcaagtttgctactgcttagagcacatcaaggatttaaagaaaaactgagaacagtgtggtcatcttgggttcgtggtataataaatgaccagtctgtagctctaatatgttctgctgcattgtttgaggagctaaccactggatgggatgcgggcattgaagttttgaatcaagctttttcaatggtgcttccagaagcagtttgtactgtcaccagtctttgttgctgcatatttggtacttatgatgtctatctaatgcttgcaaacctgcagaaagaagaagtcaagatgcttcaaagacatcagagacaatcaagtctgatgaaagtttgggagtccatcttgcatggcctccagatatatccctttagtcctgaacttctaaaagatgtggtggaggttggccattattacactacatctaataaattgcggcggattctagatgactgtagttacaagaaaccatctgtagttctctggctttttgcgttgtcatacgaaatatttaaaggtggttcacaccacagaatccgtggattgttcgaaaaggcattggctaacgacaagctttgcagctcagttttgctgtggcgttgctatattatgtttgagatggaaattgcacatgatccttctgcagctcgacgtgctttcttccgggctatccattcctgcccctggtcaaaaaggctatggttggatggctttctcaagctgaactctgtccttactgcaaaagagctatctgatctacaggaagtcatgcgtgataaggaactgaatttgagaactgacatttatgagatccttttgcaacagtcgtga

SEQ ID NO: 35019 - DNA, 3051 bp, Glycine max
  Peptide Sequence Number=SeqID_151797
gttggcaagggcttgagaatggcagacacaaattcagttgaagtgattttggattttctgaagaggaatcggttcacacgagctgaggcggctttgcgtagtgagctcagtaactgttctgatttgaatggtttcttgcagaagcttacattggatgaaaagaacttgcatgatgggttgcagaatgataaggggaagcctgtggtagaaaatcaagggttggattctcgtgacagtgttgaagtttctaaagaactgattgtgaaggaaatagagtgtgggactggtactagtaatgctgctgaaagcaaatggaaaattgttgctcctactggcgaaaggaataagtctaatgaagtggttgagacgagtgacaaaaacttcactttctccaagagttcggaggacagtgttcttgatatgtactcatggaagtttaatgccagcaatggtcctgtggagctttaccaaaatgatggtggaagtaggcctaataatgctttaaaggccccggtatctcagcaatcaaagtatcaaactagtgaagctcttgatgcaaccaacagtaatgtgaaatctaaggaggaaaataatgtgcctgcggaaaaaacttccttgtggattggaagtagtggtaaagcctctacggaaccaaagtatgaccttatgcagagcaaagaacctagggaacttgatcggcagtttaaatttaatgcttcatctcttaaagagaacttgacagataatgtcttgtcaagaactgatgagaatgtgaattcatctacagacccatggaaagattgttctgtcaagactgttttccctttctcaaagggggatatgtctacaagctacaacggttcaacttattctgacagaaaagaggaaaagagaagggcagaaaacagtgatgttagggcatcaataaaagagcaagtggacgaagtgggaagagctctttacctagggaagttgcaaggcagttctgacagcttaagttttcctcttgcaccagaaaatcagaaggaagagtttcctaggcttcctcctgtaaaaatcaagtcagaagataagcccttgacttttaattggggggagaagtttgagtgtgatggactttctgtgaaactcgctggtgctgacaacaccttacttattgggtcatatctggatgtccctattggacaagaaattaaaactacaggtgtgaggaaggctgtagggggcagttggctgtctgtaagtcaagggattgcagaggatacatctgatcttgtatcaggttttgcaacaattggggatggattgagtgaatctgttgattatccaaatgaatattgggactctgacgaatatgatgatgatgaagatgttgggtacacgagacaacctattgaggatgaggcctggtttttggcacatgaaatagattaccctagtgacaatgaaaaggggactgggcatggaagtgttccagatccgcaggaaagaggtccagccaaagatgaggaggatgatcaatcttttgctgaggaggattcttacttctctggtgagcaatatattctaccaaaaaatgttgagccggtcactgcttcagatgatcctattggtctaacggtcactgaaatgtatggaagaactaatggcgatgatgtaatggctcaatttgatagacaattgatggatgttgaagaactgaatctgatgcatatggaacctgtcaggcagggctttgtcactcacaaaaatgatctcatcatgctaggagatgggaaggttctgaatcatagtgcgaggtcacgaattgaggacatggaagatgatcagcatggttcagttagatcaataggggtgggtatcaacagcgatgctgctgatattggcagtgaagtgcatggaagtttggttggtggtagtagtgagggggatttagaatatttccgtgatcatgatactactacacacagtggctccaaacactctcatcatgatttggataagaattctattaacaaatcattcaaaaataataagaaaaaggacaatactgagtcaaataaatatgtcattgacagtgataaagatgcatgctcacagataaaaacacacactgatgggaacttctcatttcctcaatctcttagagatagccagatgattcatgctggctccagtaagaccctatggtcgagtaattgtaatgtagaagcagatgactgtatgaatgcatttgtgggatctgatgacatgctttcttcttggaagaggaagagtagtgattcttcacctgttaaaagttctagggatgagaataatgctattgtggtaagatccagaaactcttctccaactacagtctcgaattatgggtatactgatggagagcttgtcaaactagaaaaggatgaaaaggttagcattgtaagggaagatgatataggtgcatcactggaggatgaagaggcagctgctgtgcaagagcaggacaagaatttccatgttgttttaaattctgtactagctgggcgctatcatgtcaccgagtatctgggatcagctgcatttagcaaagctatacaagctcacgacctgcacacaggcatggatgtttgtgttaaaattataaagaacaacaaagacttctttgaccaaagccttgatgagatcaagcttcttaagtatgtcaataagcatgatccttcagacaagtaccaccttctaagattgtatgattacttttattatagatcaattaccattcagtgtttggaagcacttcagtttttgcacagtcttggactaatacattgtgacttgaagccagagaatattttggttaaaagctatagcagatgtgaggttaaagtcattgatctcggaagtagctgttttgagacagatcacctttgctcgtatgttcagtccaggtcctatcgcgctcctgaggttattttggggcttccatatgacaagaagattgatatctggtcacttggatgcatcttggcagaactttgtactggcaatgtaagatcaatagatggttaa

SEQ ID NO: 35020 - DNA, 912 bp, Glycine max
  Peptide Sequence Number=SeqID_151798
atggtgacaaatctccgatgtggaggaatgatcttgtgcacggcgatcaatcacagcctatgcgacggcattggctcgtcacagtttctacacgcttgggcccatctcaccagagagcccaacaccgaattgacaatattaccctttcatgggcgacatgtgttaaaacctcgtaacacttcccaggtgcacttcacgcacccgcaatacaccagaacacacccctcctctcacgtggacctgcacaagctaatgatgcagtcacagtcgctggttgccacgtcattcaccttcggaccctccgaagtgcatttcttgaagaaacagtgtgttctatcactaaagtgcatcaccacctttgaaaccgtagcagcgcacacgtggcgcgcgtgggttaaatcactaaacctctgccccatgcaaactgttaagcttcttttttctgccaacattagaaaaaaggttaacctccccgaggggtattatgggaacgggttcgttcttgcatgtgccgagagcacggtgaaagatttagtagtggctaataacaacattagtcacggattgaaagtggtgcaacatgctaaggctaatttggacaatgaagggtacataaggtcgatggttgatttgttggaggacaaaacagtgcgtgttgatctttctacgagtttggttatatcgcaatggtcaaggctagggttggaggatgtggattttggagaagggaaaccattgcatatgggtcctttaacaagctctatttattgcttgcttttaccggttgttggagatgctaattcggtgagagtacttgtctctatgccggagaatgttgtggaaagttttcgttatcacatggtggtcaaagatgaaaatgcctatcatgaatcacaacatggattaatctga

SEQ ID NO: 35021 - DNA, 672 bp, Glycine max
  Peptide Sequence Number=SeqID_151799
atgacagaaatccttagctacaccgcttccagacagttatctcaaatgttccttgccattgccttctttcacggttctgaatattttctagcagttgtcattcatgggagatcaaatgtaactctaaagtctcttttgattagcaaacattatattgtggcaatgattttttcgttgctggaatacatcattgagattgttttagtacctgagctaaaggaacattgggtgatcagtgatttgggcctggcactggttctgattggggaaattataaggaagataggaattttaacagctgggaaagcctttacacatcttataaagatttatcacgaggagcaacaccagctgattactcatggtatatatagttatatccgtcatccagggtactgtggtttcctcatttggtcggttggtactcaaataatgctctgcaatcccatatcaactattgcatttgcagctgttgtctggcgcttttttgccaagcggataccttatgaagaatactttttgagacagttttttggaacacgctgtgcttgtgtgaagcatctgaaaataaaaatccagggttggattattcatgggcttctagcaagcctactgattttaccactggcaacgattctggaatgcactgatcaggcatgctcaaacaagtaa

SEQ ID NO: 35022 - DNA, 1503 bp, Glycine max
  Peptide Sequence Number=SeqID_151800
atggaaactgtttccatgaaccaagatcttagttgtagtgagagtggtcttgtagagggtaatggttttgaaagtgatgttgataaggtgtatagcactgtgatggataatttagctgaatttaacaatatggagaaagctcttggccaattggggatcccattgtccacccctttggttactggggtgctgcataggcttagatatgatgaaaaaattgcactcaggtttttcacttgggctggtcatcaagaggattattcacatgagccttgtgcttataatgatatgatggacatcttatctagtactaggtacaaggtgaaacagtttcggatagtttgtgatgtgttggaatatatgaagaggaataacaagactacggttccggttgaagttcttttggtgattttgagaaagtatactgagaagtatcttactcatgtgcagaagtttgcaaggaagaggaggataagggtgaagacgcaaccggaaataaatgcatttaacttgctgctggatgcactgtgcaagtgttgcttggttgaggatgctgaaactctgtataagaaaatgaggaaaacagtcaagcctaatgcggaaacgtataatatattcgtttttgggtggtgtagggttagaaacccgactagagggatgaaattactggaagaaatggttgaactgggtcataggcctgacaattttgcgtacaacactgccattgatacatactgcaaagcaggtatggtaacagaggctgtagatctttttgagttcatgagaacaaaaggttcatctatatcttctcccactgccaagacttatgcaattataattgtggctcttgcccaacatgatagaatggaggagtgttttaaacttatagggcatatgattagcagtggctgtcttcctgatgtcacaacatacaaggaaataattgagggaatgtgtgtgtgtggaaagatagatgaagcttataagttcttggaagagatgggaaacaaaagttaccgaccagatattgttacttataattgttttctcaaggttctttgtgacaataagaagtctgaggatgcccttaaactctatggaagaatgattgaattgaattgcattcctagtgtccagacatacaatatgctgatttcaatgttttttgagattgatgatcctgatggggcatttgaaacttggcaggaaatggacaacaggggttgcagaccggacattgacacatacagtgtgatgatcgatgggctatttaactgcaataaagtggaagatgcctgttttcttttggaagaagtgataaacaagggaataaaattgccatataaaaagttcgactcctttttgatgcaactgtcagtgattggcgatctccaggccattcatagggtttcagaacatatgagaaaattctataatcatggtatggcaaggcgttatgcactaagccagaagcgtaagagcatgagtttaagagggaaataa

SEQ ID NO: 35023 - DNA, 705 bp, Glycine max
  Peptide Sequence Number=SeqID_151801
atgtgcagtagaggccattggaggccagctgaggatgagaaacttcgagaattggtggaacactatggacctcataattggaacgccatagccgagaagctccgaggaagatcagggaaaagctgtaggttgagatggttcaatcaattggacccaagaataaacagaaatcctttcacagaggaagaagaagagcgtcttctagcttcacaccggattcatggtaatagatgggctgtaattgcaagacacttcccaggtcgaactgataacgcagtaaagaatcattggcatgtgatgatggcaaggattcggagagaaaggtctaaaattaataatccaaaactgcagccactttttgctccaaacttgaaggatgaccttgaggccatcccttcttttgttgagaagtattatgaaaagtacagccacccttgtgtcacactcacacatagctcttttcaatttcccggcaagaagttttactttcaagatccaagttctgctggttccactgtgcctccaggcaagagtcaatcagtagagttctacgattttcttcaagtaaataccgattccaatgaaagtgaagtgacagacaatgcaagaagagacgacgaggaagtaagtcaagatgctgtgggacagaagaataaggacaatggtgttccattcattgattttttgtctactggaggctgctaa

SEQ ID NO: 35024 - DNA, 675 bp, Glycine max
  Peptide Sequence Number=SeqID_151802
atgaatgcttcaatgaggaaaaaggttcaaaggaagtgtaagataagaggctacaacctcaaagtcgacgctctgaacgagatcctctccttcgcatctcgcttcgaaggccccgacgaggacgaagccatcgatctcctcctcgtcgagctcgattcatctctgaaatccaccataatcgacaaggagacggtgcagcgcgtggtcagcctgttgctggaagccaccgaggccaccgaggaaacctccgatgccgccgctgccattcgcgtcgtcgatgcgttcctcatccccaagtataaatacgactatagcagaaagcagttctacgagcacacaggcagcttatctattcatggagaagcatcagcaaagtcagatctgtacagggaaaggtttctgttgttgttccagaggctctctcgtgaccagcatttttcagcgcctgcttttgaatctgaattttcacattttgggagctgtgagatatctcccattcaatctctggttgggcaaacagctcaatttttttataagcatggatgtattgtcatctgtttctttgacaagcaatacaggataactacaggactcttttcagagaacactatagttgtggctgaaggggagatgcttgtggaggataatcagtttattcaggatggagattactga

SEQ ID NO: 35025 - DNA, 552 bp, Glycine max
  Peptide Sequence Number=SeqID_151803
atgatcctaggcgttcaaccacctgattatgcgacggacgggctcgtcacagtttttacacgcatgggccaagctcaccagagagcccaacaccaccccagctgcacttcagccaccggtgcctttcaacacaagatgatgatgatgcagtccgagtcgcttgttgccatctcgttcactttcggagcctccaatgtggtttcacttgaagaagcagtgtgtgcctgtgctaaagcgtgtcaccaccaccttcgaagccgtgcgtgtgctgagaccacagtgaaggatttagtggtggttgacttgcatcgcggtttggaagtggtgcaagaagctaaggctagtttggaggataaggggacaaaacggtgcgtgccgatctttctacgagattggttgcatatgggtcctgtaacaagtgctacttttgctgtcattttaccggttcttggagatgccaatgcgtttagagtgcttgtgtccgttctgcagaccgtgattgaaagttttggttatcacatgcttgtgaaagaccaacacttggggaattag

SEQ ID NO: 35026 - DNA, 600 bp, Glycine max
  Peptide Sequence Number=SeqID_151804
atgattgccgggtactcgcggctcggcctcgtggaagaggccaaggagctctttggggagatgaggagtggtggagtggagcccaatttggtgtcgtggaatggcatgcttgccgggtttgggaacaacggcttttacgatgaggccgtggggatgtttcggatgatgttggtgcaagggttttggcctgacgggagtactgtttcgtgtgtgcttcctgctgtggggtgcttggaggatgtggtcgtgggggctcaggttcatggttatgtcatcaagcaagggctggggtctgacaagtttgtggttagtgccatgcttgatatgtatgggaaatgtggctgtgtgaaggagatgagccgggtgtttgatgaagtggaggaaatggaaattgggtctttgaatgcttttcttactgggttgtcacggaatggtatggttgacaccgcgttggaggtgtttaacaagtttaaggaccaaaaaatggagttgaatgttgtgacgtggacgtcaataatagctagctgctcgcagaacgggaaggatttggaggctttggagctttttagagatatgcaggcttatggggtagtgcgttga

SEQ ID NO: 35027 - DNA, 909 bp, Glycine max
  Peptide Sequence Number=SeqID_151805
atggaaatgtttcatatgatgctgcagagtggtcagaagcctgatttggttacatttacatgtgttttatcagcgtgcgcgcaaaacggcctgactgaagaagggtggcgttgttataatagtatgtccgaagaacatggcattgaacctaaaatggaacattatgcttgcttggtgacacttctcagtcgtgttggaaaacttgaagaggcttactctatcattaaggaaatgccttttgaacctgatgcttgtgtatggggagccttgctaagttcttgcagagttcacaataatttgagtttaggtgagattgctgcggagaagcttttcttcttagaaccaaccaaccctgggaactatattcttctgtccaatatctatgcttcaaagggcttgtgggatgaagaaaatagaatacgcgaagtgatgaaaagcaagggattgaggaaaaaccctgggtatagttggattgaagttggacacaaagtacacatgcttcttgctggtgaccaatcacatccacaaatgaaagatattttggagaagttggataaattgaatatgcagatgaagaagtctggttacctccctaagactaactttgtgttgcaagatgtggaggaacaggataaggagcagatattgtgtgggcacagtgagaagttggcagtagtattaggactactcaacacaagtccaggacaacctcttcaagtgattaagaacctgagaatctgtgatgactgccatgctgtgattaaagtaataagcagattggaaggaagagaaatttatatttttggtaaactgatcttggctgtctggggtaagaggagagtcaattctctgccatgggtccttacagtagatcagaaaacagataataatcaagattatttgcattga

SEQ ID NO: 35028 - DNA, 249 bp, Glycine max
  Peptide Sequence Number=SeqID_151806
atgtcgtacccaaaggggctaactgctgacttgttaaaagggacaaacaggaaagtgtcagggaaagggccacacgaacacgatgctttgtcacggttcaagctgtttactttctgtttctgctacctaagttcacaccttattcagggaagtgtcgtgaaaattgcctcaaagactcagactcagactcagtcaccatgcaaaggattttgtgaagaggaggaaaagagacagtatgagttgggatga

SEQ ID NO: 35029 - DNA, 513 bp, Glycine max
  Peptide Sequence Number=SeqID_151807
atgacacttagacgacgtgatgttgagcaatggatgagccatcggcacttagcagaagatctgagaaggaagagaaagagcatagaggggcatgtaagcatgagaatattgatggataagaaagtgcgacaagctgaacgttataactgggccgcaacaagaggtgtgaatgaagaaatgctccttgagaatttgccagaagacctccaaagggacatcagacgtcatctctttacatttattaagaaagttcgaatttttgctttgttggatgagcctatcttggatgccatatgtgagaggctaagacaaaaaacatatatcaaaggaagcaaaattttgtatgatggcggtttggtagagaagatggtttttattgtgcgtggaaaattggagagtgttggcgaagatggaattagtgctcccctttatgaagggagtgtttgtggtgaagaacttctgacatggtgtcttgagcatcctttagcaagcaaaggtacatttcatttctag

SEQ ID NO: 35030 - DNA, 918 bp, Glycine max
  Peptide Sequence Number=SeqID_151808
atggcaaaaatgcttgttgtacttagaagcatgaatgatttcatacacttcctaaacattgttcttcagtttaggttggcttatgtggctcctgagtctagggtggttggtgccggggagttagttgaccatcctaagaaaatagctcttcactaccttcgaacatcttttattattgacttatttgttgtacttccacttcctcagttgtcttatatagatatatgtaaggctaacatgaagatccttaccagtaaaatattcatattgtttgtcctaccaaaacacttggggtcatcaggagcaaactattcgaagaatattttgcgtatcgtgatccttgttcagaatattcccagattgtgttggtttcttcctatgctaatttctccaacaggatctatatttgagtcaccatgggcaagtttctttataaatctttttacctttatgctatctggccatgttgttgggtcgtggtggtacctctttggtttgcagagggttaatctgtgcctacgagttgtctgcaagaaacaattcaaagcatatattgatgaatgcgcaaaattcattgattgtgggcatggtcaagctgaagcaaatcaaaataacgcaatcatgcttaattggaggaacagttctgttgcaagtgtatgttttactgaagatggttttccatatgggatctataataaagctgtcaaccttactgcggatcataatgtgatcactagatatgtatattcatcattttggggattccagcaaattagtactctggctagcaatttaacccccagctattttgtttgggaagtcatttttaccatgatcatcataggatcgggactgttgctgtttgctcttctcattggaaacatacaaaactttcttcaggctcttgaacgcaggtag

SEQ ID NO: 35031 - DNA, 150 bp, Glycine max
  Peptide Sequence Number=SeqID_151809
atgaaaaagctacaatacaaagggtatttccgacatgttttcataattcccaatggtgagaatgttcagaaatgcattccaaacctggtgctcaaattgcaagatgatccaacggtgaatgagtctgagatcatcgtttttctgagacag

SEQ ID NO: 35032 - DNA, 2229 bp, Glycine max
  Peptide Sequence Number=SeqID_151810
atgcagatgagtggtccattgtatgctaccactggaactggaaatcttctgcagaagcatattgtatcaggaaacaaagcaaaggaaagaacaacagataattttgctacacaccatgacacaggttcaaattactggaataacgactatgatagaaaaaatgaacacttactaaagtctgggcaactgggaatgtgcaatgatccttattgtactacttgccctacttacttcaacgcttctcagcagagaaatccaaaaccttcaactagatgggatccaaaggctattggtagttggcctgtaataaaacatgtctttgttaggaagaaaaagatgggtccaggaactagcaagaaccaaattaatttccataatgctctttatggggatgccaagagttttgtcagaaaacttctttctttctgctattcgtatgttcctggagttatgaaccctcatgctaaagttgtacaaaaatggaacaaatgtttggccattttttgcttgattgctatttttgtggacccactatttttcttcttactctatgtggagaaggataataaatgtattgttatcaactggcctttgacaacagcacttgttttatttagatgcgtgaatgattttgtttatttccttaacattcttctccagtcaagatctgtccttgattccatgtttctattgatctatgttcttagttttttgaagtttaggttagcttatgtttctcgtgaatcgagggtggttggtgctggagatttggttgaccatccaaagaagattgctcttcattacctaaagggttatttccttattgacttatttgttgtatttcctcttcctcagataatgatattgtttgtcctaccaaattccttggagggagcaaattatgccaagaatcttctgcgtgcagcaatcttagtgcaatatatccccaagttgttcaggtttctgccactgctaattggccaatctccaatgggattcatatttgagtcagcctgggcaaatttcgtcataaaccttctcatttttgtgcttgctagtcatgttgttggctcttgctggtacctcttcggtcttcagagggttaatcagtgtttgcgggatgcctgccatagttctaatatacctgaatgcatgaagttcattgattgtggacgtggccatggaaacaatcagcctggcttaagatcagatcagtggatcaacaatacccaagctgtcgcttgtttggatccctctcctgatggtttctcttacggaatttatgagaatgctgtaccacttactatagaaactaatgttgtcaagaaatacgtgtattctcttttttggggattccagcaaatcagtactctagctggtaatctagaacctagctattttgtgtgggaagtcctttttactatggccatcataggaatgggactcttgctttttgcaattcttattggaaacatacagaactttctgcaggctcttggacggaggaagctggaaatgcaacttagaggccgggatgttgagcaatggatgagccatcggcgcttaccagaagatctaagaaggagagtaagacgggctgaacgatacaattgggctgcaacaaggggggtgaatgaagaaatgcttatggagaatttgccagaagatctccagagagacataagacgtcatctcttcaaatttgttaagaaaattcggctttttgctctgatggatgaacctatcttagatgccatttgtgagagactaagacaaaagacatacatcaaaggaagtaaaattctaagtcagggtggtctagtagagaagatggtattcgtggtgcgtggcaaattggaaagcattggagaagatggaactagaattcctctatctgaaggggattcttgtggtgaagagcttctgacatggtatcttgaacattcttcagttagcacagatggtagaaaagtaagacttccaggacagagattggttagcaacaggacagtaaggtgcttaacaaatgtggagtcattttcactctctgcttcagacattgaagaagttacaatccttttcacaagattcttgcggagtccatgcgttcaaggagccctaaggtacgagtcaccttattggagatcccttgctgcgacccgcattcaagttgcttggagatacaggaagaaacgtctaagtcgtgttaattcctcaccgtcagattaa

SEQ ID NO: 35033 - DNA, 795 bp, Glycine max
  Peptide Sequence Number=SeqID_151811
atggctaattttgaagaccgtgagctgctgatgatgtcagaaacagatgcacaatcatatgatgaaactttgcactctaaattccaaaggcttttatccaggacacaaagtgcatcagtttctattcccatggagtcatatgagagaaaaactagtattgtgggacatagtggttcactctatgctaatgctacaccaggaactgataatctcttgcagcatagtatagttgtaacaggaaacaaaacagaggagagcaagacagataaatttgctactttcatcagcacagataaatttgatagtaaaaatgaacatttactgatatccggacaactgggaatttgtaatgatccttattgtactacttgtcctacttacttcgaggcttctcagctaagaaatccaaaagcttcaattctatctgatcccaaggtgtctgtctttcttcctataataggttacgtttcagttgccattaattacatgttccacaatgctctttatggggatgccaagggtttcgctagaaaacttttttccttctgttcttcttttgttcctggagttatgaaccctcactctaaattcatacaacattggaacaaggttctcgccactttttgcttggttgcaatttttgtggatccattatttttcttcttactctatgttcgtcaggattttaattgcatagttgtcaactggaaattgacaaaagcacttgttatagttagaagcatgaatgacttcatatattgtcttaacattcttctccagaggattgtaccctag

SEQ ID NO: 35034 - DNA, 504 bp, Glycine max
  Peptide Sequence Number=SeqID_151812
atgaaatctattaatagaggcatttggagtgctttggtaaatggatataccgttccaaatcatgtagttgatagcaagactatagagaaaccttatgagtcatggcctaaagaagaaattagaaaaggtgaatatgactccaagacaatgaacatcataccttcctcattaaattctaatgagtttttcagggtaagactccaagaggattggactagagcggctaaagaaggccctagggttctcatgaacctcaaggccttggatcttcttcatcaatggagtccgtgtgccaacagactcgcttgtctctggaaggcaaagggtgtggatgaccataatttgtctccacgtgccaacgaactcacttgtctctggaagacaaagggtgcagatgaccataatttgtctccgcgtgccaacggactcgcttatctttggaaggcaaagggtgcggatgaccatgatgtgtctccgcgtgccatcggactcgcttgtctctag

SEQ ID NO: 35035 - DNA, 213 bp, Glycine max
  Peptide Sequence Number=SeqID_151813
atgtcaaatgaagaattgaagttgcaggatccacgatgtcggatacaatgtcctgacatcctgcccgagaatactggagttgctgatccacgatgtcggatacaatgtcctgacatcctgcccgagaatactggagttgctgtacaatgcaagataaaagtcaagtgcagaagtgaagctgcaggatccacgatgtcggacacgatgtcctga

SEQ ID NO: 35036 - DNA, 600 bp, Glycine max
  Peptide Sequence Number=SeqID_151814
atgattgactcagggtgccctgatgggttgcagcaactccttgcatgggtcactggatccgccagtaggaaggctgtgatgcaagggtccaaaagaaaaaggcaacgaagtaaatcgagacaccaagttcaaaagcctaagaaatttcatgaacaaaggcctgatgacagccatgaagaaggaccggaggatgatgataattcagaagacgagtatttgaaagacttcctagaatcaagacccaaattgaaaggtactgcagaaaggcctccaaagcacttggtgatgccaccaaagagccttggcgaagtagagcttaatgaaaactaccaccaaattgaaaggccgaagccgatcggcacagaaaggataacaattagcagggaagaaaatgaggaaacattgtctctgaaactgcaagagttggcagtagagattgaagcaattgctagtgaatcagcagcagactataaaggaggtggctcacaaaatttagaggactcgtatgactttacaagaggccaaggggacaagctcataactctctggttgtgttcaatcactgatgctgctcatgtgaaagaactgcccaagaaatag

SEQ ID NO: 35037 - DNA, 240 bp, Glycine max
  Peptide Sequence Number=SeqID_151815
atgacctggttatggcattctatgactcaagaaatcagccgaaactctatgttcttctccactgctaaggagatttgggagaatcttagtcatacatattctatgaagaaggatattgcagcatcttatgaaatagagaacaaggattccactcctatagaggatgacaaaggccctaaaccaacatcatcaccagttcaacataagaaggacaaacgctctgggaaccagtacgagtga

SEQ ID NO: 35038 - DNA, 822 bp, Glycine max
  Peptide Sequence Number=SeqID_151816
atggccatcgtgggattgggactttttctttttgcacttctcattggaaacatacagaactttcttcaaggtcttggacggaggaggctagaaatgcaacttagaagccgtgatgttgagcaatggatgagtcatcggcgcttacccgaatacctaagaaggaaagtacgagaggctgaacggtatagttggaccgcaacaaggggggtgaatgaagcagtgctaatggagaattttccagaagatctccaaatgactagtaatgattaccccaattatcatgcttacaccttaaatggattgcaagttcggatttttgctctgatggatgagcctatattagatgccatttgcacgagattaagacagtcgacatacatcaaaggaagtagaattttgagtcatggtgctgtggtagacaagatgctattcgtggtgcgtggtaaattggagagcattggagaagatggaactaggattcctttatctgaaggggatgcttgtggtgaagaactcctaacgtggtatcttgagcattcttcagtgagcacggatggaagaagagttaggcttccaggacagaggctgcttagcaacaggacagtaagatgcttaacaaatgtggaagcactttcactccgagctgcaaaccttgaagaagtcacaatccttttcacaagattcttgcgtagtttgcgtgttcaaggagccttaaggtatgaatcaccctattggagatcccttgcagcaatccgcattcaggttgcatggagatacaggaagaaacgactaagtcatgctgattcctctcttcaagattaa

SEQ ID NO: 35039 - DNA, 1275 bp, Glycine max
  Peptide Sequence Number=SeqID_151817
atgaatcacttcaaacccaatgacacaagcattgacattgaacccttaaagagaagagtgtcttttgcagaataccacccaaatgaacaagaaccaccaccccatcagcaccaacccaataataatagtgttccattgttcctacagccatcatatgcgagatcaaagtcggtgatcttcgatgaactgcgaaactttcgcatcagcctcaggtggtgtgcccttgaccactcttcatgcgcaggaaaaatcatttcctacgcgactttcatattcttcaccatcattgttcctcttctcgcgtccatcttcgtcgaaatccctgcctcggcaccagaagatgaccccatctccttcaacaagcttgttcaactgccaaaatctggtctcgccattattgcctttttcactctctccggtttcttcaaaaggtatggccttaggcagcttctgttcctagatgctttgcaagaagacaccacctatgttcgacgtggctacacacgggagcttgagaaggctttcagatacttgacatgcataatcttaccttgtttatttgtggaacttgcccacaaaatcatattcttttcagcagttaaattttcagccccacacatcagccctgggttgccactgaactcaattgtgtttgtattggtgttgctgtcttggctgtacagaactggggtattcctgttggtgtgtgtgctttttaggctcacttgtgagcttcaaaagctgaggtttgaaggggtgcacaagctgtttgaagggtgtgggtctgaggcaggtgtgatattcaaagagcatgtgaggatcagaaggcagttgtgggatacaagtcataggtataggttcttcataattgggtgtgtggttacaatcactattagtcagctaggtgctttgctgctggttttggcttccaagtctgataagaccttcttcaattccggggaccttgtgatttgttcagctgtgcagttaagtggcttctttttgtgtattttaggagcaacaagaatcacacacagagcacaaggaatagtggcaattgccacaagatggcacatgcttgtgactgaagcatcttctgaatcaaagcaatgcaaagctcgagtgtcagaaggacttgctagtgacagtgattctgatgattcctccaacatacatgtgtcagtgatcccatcacaactttcttctttccaaaccagacaaactttaggtgagtttaatctctacgaagaaaatgttactggtacatttgattag

SEQ ID NO: 35040 - DNA, 324 bp, Glycine max
  Peptide Sequence Number=SeqID_151818
atggctcgagacaccaacgacaactctcaagacattccattagatgaagtgcaaaatttcaaaatgagaaccaaatgggttgatcatcaatctcctttgaatatagaacatgtctctcctactaaagatgtggacggatgtgtttcaatgaatcctcgggttcttcatgatatgcgcattttatccaagttctggggtgatgttgtggatgagactgatgaagacaaaccccctgataggcttactcaagagcttaaacaggatgctaacttcagtagggtcctccctaaaacccaaaagtttaagctgaaaagaaggaaatga

SEQ ID NO: 35041 - DNA, 1017 bp, Glycine max
  Peptide Sequence Number=SeqID_151819
atgccacaactaaaattgggggacatccaagagatgaagcttatctacaacaatctagatgcacttcatattgcatcaaactcagtcttccatgagaggaccaaacacatagagatcaattgtagctttccaaagaaatcacaactgaggctagaaatgcaacttagaggtcgtgatgttgagcaatggatgagccaccgtcgcttacccgaagatctaagaaggagagtacgtcatgctgaacggtatagttgggcagcaacaagaggagtgaatgaagaaatacttctggagaatatgcaggaagatctccagacagacataagacgtcatctcttcaaatttgttaaaaaagttcgaatcttcgccctgatggatgagcctatcttagatgccatttgtgagagactaaaacaaaagacatacatcaaaggaagtaaagttttgagtcaggggagtcttgtagagaagatggtctttgttgtacgtgggacattggagagctttggggatgatggaactatggttcccttatctgaaggggatgcttgtggtgaagaacttctgacatggtatcttgagcattcttctgtaagcacaggtataacaatactggatacaatgataacatgcctgctaaagtggaggttagcagaagttgcaattttcagcaacttggcctcgctacaaattcagaaacatggtttacgaaagtgttttctcacccttgcagatggtaaaaaagtaagggttcaaggacagaggttgctgagcaacaggacagtaagatgcttaacaaacgtggaggcattttcacttcgagctgcagaccttgaggaactgacaattcttttcacaagattcttgcggaaccctcatgttcaaggagcactaaggtatgtatcaccttactggagatcccttgcagcaaaccgtattcaggttgcatggagatacaggaagaagcgtctaagtcgtgctaatacctcgcaatcagatcaaacattgattgcatag

SEQ ID NO: 35042 - DNA, 180 bp, Glycine max
  Peptide Sequence Number=SeqID_151820
atggacggtgggatggggattgcgcgtgaaggtgatggtccatggaaaggtgacacgagccaagagaaaatatgggaggagaaggatcttgtgagattgggaacacggcaagtgtcatgtcatcggccaatggtcatgaaatctattttttcacatcccaaaattagctattcaacttaa

SEQ ID NO: 35043 - DNA, 1713 bp, Glycine max
  Peptide Sequence Number=SeqID_151821
atggcgttgaatatgactcaccagatcgggaccctggctgctgcgacggtgccggtgccgaattcgtctgccggagaatcaaccgcggcgatgagtgccgccactctgtggaagccgccggcggtgagtctgaagtgcaaggtcacgaggacggagggcggcgctgaggggctgtcgccgccgctgagcccgtgcaggtcgccggtgctacgggcggatctgtcggcagcgtgtcaggcgttcacggcggaggtggcggcggaggagtacattgccggagggaaggagaaaggagaggggaaggagggagtgccgctgtttgtgatgatgccgttggacagcgtaaagacgggaaacgcggtgaaccggaagaaggcgatgaacgcggcgatggcggcgctgaagagtgcgggggtggagggggtaatgatggacgtgtggtggggtttggtggagagagagaagcctggggagtataattggggagggtacgttgaactcatggagatggcgaagaagcatggcctgaaggtgcaggccgttatgtcatttcaccaatgtggcggtaacgtcggagactcttgcactattcctttacccaaatgggttgtggaggagattgataatgaccccgatcttgcatatactgatcaatggggaagaagaaactatgaatatatatcacttggatgtgatacttcgccagtgctcaagggccgaaccccagttcaatgttatgctgatttcatgcgtgctttcagagacactttcaagcacctccttggtgacaccattgtggaaattcaagttgggatgggaccggcaggtgagctgcgttacccttcttacccagagcaaaatgggacatggaatttcccaggaattggtggtttccaatgctatgacaagtatatgttgagtagcttaaaagctgctgctgaagctgagggtaagcctgaatggggaagcacaggccctactgatgctggacactataacaactggccagaagacactcaatttttccgcaaagaaggtggaggctgggatggtccatatggtgagtttttcctcacctggtactctcagatgctgttggaccacggtgacaggattctctcatcagccacgtcaatctttgacaacactggagtgaagatctcagtgaaggttgctggcattcactggcactatggctcaaggtctcacgccccagaactcacagcagggtattacaacacccggttccgtgatggctacatccccattgctcaaatgttggcacgccacggtgccatcttcaacttcacctgtattgagatgcgcgatcacgagcagccacaagatgccctttgtgcacccgagaagcttgtgaagcaagtggctctggcaacgcagaaggcacaggttccacttgctggtgaaaatgcgctgccacggtacgatgagtatgctcatgagcagatcataagggcatcacagttggatgttgatggtgactctggtggaagagagatgtgtgcattcacttacctgagaatgaacccgcatttgtttgaaccaaataactggaggaagtttgtggggtttgtgaagaaaatgaaagaagggaagagtgcacacaagtgttgggaagaggtggagagggaagctgagcattttgtgcatgttacacagcctcttgtgcaagaagctgcagtgctgatgcactga

SEQ ID NO: 35044 - DNA, 201 bp, Glycine max
  Peptide Sequence Number=SeqID_151822
atggagcatgaaacattccttgcaacttggttggcagagattgatttctctcccaatggcttgagattctcaaatgtgcaaccacagcctaggttgatcaaccatgaaaaacctatgctatgtgggtggcacaagcttaatcccttgaaaattgagggtaggagatttgccctggattcagctagggactactttccttag

SEQ ID NO: 35045 - DNA, 252 bp, Glycine max
  Peptide Sequence Number=SeqID_151823
atgtcaccacacgttatgcaggatggtggaagcagtcaatactgtatcatcatcgtgattttgcaaagaatattactcggtgaaagagcagtctatgcaatgatgctggtgtttccacctgaattttctcctttgaaaactattttatttggaaatccttcccaagacaccgttgaaccacttatggaggctttggtggaagattataaagatgaaaatgagataaatgaatcaaggcagtttattggagga

SEQ ID NO: 35046 - DNA, 258 bp, Glycine max
  Peptide Sequence Number=SeqID_151824
atggatacctcaaagacctacactggggcaatgaaaggcatcacccatttggaatcatttgacttaatccatcaactgaaaaatccttcaactatttctcgtccttggaaaattctttttgcaagaatcaactgcttctttcattcttcctcactacgaggttgtgaaaacaagacaacaattggtaccgctaagccctacactggggcaatgaaaggcaccatgcaaaaacctcaagcgaacctaggggcagattag

SEQ ID NO: 35047 - DNA, 2152 bp, Glycine max
  Peptide Sequence Number=SeqID_151825
atattccccaacttggagtttttgtatattcactttgacgaagcacagaagtggttattgagcaacactgtgaagcatccaatgcaccgtttaaaagagcttcgcttgcgccaagttaatgatggtgaacgtctctgtcagattctgtacagaatgccaaatctagaaaagttatacttgtcgggcgctaaatatttgtttaaagagtcgtcggagtcacgtttgggaaccgtattacagctgaaggaattggatttgtggtcttcggagataaaggatataggatttgaacgagaaccagttctacagagactagagcttttgagcatagtatcgttggcttacttgacaaatttgaaagtatggtattgtaatggattaaggaatttaatggcatcctcaacggcaaaaagcttggttcaacttaagtccatgaagataagcaaatgtgatgaattagaggaaatagtaagcaatgagggaaatgaagaagcagagcaaatagtgtttggcaaattgattactataaaacttgaggggctaaaaaagctgaaaagtttttgcagttacaagaagtgtgaattcaaattcccgtcattggaagtattgattgtgagagaatgcccattgatgcatacattcacggagggtgacgcaagagcagcaaagttacaaaacatagttagtgctaatgaagaaggaaaagaggaagccaaatggcagtgggaaggagacttgaatgccaccatacaaaaaggtttcaacaagcttttggagtctgaaagtactgaatcatctcttagtctcagatatagcccactacaagtgatatggcttgactcagggcggatcccaaagtcgttcttcagtaacttgacgtctttgactgtggacggatgccaatttttaacagatgttgtcatacccttctatttacttcctctcttatctaatttggaacaattagaagtctcggactgtggttctgtgaaaagcatatttgatataacacaagaaagagaaatcacaactatgggattgggagcagcagccttccctagacctctccctttttccctcaagaaattgactttagagaggctgccaaaactggagaatatctggaatgaagatcctcatggaattctaaccatgcaacttctacaacatgtaaaggttaaaaattgtaaatgccttacaagtgtgtttccggcatcagtagccaaagatcttgaaaaactagttgtcaaagactgtgagggattgacagaaattgttgcagaggataatgcagatccaagaagagcaaatctgaagcttacgttcccttgtccctgtgtgtggtcattgaaactacaagatttgcccaagttcaagtatttttactactcctcactgcagtgtgacatgttccagacacctaccaaggatgaaatgcctacatccaacttacagtgcctgtcactcggtgaaaaaggactggagatgatcaagcgtggagaatttcagagaaacttcttacacaagttacaagttcttactctgtgctttaatattgggtcgaatgtatttccatatgaaattctacaactggcgcccaatatagagaagctagtggtgtgtgattgttccttcaaggagattttctgctttgatagtcttaatgtggatgaggctggactcctattacagctcaaagtcttatgcttggagtcccttccagagcttgtttccattgggttagagaactcttggattcagcccttactgggaaatctagaaaccttggaagtaataggttgttctagtttaaaagacttggtaccatctacagtgtctttttccaatctgacatatttggaagtagaaagatgcccttccctgctatttttgttcacatcctccacagcaagaagtttggggcaactcaaaacaatgaagataagttgctgttattcaattgaagaggtagtagtctctaaggacggggatgaatcacatgaggaggagattatatttccgcagctcaattgtttgaaacttgaagaactaccaaagctgagaagcttctataaaggaagtttattaagtttcccatcattggaggaattgtcagtaatctattgcgagtggatggaaacattatgtccag

SEQ ID NO: 35048 - DNA, 603 bp, Glycine max
  Peptide Sequence Number=SeqID_151826
atggctggtacattcttccttttgaaacagcaaaatagtttagagattataagcggtaagaaagaaatgactccgaatagagttgtgaactggccattcaggactctgtatgttatggcacgttctccaaacaagataaagagcatcaatggctcaaaagaaagtcttaaactcagtgtgaggatcagtgatctatggtttattggcacgcctaacaaatctgagcaagctgaaatggtgtttgtggactcggatggtgatgagatccacgctatttgtaaacaagaccaattgaaggagtgtgttctaggggacatcccttttagaaaatacaggtttgctggatttgcagatgttgtgactggccagtttgaacatggactattggttgatgttattggtgttgtggaggaggttgtctttcggcaagttttaggaaaaggtagaagggtagttttcaaattaaaggacttgagccagcaattgctatcttgcactttgtgggatgattattgcttgcagtttgtgaagttcttagatgattatgtaggtgatggtccaattacagttctattaagccattgtaggatcaaggaagcgtag

SEQ ID NO: 35049 - DNA, 366 bp, Glycine max
  Peptide Sequence Number=SeqID_151827
atgtctcctccacctctaggacctcacaatcactcacaaactcatctcaagctctcaggacggcttcctcttccagctctggtctctacagatcttcacacaacaaaatctctcaaactctctggaacttggacctttctctctctagaactttctagacatgcagaagcttcaagaaaaggccaaactcccctcagaaatctgatttcaggcttaaataggcggccttcgaatatgcacaactcatcctccttccagattcttcctcgcactcagccgagaagtgttgcgctcagcggatggctcgctaagcccgaagattggcttagcgagagagtgaaaatcattgcttcaaaacttgcctaa

SEQ ID NO: 35050 - DNA, 602 bp, Glycine max
  Peptide Sequence Number=SeqID_151828
atgtcctggctacagaagtttcctctcttagaggagagttgcaacaattctgaattagagaaagttaaagaatctaggaagcactcctccactgaattggacagcttgaccttaaaagctaatgatctggaggaaaaatgttctttgaaagataatcagataaaggcattggaagagcaactagcaactgcagagaagaaactgcaggcatcacaagaagaagtttttgtagaaatttcacagcttgtaccaagtgctcttgatggttacaaggtttgcatctttgcctgtggtcagacagggtcagggaaaacctatacaatgatgggaaggcctggacatctagaggagaagggcttgatacctcgttcattagagcaaatatttcaaacaaagcagtctcaacaacctcaaggctggaaatatgaaatgatccgtgatctgatatctacaacaacacgtatggaaaatggtactcctggaaaacaatatacaatcaaacatgacgcaaatggaaatacacaagtttctgatctcaaagtagtggatgttcatagtgctaaagaggttgcatttcttttaaatcaacctgcaaatagcag

SEQ ID NO: 35051 - DNA, 360 bp, Glycine max
  Peptide Sequence Number=SeqID_151829
atgaaagattgcagaaatacaagtagtggggatgtctcctccacctctaggaccttacaatcactcacaaaatcatctcaagctctcaggacagcttcctcttcaagctctggtggctttgttcgtgctcgtgcgcatagcgcaattctaaaccgcttagcgcgcattggtgaatttcggcttagcgcaacttttctcgctcaacggatggccctttgctcagcgaacaagcacaactcatccttcttccagattcttcctcgtgctttgccgaggaatgttgcactcagtggatggctcgctaagccagcagattcatttagcacgagggtgaaaatcaacacttcaaaacttgcctaa

SEQ ID NO: 35052 - DNA, 504 bp, Glycine max
  Peptide Sequence Number=SeqID_151830
atgtgtagcgccaccgattacaaaattaaatcaatcgaaggtatgtgcatcttaatccaaatgtgggcatggaaacgatgcacgactttggctccaaagaggactcctcccgtaatagaaaataaaccacttggacacaggtggctgcgacgtggaaatcagcagcatattgacaatgatgatctgatagtttttcgtcgcaaattggatatcatgaaacgacatgagtttctatgggaaccttacacaacaactgttattgtagcgtggtgcgcggtggtgccactcatttgttttcatgttgttgagtggcaccaacccgataaagtgttgcgaaaatttggaatgcaaaaacctattcccaagtgtccttcacaaccattgaatttccatggcataacgctgaaaggcaaacaagatgaaaattggttccaactattggccccaatgatcagtcaatggaacaatcgaactgagtttagggtcgacgtttatcctcgatag

SEQ ID NO: 35053 - DNA, 894 bp, Glycine max
  Peptide Sequence Number=SeqID_151831
atggcgttaatgattacagttagaattagaagtttaggtcgtgctttaagtagagttataggaagagtcctagggagagaagataatcgtgattcagatgaagttctcaaaaggcgaaggcccacaacatccacacgtaggcaacgagaagttgtcgttgttgctgaggatgctcattacatggataatgcagctgaagaggtcttccaacagcctgaagaagcagtttttgatgcccagggttttctaggtgagccgcgtgacacattagttctgactgcctatgctgatcataaatgtcctgaattgaaactatcctcccatgaaaggaaggttcaaaaattcgggaggtctactgctgagattgaagggttagtcgctcccacaggattaagtcttttgatcgcatgttcatttgacattggcgattggagacttatatcgccttttgtggaaggctggcataaggaaactagcagtttccatcttccagtaggagaggccatcatcacccttgatgatgtggcttttttgcttcatctgcgcatcataaattcattccatagtttcaaaactcttcatgttgacgaagtggtgttgatgttagtggagttacttgaagtcaatggagatgaagccagagctgaggcagtacaatgttatgggacatattgttggatttatgagcattttccatctattgccgagacttttaccgatgaagactatgatgaaaggtcaccatgtgcctgccactggacctctacaaaggcattaccaatgttgacatatcgtaagcgtctagatcaattgacgacggctgatcccagggatccacctagacatctacctatcgtgcaagatgagacatatgtcgaaccagagaagccttag

SEQ ID NO: 35054 - DNA, 1206 bp, Glycine max
  Peptide Sequence Number=SeqID_151832
atgttcaagaaaatcatgaaaggcgggcacaagaagcccgctaagtccgacgccagcgatccggttccgccgccgtacgccgccgccaaccgtagcgctccggcggctccctccgccaatgccgtctccaaccacgcctcgcgcatctcctcgaccccgctgacactctcttccggcggctccatcgagccggtgccgctgttccgcgacgctcctgtcgcggaacgccagaacctcttcctccggaagctccacgtgtgctgctacgtcctcgacttctccgacacgctgaagaacgttagggagaaagaaatcaaacgccaggcgctcatggacctcgtcgatttcatccaatccggctccggcaagataaacgagaattgccaggaagagatgatcaggatgatctccgtcaacattttccggtgcctccctccggcgtcgcacgaaaacaccggccaagaacccaccgatcccgaggaagaagaaccttccttggacccttcctggccccaccttcagctcgtctacgaacttctcctcagatacattgtttcctccgacaccgatacgaaaatcgcgaaacggtacatcgatcactccttcgttcttaaattgctcgatttgtttgactctgaggacccgcgcgagagagagtatttgaaaaccatactgcatcgtatatacgggaaattcatggtgcataggccctttattaggaaagctattaacaacattttttaccggtttatatatgagactgagagacactctggcattggggagcttctggagattctcggcagcattattaatgggtttgccttgcccatgaaggaggagcacaagttgtttcttgtgagggcgcttctgcctctgcataagccgaaatcggtggggatgtatcatcagcagttgtcttactgcattactcagtttgtggagaaggatttcaagctcgccgatacggtgatcagggggttgttgaagtattggccggttactaattgccagaaggaggttctcttccttggagaacttgaggaggtgctggaggccacgcaggccgcggagtttcaacgttgcatggttcctctttttagacagatttcgcgctgcctcaatagctctcactttcaggttcgtggattattgctatgtttatatgatggtgttggtttggacttggtggtggtgtgggtttaa

SEQ ID NO: 35055 - DNA, 498 bp, Glycine max
  Peptide Sequence Number=SeqID_151833
atgagtggaaagggattgcagcatgttcggaaatcactttctcaatatgagcgtcttagagcatgtttggaaatcaaatgggataccaattgggaaagagagtttttagtttatgtaaagaactcaaaaacttcgacatccttacctttaggaacactcgaaaggtggcaacgccactcaaaaaggcatgacttcggctacgtggcggtggtgggagcagcaggtccacttcggcttcaggtacttcacggtgggaaacaaaacgtcaggatgataacgggacggagttcacggcgggatgaagtagttcaggcaatagcgggggcgctaggtttttggagtgtacaagagagggtgtttaccgcgagactatataaactacaaaatttacgacggtgtttaatgacaccgactttgtatgtgactatttctaggacggtgtacctacaagcaccgtctttgatgacttccatcaaaactacaacgacggggttatag

SEQ ID NO: 35056 - DNA, 330 bp, Glycine max
  Peptide Sequence Number=SeqID_151834
atggaaacttctggacgagccattgacctagcccaaaatggtaaatctgttgtgatcatgccaaaaaattcttttacatttgataaagtttttacaccagaggcatcacaagaagaagtttttgtagaaatttcacagcttgtacaaagtgctcttgatggttacaaggtttgcatctttgcctatggccagacagggtcagggaaaacctatacaatgatgggaaggcctggacatctagaggagaagggcttgatacctcgttcattagagcaaatatttcaaacaaagcagtctcaacaacctcaaggctggaaatatgaaatgtag

SEQ ID NO: 35057 - DNA, 699 bp, Glycine max
  Peptide Sequence Number=SeqID_151835
atgcaaggagaacatttgcgtaaagggacttggctccaagaggaagatgaacaattgactagctttgtgacccgtcttggggagagaaggtgggattcccttgccaaagtagctggcctcaagagaagtggtaaaagctgcaggttaagatggatgaactatcttcgtccaaatctcaagcatggtcattttagtgtcgaagaagagcagcttattgttcagcttcaacaacaattggggaataagtgggcaaagattgctcggaaacttccaggtagaactgacaatgaaatcaagaatttctggagaactcatttaagaaatagagctcaagctcaacaagtcccgggagattttaagtacaaattagaaattgcaacagaagaagtcaaccagaaaagcattgacatggattccaaggattacaaacatggaaacgtttgctgtcaagatagtgagtgggagacaaaggatggtagctccatacacactttacccttatcagattgggaattgggaagctcaccctatgaaactaggatattggattggatagcagaattgcaaaatggatatggtgataaagaactagagcaagattgtaatagcacaggaacgtgcaacaactatagtcctcaagaatttgatgagggatgtgactcatgggattattcaggttccttgtgggatatgaactaa

SEQ ID NO: 35058 - DNA, 192 bp, Glycine max
  Peptide Sequence Number=SeqID_151836
atgtttgtattcaacagtgctgtgaaaggacttgacaatactcaacaaactaaacccaagcctcctactaggtggattgttgttaaatatttcactgatgctagaccaatggaaccagagagattgaaggcgtttcacatcgagtgggcaaagtactatttgaaagttaaaaatgaaacttatgatgtttag

SEQ ID NO: 35059 - DNA, 264 bp, Glycine max
  Peptide Sequence Number=SeqID_151837
atggaaaatcttcacgaaatctcccacggaaacgtctcggaagcgttacagaagcgcctcggcttggaaacaatttttttcactaatttcaagagaatcgtaaatactagaagggctgaacgaaattactctgccctctttcccctatttatagggaaaaagagggaggtggttgccgcccagctcgcccaggcgagctgggttgcttccactagaaggcaccgccttctcttggaacatcctggaagggccaagtgggtctga

SEQ ID NO: 35060 - DNA, 354 bp, Glycine max
  Peptide Sequence Number=SeqID_151838
atggaggaggaggaaaagacatttatagtcccaatcaatggatccgcttatagctgtgaacatagatacataactggcaacgccgagaacaccagcggagatagtgagaagcgaaatgcgatccacgttcttaggttgggtgctgtaggcgttgtgataagtctgggagatcgtgatcccggtggagcccatcacggcgtcgatgaggccgtccttgcagcgggagagggtgcagtggtcgattcagatgtcccgcgagcccaagatggagattccgtcgccgtcggactccgtgcggtacccgtagtgctctgggcgccaacgcacgttagcgttgccttcaagtcgcagtga

SEQ ID NO: 35061 - DNA, 285 bp, Glycine max
  Peptide Sequence Number=SeqID_151839
atgacaagaagggaaatgctgggagtgtcagagaaagatgtagcatcatgtgtaacagggaaccccattgatgattgttggaaatgtgacccagattgggccaacaacaggcagaggctagcagatggtgcaattgggttcgctacaaggccattgatgggcgtggagctgatgtgcacattgtgggtggaagctgcattactcttcagtatattagcaatgtcatcattcacaacattcacatccaccattgccatccctcgggtaagatcaatcattcaatag

SEQ ID NO: 35062 - DNA, 198 bp, Glycine max
  Peptide Sequence Number=SeqID_151840
atgatggaaaatattttgtaccttgctaatacccctgtcaccaattcagagaaaaataaatcgcatgatgacagtacaagtggaggcttcaatcccttctctgtctctttgacgtttgggaactctatcggagcagttagaggaaaaaaattggaggaatctcagggaaccgctagagatgctgctatcgctggctga

SEQ ID NO: 35063 - DNA, 231 bp, Glycine max
  Peptide Sequence Number=SeqID_151841
atgcatgaggtagagagtgtcacaagggaggctgcgtggtgcactagaatgatgaacatgttttgtgagattgctaagagaatcaatgaaatgatgagaaatggaactttgagagtcaaagctggagaaataaaggaggcagctaggagggctgctggtgttggtgggagtagtgaggttattgttaagagacaaattgaggagtggaagatgaatgctcaatctacttga

SEQ ID NO: 35064 - DNA, 837 bp, Glycine max
  Peptide Sequence Number=SeqID_151842
atgaagcatccaggcaagcttagagtgtttcttccaaatttgataatacttgtaaccatccttctccattcaacatggattaatgcacaggaagttgaggatgagagtgagtttgattacataaaagggagtgagaagggtccctcacactggggggaactgaagaaggaatgggaaacatgtaaaagtggcaaaatgcaatctccaattgatttgtcaagccacagagtgagagtggtgccaaagttaggggagcttaagaagtactataagcctcagaatgccactgtcaagaacagaggccatgatattgagctgaaatgggagggagatgctggatcaataaacatcaacggcaccgagttttttctgcatcaatgccattggcattcaccttcagaacatacaatcaatggcaggaggtatgacttggagctccacatggttcatgaaagcaaaagaataaacgggaaaggcaaaattgctgttgttggacttttctataagattggacggcccgattctgttctcaacaagttgtcaaaatttataaaaaccatggtggatgaagaagaagaaaagaacattggggtgttcgatccctcaaaaattaagttgggtggcaagaaatactacagatacatgggctctctcactgtccctccttgcatagaaggtgtcatttggactattaataaaaagataagaactgtgtcgagggctcaagtcaatttacttagagaggctgtccacgatcatgcagagaagaatgccagacctatacaacccctgaatagacgagggatacaactctatgcccaaaagcggaaggattaa

SEQ ID NO: 35065 - DNA, 1646 bp, Glycine max
  Peptide Sequence Number=SeqID_151843
atgttggggaacaaaaacattctggggcaagccttatttcctgtaaagggtgttgtagtggttgaaaaagttgcatcgtttggccttatgttcttcttcttcatatgttgtgttaaaatgaatatttccacattgatgaagattgaaaagctggccatcactgttgctatttctgtgttcgctcttacattggtaatccctactggactagccattctgttgaggaaatatgctacgatggacaggagccttgcacaggcactgccctttatggctctctcacaagccttaattgtatttattagcatagcaatgctcttgaaacatgtcaaattccttaacactgatataggacgtttaaccatgtcagcagcaatgtttgttgatatagctggttttaccttcacagtgattatttttgttgcactgcagaatcagagtggtagctttctgacactagcaggcctccttcagttcatagttgcacgcagagatagcaagattggggtcacaacattagtcatagtgaagcttcaaggaagacccaggcctattcttgttgataaccaaaaccaaccccatcatgacctacgctcaatgtcttgcaacgcaagtcacattgataatgcattgaggcaatatggacaacaaaatgaaagatgtgtatctgttcaatctttcacttcaatctccacatttgaaaccatgtatggtgatatttgtagaatttcactagacagtggatccaacattttgatcttgctattccacaagaggtgggtaagtgatgacaccgttgaaatttctcataggaccatccaaaccatgaacattaatgtcctccaaacggcaccatgtttagtgggaattctagttgataagagcatgttcaatccttctccttcactcttgatggctagagcatcattctatgtcgcagtgttcttcattggcggtcaagatgtcatggagacattagcgtatgccactagaatgggtaggcatcaatgtgtgtatgtaactgtggtaaggttccttctatttggagaggagaattctaaagatagaaaacgtgacggtaatcttatagatgagtatagatactataaagccagaaatggtaggtttcagattctagaagaattggagaaagatgagatagatatgtcaacatgtataacaacattgatagattattttgatctagtgatggtgggaaatgagcatccagagagttataatagagagataaagtctattgggagcagaaattcttatgggaatgatttgttgggtattctcttagatgagatgaagaaggagggtgctaccttcaatgtacaactagttatggatgaatgcaaaacatttttctttgttggacatgaaaccactgcactcttgctcacttggacaactatgttgctagcaagcaatccatattggcaagacaaagtccgacttgaagtgaaagagctcttcaagggggaaattccatcagttgatcaactctctaagctcactctgggacatgatgaatggagtgagtgtgaagagctaggggtcattggagacatgctaccatcaccaaattttgtgaccaaggcatcgttgttggtggtgcaacaacagagaataagagggag

SEQ ID NO: 35066 - DNA, 375 bp, Glycine max
  Peptide Sequence Number=SeqID_151844
atgcgaaaccatgttagagaaaataaagttaaagtggtcacggaaggcaagaccaatgttgatgacatcgagggagcggggctcgaaggagaaggaggcaaggcgaaattggaagacgcgatactcatgcgcggaggaggaagatgcaaagagggaaaagagaggagaggagagggaggtgacagagaattggcacatggagggacgaaagggggagcgacactggcggaggaccagccaaggaagggggaagaggtggggaggaaggatgggaggacgttgtcggtgaagttgtggaaggagggggaggtgaggaagccagtgacagtggcaaggagggtggctgaggaggaggaggtgtcgtcgtcattgtag

SEQ ID NO: 35067 - DNA, 906 bp, Glycine max
  Peptide Sequence Number=SeqID_151845
atgagtgcctcagtcattgtttctctttcacatctaacaagcatgaagcttcaaagagtgaatacatatataattccacatttactcgtgcttttcatgatcttgttagcttcaacatcaacaagagcacaagttgaagaacttgaggacgagagagagttcgattatattggagcaagtgaaaaggggcctcgtcactggggagagatgaaaaaagaatggtcatcttgtaaaaatggacacttgcaatctcccatagacttgtcatgtgcaagagtcaaaattatccctcgatgtcgccaacctgatatatactacacagctactaatgccactatcatcaacagaggccatgatattgctgtatattggaaggatgatgctggttcagtatacctcaatggaaccgaatactttctgaaacaatgtcattggcactctccttcggaacattccatgaatggcaggagatatgacttggagatgcacatggtgcatgtaagtccggacaacaagatttttgtggttggagctctctataagtttggtcatcgtcctgatcgttttctctctcagttggagaaagacataaagcacctggttgataatgaagtagaaagagaaattggagagacaaatccctcaggattacagacaagaggcaatgcgtattacagatacgtaggctcactcaccactcctccttgtactgaaggtgtcatctggaacattgatagaaagattaggacagtttcggaagaacaagtgaggcttttgagggaggcagtgcatgacctgtggccattgcagcatgcagagaggaatgcaaggccaatgcagcgacgttacaatcgagatatattatacttccgatccaaaagcagagcaaaaccagaatattattaa

SEQ ID NO: 35068 - DNA, 447 bp, Glycine max
  Peptide Sequence Number=SeqID_151846
atggtttttccaactccagcccaccactgcaggcccaatcaatgcagccagaaatttaaatggttaggaagaataacaggaaacccatggccgatcccatcaaaaggtccaccaaccaaaatatttgctccaacgatgaacccaatcacaattggcgctatcacttcgaaactacgggacgcagcggagcaaggtgaggttgccgccgacgaaggcgccgaacgtaacagcaggattgacgtggccaccggagatgttagaactcacagagacggtgacgaagagtgcggagggcttgtcgacggcgacggaggagccggagccggagccggcgaagatgaagatgagtgtggagatgaattcggagagagcggctcgccacgtgtcgtggtgagtgacctcttgggctctacgcacgatggcggtgaaacgccattgtccatgtga

SEQ ID NO: 35069 - DNA, 180 bp, Glycine max
  Peptide Sequence Number=SeqID_151847
atggttcaaaggcatcatgttggatcgtttgtggctcgaatgagacgtcaagggcagtgcgggctgggcgatgaagagtcaggaaataaggacgaagcaacaacaactctggttgaggtcattgctttcggagtcaagattttcccttgccactccaatgaagcaaactcaccggactag

SEQ ID NO: 35070 - DNA, 897 bp, Glycine max
  Peptide Sequence Number=SeqID_151848
atgcaagtccaagaggaattacttgtggtttccaaggatcacacccaaatgatgatggtcaagggcaaaagaaccaagcgtcaaagagcaccatcccctcttaggctagccatgccttataattcaacctcaagtaatagtagcaccaacaattccattgatagtgccacaacctcctcaccctctccctctcccaccaacaacacaattgaatttcgagaagaccaagacatggcgaattgtctcatccttctcgctcaaggcagataccacgtggcagcaccaacgccgcatcacaacaataacaacaacgacgacgacaacctcaaaaagtcaacaagcctatacctttaccagtgcaagacttgcaacagatgcttcccttcattccaagcacttggaggacacagagcaagtcacaagaagcctaagcaaaacggcaccttttcatcagaagcagttactaatttcattgaagagaataatgatcgttatgaccccaccacaagtaccaccctctctttgaaaacaccaaatggtgttagtaatttgtgtggcaccatcactgccacaacaacaacaacaacaacaacaaaagctaataaggttcacgagtgttctatctgtggtgctgaattctcatcagggcaagccttggggggccacatgaggcgtcatagaactcttgtgaatgcttctatgacaacttctatgaggggtggaaatgttgttggtagcaatgaatttcaagaagccaagaaacccttgaagttggacttgaatcttccagcactaccagaggatgatcatcatagagaatccaagttttcgtttcaacaaagagaaaaaaacgttattgtcttctctaagtcttctttggtggattgccattactga

SEQ ID NO: 35071 - DNA, 342 bp, Glycine max
  Peptide Sequence Number=SeqID_151849
atgaagttcgacgtgaacagtaacccaaaactgaaaataatgaaaccctcaatctctttcccctacgtgaatagtagcccccctcaaaaccctagcagctgggttcctaaagcttacaaatctggttttgggcccaataagggtacatctacttggggttgttatactgagaacaaaagagggtacatctcttgtggatcagttcaagtggagggttcatccacttggtttttcaaagagaacaagggagggtacatcccttgtggatctttggcttgtaaaggattttacaaggttgaaagaaatttcaagaaccacagattgcttggggactggatgtag

SEQ ID NO: 35072 - DNA, 396 bp, Glycine max
  Peptide Sequence Number=SeqID_151850
atgagaggagcgccatcggaaaagagtatcgcgcctttcattgcacgaggcttcagtgaccccaatgcaagaatgcttcaaagagtccaaaaagcatggaatgcggtgcaaagaaaggataaggagcttggaggaagcgacaatgggatcgtcggcggctatcacaagtggctgaaggctcggacgcaagagataacttggcacccaatgctaaaggtttcaagtgaggaagaggttgaggtccttgtggagagcgaagggatgcaagccttaaaagtggaactgaaaagaacacaagtagtcaaggaaaagttcaagacaacaaccattagagttagaaaggaatgtgacgagttgagggatgtcaacgtggccatggctgaagcgttggaatga

SEQ ID NO: 35073 - DNA, 240 bp, Glycine max
  Peptide Sequence Number=SeqID_151851
atgggagatcgcttagaggatatgattcgtgaccttggacaagagtcttttcagcaagaacatgcccctatacatgaatttgaacaaatgtccaaatgccctaggcgtggggtatcacgatacaaagtcaaggatgatgaggagtgtagtattgatgaaaactcaaagaagggccccccagtgaaggtgttgtggtatctaccgatcgttccaaggtttaagcgtccttttgctaattga

SEQ ID NO: 35074 - DNA, 207 bp, Glycine max
  Peptide Sequence Number=SeqID_151852
atgtcttgggaaaggaaacattttgggttcaaagcatatagaacaaagaaacatgttttgttgggtggtcatacttgcggccaccccaatttgatagtgcccatttacctcatgggtccatgggctatagggttccctttatgggctgcagctggggcacctacattcaccccattttgcttgtcttctaaagtgtttaataggtag

SEQ ID NO: 35075 - DNA, 606 bp, Glycine max
  Peptide Sequence Number=SeqID_151853
atggcctctagaaagagaaagacaacaacctcccgaccccagcagccctatgataccaccaaattcatttctgaggagttttatgacaatctatatgatccagaggataagttcccgaggcaagtcagagtccggggaaaactgattaaatttgatagggagtcactaaacacttttctagagacccccgtggttttggagctaggggagcgctacatcacttacactagggccctggaagctcttgaggaaggatctcactactttggctcagacctagaggcgaggttagtttacggtctagtgaccaagatggacatggacatgggttcattcatctcaggccatatttgtcaaatggcctaccctgccattaatttggcatacatcaggaaaaattgttggaacctggatgatctcacgatcaccttttcggggacccgcaagaccagggctcagggaccctcagacgcttctgcttcttcttctactccacctgctccagctccaccagctcccactccagctcccacaccagcaccctccggcccctcagctcagagcacaaagattttagtgttgttgcttaagctaagtgctttatga

SEQ ID NO: 35076 - DNA, 471 bp, Glycine max
  Peptide Sequence Number=SeqID_151854
atggatcttcatggacaatcgattcatttactgaagcatatgtctcaaagcatcactgttacagttgctaaagagatccatgctttgaaaagcatagctgcatactacggtggcttagaaatcaatttaaatgtgactaaaacggatgctgaggagagtctgaaagaggtgttaacaaatactacgaaacctatttttctactaaaatacaaaaattacaaaaatcttgttgactacctcttcttgcaaagtttggaaattgctctatcttatgacttgccaatgcagatacacacaggctttggggatagacttttggatttgaggaagaccaatcctcttcatctccgttcagttcttgaggacaagagatattcaaagtgtcggtttgttttgttacatgcatctcatccatactcaaaggaagcatcatatctagcttctgtttactcccaggcaaacattttatga

SEQ ID NO: 35077 - DNA, 717 bp, Glycine max
  Peptide Sequence Number=SeqID_151855
atgagggcgagccctagtgcagcggtaaagttgtgccttggtgacttgttggtcatgggttcgaatccgaaaacagcctctttgcatatgcaagggtacgcattagatgatttgggttctggatcccatgttcaccttagcttgtcgcgaaatggccaaaatgtatatatggcatctgatagatcatctaagcatggaatatcaactttgggaaaggaatttatggctggaattctacatcatcttccttcaattttggcatttatagcaccactccctaacagttatgatcgattacaacccaacacatggagtggtgcataccttttctggggaaacgaaaataaggaggctccattgcgagctacgtctccacctggaactcctgatggtctagtgagcaactttgagatgaaatcatttgatggttctgccaatccatacttgggcttagctgccatacttgctgctggcattgatggacttcgtaggaagctttctcttcctgaacctgttgatacaaatccaaatccggaaacccttcagagattgccagcatcactttctgaatctttggatgctctcaataaggatgacttccttaaggaatttatgagtgataagttgctaactaccataaaagcaatcagaaaggctgaaattgatcattacacgaagcacaaggatgcatacaagcaactcatacaccgttattga

SEQ ID NO: 35078 - DNA, 3317 bp, Glycine max
  Peptide Sequence Number=SeqID_151856
gtgcgaagaagtctcgcgaagttgttttctctgtcctacgtgatgcatgcattgatggtgatctctcaattcctgaggctgtggaagttgcaaaggacatctttgctcgaaatgcaatccacttctacaagattagttcagctattggtgttgttagttcacatagtaatttgccccaaaagctgaatgatggcttagacattgatttgtcacttgttcgtatcttgtgggttgatggttcaggacagcatagatgtcgtgcggttcctaaaaaacgcttcaatgatattgttgcaaagaatggggttggcttagcatttgcgactttgggattctcttcttatatggatggacctgcagacgggtctggtctaactgcagttgttttgtgttcgcacttgattcgtgattctgtttctgttcttcgtcttggtccttgcttggccgcacgcacgacaccggcgctcgtttgtttgcgtgtgctcctgttcaagatgttcttgaaagggaaaggcatgaggggacatgtcaatgggtcctcctctaaacccacggccatggctgagttggcagcttgggagacgcaggatgcccagattatttcttggcttttgggctgtacgtgctgctctcttaaatcgccacccacttccttctctggatgtgtatgtgttggcgaactgcttcgggaagaacaacgtcttctcactcaaccagctctgtcccgtgactcttctgtttcggaagctattgttgttgcctatactgcccaagataaaggcaaaggttgtgatacacgacaagttcaatgttatccgtgcaagcaatttggtcatattgctcgccattgcaccaagaagttttgcaactattgtaagcaacgtggtcatatcatcacggactgtcccactagaccaccatggcgtcaggtgcaagcttttcatgcagctaattctatgactgagacacccacttctgtcccaaccaatgctgatgccttaactccagagatggtgcagcaaatggtgctttctgcattaggcatccagggtaagtctaatgatatatcttcaccatggtctgttgattctggagcctccaatcatatgactggtacctcggaacatttaaacaacgttggcacttataatgacactcaaaacattcatattgctgatggtaatactctttcaatcactgctgttggtgatattactccttcctttcgtgatgtatttgtctctcctggacttgatcaggtgtcggggaaggtgatcgcgacggggcctaaagtgggcagattatttccactccagtttactctacctagacttttgtcttttaattgtactggtgtgccaaataagtatgaggattggcacaaaaagttgggtcacccaaattcagttgttttgtctcatttactgaaaaatggattcttaagcagtaaaattaccattcctggttcatcctttaattgttctgtatgcaaacttactaaaagcaaaaccctcccgtttccttctaatgctcatcgtgctgacaaatgtttcgacattattcacagtgatgtttgggatcaagttttctccatgtttaagacatttttggcctacattgcaaatcaattccacactagcattaagattttgcgcaccgattctggtggggaatatatttctgctgagtttcacacgtacttgcagcaacaaggcattatttctcaacgtttatgtccatatacacctcaacagaatggcgttgcggagcgaaagcataggcatttgcttgatgcattgaccactgttgtctacttgatcaatcgccttccctcccaggttcttggcgtcgattctcctttctttcgactttataacatacaaccgagctatgatgacttcaccgttttggttaagggttttttgtgttatgatgttgttgtccagcgtttccgtatctctcggaatgtggttttcttttataatcaagatttctttccatttgtttctcctggtgctaatgattttgctactcttccttcttttcctaaggtttctcatgctacggaacggtttaaaccaggctatgtatatactaggcaccctcttgccccgccccttcccgactctgaaccgtcacctgaatgtacaccaatagcaccttgtagatccggccgtatttctcgtccaccagataggtatggttactcccctacttctcttactgccactttatctagcattcctattcctacatgctattcacaggctgttatggatgtgtgttgggtcaaagctatgcaagaggagttgcaagcacttcaggagaattatacttgggatattgttccatgcccccctaatgtcaaaccccttggctgtaaatgggaatatggagtggattatgatgggacattttcacctgtggccaaaatgactactattagaactgtgctatctattgctgcctccaagggctggtctctccatcaaatggatgtgaaaaatgtctttcttcatggtgacctagctgaagatatttacatgacccctccacaaggcaatcttaactattttttgggtcttgaggttaattctcatcccaaaggtctctttcttcatcaacacaagtatactgacgatttgatctctttggctggtctccaatctgctgctcccttagatactcctctcgaagttaatgccaaatatctttgtgatgagggtgacattctacctaatcctttgttgtatcgtctattagtgggtagtcttaattatctgactattacacgtcctgacatctcctttgcagtccagcaggttagccaatttatgcacactcctcgccatcttcacctagctgctgtccgacgtatcattcgttacttgaaaggttgcccagatactcgaagatctgtcacaggttggtgcatgtttcttggttctgcacttatttcttggaaaagcaaaaagctagcttgggtctctaagtcttccactgagtctgaatatcgtgctatgtctctagcctgttctaaaattatttggcttcgtggtcttttagctgagcttgatttccctcaaaccgaggctacacctctctatgctgacaatactagcgccattcagattgccgccaatccagtcttccatgaacgaaccaaacatatcgaagtggattgtcattccattcgtgaggctcttgataatcgtattgtctctcttccccacattacctcgcaacttcagcttgcagatatatttaccaaggttgttcctcatcctcgccatcagtttctcaatgatgctccttga

SEQ ID NO: 35079 - DNA, 456 bp, Glycine max
  Peptide Sequence Number=SeqID_151857
atggaattgagtgagttgagaaaagcggtggaagaggtggagctggtggacgctcatgctcacaacatagtttctctcgattccaactttgcttttatccatgccttctctgaagcctatggtgatgctgttactttctcaccacacactctatctttcaagagaaatttaagagaaattgctgagctgtatggatccgagctatctttgcaaggtgttgaagaacaccgtagagtatctggaatgcaatccatctgctcaacatgcttcaaagctgcaagaatctctgccatacttattgatgatggcttacaattggacaaaaagcatgatatagaatggcataggagttttacacctcttgttggtagaatcttaagaattgaacggttggctgaggaaatccttgatgagtatttcatttcaacttggttacttatgcaggaaggagaataa

SEQ ID NO: 35080 - DNA, 669 bp, Glycine max
  Peptide Sequence Number=SeqID_151858
atgctgactccccttcctatgccgatcgcgattccatgccctgcaccaaggcaacaaagccccacacccatcccgactccgcttcccatggctggaaaaggagatggtcctagtatcggaataaattccggcaccacctacttccccgtcagagtgtggcaacaccaccgtgtcgacatcaaccacctcttccagttcaaccgtctgttgcctctgctgcttcgcaatgaccaccgtcgttaccaagagatttcctacgaaaaagacatcatcctgctcggtgacgccgtcgtcacacaccggattcatccgcgttggatttgggttctctccgctactgagactcaactttgctttgttcctcaccggtgtcgatgtccgccgccacacctaccaccatgtccaccacaactatcgaagccactattggcacgggtctacattcacagccctcagcacatcatcgtctgcgtttcgttgacaatggtgttacggtcatcaagctcttggctgtgtgttctacattcgcagccctcaacgcaggtcataaacccaaccttctccaccttcacaagaatagacgataacagtcaaagaactcaagaagattgtccaaaatccccccgccttgaagattcctggaacaagccagaggatattacaaactga

SEQ ID NO: 35081 - DNA, 246 bp, Glycine max
  Peptide Sequence Number=SeqID_151859
atgaacgtaggattcgaggcttttagtcctcacgggcaggatcaccttgggctaccttctggagtagagacaaaacatgaacggcataaaccaatcaaggtacttaaggacgaacgcaagtggggatggggtcacgaccgaccgatcgttgcccttctctgtgcgaaacaagcagagaatgtcgctgcaaggcagccccgtatcctttgtattttgcagctttcttttactttttgtttgttttaa

SEQ ID NO: 35082 - DNA, 444 bp, Glycine max
  Peptide Sequence Number=SeqID_151860
atggaagatggtgcttccaaaacgaaggaggaatatatagaggaatctaccagcattgagttagggttagttagcagtctcaactgtgagagacagggtacaatgtggaacaatggcgcaaaggaagattctaactcagggatctttcaacaacaaggcttcatggcaacaatagtgcaaatttggaaggtgcgtgggggtgtagaaatcaatgaagtaggaaggaacctttacaccttcaggttcctaaatgaaaagcatcgagcacaggttgaagaaggaggggtttatgatcttctggtgggtttcaaaacaaaggagatggcagagcgaattggcaaatcaatggggaattttatcaaatgggataagtgcaatgaaagtgtgatgagtgactgtaaggaagaagatacgaatgaaattgatcaagatgatttaccctag

SEQ ID NO: 35083 - DNA, 152 bp, Glycine max
  Peptide Sequence Number=SeqID_151861
atgacccagcctggtttggtgaccaagatgttgtagatgaactctttttgatggttggcttaggtagagccaacctaaaaccattaccagtgcttcttcctcctcttagggaggttcctgatgccttaggcgacatgagaatttttcggtaa

SEQ ID NO: 35084 - DNA, 369 bp, Glycine max
  Peptide Sequence Number=SeqID_151862
aaaactgacttgactccttcatgcatgctccactcggctcggggggatatagctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 35085 - DNA, 2409 bp, Glycine max
  Peptide Sequence Number=SeqID_151863
atgataaccattgttgcttcttacaatgtcactccaaatcagccaactcccagtgatcctatttggctatccgatagtgatcaaattgggcacctacgtcatgtaaacactatctatgcctacaaatcaagacccaacaacaccattgatattgagaggatgaagaactctcttagcaagattttggtgccatactatccaatagctggcagattgaagctgacaaaaaatggtagaatggaagtggattgcaatgcaaaaggagtgacattgattgaagctgaaagcacagccacatttggtgattatggagactttgcaccttccgattccaccatggaacttgttccaaaagttgattatactcgaccctcagaggacatgccgctaatgctagtgcagttaacaaggttctgtggtggtgaaggtcttgccattggagttgctttctctcatcctttggttgatggtactgccgctattttcttcatcaaccgatgggcaaagctggttcgaggcgaagaactggatcccaatgaagttccttttcttgatcgaacactactcaaatttccagagccatcagaaccatgtgttgatctcccagagtggaagcctgtaaggttcatgccagacaacattgctgagcaaaacaagataagtgctatattgttgaaactctcatcaagccaagtggagaagctgaagaagaaggctaatgaacaaccttcaaaagaaggggtaagaccttatagcagatttgaagctatttcttctcatatatggagatgtgcatctaaggctcatcacgctcatgcatctgatgagaatcaccaaccaactgtagttacgtttagtgttgatattcgcaatagattgaatccacctctccctcagaattattttgggaatgctttggcaaaaacactgactcctaagtgtagtgtgggagatatcttattaaacccattaagctatggggctcaaaagataagggatgcggtttatgcggttacatatgagtatataaggtcacacataagttatgttttagggcaagagcaattggataacataagggcttttttctcgggacaaggagaccttattaatgaaccctattctgggaatcctcataacattctcatcacaagctggatgagcttgccagtgtatgatgcagattttggttggggaaagcctgtgcactttggtttagcaaaagtatttcgagaagttagggcacatattattataagccctgatggagatgtcgctcgtcagtcgctgcaacgggatgatgattgtagccaaatgcaaagccacgtggaccgcccatgccggcgcataggacagcctcatagtacaaaaaagggaatcggcggcgacatcgcagtcgcggctagaggactcgacgatgctgctctagctggggctcaagttcttaacattttccaaagggagagggaagtttgtcttggccttagggccacgaaactctcgcgtatctcccccatggcctctttctcactccacgaaaatgcacctccggtgatattgatgatacatgcaggagccatcagccatgctcatgtgggatctgcatctgtgttggttggtgatattgatgatgcattggactctgaaaaaaggtacttgaaaaggggtgtgaatgatcgggggagggttgctaatgatgttgagacagagcagattgtccttgatgaagaatcaggctcttgcaagggaaagatgagttcagttgtgcaaatgcgtggatcaataccacttttctggtcacaagaagcatccagatttagccccaagcctgatataattttgcagaggtatgatccaacataccaagcaacaaaattgcattttgaagacctagctaagagatatggcaatccaattattgttctgaatttgattaagacagttgagaaacggcctcgagaaatgatgttgaggcgtgaatttgcaaatgatgttgggtatctgaaccaaattctaccagtggagaaccatcttagatttattcactgggattttcacaagtttgcaaagagcaagtctgccaatgttttggcagttttaggagctatagcaagtgaagcgctcgatttaactggtttttactacagtggtaaacccagcatcattaagagagccaacaagagcaatcaaacaagcacagggagggatacttcactgagagatctgagagctagttctgtggatcttgtgaggattgggaacagtaatgaaatgataaattctgtggtgagtgtgttctctgctcaccttatctatggttcacaggtgaatggttcagtgatccactcaccatcagagtttgatgcagcttcaatggcttttgagatccctctcctaacctatggttaa

SEQ ID NO: 35086 - DNA, 434 bp, Glycine max
  Peptide Sequence Number=SeqID_151864
atgcactttgaggtgttggatgttagtgattatgcaactgaccttgctgatttggtaccagaggtttgggtcgaaggaagcggcggtgagaatgacttgggggaaactggtggcggatttgatggtgccgttgaatctgatgccgaagccggcatcggcgacgccgtgcagcgcttcactccaccactggtaactcgggatgccgagccggggaatcgccggtgccgtgttgacgagttgggcgagtttctcgtcgagagtgagccgcgagacgaggtcttgggctcttttgctgatggggagcctggtgttgcagaatgggtagtaggtgaggagaaggaaagagatgaaaatggcagcggaaaagtgagaaagagtcatgctatatgctctgggaggaaagtgccagagatgggtgaaaataagtgtgaaag

SEQ ID NO: 35087 - DNA, 258 bp, Glycine max
  Peptide Sequence Number=SeqID_151865
atggctcattcctctctcttgcggtactcactcctctctctcggtcttttctcagagagaatatgttcatcggcagcacgtctgggaccacgtgaaggtgatgtggttataaacaagggaagggaagtcgcgtggacggtggctgctctgtccaagaagccgaggggagtgagaggggaagagttagcagcacttggcttcaactgttccataattagaacaagattctctgaacgaaaatgcactcacactgggtaa

SEQ ID NO: 35088 - DNA, 114 bp, Glycine max
  Peptide Sequence Number=SeqID_151866
atgacagaacttgagtcctttgctggtgtaaatgctgtcaagggtgatagatacggtgatgagcttagcaagttgctatttgaaacgaacttggcactactagagaaagcctaa

SEQ ID NO: 35089 - DNA, 282 bp, Glycine max
  Peptide Sequence Number=SeqID_151867
atgaaggacacgagaggtgaatgggatgaccgagtctttgatgccaagacgaaaggaggcgcagtcagcagtggcgcagttgaaccttccgttgttgttggagcatttggtttgagcccagaacgcacccgactatatggagatggaatgtccacagagtttgatgctcctgaagccaactcgaaacctgttgttgataactgcggctttttatcaccggttagggttactggccataccgtgtatgtgcacttgtttgtgaaagtcaccttggctccttga

SEQ ID NO: 35090 - DNA, 417 bp, Glycine max
  Peptide Sequence Number=SeqID_151868
atgttttccctaccaggtattaattgggcacacatcttctccttggtgatgaactcaggccaatgcaagttgaggaggtgtttgatagtggctcaaggagccaaggtgactttcacaaacaagtgcacatacacggtatggccagtaaccctaaccggtgataaaaagccgcagttatcaacaacaggtttcgagttggcttcaggagcatcaaactctgtggacattccatctccatatagtcgggtgcgttctgggctcaaaccaaatgctccaacaacaacggaaggttcaactgcgccactgctgactgcgcctccggtcaagtcgcatgcaatggtgcccgttcaatcccgccggcaacctagacagaaattaccgttgcaaaaaacggaggacaagatttctatgaggtga

SEQ ID NO: 35091 - DNA, 732 bp, Glycine max
  Peptide Sequence Number=SeqID_151869
atgagagctggaatgtttcagaaatgtgaaatcatctttaaagttgtgttatctaagacgattttcaccaaaatcctcttaaatttgagtgtctttacgacggttttagtggctcaaggagccaaggttactttcacaaacaaatacatatacatgttatggccagtaacccaaaccggtgatcaaaagccgcaattatcaacaacaggtttcgagctgagttggctccaggagcatcaaactctgtacgtggaccttccatcaccatggtcgagtgcgtttcgggctcgaactgaatgctccaacaacaacggaaggttcaactgcgccactgtcgactgcacctccgatcaagtcgcatgcaatggtgctggttcaatcctgccggcaaccaaggcagaaattaccgttgcagaaaacagaggacaagatttctacgacgtgagcaacgtggacgacttcaacatacccatgtccttaaccgcacaaggtggaagtggcgattacaaaaccttaggttgtcttaggaacatcaaccatgtgtgtccttcgcagctacaacaaccagggcctagtggcaatgtcatcgcttgcaagagtgcttgtgtggctttcaatgcagatcgatattgtcacttaggagattacttaggagatcgatattgttttggggttttgtttatgccagccccttttcggctagtcttcaatattaaacctttcaaagagtaa

SEQ ID NO: 35092 - DNA, 222 bp, Glycine max
  Peptide Sequence Number=SeqID_151870
atgactcttattaattacaagactccagatgagacaagaatagaaattttgttggacttgaggcgcacgatgaaggacacgagaggtgaatgggatgaccgagtctttgatgccaagacgaaaggagaggaaacaccatcaatagtaattaattatgatcaggggccagtgcaccttcatcggaatgaggtggataaccagtactccttgtatttctcttga

SEQ ID NO: 35093 - DNA, 589 bp, Glycine max
  Peptide Sequence Number=SeqID_151871
tgttggaagagcattgcatgtcacaccgatacacctctggaacaaaaacaacggagaactcgctgacttcagctctggcttctcctttgtcgtgaaccctaagggttcaacccttcgtggtgatggctttgccttctttcttgcaccagccaaccttaacttccccaaaaattcaagtggagggtatcttggacttttcaacccggaaactgcactggacccttccaaaaaccaaatagtggctattgagtttgatagtttcaccaatgattgggaccccaattcaccaaaccagtctcctcatgttggaattgatgttgactctattaagtcagtggcaactgtgccatggcctagtgaacttgaacctgataacgctgtagcacatgcgagcctgaactataactccgagtccaagagcttgagtgtgtttgtgggttaccctgacaataggaatgccactgtctctactattgttgatttgaggaatgttttgcccgaatggatcagagttggtttctctgcctccactggtgacttggttgaaacacatgacattcttaactggtctttcgaagcagccttgtag

SEQ ID NO: 35094 - DNA, 3078 bp, Glycine max
  Peptide Sequence Number=SeqID_151872
atggtgacaaccaatgatgaaggcgtaatagtagattggtggtatttggacacaggttgttctaaccatctaactgggaataggcagtggttgattaactatgattccagcaaagaaagtagaatcaggtgtgctgatgatgagtacttggttgctgaaggaatgggagatgtgctggtaaaattgaaggatggtggaactgtcttgattgaaaatgtgtggtatgtgcctggcatgaagagtaatttgatgagtgtaggccaattattggagaaaggttactcagtaactatgagagatgcagtgctgcagctgtttgataattctgataaactggttttgaagtcaaaactgagcaggaacaggacttttaaatgcaatgtaaaagattctggtgtgaaagtattgagtacagtgactgaatcacagagctggctatggcataggagatttggacacttgaatttcaagagtctaactcagttgagtgagaaggagctagtgacaggtatgccaaagattggtgtgtgtgacaagacctgtgatgtgtgcttgaaaggcaagcaaaccagattgccatttgctgatcagtcacctatgagagcaagctctccactacatgcagtgagttctgacatttgtggtcctattgaagtgccaacacttggaggtaataaatactttattactttcattgatgagtttactagaatgatatggctgtatgtcatcaagcagaagagtgaagcattagaggtgttcaagaaattcaaagctgtggcagaaacacagagtggccagaaattaaaaatattgagaacagatggtggaggtgaatacacctcaaaagcatttgaggaattttgtgaagctcaaggtgttgtccatgaggtcactcccccatacacaccacaacacaatggacttgctgaaagaaggaataggaccttgcttgatatggcaaggagcatgttgaaacaaaagaacatgcctcatgagttttggggtgaagctgtaacaacatcagcttacattctcaataggtgtcctacaaagagcttgaagttgaaggtacctatggaggtatggagtggcaagaagccctcagtgagtcatctaagggtgtttggatctttgtgttacaatcatataccagacgttaagagaactaagttgcaagacaagagtgaagtcatggtattgattggataccactcaactggtggttacaagttgtacaatcccaagttgaagaagacgtgtattagtagagatctcttgatcaaagaagatgagtcatgggactgggagataggggaagtgaaattcaaggctgcaccagaaatcgatatatgcagtgacagtgagagtgatgatcacagtgctgcagaagtgaataatgatggtgtgaatggtgttgtagcacctaatgatgatgtgcctggtgatgtagtacacgatgtgcccgctactccagcagtgagaccacagaggcagaaacaattaccaaggagactgcaagattgtgaggtgctgccagatagtgctgtgactgacgaaggtgacttgattcacttcgctctcttagcagatgcagagccagtcaacttcactgaagcattgaagattagtgagtggagagcagcaatggaagatgagttgagatcaattgaaaggaaccatacttgggatcttgttcaattgcctaagaacaagaaaccaataagtgtaaaatgggtattcaagttgaaattggatcctgagggcagaattgtgaagcacaaggctaggcttgtggctagaggtttcttgcagaaacaaggagttgattatacagagatctttgcaccagttgcaaggcacgaaactgtgagagtgattgtctctctagcaagcaataaggggtggagtttgacacatcttgatgtaaaatctgcatttttgaatggggcactagaagaaactgtgtttgtgactcaacctcctggctttgagttagaaggcaaggaggaaatggtatacaagttgaacaaggcgctctatgggctcaaacaagcaccaagagcatggaataggagaattgatgcatatcttgctcaacttggcttcaaaaggtgtgtggtagaacatggagtttatgtcatgttgaaggaggataacaaggtgttaatggtgtgcctatacgttgatgatttactagtgactgggaaattgtcatatttccttgggttagaattcttgtggactgaatatgggattgtcatgcatcaaaggaaatatgctggtgaaattctgaagagatttgggatggaggattgcaatgttgcaatcacaccggcagaaacaaaccagaagcttgaagacaagcctgaggaagaaggtgttgatccaactggttacaaacagttggtaggctcactgagatacctctgcaatagcagaccagatatctgttatgccgtaggcgtgctgagtaaattcatgaataggccaaagaaatctcatttcttggctgccaagagggttctaaggtatgtgaagggaactatgcagtatggtgtgatgtttccaagtagtgttgatggtgctgagatgaaattgattggttactcagatgcggattggtgtggggacaggacagataggagaagcacatctggttacttgttcaaatttggtgaagctgctgtgtcttggagctcaaagaaacaaccagttactgctctctcaagctgtgaggcagagtatatatctggttcctttgctgcttgtcaagcaatttggttgaaatcactgcttgatgagttgaaatgtgaagtacagatgccactgtcattactgatagataataaatcagcaattagtcttgctaaaaacccagtctcacatgggcgtagcaagcacatcgaaacaaggtttcatttcatcagagaacaagtgaataatggagttctgaaattgatttactgtcccactgaagatcagttagcagacctgctaaccaaggctgttaaaccagacagattcataaagctaagggaagagattggagtcatttgttttgaagatttgaattaa

SEQ ID NO: 35095 - DNA, 925 bp, Glycine max
  Peptide Sequence Number=SeqID_151873
atggccaaccatgcagctcaaaaccctttatctgttttccttacgaccttcctcttgctaatcaccagcgccaaatcagacttattttcctttaacataccacgttttgagccaggtgctttaaacatactactcgatggtagtgccaagacaacaggtggagtgctacaactcaccaaaaaggacaaaagcggcaacccaacccaacacagcgttggcctctctgcattctatgcagcacttcatctctccgacgcaaaaaccgggagagtcgcaaacttcgccaccgagttctccttcgtcgtgaacacaaagggtgcaccactccacggcgacggcttcaccttctatcttgcatcactcgactttgatttcccagacaactcaagtggtggcttcttcggactcttcaacaaaaaaacagccttcaacacttctttaaaccaagttgttgctgttgagtttgatagttttgcaaacgaatgggaccctaactttccacagtctgattctcctcacataggaattgacatcaattccattaggtccgtggcaactgcgccatggccacttgatattcaaccacaagggtcaataggaaaggcacgcataagctatcaatcttcctccaaaatattgagtgtctccgtggcttatccaaatagtcctgtgaatctgaatgccactgttttatcgtatcctgttaacttaggggctgttctgcctgaatgggtcctattcggtttcactgcttctaccggtgtggcagtgtatgcttttgaaggaattggaatggttttacctttggaaactaaggtgaaggataagcagaggttcggtgatggagagacggttctacgggtcaaggtattgcttgtggccgaggtgggtgatggagttggtcataagcttggtggcgcttttg

SEQ ID NO: 35096 - DNA, 132 bp, Glycine max
  Peptide Sequence Number=SeqID_151874
atgacaacaggtgattcaacccaacagaagacaagtcaaggaaatgagaaaaagaaagaagatgaaaatataactcacgtggtagctgaattctatgcattcaagcgatatttatctcttttacaaacatag

SEQ ID NO: 35097 - DNA, 653 bp, Glycine max
  Peptide Sequence Number=SeqID_151875
gaaatggctccaaagaaactctacacgaagaggtctagaagagacaccatacgagaaggatccaatgccgcctcagagtttgatagtcatcgttttcagagtgtcgagcaccagcagcgcttcggggccatcaggggatggtcattccatagggagaggcgtgtccagctcagggaggatgagtatacagacttccaggaggagatagctctcagacgttggacaccgctagtgacttccatggccaagttcgaccctgagatagtcctagagttctatgctaatgcctggcccacggaggagggggaaggccaacagtgtgagttcagccagaggaggagcagggccgacggtttcgatgaggaagccatcgcccagttgttgtgcataccgggcaatgtcttgcctagcgatcacaactccgacctccctctacctaagtgccaattggtgtatgccatcctgacacggatgagcgcccatgtggcccaggtgattgctggtgcactttatttgtttgcaggtatggcacctactaggcaccctctggacccagatatgtccaacaaggccctggggggtgtgcaaatagcaatcaggctcacttgggccttccaggatgttccaacagaaggtggtgccttctggtggaa

SEQ ID NO: 35098 - DNA, 351 bp, Glycine max
  Peptide Sequence Number=SeqID_151876
atgtgtccacccaaaggagtggtgtggaattcgtccaatagagcagtggttaaaagattatctaatggtagccaaatcttccccaaaaagaaaatgaggtctctgttaatggtaaagcttggcgcaaatgatttgagacataagttctttcaggcttctatgatcggtgatgataatgaaaggatgtcccagaaggagggagaggtcctgacaaactcctcagagtctaggcttggaggtaaatacactcagtttgagtgctcctttaatcttgtgatgatcccacatggttggagcattcttgcaaaatatagtgaccctgactggtctccctatgatttcacttggtga

SEQ ID NO: 35099 - DNA, 210 bp, Glycine max
  Peptide Sequence Number=SeqID_151877
atgttgaccaccgatctctctgccctaggtagtctagtggccaaggatcatagccatgtggctttgcatgtccgcttcaaggtagatggagatgctgatgctattgcaggaggaggaggtggaggaggagaaggaggaggaggaggcgaggcagcttcttcttccccgacgacgttaggagtcatttgtatggacaaaggactaacataa

SEQ ID NO: 35100 - DNA, 1127 bp, Glycine max
  Peptide Sequence Number=SeqID_151878
ttatgtacgaacacttgatcataaatgggataaaaagggactatgttatatgggagcatcatggagaagtgattagtgagcctgatgaatttgatgatgatgatgatgatgatcaaaataattgcaatgatggggttcgtgatatgttacatgatcttggaagtgctatgaatattgagaacatcacaggaactgaggaaataaattatacaactggcacggacactaatagtgtgaacgaagaagaagataagttttctaaactattttttattgccgaacaagaactatatcctgcatttccacaaggaaataaagttcatgtgtcttactatgaggctcgaaaatttattcgtgaacttgggctagattatgttaagatagatgcttgcttgaatgattgcatcctttaccgagctgattcaattacttggaaaactcttgactcaaaatatccatcttttgcggcggatccacttccttataacttgccgccttggatgtgcatgaaagatccttttttcatgatgtcacttcttattccaagtcctacggctcctggaaatgatattgatgtgtatttacaacctttaattgaagagctgaaggaattatgggagaaaggtgtagtgacatatgatgcatctaccaaagaaacgtttaggttatatgcatcaattttatggactattaatgattttccggcatatggaaatctatcaggatggagcactaaagggcgatatgcttgtccttgttgtaacatggatacatggtcttcatggttactaaatggaggaaaattttcttatatgggaagtcgtcgatttttgccacatgatcattcttggagaaataatgcaaaagcatttgatggtaagaaagaaaaacaatctgcccctaaaccattgttcgaggatgatataattgaacaatatcaacattttgaccaggcaaggattgctgggccagtgcaataccgttggatgtatcctattgaaagatacctacgaaggcttaaatcgtatgtcaaaaacaaggcccgtccagaaggatctattgatatattgcacaagaatgtttgcatttctgttctaggtacttacatggagttgagacaagattga

SEQ ID NO: 35101 - DNA, 609 bp, Glycine max
  Peptide Sequence Number=SeqID_151879
atggagtgtctaaaatatgtaagaaaaaagaaaaagaaaaaaagaagaagcgtataccaaaaagaacaaggaacaaaacgtgatcccgattcttgttttgattgttgcgggattaagcttcaacctcaaactaatcttgacgaagccagaacattgcacgctcttcttctcgttttgggtttctttcaacccacgtgtcctcatacatcatcctttgcttcacagcttgtcaatgtcttcgtcaactttggttccctccaacacgcgtttctcacgttccgtgcactgcttcacaagcccaacattgcttggaacgcaatactcagaggcctggttggtgttggtcacttcaccaaagccattcacttttctcactctatgctccaacatgaggtcacacctgataactacacataccctcttgtcctcaaggcatgttcttccttgtgtgtgcttgagttaggaagatgggttcatgacaccatgttgtacaatgagttgcattgtaaaacaaaggctaatgtttatgttaagtgtgttgtgattggcatgtttgctaagtgtggaagccttgagcgtgataccctctacctcgacatatatatataa

SEQ ID NO: 35102 - DNA, 828 bp, Glycine max
  Peptide Sequence Number=SeqID_151880
atgaccttgaattattaccgtaaaggtgtcatgcatgaccaggtgctgccacctgacgaactggcttttgccagtgagctggaagcggcgattgcacaccaggagttttatctggattatcagccgcaaatcgatttcatgactggcaaactggtcggcgtagaagcgctgattcgctggcggcatccgcaacttggcgtggtgcctccggccaagtttattggtgtcgctgaattgacaggcctgattgtgcccatgggagcctgggtgctaaaagcagcttgccagcaagtcgccgcatggaaaacaggggctttgagcaaagtcaaagtgtcggtcaatgtgtcgcctttgcaactgcggacaccaggctttaatgattttgtattgcaggtattgcgtgaaaccggcttgtctccggagcgactggtcattgaactgaccgagagtgcgtttgtacattcagactgtacaggaattgaaagtttacaggccctcaaacagcttggggtcaaactggcaattgatgatttcgggaccggttactcatgcctggcttacttacgcgatatccctggtgattatctgaaagtagaccgctcttttgtgaatgatgtgccgggcaaagagcgctcggaagccgtgaccagtgcgatcgtggtactaggtaaaaacctgcattaccagattgtggcagagggcgtggagacacaggcacaagcagattatctcaaaagcctgggatgtgatctcgcacaaggatatttatacgccaagcccatgtctgaacaagcgttacaacactgggttgatgagaggcactcttaa

SEQ ID NO: 35103 - DNA, 129 bp, Glycine max
  Peptide Sequence Number=SeqID_151881
atggcgttcaatgcgagggtgatcagtaacggcgtaagctgggggtcatgcccaaacagcacacccaggccacctagtgcaatcgcacacaaaaacagcgctgcaacaatccagcgtaaatgctggccg

SEQ ID NO: 35104 - DNA, 384 bp, Glycine max
  Peptide Sequence Number=SeqID_151882
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 35105 - DNA, 474 bp, Glycine max
  Peptide Sequence Number=SeqID_151883
atgacggatgcgtgccgtcgggaatcaacaactttgtgtgagttgagtgagacgttcgaattgaacaacttttgtttcgctcctgaggatttgaaaagagtttatctgttaatgatatgggctattgagttggggaggattgattttggaacttgtcgtggtgcagaagttagttcaagtgcgaacactactagaaaaagagctttttgcgatgcacttacgacatcggtccaacgaaaccatagaagtaggcctactatgagtgggaaccttcaaaagaggaagatccaattagctaaagatgtatattcatgcccattttgtggaagagaagaggaatccaatagtcatttgcttcttacatgttatgctacggatcgcttaaggaaatggttctactcatggctagatatacggatagtgttgtcgcaagccatacataaccacttttggcaacattcttcattggtgtag

SEQ ID NO: 35106 - DNA, 396 bp, Glycine max
  Peptide Sequence Number=SeqID_151884
atgacattgtcagggcaaaactcaaaaacttcgacatccttaccttcaggaacacttgaaaggtggcaacgccactcaaaaaggcacgacttcggctacatggcggtggtgggagcagcaggtccacttcggcttcaagtacttcacggcgggaaacaaaacgtcagggtggtagcgggatggagttcacggcgggatgaagtagttcaggcaatagcgggggcgctaggtttttggagggtacgagagagggtgtttaccgtgagactatataaactacaaaatttacgacggtgtttaatgacatcgactttgtatgtgactatttctaggacggtgtacctacaagcaccgtcttttatgacttccatcaaaactacaacgacggggttatag

SEQ ID NO: 35107 - DNA, 1008 bp, Glycine max
  Peptide Sequence Number=SeqID_151885
atgaaggtcattgtcatctttgagcactctgaaggcgaggactttaagacttctaaggtgtttgagccctccaaagtcgaggaatttgagtcctctgagggcaaggactttgggccctctaaaggcgagaactttgagtcatgtgatggcgatgactttgagccctctgaagatgaggactttgagttctctgaaggcaagaacattgactcctctgatggaaaaaactttgagcccaataaagacgaggactttgagtcttgcgaggaatttgagctctctgaaggcgaggactttgagtcctctaaggcgagaactttgagtcctttgatggcgagggcttcgagtcctctgatggcgatgactttgaaccctaaaggcgaggaatttgagtcctctgaaggcgagaactttgagtcctctgatggcgaggactttgagccctttaaaggcgagaactttgagtcatctgatggcgaggactttgagctctctaaaggcggggactttgagtcccatgatggccaggacattgagccctctaaaggcgaggacttcgagtcctctacaggtgagaactttgagacctttgatggcgaggaatttgagccttctaaaggcgaggactttgagccctctgaaggcgaggactttgagccctctgaaggcgaggactttgagtcttctaaggtgtttgagcactctaaaggcgaggaatttgagtcctctgagggcaaggactttgggccctgtaaaggagaaaactttgagtcatgtgatggcgatgactttgagccctctaaagatgaggactttgagttctctaaaggcaagacctttgagtcctttgatggcgaagactttgagtcttgcaaggcgaggactttgagtcctctaaaggagagaaatttgtgtcctctgatggcaaggactttgagcgctctaaaggcgaggactttgagctctctgaaggcgaggacgttgagtcctctaaggcgagaactttga

SEQ ID NO: 35108 - DNA, 171 bp, Glycine max
  Peptide Sequence Number=SeqID_151886
atgcatgatgcgatcaaggagcaagccagaggactatcagtaacaatgcatcaccaaaagaggaaaactctagatgacgcttcactgttatcaagcgagttagagacccaacatgaccacaggtcgacctccattccttatggcttacatagacccgggtatagggcctaa

SEQ ID NO: 35109 - DNA, 748 bp, Glycine max
  Peptide Sequence Number=SeqID_151887
agggctacacgtcctcgcctccagaggattagacgtcctcgccttaagagggctgcatgtcctcgccttcagagggctacgcgccctcaccttcaaagggctgcatgtcctcgccttcagagggctacgcgccctcgccttcaaagggctacacgtcctcgcttttagaggactacatgccctcaccttcagaggtctacaccccctcgcctttagaggactacacgtcttccccttcagaggactacacgtcctcgccttcagaggattacacgccttcgccttcagaggaccgcacgccctcgccgtcagaggactacacgtcctcgccttcagaggactgcacgtcctcaccttcagagggctacacgttctcgcctttagaggattacacgccctcgccttcataggattgcacgccctcgccatcataagactacacgtcctccccttcagaggactacacgtcctcgccttcagaggactacacgtcctcgccatcatacgactacacgtcctccccttcagaggactacacgtcctcaccttcattgggctacacgctctcaccttcagaggactacacatccttacctttagagggctacacgccctcgtcttcagagggttacatgtcctcactttcagagggttgcacgtcctcgccttcggagggctgcacgccctcgcctttagagggttacgcgtcctcacttttagtgggctccatatccacaccttaagataa

SEQ ID NO: 35110 - DNA, 135 bp, Glycine max
  Peptide Sequence Number=SeqID_151888
caagggacggaaagaagtagatcagtaggaatactagggcctgctttagagctagccacaccaagcctagttctcttgcccgcttcgcttgtcgggcttaaagcggaactgagcttctcactaagagaatcgtaa

SEQ ID NO: 35111 - DNA, 486 bp, Glycine max
  Peptide Sequence Number=SeqID_151889
atgtctccttatcgggttgtctttggcaagacatgtcatcttcctgtagagatagagcacaaagcctactgggctgtaaagacctgcaacttctctatggatcaggctggagaggaaaggaagttgcaactaagtgagctagatgagatccgtttagaagcatatgagaattccaaattctacaaggataagaccaagaagttccatgatagtttgatagctaagaaggacttcgtggttggacagaaagttttattgtataactctaggctcggactcatgagtgttgagatcaaaagtgaatccacagataagagcttcaaggtcaatggacaccggttgaaatcattcctcacaaatccttgcttagtggatgtagtggtggaggagacctccttacttcatcctacttctcttctgccacgacttaggaagttttctttttctgtctcctttaattttattgcacttgttcaaatttattga

SEQ ID NO: 35112 - DNA, 318 bp, Glycine max
  Peptide Sequence Number=SeqID_151890
atgccactcaaaggagttggacatctcatagccatacttgcttcctctacaagctacaccaagcctacatatgcctcagtgtactcgacatcttcagtacctggaagacaacataacaactatgattacaaccaagagagtgccttggataagaagtttagagaggaagttttaatggaggaagagaatgcgagagggaagggagggcacatgggaagcttcattgagaagctaaagggtagcttccatggaaagctagaggaagaaaacttccttgagaagttagagaggggctactcacacccctccaatagctaa

SEQ ID NO: 35113 - DNA, 309 bp, Glycine max
  Peptide Sequence Number=SeqID_151891
atgtctcttgctacattatttggaaagttacaagaacacaaaatggaactgttgagattaaatcaacacgaagaaaatgataagaaaaagaagggaatttctcttaaagcttcatcttcaatccaagaagaaagggataaggaagatgatttgaatgaagatgatgatcttagcctttttgttaaaaggttcaacaagtttctgagaatcagaggaaatcaaaggagaccaaactttaaacctaaagaaggacagaagattcatcctctactccaaaatgctttgaatgcaatcaacctagacatctga

SEQ ID NO: 35114 - DNA, 212 bp, Glycine max
  Peptide Sequence Number=SeqID_151892
atggtctttccattgagtttcctggaccctagctcacccatgctagcctctagctcgcttgggcctccaaatgacttcatggtgaaggaaccagctcgcttgggagagccagttacttcaggagtgtcgcaacttaccctccggcgggagggcgacgcgaggctcacgggtgcatcttccaaggaaggaaaacgcacggagtcgtcaccaac

SEQ ID NO: 35115 - DNA, 738 bp, Glycine max
  Peptide Sequence Number=SeqID_151893
atggctctcgctgaatggtcatacaacacttccctgcattccagcatgggagtaaccccctacgagtttacttatggcaagcctcctccctctattccccactatatccttgggacctctactaatgaagtcgtggactccttactttccacaagggaggccattcactcatccctcaaaagttgtctcctcaaagcccaggccgccataaagaagcacgtagatgcgaagcgacgggatgaagaatatgagacctctgtcgctagtgccaatcaccataagctcgccaaatgcttctatggtccctttgtgatacttgagcacattaggagcatggcttatcgtctccagatgtcggagaattcgaaaatccacctgcctgtgttggaacccctctctattttatcttccaaagtcgattcctctaccgacccttcgacacgcttggtgctggttcaatggctcggtttacccctggaagagacgtcctgggagaactgggatgagattcgtgacatttatcaccctggatggggaggggtggcgactgtggtgacgaagctgtttaatatagtggagccgggtgtggatgtgttcgggaagaaggattatcagcagtggcgccttattcagaggatggtagaagagagtgcaatgaggaatgcttatctgattatcaatcaacagctatttaattactctgtattcactttcacaatgcttatcttgtctaattga

SEQ ID NO: 35116 - DNA, 702 bp, Glycine max
  Peptide Sequence Number=SeqID_151894
atgagaaggaagaaggggcagacaatccttattcctatgtttgcacatggtaaaaaggaattgacttgtggaagttttagtcaagaagaggcaataagggtacttgtatgtgcgattatcatgcatgaatatccactttcaataatggaccatgttgggtttaggagacttttggatttacttcaaccattgtttgaagttccttcgtggaacactttgaagaaagagatattcaatgtctatcaagatgaagaacaaatggtcatgaagatgttagatacaaaggaaggaagagtggcaattacattagatatatggatagaaagaaacaaaaaaaaagctgatagactttacattgctttagttaactatttgtgggattggaatattgatgccaaattgtccaccattaccctagataattgtagtacaattatttgcatgattgataagattaaggataagctgcagttaaacactttaatcaaggaagggtctttgcttcatatgcattgttgtgtgcatatcctaaatttgatagtgaaaaaggggttcggagttttgaaagatgaggtggaaaatattctagataatatagcacattataccgcaacacctaagaaggtggaaaattttgaggagactgctaagcaattgcgaactccttacacaaaaaagttatgtttagattgtccaacatga

SEQ ID NO: 35117 - DNA, 294 bp, Glycine max
  Peptide Sequence Number=SeqID_151895
atgtcgtcttacagtcctttcgctaagcgtcagcttcacgctaagcacatctttggtcatgcgctaagccgaaagtctcaagcgcttagtgtccaacccttgcatctgaggctgattgggtccgctaagctggccaaggttgagctaagccgaaagtctcaagcgcttagtgtccaacccttgcatctgaggctgattgggtccgctaagctggccaaggttgagctaagccgaaagtctcaagcgcttagtgcccaacccttgcatgtccttcatgctttacatgcctcatga

SEQ ID NO: 35118 - DNA, 462 bp, Glycine max
  Peptide Sequence Number=SeqID_151896
atgtacaaagataagtggacccaaccttggcccatgggctcagaaatctaccctgaggttcatgagaaccctagggccttcttcaacagctctagcctaatcctcttggagcctcttgctcatggctctggtgactggtcccttcttagggaggattgcatcacaactcaaaaaacatatatcactgacaagggggaagatggatcctccttgacagatgtgtcctcctcaaaaccttcttcttcgtccttagacacaagatccatcaaatctaccatggatggtgccacccttcaagaacctgccccagtcaaggacatgcaacaaggcctagatggtggtacacaaggcttaggaaacactgattgtggagaaatcgaaacatggagggtagcctcagaatcattagatgaagaatcaaatatggttgaagacatctcatcatccacgggtagtgaatga

SEQ ID NO: 35119 - DNA, 3747 bp, Glycine max
  Peptide Sequence Number=SeqID_151897
atggaaggtcgcgttgcatcattggagaatgagatttcgaagctcaaggcttccgttgaggtgttgcgaagtcagtcggagaaacagaacaccaaacaagacactattgctgcgaatcaagagaaattgatggatctgttcaccaaaagttttgggaaggataacccagaagatggcgagagttctgtgggaaaaaactcacgcggaaagggggccaagggagacgcagagaagtccaatttcagaacgataacattagatggggacgcattgaacgagtttcgtcagtcaatgaagaagattgaattaccaaccttcatcggtgaggatccagccggttggatttctcgtgcagaaatctatttccaagtccagaataccagcgaagctttgaaggtaagccttgctcagatttgtatggaagggggtaccatccacttctttaattcattgttgaacgattatgaagatttgacttgggaggatctgaagagggagttgatggagaggtatggtggaatcgaggaagggacggtgtttgagcaattgacgtcattacgccaaactgggacggtggaagaatacattcgacgcttcgagagctttgttgctcaagtaccaaggttgatggaggggcagtattttgcttactttacgaatggtctgagagaagacattcgtgctcgtctgaggagtctgaacatggcagcgccgttatcgcgtgggtgcctcatgaatacgacgcaagcgcttgaggcagaattagcgcatgggtcgcgtggatggcaaacgcgtgttgacactcgaggaggaggaggtttcggatttgtgccgaaatcccagcatagtggatcaaacacgggccatggaggattgaaaggcctcgtgataggggagtgccccgttaagcaactcaagcttattctggtgaatgaggaaatccaagtggaatgtgaggaagaggagactccaaacgacgagggaagtgatgaagattatgtcgttttggaagggaaatgcagtgtgttgaccttgcgaggcttggacaccgacaatcgagatttccccagtacgatgaagattagagggaccgttggtggtattccgaatacaaagaagatgaggattttaatgggcgatggtcacaaggctgacacctgtggaatttgtcgaaacatttgtgtggagatagaagctggtaatgttctgatcgatgctgtcctgttcgagttgggagacattgatattgttttaggaatgtcttggttgcactcactgggggagatgacaattgattggtccaaaaagatcatgaaattcaaagaaggtgggatgtcaaagatgttgaaagggattgcgggtgaggaaccattgttggcatcacttgagggaattctgaatgaagaaaagggacatagggatggtgagttgaaccagcagaagcgactagagttggaggagattttgaaggaatttgatgatgtattccaggaacctagaggtatttccccagaaagggtgaaggcgcattcaattactcttaagccaggagaagcaccggtgaatgtacgaccctataggtacccgtatcaccaaaaaaatgaaatcgaaaggcaagttaaggagttgctggaaaatgggtggataaggcatagtcaaagtgagtattcaagccctgtcatcttggtgaaaaagaagagtaaccaatggaggatgtgcgtcaactatcgtgctttaaacaaggcaacagtaccagataaatttccgattccggttattgaggaattgttggatgaactgcatggggcaaaatatttctccaagttggacctccgatcaggttatcaccaagtgagaatgaaagtggaggacatcccaaaaacagcatttggaacacatgaggggcattgcgagtatcttgtcatgccatttggtttgatgaatgctcctgcgacattccaatcccttatgaatgaagtgtttagggacttactgaggcgtggggtattggttttcttcgatgatatcttggtgtatcatgaggaatgggaggagcacatagaggggttaagagctgttctgggaattttgaggcagcattgcctgtatgccaataaggagaagtgtagctttggccaaatgagcgtagggtatttggggcatatcatcacacaacaaggagtggaagtggatccaaacaaggtcaagagcattgtggagtggcttgtacccaaaaatgtgaagggggttcgaggatttttgggaattacgggttactaccgtaaattcattaaagattatgggaaggaacgtaggcctatagcttactttagtaaagctttaggaagcaaaaacttagctaagtccgcttatgaaaaagaattgatggcagtggcattagcaatacaacactggcggccgtatctgttaggaagaaaaacttaccggagattagccttgaatgtattttggattggcatgaggagggatgtgatgaaatttgtacaaaattgtgatatatgccaacgacaaaaatacctcaccactgctcctgggggtttactacagccacttccagttcctgcacaaatatgggaagatatttcccttgattttattactgggttacctcgttcaaaagggtatgaagctgtcctggtagttgtggataggctatccaagtatagccactttattccactgaagcatccttatacggcgaggacagtagttgaattgttcataagggaagtggtttgtttgcatggagttcctagttttgtaattagtgatagagatccactgttcatgagtgtgttctggaaggagttttttagactccaaggaactgtgttgaagatgagtacagcttatcatccgcaaacggatggtcaaaccgaagtaacaaatcggtgtttagagacttatctcagatgctttatcggtgacaagcctaggagttgggttcagtggttatcttgggctgaatattggtttaataccacctatcatgagtccattggtattacaccatttgaggcagtatatgggcaaaaaccaccagctctagtgagaagtgtgcctggagaaattcgagtggcagctgtgtttaaggatttacaggatcgtgatgagatccttagacagctgaaaatccatctggagagagccagggagagaatgaagcatcaggttggagatatggtctttctcaagctgaaaccatataggcaagcatcggtgaaaaaccggaccaatccaaagctatgtgctcgttattatgggccttatgaagtgtttgaaagaattggagaggtagcttatcgtctgaaattgccagcaacatcaagaattcatctggtattccatgtttcgttactgaagaaagcacatggagagtaccctgtggagactgaattattgcttgatttggaagaaggaactgtggcaatagctgaacctgaggctgtgctagaggtcagggaggtttctaaaggagggaagagggtaattcaatggttggtgagctggaaaggccaaccaagtgaagaggctacttgggaggatgaagtgctcatgagaagtcaatttccagaattgaagcttgaggacaagcagttgtttttaggaggaggtattgatagggatcaggggatcattgggcctaaggagccattggcaaatgagacattaaaaagcccaagggagtggattgtctacactcgtaggaagaagagggcaaattag

SEQ ID NO: 35120 - DNA, 459 bp, Glycine max
  Peptide Sequence Number=SeqID_151898
atgaaagactttctggattacctcgactccctcaaaaattacgagaaatcaggagttcccaaaggtgccggcaccgattccagcgacggtttcgatcttggtagaatgagacgcctcatggagcgttttggtaaccctcactccaagttcaaggctgttcatattgctggaactaaggggaagggatcaacagctgcttttgtatctaatattctgaggaatgaaggctattctgttggttgttacaccagtccacatatcctgaccatccgggagcgcattttactgggaaaatccggccatccggtgtcagcgaaattgttgaatgatctctttcgtaggatcaagcccgatattgaccaggcaatgaaagaggaaaatggttgcataagccattttgaggtattgaatgttgaacctcatcaatgtttgaatgttgtcaagaaattgttgtggtaa

SEQ ID NO: 35121 - DNA, 777 bp, Glycine max
  Peptide Sequence Number=SeqID_151899
atggttactccccttgcctcgcttcctcctcctcctccttctcctcctccttctcctcttgcagtagcatcagagtctccgtctaccttgaagcggacatgtaaagccacacggctacaatccttggccactagatcacctggggcaaatagaccagtggtccacatcgatcctgcgaccgggaaggctgacggtccccacaagaagaaattaagaacatatttggggattgtcgctcgtgataaggtcaacgtcacatatgaaacgtggaagcaagcccttgctgctcagaaggatttgatatgggaggatattcaggctgaatttgatatccctgaagcatctgacggaaatgggcacttgcggttgacaatgacagtatggatgacactgttggcaaaaaatatggcattagcaaggagaaatgagcccaattttgtcagacccgcagagacccctcgttggagaacaaaagttgatgctgagaagacaaagaaaaaactggaggaagctgcttcatccagaagcactgaggctgtgattgaccctccatctcccattagacggcacataaattggaagatggcccgcacgaagaaaactaatcagatgacgtctgacgcagcaatggaaattgctgagaagattgcatcacaggattcctttgtcccccatggacgtcaagatgtcctgactgctgccattgggcgaccggaataccctggtcatgtgcatgttgctggagccggtgtgaccatcaagcaatacttcgaataa

SEQ ID NO: 35122 - DNA, 1185 bp, Glycine max
  Peptide Sequence Number=SeqID_151900
ggtttgcgatataaagttatggcatgttttcctgataagattaagttgatagatggatcaagggaaactcttaagctttttgtaaggatcactgatctttggttcattgggatccctgaaaagtctaaacaagccgaaatggtggttgttgattctgatggagatgaaatccatgttgtttgcaaacaagatcagctaaagtcttggaaggatgattttaaggaaaatttgacttatgtgatgcataattttaaagttatgaagaatgatggaaaattcagaatttgtgatcatgaatataaattatcttttattggagttactgttgttaggcaatgtaatatggaacacttaccttttaggaaattcagatttgttgatttttccactgtcattgctggtcattttgaaactggactcttggtacttatggcttttcaaataacatgcgtttatcttgtggttgctttagatgtcattggcgtggttgatgaagtggttgaagatgaaagactcatcgttattcttttgacacatgccaggatcaaggaagcccagggatcatatccgctgtcagttagtaattctttcagggcgtctaaactcatgatcaacgagcttgtgctggaaatccaagaattcagagaaagccttttagatttagggattgaggaccgtgaatgtgcagagttaattggtcaatcggtggatgaagtcaacaggctcaaaatagaagatggcgatgttgatttaaatgcctctcctcaggcactagataggctattgggttgtttccttgcattcaaagttaaggtacaaccaaggttcaggaatgttgttgttcttaaatattcagatgaattagactttatcaatgttgtgttggatatgcttcccgatactgagaccgagagttcaatacttgactcgaccgaccctacagagcttgaatctcaatctgtgtctgttaccgtcgatgatgaccgttcaatgcttgactcggctgagcctacagagcttgaatctcaatctgtctctgttaccgccgatcatgaccctcttctcaggattccattgacaccaactaagcgtgtatcttctgatgatgatggacacaagaactttgagatttcacctgccgaagtttcctcaaataaattagcgaagctttgtcagcctgaatga

SEQ ID NO: 35123 - DNA, 579 bp, Glycine max
  Peptide Sequence Number=SeqID_151901
atgaacaacacatcttcaacaacatcaagtgaaatgaaaaatcccatgatcggaccgccattgatcatccaatttatggctaccttcaacaacgacaaaaacatcatacaacttccagcgttctaccatacacaatgggcactacagtatcccgagtttgctcatctgagatataatggagccatctacgaaatacgggtcagacgacacaaagaaaaagtctatttagtagatggactcaaaaacttcaggaaagacttgaaaatctacgagtcgaccaccttcaacttttttgcccatgaccatcactgcgtatttgacatacatttcataccaccactggagcggcaaacttgtggtaggcagaggcattcatccagaaagcatatatggactgttcgatttactcaggaaatgttggatgctcctgaatccctgaaattcccgcgttgtacagaagttcctcttaaagcttacggttaccacatgatagtcttaaggcgatctggtcctccattgcaatggaaagttgaaaccctgaatcctgctattggtggaaaaggcgttgttcaaccatga

SEQ ID NO: 35124 - DNA, 444 bp, Glycine max
  Peptide Sequence Number=SeqID_151902
gctattgaagtttccaaacgccaggcaaaagtaagagaaacaccaggaaattctgagaattctatgaagttggaagcagttgaaacaaagctgcaagacctgaagacaaacatggccatattgggaaaagaagtagctgccgcaatggttgttgtagaagcacaacaacagaggttaaccctccatcatcttatagctatggttgaagcaaagcgtgcctatcatcaaagagtactccaaatacttgatcagcttgaggaagagatttcagaagtccgagatgctcacaatctgaaaaaagaagccacgtacctcaatgaatgctcacaagacatgagggaagcagccacgtacctgaaactcgcggacgaggagacaccaaactcgaggacggcggtgacgagtcgcaaaatgcaatgtcgtggaggagggagacggcggtga

SEQ ID NO: 35125 - DNA, 4398 bp, Glycine max
  Peptide Sequence Number=SeqID_151903
atggcagagaatacccggatgaaagagctcagttccgacatcaagcgcaacgctgaatcaatcgaaaagatgtataacgatttccacgagaagatcgaccgattggaaatcgcgaacgcatctcgctttgaagcgatgcagacgaacacagaaagcaagttttctcagatcaacaacgcgcttgatatgctactgaatcagagtccccataaatcttcccatggtgtcggtaactcaagcaaacaaccatttcaggtgcgaaacattaaattggaatttccccgttttgatggcaaaaatgtgttagaatggatatttcgtgctgagcagttttttgattattatggtacgccggatccggatcggttaaccatcgcgtcggtgcacttagacaaagacgtagttccttggttccagatgatgcagcgttctcacccatttcattcttgggtggagttcacacgcgctttagaacttgattttggcccatcaatttatgagtgtcccagagcaacgttattcaaattaagtcaaactggaactgtggctgattattatctgcaatttacttcattagctaacaaagtttacggcttgagtaatgatgcattgattgattgtttcattagtggtttaattcctgagatcagacgggatgttatgattcacacgccaatttctatggtcaaagttgtgtcccttgctaaagtatatgaagagaagtatacctcaaccagtaaaccacataaatccacaccgtcaaattcatacaaccacagagcacccttcaattcaaataaaccagaaaatacccaaaaagcaaaccacactcctctccttcaaaccctgccaacaagacctatgaaccccaatcaaagaaacccaaacatcaaaagaatttccccagctgaaatgcaattgagaagagaaaaaggtttatgctactggtgtgatgaccaattttctctaacccacaaatgtccaaaccgtcaagtcatgatgctgcaatttgacgacagtgaaaaacacattgaacctgaaccagaaaaagcccagctagatatgacctgtaatgaacctgacccaaccacaaatgaccaccacttatctttgaatgcaatgaaagggaccaatagcatgggtattttgcgattcacgggccagattggacaaatcagtgtgcaagtattaattgatggaggaagttcagacaatttcttacaacctagaattgctgaatttcttaaattaccagttgaaccaggaccatgtttcaaagtgttggtgggtaatgtccaaactatgactgctgagggagttgttcctaacttgtctatcacactacaaggccatgaattgatagtaccagtcttcttactacctgtggcaggagcagatattattttgggctcatcttggctggctactctaggcccacatgttgcagattatgcagctttgacattaaaatttctctacaaaggcaaatttgtgacattacaaggagagaggggaacatcgcctaaactggctcagtttaatcattgtagacgaatgcaaaacactgatgctattgctgaaacttttgcagttcaactacttcaatttcacacagaagaggatattttgaaagaactgccacaagatatagcccctgagattgccctgttgttacacacatacagttcagtgtttcaaactccaacagctctaccaccccctcgaagtcagaatcatgctatcccactgatggaaggtattatacaacctagtactagtcctttttcctctccaattttacttgtgaaaaagaaagatggtagttggaggttttgcactgattatagggccttaaatgccgtgaccataaaggatagttttcctatgccaattgtagacgaactattagatgagctatttggtgcaaagtttttttcaaaactggacttaaggttaggatatcatcagattctggtgcaaccagaggataggcataaaacagcttttagaacacatcatggccactatgaatggttagtcatgccttttggattaacaaatgctcctgcaacttttcagaatttgatgaatcagatctttcatgatgctttgagaaaatatgtgctagttttttttgatgatatactcatatatagctctacttggaatgaacacttgacacacttagaaaatgtgttaagagtcattcaacaacatgtattgtttgtgaagctatcgaagtgttcatttggagtattggaaattgaatacttgggtcacatagtttcgggccaaggagtatctatggataatagcaaggttcaggcaatccttcaatggccaccaccaaataacgtgaaacaattgagagggtttttgggtctcacaggctactatagacgttttatcaaagcatatgccagaattgctgctcctttaactgaattacttaagaaagatggctatttatggactgatgaaactgaaatagcattcctaagacttaaggaagctatgatgtcagcacctgttcttgggttacctaatttccaacagccatttatcttagaaactgatgcatcaggagttggtataggtgcagtgttgcatcaaaatggccacccgattgcgtatttttccaagaaacttgcaccacgcacacaaaagaagtcagcttattttagagagatgttggccatagctgaagcaattgcaaagttcagacattatctactgggccatagatttgttatcagaactgatcaaaagagtttgcgaagtttgatggatcaaagcttgcaaacaccggaacaacaagaatggttgcataaatttttgggatatgatttcacaatagagtataagccgggaaaagacaatttggcagctgatgcactctctagagtaatgactttgtcatggtccgagcccgagaattcaattgttctaaagttgaaagaagcactgcagaaagatcccaagttacaagttatcatgcaacaatgtgttgagcaaccactattacacccaaattactcagtgaagggtgacttgttataccgaaaagacaaaattgtggtacctatggatgttgatcttagacagcacctcttacaagaatttcatagttcaccaattgggggacattctgggataacaagaactatggcacggatgacagaacaattctactggccagatatgaagcaggatgtgcaaaaatatgttcaatcttgtgcaatttgtcaacaagcaaaaactttgcatactaaacctgctggattgctacaaccattacctataccatcccaagtatgggaggacatatcaatggattttataacaagactacctaattcttatggtttcaatactataatggtagtagtagaccgtttgtcaaaatatggtcatttcatagcactcaagggggactacactagcaagtctgtagctgagttattcaagtatgtggaaatgtttctcaggtgtttcacttttaacaatccaaaggcttggtacaaggctttgagctgggcagaattttggtacaacacatcattccatactagtattggcatgacaccctttaaagcattatatgggagagatccacctgcattgattcgatacactccagaagcatcagatcccgtcactctgcaggaacagctgaccaacagggatagaattttgcagcaattgaaacaacatttggaaagagctcaagtttacatgaaaaatcaagctgacaagaagcgaattgatgtgtccttagaagtgggagatctggtcttagtaaagctccaaccttataggcaacactctgtcacattaagaagaaatcagaagctgggaatgagatattttggaccatttcctgttacggccaaaataggtaaggttgcttacaagttacaactgccagatgaagccaagatacatccagtttttcacatctctcaattgaagccattcaaaggagtgccacatgatcaatacatgccattgcccctcacaacgactgatacaagtccaataatagcaccagttgccattctgcaaaccagatccgtcaagcaaggctcctcctttataccacaggtgcttgttcaatgggaaaacactacaccagctgaagctacttgggagaatttcaatgagatgctagacagtttccctaatctcaaccttgaggacaaggttgtcataaatggggatggtattgcaatgaatgaaaatagggagatcacgttctctgccaagtcagctaagggggacccacatggaaacaaagggaatcatgcagttagcattgatccgggaatcatggtgcaaaagaaaggaatgaggaaacgtgtgactagctcaaggttgagggactacgtgcacacatga

SEQ ID NO: 35126 - DNA, 282 bp, Glycine max
  Peptide Sequence Number=SeqID_151904
atgggtgatgttgatttcaaacacaaccaagcttgtgcgtgcgagatggtaggggatcaggaaggaggtgttggcaaagaatttttccaagaagacgaagaagatataattgcaatgaatgaaaatagggagatcacgttctctgccaagtcagctaagggggacccacatggaaacaaagggaatcatgcagttagcattgatccgggaatcatggtgcaaaagaaaggaatgaggaaacgtgtgactagctcaaggttgagggactacgtgcacacatga

SEQ ID NO: 35127 - DNA, 465 bp, Glycine max
  Peptide Sequence Number=SeqID_151905
atgctcgatgccaccgatgcccccaatcttgggacaaggacaggttggagagacaaaaggaagagaaggaattcaccttcgagcatcttcgaggactgcaactacgtgtgcgacgtgctggatgggcacagggttgtgcttgacgagcgcaacatgtcgctgcacggggagtttctaaaggaggtgaaggagttggtcgacgaggaaggggtggcgctgccgagggtgttcatgaaagggagatgcgtgggtgggttggaggagttggtggagctgaacgagacggatcgacttgggaggatattaaatgcgacacgtgtggagagggggattgggaggcaaacgtgtggagggtgtggaggggctaggttcgttccttgcttcaactgtgctggaagttgcaagattgtatggagaggagatgaaagggtggtggcgaagggaggagggagaaagacaggctag

SEQ ID NO: 35128 - DNA, 402 bp, Glycine max
  Peptide Sequence Number=SeqID_151906
atggctgttggcatgggcacaaacttgccttcacttctctattggaatattttggatccttcgggcacctacagtggtggctcaagaatgctaggaagcactgcatttccgtgtctcactagtgggccatcatcgcttagaactgaggagtgcctagttgttgcatacattatactagctcttctcctgggtattgtggcttatgactatcagcgcgaagttatgtgttttgttgatttcactgctgatgagacttctgatttatgcactgcacaaaaagttggtgagcagcttgagagctaccataaggcttcatcacttactcctgctatccaattgggcactttgtgttgcaaacttgcaaccatgtcatttggtttcactgacacctttgacatttga

SEQ ID NO: 35129 - DNA, 480 bp, Glycine max
  Peptide Sequence Number=SeqID_151907
atggatgcgggcacggacaaggaaaaggacaaaggaaagaagaaagaggaaacaccatcctcaaacccaacaacattggtgttgaaggtggacatgcattgcaaaggatgtgcttccagaatcgccaaatgccttcgtggttttgaagagatagcgcaaggcgttgatgtttaccctggtgcacaacgaatgcttattcatcaggggaaggtgcttaaggatgccacaaccctggaggaaaataaagttgttgaggataattctgtggtgatcatgttaagcaagattatctatatggacacaagtggcacagaaattgctttaggaaccatctttgcgttattgtgtttctttcctcacctttccatagcagatgttatgtatcatcccgttggtctcttgacaaaggataaaataataatattttttagcactgtcaataatattttagaagtgatatttgcatcaaattcaatatga

SEQ ID NO: 35130 - DNA, 243 bp, Glycine max
  Peptide Sequence Number=SeqID_151908
atggtggttgctggcaggataaagcagctaacatcactgcttgcaaatcacaatgcttttgagttacttgctaaatatgggacaactcatctcattttcaatgacgatatacatgggactgcatctgttgttgtagctggagttgtagcagccctaaaactcattggtggtacattgcctgagcacacattcctcttccttggtgctggagaaggaagggaagcaaccaaaagtaatctctag

SEQ ID NO: 35131 - DNA, 240 bp, Glycine max
  Peptide Sequence Number=SeqID_151909
atgactcaacctccagggtttgagtcctttgataaatcccttctactggcttcgaggcagcataacctcctaagaaaagaagaaggcacaaagaagaaagacagcatcaagcaaggatattccctcatagtgtgtggtgcctttgctgatcaagctcaccattcttccttagacatagtcactgagatattgcttattgttattctcagaggaaattcaatgcttactagtattggttag

SEQ ID NO: 35132 - DNA, 336 bp, Glycine max
  Peptide Sequence Number=SeqID_151910
atgtcgcctgaagtatttattagtgcaggtgttccatgctgcaggttagtacaaaatgctggggaatttgttgtgacttttccaagagcctatcacacagggtttagtcatggttttaattgtggagaggcggcgaacattgcaacacctgagtggttgaggtttgctaaagatgctgctattcggagggcttcactaaattatcctcccatggtttcacatttccagttactttatgaccttgccttagctttgtgttctagaattcctgcgggcatcagtgctgaacctcgtagttctcgtcttaaagacaagaagaagggtgaaggagaaact

SEQ ID NO: 35133 - DNA, 858 bp, Glycine max
  Peptide Sequence Number=SeqID_151911
atgggtttaaaacccaataaaaaagaacaacacattcctggtcagtttcctggaccgaccggtctccggttacccgaaaaccgccatgtccgcttcagcctctcgccatccacaaacacagtgttttggagtggcctagcaccggctaccacgatctcgttcaagaaagactattacgcgttctacgataaggaatgttcgaggatcgctgagtacatgtacctggggagtgacacaatggcaaagaccattgagcttctacggtggtactggcgacctttctctttctctttctctctttcgatttcgcttaaaaatccgtcgaacttacccttttcatataaggcagtttttgtgactgacattgcggaaataagggaagatcatttcgaaattggagaggatgaagctatggctgtttactctccatattttctaaggagcatggtatcaagacctgattgtatggaaaacttgatgagggttataagaaatatcaaaccagttataatgatagtccttgaagtagaagcaaaccataactcgccctcttttgtgaacggcttcattgaagcattgttcttctactcagcatattttgattgccttgaaacctgcataaaacatgagattgagtgtagaatgacaatagaagcagtattatctgaagggataagagacattgttgctatggaaggaagggaaaggacagttagaaatgtgaagatagatttttggagaaggttctttgcaaggtacagaatggttgaaaccggggagaagagagaaagcggtgtaaaacaaaagaggcagagggaagtgaagaagactttggagtttgctgagaaatggaaataa

SEQ ID NO: 35134 - DNA, 279 bp, Glycine max
  Peptide Sequence Number=SeqID_151912
atggatcaggccaataaggagaatgatgagggaaaagagcttgaggaattgggaacatatgaagagggaaatgaaacaacacctacaaagtcaacccctcacatgtttcgcaaaactcttacaacctcagataccaacactcatggggggttctttgtccctcgcagagctgttgaagactgttttcctcgtttggattataagcagcaaagaccttctcaagagcttgttgccaaagatttgtatggtgtggagtggaaatttcgacatatttactga

SEQ ID NO: 35135 - DNA, 282 bp, Glycine max
  Peptide Sequence Number=SeqID_151913
atgcatgtttttgacataaaaggttatgttctttcttcgaagtcagtgttttacttggaacacaacctagcgctcattaaaaagaaggtggccagacatgccaacgaatcggcaataaaaggagctgtttggtggagaaaagactcagcacgtgagaaagagtttgatgtcaatgctcatacgactgagtcaccggaagaagtacgacaagcaaaagggtctgcaggggatagtgggttcccggtgaggcacaatttctgtgatatctctgttaggctctaa

SEQ ID NO: 35136 - DNA, 657 bp, Glycine max
  Peptide Sequence Number=SeqID_151914
atgcattcttcaaaaggttttgtttctgatgatctggcattcaacagaagtcatggaatcaagcaaggaaaaagtttctattttgtgaaagacaagtttactacattgtgtgaaaggaacatgatttcctcttttgatgtaaatggtaacataagcatttcaagttttaatccgcttcaaagagacactgaaagagaaacttgtcaaggagatgggttgtcagatcagagactgttttcatgtgtcacatgtggaatattatgcttttcctgtgttgctattgtacagcctagagaaccagcagctagatatcttatgtcagctgattgcagcttctttaatgattgggttgttggttctggagtatctaacaataaatttactattgcccgtgaagaagcaactattcctgagtcaaatatgtatacaggcaggtatcttccttgctatatcttgtgctcatcaggaaacatgcctatttatttgttcagtgtctgtctgtatgatttaggatggatgaaaaagaatgtccaagatggtatacatgatgttccttttcaatcttctcagctcttgcattattggcttcagcatatggaaattcttctgactctgaggaagatcagattgcggttgacagtcatgaatcaaatgtga

SEQ ID NO: 35137 - DNA, 330 bp, Glycine max
  Peptide Sequence Number=SeqID_151915
atggcacttgatggcaattcttctgtctctgagtctgagaatacagtgttaaatgaaccagggcttctacttcagctcttaagatatgggcagacacatttgtccctgggagtaggattcaaattgttaaagtttaaaccacagagggatcaagatcttgatcctcactatgaaactgtagaaagagtaatgctaggaagacaaagagaggctacagttaaaggaagtagactacccagtatgctaaagagagatcagcaatatgaaggattcggagctatttacatgacaagtgcatcaagcagcaagcaacaagcaacacccttgtaa

SEQ ID NO: 35138 - DNA, 1448 bp, Glycine max
  Peptide Sequence Number=SeqID_151916
gcagcgaacattgcaacacctgaatggttgaggtttgctaaagatgctgcaattcggagggcttcattaaattatcctcccatggtttcacacttccagttactttatgaccttgccttagctttgtgttctagaattcctgtgagcatcagtgctgaacctcgtagttctcgtcttaaagataagaagggtgaaggagagactgtaactaaagaactatttgtccaagatgtgttacagaacaatgatctgcttcatatacttgggaaaggatctgatgtagtacttcttcctcgtagctcagttgacatttctgtttgctcaaaattacgtgttggatcccaacaatccatcaatgtaagaaattctgagggaatgcattcctcaaaaggttttgtttcagatgatctggtattcaacaggagtccaggaatcaagcaagaaaaaagtttctattttgtgaaagacaagtttactacattgtgtgaaaggaacaggatttccacttttaatgtaaatggtaacataagcactgcaagctctaatccacttcaaagagacaatgatagagaaactagtcaaggagatggcccagagaaccagcagctagatatcttatgtcagctgattgcagcttctttaatgattgggttgttggttctggagtatctagcaataagcttactattgcccatgaagatgcaactattaccaagccaaatatgtatacaggcaggatggatgaaaaataatgtccaagatggtaaacatgatgttactgttcaatcttctcgggaggctttaaatactgaaagtgaaaatggcaatacagctcttgcattattggcttcagcatatggaaattcatctgactctgaggaagatcatattacagatgacagtcatgaatcaaatgtgataaactctgcttcagaatgtttactttctcatactcaaaattcccatgctagtcccatgactgcacttgacagggatgacaatattccttcaacaagtgccacttgtgagaattttatgcatcgtagatttgaatgtaatttgaatcatcagtctgtagaccactctttaaagaaacaggattataatattacatcagaggttaaatttgaaaatacaaagatggtgcctaatttcacctctaattgttcccaacacactcatgatgctgacaggtcattgtctaacaagtctatggttccctttgataataaaaatacttcgatggtgctacaatctgatgaagactcatccagaatgcatgttttttgtctagagcatgctgcagaagcagagcagcaacttcgcccaataggtggagcccacatgttgctcctatgtcatccagagtttaaactggttaagaaacaagggaaacatggttataacatgagtcttgtgatgggagttatgccagtttatgttgtgaa

SEQ ID NO: 35139 - DNA, 147 bp, Glycine max
  Peptide Sequence Number=SeqID_151917
atgaagctactggagttggtctggcgagattccgacagtaggaaggcggtgcgtggccttcacgcgccggaaatgatgcgcgattgtggtggcgcgtggatgaccttctggccacgcgacttgcagggttgggtcgcgctcctcaag

SEQ ID NO: 35140 - DNA, 570 bp, Glycine max
  Peptide Sequence Number=SeqID_151918
atggccaaaatacaaggctcaaaagaaggaaaaacctattctaatatttacaaagaagagtggacccaaccttggcccatgggctcagaaatctaccttgaggttcatgagaatcctagggccttctttagcagctctagctcaatcctcttggagtcttctatccaatacccttggggtgttgcctgggggtgtagggcatcatacatccttgcaatgtcagtcttgatatcacacatcaaaagcactgaaggatacactaccacgtaccgaaaaacatggttgacaaagaaaaaggccattgaaaacatctacaacaactgggaaagatcgttccatgatttatcgagatttgttgcaagttatgcaacaatttttcctggtatggttgtggagaaggaaatactgccaatgccaccacaaggaggtcaaacagtagagggtttcgtgaaattccatagtcttttttggagttttggatcgtgtatcgatgggtttcaatattgcaagcctatggttcaagtcgatgaaacatggttgtacagaagtacaaggagatcctccttgtga

SEQ ID NO: 35141 - DNA, 276 bp, Glycine max
  Peptide Sequence Number=SeqID_151919
atggctatttgcttccactgggatgttttgcagctttcttattttttcttggatctccttgatttggatgaggaggctggcatgatccagaagtcaactaaccaaattgatcaaaatgagaatgctgaagaacaagctaatgctgagtcaactaaccaaactcttatgccagatttcatgaagccagctcacaatcagtacgtttaccgccacgccaatgggtatatactattcattcattcttttgagattctacttggaattgaattgtgttga

SEQ ID NO: 35142 - DNA, 333 bp, Glycine max
  Peptide Sequence Number=SeqID_151920
atgtctgtgactgggccagtggattggtttaggtttgaaggctattgcaacggaaggaacaaaaaacagagtctcattactgactatacactcaaaatattgaggcttgatatttgcaaagataccattgtgggtgatgaaatgcagagaggtgtatctggtggccaaaagaagcgtgtatccacggcagttcacattatcctgacaactaataatgatccactaggtcaagctttagcggaagagctggcacggcgccttgggcgagtaaggttgtatatcctgtcatttattttccatgttaaacagtctggaatagaggctgcaaggtag

SEQ ID NO: 35143 - DNA, 366 bp, Glycine max
  Peptide Sequence Number=SeqID_151921
atgcagggaactagaaccagagaggcgacacgcaaaccgaggcaggatttcagcattcaaaggaaatttcagcagcccttcttctccctttcacgtagctttttcttcttccttcttctccaccattgttctccattaaagctccaaaatttctccacattcatactccaaattgcaaggggaagccattttcggagtcatgaagcacacctctacattgtggggcttcgaatttcagggctttatggtgatgctttgtggtatttgtatgttgaaattgttgatgcaaaactggtagagatgatggggagagataacttagggctaaatgtaagcttgggtagagcaaatgaggaagatgagtga

SEQ ID NO: 35144 - DNA, 334 bp, Glycine max
  Peptide Sequence Number=SeqID_151922
cttgagtgtgattgggttggctccttcccacattgctttcaagaatgaaggtggaatcacagccgttgatttcaatgttggaaagtctgatcgcagtaggataaaagtcactggaaagcagaagaagaaactagagatgcagcttttaaacccgctcctctggttcagaagccaatttcttcgatcttggagaaaattcggcagaggaaattggagattttacagaagtgtcaagggggaggggatgatgcaatcctatccccaagggtattggatagaagactccaagagcattgagctagagctgctaaagaaggccctagggttctcatga

SEQ ID NO: 35145 - DNA, 837 bp, Glycine max
  Peptide Sequence Number=SeqID_151923
atgtatctacctttgttagctaatcttgatcgagatgaccggtacaattggggttcgacgtgtttagcacatttgtatagagaaatatgtagagcaatttatcccacatccaaaaatatgggaggatatatagtgttgttgcagtcttgggcacggtatcgcatgtcattcactcaaccaagggtcaagaaccaaacgtcatatccacttgcaacaagggtcatgctccaattcggactttgtcaagacataccaaatccaccacataatcttgacaaaatccatcatactgacatgagaggacatattgacacaaactgggcagaggaacatcaacagtggattgtaatttggaaggaaagatgcaaatatgtgttaatcggccaaccaattctaggaaatattgaacatatgagtcactacataaattggtaccaagcaaattcaaaaattttcctaacacaatttgcaactcatcaaacattgcccccacatctcgctcagctccagacatggaaactaaacaacattctccataacaaagcccaccagctgttgccagtatgcatgatgaaggactacaaccatatgcttaatcatatgaattcacgctacaacctcatcatcatcaagaaaattatgggtacaatccgcagttcttcagtgctagaaagaagactttatgagcaacctcataggtatagatcttcaaacactggagttttcttatacgtacatgaaaagtatgcaatacccttgtttgcttctttgaaccaaagtattgtcggtagttcttccataatgactttgtctaggaagagtaactattgttcctga

SEQ ID NO: 35146 - DNA, 537 bp, Glycine max
  Peptide Sequence Number=SeqID_151924
atgatgccctactactactttggtcatggctcagttggggtacaaggtattttaaatcgtcatattctaaggcagcacaacattccaataagtcctaagattgcaaggaaacatgattttgaaatcaagcaaaccttagatcaacacattgaaagtggttcactttcatcagaaatcaatagcagtgcttctcaagtggattcaccccaacctattgttactagtcctgccccccagcttgaacctgtggtagaagaacctcacatgctagaaggagacaaagacatggctaccacaactgatatccagaaccaaagtcaaagtcacaagcaattggaagcagaagggagattaaaaagcaaaattgtttgtaacaatcagctgttggaagaggcccagcaattatgggacttagggacaagcataggcttggaagcagacacatgtcactctgattttattcaaagctttgcagatatggaggccagagacagaaatgaagctatggagttgggagagaggaaaactcatagatga

SEQ ID NO: 35147 - DNA, 372 bp, Glycine max
  Peptide Sequence Number=SeqID_151925
atggaagattctccatcaagtggaagagcacaaacttgtggatctgatatagatgtccttgatcttgctttgtggagaacactcttgagcccttgccacatgagagtcatagttcttctcccacccttcttgataagtgtttccctcatgaaagcaccttgtggccttggcaataaagtcactagaaagcatcaccttgattcccaaaacaaggttcttggagtccaagtaaccttgtccaacgactttgttgctaaggtcattggatgcctttgtgatggcaatagttatcatgaaggatgggagaaggcctatgactctcatgtaactagggctctgtacaatgagaatgtagataaggttggtgaatag

SEQ ID NO: 35148 - DNA, 345 bp, Glycine max
  Peptide Sequence Number=SeqID_151926
atgaagggcttaggtggtctggacaacatctactatgttgccctaataaaaaaagtgctttgggatcaagaagtctatcatgtttttgaagggatggacgacgactccaagcacaccatcatagtcaaaggttttgttgttgctaaacaacaattcagcaaaactaaccttaaagctatgaaggttgctatagaacaaaacttgaaggaagctcctcaggtggactttgacgcaatcaacaagaggaagcaaaaaaggctagccaaggccatcactgatgaagatagaggtcttaacagttttggcattgctaagaagattcaaaagatcatgaatgaaaaatag

SEQ ID NO: 35149 - DNA, 414 bp, Glycine max
  Peptide Sequence Number=SeqID_151927
atgtcgcagaggagcaatgcatcatcatctcgaacaagagtttcatcacaagttgttcttttttgtggttgtgatagaagggttgttaggcgtgttgctggaacaaatattaatagaggaagggcgtttttcacttgttcaattaataaggatgaagttggatattgtgggtactttatttgggttgatcaattgattgaaacacttggagttgatgattcacttgggacattttccatggaacaaagaagacaatttggaagagaggaagataagacaatgtggaaggctcaagttaactcaaagcttgattgtatggggattgaaatgaagatgtttagaacaattgtctatggaatgttcttaatccaattgttgtcaatggtggtgtttgtatgtattcacaagtactag

SEQ ID NO: 35150 - DNA, 320 bp, Glycine max
  Peptide Sequence Number=SeqID_151928
atggtctcttctctccttccttcttgtcccccctatgtcgtccccctcaccctcgtccctctccccacaccaccatttcaacaaattagatctggagggtctccgcataaggggaaaggcagtaaacaagaatgtgtttgcggtggtttgtgcggaatcgatagcgagccatacagcggggacaacgcgttccgttcttggaaccaaaagttctctgtggagttggggcagcacgcgaggcacgtgacgattgaggtgaagttgagggattgggatagtagaggaaataagattgtgaatttcaccatcagagtggtggg

SEQ ID NO: 35151 - DNA, 612 bp, Glycine max
  Peptide Sequence Number=SeqID_151929
atgttgtgtgcttcatcagaagaagagtacaccaaggtacacaacttcaaaagtgtcaaacaaatttgggacactttagctgtaacatacgatggaacatcacaggtagagaggaacaaactcattctcttcactcataagtatgaactcttcattatggaagaaggcgaagacacacaaagtatgttcggacactttcaaaccattctcaataaactaagatcttcagttggtgattcatctcatgatgattctgaggaagactttgatggatatgagcttgccttcatttcacgaaagatttgcaaaatatggagaagcaaaggtgtccccaagtggaaaaattcctcaagaagaattcccaaagaaaagaaagataaagacaaaagctccataatttgctacgaatgcaaaaatcttggacacttcaaatctgagtgcctagaactagagaagggccaagacaagaagaaacactacaagaccaaagaaaagaagggtcttataagtatcttggaatatctggatgaaacttcatctaatgaacaggatgaagaagccaatatatgcttgatgacaaatataacttctaaggaatttgaatcaaattaa

SEQ ID NO: 35152 - DNA, 564 bp, Glycine max
  Peptide Sequence Number=SeqID_151930
atgactctcatgttacaagggcactatacaaggagaatgcggagaagaatagagtctaaaggaggcttctcaggtggacctggatgccataacaaaaggaagcagaaaaggctcgccaaagctatcactgaagaagatcgagatctaaatagctttgggattaccaagaagatacaaaagattatggctaagcaacaaaagaaaaagaagacaaggaagcagtcacaaaaagaggaagaagaggagaagataaaagacttgagtgaggctgatgaagaggatgaggggttagtacaaatagctcttcaaaaaagaaaggttgccgccctggttgcccctaccccaaaaggagccaagaccatccaaccagctctgaaacatagagaacctgtcattccttctactatacctagacacattaaaacaagggctactaaagccaatcccaagattggtaatgagtggacagtctctttcaccaggaataaggaggatccatcttcatcctcctcggatagtgagtctactgacgaaactcctatctctcctctcaacaagcgttaa

SEQ ID NO: 35153 - DNA, 408 bp, Glycine max
  Peptide Sequence Number=SeqID_151931
atgggtgaagtagaggaggtgcaagagcaaatggccataatgttggaggccatgatgagcatgaagaagataatggaagccaatgtggttgcagtcaccactaccagcgttgttgctttggtgaacccgatgcccccatctgacctcaaccaaatgaatcatccaacctcagatatggtaggcaaagatttgggaagtatggacaaccccatgatgtgcaaattcaaaacgagcatgccttcccgccatatggcttgcctcccaactatacaccacccaatgtggcgtacactcccaataaggatgtcaataactctgctcccatacacattaagagtcgacaacctcattatgtacatgtctctcaacccatggaggagacacatgaaattccacaccacaatctag

SEQ ID NO: 35154 - DNA, 377 bp, Glycine max
  Peptide Sequence Number=SeqID_151932
ctgtttcctggcgcatcctcaacttcttcccggaaagcgcgcacaagaacgtgctgatgaacctcgcgctgaacctgcgtgcagtgatcagccagcgcctggtgaagaacaaggaaggccgtcgcctgccggccaccgaggtgctgatcaacacgccgatgatccgcgacctgctgcgcggcggccaggtgcacgagatcaaggctgcgatggaaggctcgctggaggaaggcatggagagcttcgaccagtgcctgttccggctggccaagtctggcaccatcgagcaggaggaggccctgcgcgcggacgactcgcgcgatggcctggcgctgaagtgccgcctgtccgaagtcagcagcgggcgaacacgaccc

SEQ ID NO: 35155 - DNA, 384 bp, Glycine max
  Peptide Sequence Number=SeqID_151933
atgaccaaatttggaacgtcttcatcagtaggcatgttcgctataggcggggagggggatggtatggatgtagatattagggatggtccatgtgcatcaatcggggatggggatggtgtggatgtaggtaccagggacgatctgcgtgcatcaatcagagattgggatggtctaacttcaatcagaggtggagatggtgtaggtgcaacatccgaagatcttattagcttagatatagtagacggggatggggtacatgatggcagactatctctaggtggcagtagtctaaccacatatcattttttctttccacttgtccctttcctactggagtcatgtgacaggggtcagggaggattagcagggtctactttttcttaa

SEQ ID NO: 35156 - DNA, 882 bp, Glycine max
  Peptide Sequence Number=SeqID_151934
tctagaggatccccgcatgtcctcgccttcagaggactacacgtcctcgccttcatagggctatacgccctcatcttcagaggactacacgtcctcgcctttagagggctacatgtcctcgccttgaaagagcttcacgccatcgccttcagagggctacacaccctcgccttcagaggactccacgtcctcggcttcagaggacagcatgtcctcgcctttagaggactacatgtgctcccctttagaggactacacgtcctcaccgccagagggctgcacgccctacccttcagagggctgcacgccttcacctttagagaactgcttgtcctcgccttcagagggctacaccccctcgcctttagaggactatacgtcctcatcttaagaggactacacgtcctcatgttcagaggactaccgtcctcgctatcagaggactgcacgtcctcgccatcagagggctatacgcctttgccttcagaggactccacgtcctcgccttcagaaggctcgacgcccacgccttcagatgacaaaatagggctgcacgccctcgcctttagaggactacacgtcctcgcctttagagggctacatgccctcgccttgaaagagcttcacgctatcgccttcagagggctacacgccctcgctcttagaggactccacgtccttggctttagaggactgcatgtcctcgcctttagaggactacatctcctcccctttagaggactacacgtcctcgccatcagagtgctgcacgccctcccctttagagggctgcacgccctcgcctttgaggactacacgtcctcgccatcagtggactatacgtcctcgctgtcagagggttgcacgtcctcgccttcatag

SEQ ID NO: 35157 - DNA, 861 bp, Glycine max
  Peptide Sequence Number=SeqID_151935
atgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactggtttatcaagaatacgcaagaaaagcattttgaattgttgattcattgccagagatggcttagaatcaatagttcattatctaatggatttttccgttctaatactctatctgagagttatcaatatttatcaaatctgttcctatctaacgaagcgctattggatcaaatgacaaagacattgttgagaaaaagatggcttttcccagatgagatggttgttgctatctgctccaataacgaatcattggtttaa

SEQ ID NO: 35158 - DNA, 873 bp, Glycine max
  Peptide Sequence Number=SeqID_151936
gtagatactgctaattccggtgaagaagcattagggaaagcattgaaaaatgattatgccctaattattctcgatgttcagatgccgggaatggatggttttgaggtagctgaaatatttgcagcggtaaatacagaaaagagatttatcaccaaaggatatgcttccggaggtaaggactatgtcaccaagccggagcagaatattgaaatgaaaaaaactcagcagagtttacagcttgaggtaaaaggaagaagagaatcacaggttaccatgaagtctcagattgatcactttcacctgatgctggaaggcttgccgcaaattgcatttacgttgaatgataaagggatcattgattttgtcaacggcagatggtatcagtattcaacatctgataaaaacttccccgaaacttttcctgatgatttagatataaaagagcaatttgaaatttcaaggaaaaatggaaaatcacttcaacttgagacgcggataaaaaatattgaatccggagaatacaggtatcatttattgagaatatcaccggtttatgaaggtaaccatgtcaaaaactgggtaggaacatttacggatattgatgatcagaagagggtagaaaatgagaaagatgaattcctgagtattgccagtcatgaactgaaaactcctcttacaagcattaaagcgtatgttcagttgttggaacgcaagctaaaacttgacaaagacagtgcagaagcaggatatgtaaccaaggtccaggatcagatcgaaaaattgaacagccttatcagtgacttactggatgtctctaaaattgagaacgggaagctgaagatcaacaggaaccttccaatcttgagaagataa

SEQ ID NO: 35159 - DNA, 240 bp, Glycine max
  Peptide Sequence Number=SeqID_151937
atgggtctgttgaagcatgaagggaaagagagatttggttctgcttttcgccaatggcaggtggatgctgcaaatttcaacattgatggtcattatcctgttagagagctgtgggatcgtgctagaagctgctggactaaaatcttagctcatgatagcaggtctgttcttgtggttgctcacaatgctgttaatcaggcccttgttgccacagcaattggtacctgtttctccctctag

SEQ ID NO: 35160 - DNA, 192 bp, Glycine max
  Peptide Sequence Number=SeqID_151938
atgggtgccaagtacctcgaagcggtcaagcaaaggttgcatgccatcaatggatggtccccggacaaaattaagggaagtaaggataagacactaatttcgttcgagcgaaacaccattcggccggtgaatctccctgtcagtggaacctgcaaaaatttgaaaatgatcagtaccgacacatcatcctga

SEQ ID NO: 35161 - DNA, 672 bp, Glycine max
  Peptide Sequence Number=SeqID_151939
atggaaaaactcacttttgcagattttggcctgccggtaaaaattcttgatgttttagcagatttggaactgtttgaacctactcctattcaggaaaagagtatcagcccgatactttcgggtagggatgtaatgggaattgcccaaaccggaacaggaaaaactttagcatatcttttaccggttcttaagacctggaagtataacaaaagtggaaatccaacggtattggtattggttcctaccagggagttggtggtacaggtaactgaaattcttgaaaagttgaccgccaatattaccgcaagagttatcggaatttatggaggaaaaaatatcaatacacagaagcttttatttgataacggatgtgatattttggtaggaactccgggaagggtaatggatctggcaattgataacgcaatttctcttaaagaagttcagaagctgatcattgatgagtttgatgaaatgcttaatttaggtttcagaccacaactgactcatatttttgaaatgatgaaagagaaaagacagaatatccttttctctgctacaatgacggaagccgtagatgaaatgctggatgaatattttgcacatcctatagaaatttcattggcaaagtccggaactcctctggaaaagatagaacagacaggatataaa

SEQ ID NO: 35162 - DNA, 201 bp, Glycine max
  Peptide Sequence Number=SeqID_151940
atgagggagaatcgcattacagtgtcttgcggattatctcgttggagaatcaaagttcttgttaaatcctacgacctcctcaggcttggatgcaaaaagggttgtgggtcgacgatgttacgagttgagaaaacaaagaggatgttgtacaagttgttgtacttgaacatggaaacaagactacagtatgtaaatgtttga

SEQ ID NO: 35163 - DNA, 594 bp, Glycine max
  Peptide Sequence Number=SeqID_151941
atgtctggtgaagctatgtttagagaacctttttgtgtggaatataagtggcagaagaaagggtccgagaatttgttactgttggctcaccctctccatctcatgcttctctctaatagagacagtggtatcactgttcttggtgattttaagtacataagtattgatggggatcttgttggtgttattggtagttcgtggattttgaaaatagatcctgtagttgtaacttggcattcaactaagggtgtcaaagaaaattcctgtgatgaaattgtttcagccctttgtaaagatgtgaatggcctaaattcatcaataataacaacaacttcgtcctatttttatgggaagttggttggaagggctgcaaggttggcattgattgctaaggagatgagctatctcgatatgattcccaaggtttccaaatttttgaaggaaaccgttgagccatggttggagcagaaatttgacgagaatatggatttctacatgataaaaaatggggaggcaatattaccaaaaaagggtctaaagatgttggtgctgattttggatttggtatttacaattatcaccactaccatttag

SEQ ID NO: 35164 - DNA, 486 bp, Glycine max
  Peptide Sequence Number=SeqID_151942
atgcatcagaaatgcgctagtaagggtgtgactcaacatgatgggagaggaagcataaagaagccatgtttgaccattgttgaaacgaatgatgtacttgacacagtcacaaaaggacttctcctaaaaaggaaaaacctcatattggaacaagagacatccaagggattagtattgttttgggtgttagccattgctgttgaagaatatggaagtggtgggggttgtggagtgaatgcacttctttcttacatacttgaaggtttcagatattttgaggattttggaaacgatggtaagttattgtacattgcactaccagtaaatgaaattcaaaagggtacgtgcaattttgttggcagaatatatgttcacattggtacatctcataatggtggtgaggagatggaacggtttgcaacattcactcaagatgcatggcgtatgctattcataattgattggtcttggaagctggaagcctaa

SEQ ID NO: 35165 - DNA, 1299 bp, Glycine max
  Peptide Sequence Number=SeqID_151943
atgacaatgaagtttccggccaatgaggttctcaatgggaagtacacaacaagaaccacagccaaaagtgttttcctggtacccttcactcttcttctcatcatgctccctctttctctcatgagaagctctcgtgaaccaactcctgagatatcttctgtaagtgttagcagtttggacaacaacacagaagtaaaacaatgtaacatcttttctggaagatggatgcataatcctgcagcaccttactacagcaatgaaacatgccattggataatagaccaacaaaactgcttgaagtttgggagacctgatagagagtacctgcattggaggtggaaaccagatgaatgtgagcttccactcttcaatgcaactcgattcttaaatcttgtgagaggaaagaagatggcatttgttggagactcagtggggagaaaccagatgcagtctttgttgtgcctcctaagtcatgtgtctgagcctgaggatgtttctcacaaatactcttcagatgtggtatacttcaaacgttatttctatcatgattacaatttcacacttggaaacctgtggtctccatattttgtgagatccagtgatgcagaccccagaggccacacctacaacagcatcatgaagctgtatgtggatgaggcagatgaagcatggacaagcctggttgaaaactttgacatagtcataatctcatcagggcaatggttctttaggcccctattgttctatgaagagggaaagcttgttggatgcaacaagtgtaggatagacaatgtgacagacctcacatacctctatggatacaagaaggcattcaggacagcatttagggcactcagcagccttgaaaactacaaaggggtcacattcttgaggacattctcaccagcacactttgagaatggggattggaacaagggagggaggtgtgtgaggactatgccattcaccaagcaagaaatgaggcttgaggatggggcagtggagtacattctagagatgtatgtgacacaagtggaggagtttagagaggcacaaagggtggccacaaagagagggttggagtttctgatgatgaacacaactgaaatcatgttgcttaggcctgatggacaccccaacaactatggatattcaaaggacaaaaatatgacactgaatgactgtgttcattggtgcctgccagggcctgttgacacatggaatgagtttttgctctatatgttggatactatgggaagtgaggcattttttagttctaagctagagagagttttttaa

SEQ ID NO: 35166 - DNA, 109 bp, Glycine max
  Peptide Sequence Number=SeqID_151944
gtttaatcctagacgatcctaagtcatcccttgtgccatgtgggttcatatcatttggtaatcagagctctggttctaggatcaacacttcctttgctggaaatattgg

SEQ ID NO: 35167 - DNA, 216 bp, Glycine max
  Peptide Sequence Number=SeqID_151945
atggcagtgttaaaacacgcagcgtgttcgctttgtgcccctattttaggaacccaaacgggaggaactaaaaggcttttagtgataactcccaagagatatcattcccttctacaacaatgttgtggtggtagggactaccagcgtcaacatatcatcaaagagaaaaaaactctagatgaggtttcactgtcagcaagcaagtcgaagacttag

SEQ ID NO: 35168 - DNA, 564 bp, Glycine max
  Peptide Sequence Number=SeqID_151946
atgcttgtacgacccctattgcgctataaaccatgcacttttttgcacgttcgcgtctgcatcgtgttgtcacacgcgcgttgtatgttggtctcgtcattttgtcacgggaagccggatggtttgtgtcaccttcttaagtgcatacaaggggcactgtgctgccaactattgcaagtaagaagagacgattttctgggctctcgtgtccgtaaaatacattcgtatcatgcaccgcataggcatctcttcatgcattcatccatttctcccatgatagatgtcggagtattgattcaaacaggacttttcattctagtaaacatgggatcaaatcaagcacctctgctcaagaaaaggttctatcaagtcaaaatcaagagcttagaggtcaccagtttacgagagttggggcaattgatgggtcaacttcaacggcaagccttccgcaaagtctatggaattaatgaagcattgggcttgaatccagagttgggcttgggcttgaatccagaattgggcttggacttgaagagggcagactattttattctacaaaattag

SEQ ID NO: 35169 - DNA, 354 bp, Glycine max
  Peptide Sequence Number=SeqID_151947
atggccaacttccaatacaaaattatcagcaaattcttggttgatagaggtactaaaaagaatctcattgctctaatgaagcttttcacaaatatggtcaagcttcggatctctcttgaaggagatagaaacttagataaggaaattcgtatgggctatgatattcacactaggaagtttgttattgtcaattggcaaaagctttgtgcacctcttatggaagaaggcttagatcttttcccagtttctcggatcaatgccttcaagaagaatttccaactggttttggagaactctggatgggttttagggtctggtattgggttagctaggaatctaaaaggggttgaatag

SEQ ID NO: 35170 - DNA, 399 bp, Glycine max
  Peptide Sequence Number=SeqID_151948
atggaggcgattgttccagtggtggatttccagaggctttcagaggaagaggagcgcaagaagctgagaaaaacatgtgagaaaccagggtgtttcagaatcatcaaccactcaattccactaacactcatggctgacatgaagtcagtggttaaatacttgcatgaccttcccacggaaatcaaaatgcgcaacaaaccctccgtccctgagagtggctatagggcggcatcgccaacaagtcctctatacgagggcatgggaatatatgacatgcatgcctcaccacaagcatttgaagatttctgctccaacttgaatgtgtcaccccgtcacaggttttcagctcggcttgagttgaatacgcaaagcttgagcttgactcattacctatcatag

SEQ ID NO: 35171 - DNA, 390 bp, Glycine max
  Peptide Sequence Number=SeqID_151949
atgacggtagtggcggccggctctgattgccggatatcggctccgacggtgtttccggtggtgctggtgttggtgctcgggattgtgctgccatttctgttcgtgaggatcacgatcttgattctggaatctgctgcggcgtgttcctcattggatgtgaaacctggtgtgtccttggaggaaaaaaaactacccaaaggagaaacttggtctgttcacaaatttggtggaacctgtgtgggaacctctcaaagaataaaaaatgttgctgacataattcttaaggatgattcggggagaaaattggtggttgtctctgcaatgtcaaaggtgaaaaatatgatgtatgaccttatccacaaggctcaatcacgcgatgagcttatatag

SEQ ID NO: 35172 - DNA, 366 bp, Glycine max
  Peptide Sequence Number=SeqID_151950
atgaaaagaaagaaaggtggacaaggttggatggcaataaaaattgatttagagagagctaatcattgccttgattggagttttatcagggacactctcttaggtattggatgcccaagtagggtcactttagtgaaatctgttgttcaggctctacctcatgctatgcaatttgctcaccttccaagatgcttatatgataaggtggataagaagcacataagcttcatttggggagacatggttaatcataggcacattcatacaacggcttcgaataacttgtgtaaacccaaaagtgttggtggtcttggccttaggaagtctagagatacaaatttaacctttatgatgaaagttggatag

SEQ ID NO: 35173 - DNA, 228 bp, Glycine max
  Peptide Sequence Number=SeqID_151951
atggttccaatgtctggtcacaaagttatggaaattcgcatgagttatccaagagggcatgaagcaaagcaaccttctataaaggttctgagataccgtagccttaacattcaacaagaaaggcctatgatcaaacttgtagtaaggaaaatgaagaacataagcctcttggaacatcaatctccactgatcttatctagcctatgttcaaaggtccctcttttctag

SEQ ID NO: 35174 - DNA, 366 bp, Glycine max
  Peptide Sequence Number=SeqID_151952
atggatcaaatttttggaaaggaacttttagtagttaggcctctgttcaaaaaaatcttggctggaacatttacaatggagctcaagttaactttcggactgatatatgggttcattcacagggaagatggttcttggaatttgcagttgttatcttctcttcttccaattcaaactattgattgcattagagctatccttccaccaaagataactaaaggagatgacattcttacttggctagggtctcacaatggtggttttaaaatgtcaatattgtatggcagtattaaggagtatgatatgcttccccacaatcctatgcataaggccatttggaattggagaggatctgagaggatttga

SEQ ID NO: 35175 - DNA, 333 bp, Glycine max
  Peptide Sequence Number=SeqID_151953
atgaagcttacctcgaacccgacagtgacaatggcaacgagactggcagtgagatcaatgacaatggcacggagacatgaagcttacgtcatacctcaggtcaccatgagttccctaatccttgcagtagaaactgaaaaaggtaagttggcgatggacaacaaaaagcaagctgtcacggtcttcagcgcgatgaagaacaacaagcttagatgcagaacaagggagaaaatcgatattaacgaacataggttaacgtcggttttcttaaaacctgatgttaacgaagagatattaacatcgattttggaaaaaccgatgttaacaaattaa

SEQ ID NO: 35176 - DNA, 135 bp, Glycine max
  Peptide Sequence Number=SeqID_151954
atgtcggggtggacgtggctaaggtggactctcggacttcacacatcagtttcgaaaggcacctttgttaagaggacaggaggggggatctgcaaaacaaaagactttgatgctcaaataattctcggcttatag

SEQ ID NO: 35177 - DNA, 666 bp, Glycine max
  Peptide Sequence Number=SeqID_151955
atgaacaaaaatgacggaatgaactacgcgccggtcggtaagccacagccggtggtgaaggaaggcgaatttgtctttgccgccgccgcgctcgaccacggccatatctacggcatgagtaacggactgattgaagccggggccacgctgaagtgggtgtacgatcctgacccggccaaagtggataaattcatccagcagtatccgcaggcacgcgtcgccacgtcgctggagcagatcctcgccgacgatgaggtacgcctggtggcgggcgccgccattccctccgagcgctgcgcgctggggctgaaaacgatggccgctggcaaggactacttcacggataaagcgccgctcaccacccttgagcaactggaagacgccaaagccatggtggaaaaaacgggccgcaaatacgcggtgtattacagcgaacgcctgcatgtggagagcgcggtctttgccggacagctggtgcagcaaggggccattggccgtgtcgtacaaacgctggggacaggcccgcaccgggaaggcaccgggcgtccggactggttctacgatcgtcgttatttcggcgggattctgtgcgatatcggcagccatcagattgaacagttccttttttacaccggcaaccacgacgcctccgtggtggcaagccag

SEQ ID NO: 35178 - DNA, 393 bp, Glycine max
  Peptide Sequence Number=SeqID_151956
atgaccaacgtggcgcacgacaatgccgaagtggaggacctcagcgccgcgatatttaaataccccagcggcgcgctcacccagctgaccgcctccgttgtgcaccacggggaagatcagaaaatcattatccagggtgaaaaggcgcgcatctccgcgccatggcaggcctttgccagcgtcagtgcggacaacggtttcgcgcaggaaacccacgaccagcagcgagaagcgcagctcgacgccgtgtttcaggagacgccgaagctcgactggacgctgcacaccgggcagattaacgatctgcttgacgccatcgggcacggcacggcgccgttagtcgatggtctgcagggcaaaacgctccctggagctgattaccgcgatttataa

SEQ ID NO: 35179 - DNA, 261 bp, Glycine max
  Peptide Sequence Number=SeqID_151957
atgggttcgtcgggctttgatcccattccgttccgaagcgttctgctcattgagttttgtaaaaggttccggtctttcttcggtgaatctcgaggtctttctgatggctgcgctcagcctaatgttatctacgttgacccttctcagactagtttacaacggttttcaaagcaagaagcaagtggaaaaacggcttgttacagtgaatccgaaagtaggcatatccgctgttgcatagttatatattcctctaatcgctaa

SEQ ID NO: 35180 - DNA, 351 bp, Glycine max
  Peptide Sequence Number=SeqID_151958
tttttgaagttcttagatgattatgaaggtgatggcccaattacagttctattgagccattgtaggatcaaggaagcgcagggatcttatcccgcatcgatcaacaattctttcaaggcttcaaagttaattattaaccagcccatgatggagattcaagaattcaatgaacggcttgcagagttgggcattgaggcccggtcaggttttaaatcccatggtgaagggagtacacaactttcaggttctatccaattatcatcaaaagaatcattctttggcaaggctgaggcaaagactattgctgacattaacaccatctctgaaataatgattttatatagattttaa

SEQ ID NO: 35181 - DNA, 297 bp, Glycine max
  Peptide Sequence Number=SeqID_151959
atgtcgaccccggcaaggaagagactgatgagggattttaaaagattgcaacaagatcctcctgctggcatcagtggggctccccaagacaataatattatgctttggaatgctgttatctttggaccagatgacaccccttgggatggaggtacgtttaagttgacacttcagtttacagaggattatcctaataaaccacctactgtgcgttttgtttctcgaatgtttcatcctaacagtgagtacaaaactaccctgcaattccactttggagttagaatgacaatcacgtga

SEQ ID NO: 35182 - DNA, 180 bp, Glycine max
  Peptide Sequence Number=SeqID_151960
atgacggtagtggcggttggctctgattgccagatatcgactccgacggtgtttccggtggtgctggtgctcgggattgtgctgccatttctgttcgtgaggatcacgatcttgattctggaatctgttgcggcgtgttcctcattggtttttgctcttaaaagaaaaagaataagctga

SEQ ID NO: 35183 - DNA, 192 bp, Glycine max
  Peptide Sequence Number=SeqID_151961
atgcatggtcatgcaggcaaaccgccattgccattggcgagttcgctgcgtttggcccacgtggcatggaaaccgccactggtggtgcagtcagtcataggcacgttgatggacagtctttttcagagaaaggggagttgcaactcctcctggcgatttgagttcaagttgccactcctcttggtgatttag

SEQ ID NO: 35184 - DNA, 555 bp, Glycine max
  Peptide Sequence Number=SeqID_151962
atgcaagaagctaagcatgcaacaatcatcactattaataagagttccttccttcactctcacccaagccaaagaaaggaacaagaacaagaacaacaaagtaacgtgaaagagagagagatggaggcgattgttccagtggtggatttccagaggctttcagaggaagaggagcgcaagaagctgagaaaaacatgtgagaaaccagggtgtttcagaatcatcaaccactcaattccactaacactcatggctgacatgaagtcagtggttaaatacttgcatgaccttcccacggaaatcaaaatgcgcaacaaaccctccgtccctgagagtggctatagggcggcaatgccaacaagtcctctatacgagggcatgggaatatatgacatgcatgcctcaccacaagcatttgaagatttctgctccaacttgaatgtgtcaccccgtcacaggttctttatgttactctcattcaatccttctttatttggctccaacaatatagaatttatttttgtatgcttgaaaattgttatatatgaaagttaa

SEQ ID NO: 35185 - DNA, 327 bp, Glycine max
  Peptide Sequence Number=SeqID_151963
atggtggtatctatttttggtggcaatggtgacaacaacaatcatcacatggtggcaatggcggtggcaagagtcacaatgaccatcattgttagtgccaccgccaccaccatcaattatcacttcctaaaatatctcaaattaacccatcatcatcaccattacaactgttggtaccacacctctactgccatgactatcactattgttgttgccagcattgctagcaacgatgctggttttgacggtggaggtggtggtgatagtggtggtggtggtggtgatgatgatgatggattaacagtagttgagatgtttaagtcatga

SEQ ID NO: 35186 - DNA, 171 bp, Glycine max
  Peptide Sequence Number=SeqID_151964
atggaagaagggcataaacatttatcaggctggaggggtagagaagtgaatgtgcaacgggatgggttgaggttgagtatatcttggattctatatccagatgatgcaaagccccaagctgttcactcaacagaggcaatggagcctgataggggggcacatcaggtttga

SEQ ID NO: 35187 - DNA, 772 bp, Glycine max
  Peptide Sequence Number=SeqID_151965
gaaagaatgctctttacggtgcccttaccaaacacgtgctagagctagagtaatgagtgaagtagaggaggtgcaagagaaaatgaaggccgacatgaaggttatgaaagaccaaatggccgccatgatggaggccatgttgagcatgaagaaaataatggaaagcaatgcagcaatggtcgcccctacgagtaccgctacagaagtggacccgactcacccatctagcctcaatcaagtaaatcctccagtctcgaatatggtaggatcagaacaagcattccttcccaccatatggcctacctcccaactatacaccacccaatgtggcaatgctcccgatgaggatgtcaataactccactcccatactcttgaagatgtactatcggaagataggggtgtacgcgaaagatgagaaactgttgatgcatttcttccaggaaagtcctactagggcaacttacaattctgatatggctccggatagaatgcagctacagaacatgtgtaagaaggaacatgaatctttcaaagaatacgcccaaaggtggagggatctggcagctcaagaagcacatccaatgacggagaaggagatgataacaatgatagtagacacattaccagtgttatactatgagaagatggtgggttacctgccctcaagctttgccgatttagttttcaccagtgaaaggatcgaagtgggtctgagaagaggcaaatttgatcatcctgctttgatgaataaaaagcctggggaaaattga

SEQ ID NO: 35188 - DNA, 675 bp, Glycine max
  Peptide Sequence Number=SeqID_151966
atgcctcaccctaaggtcttcttctacatgaccattggtgggcaacttgttggtcgcatcatgatggagctctatgccaacatgactcctcgcactgccgggaacttctacgcgctctacaccgacgaaaaaggaggtggccacttcacctccgaaaaaggaagtggcagcaagttgatctatggtgccaagttcgctgtgaagaaacacactggtcccaatatccgctctatggaaaacgccagtcccataaccaatagatcacagttctttatttgcgcagagaagacaaaatggcttgatgaaattgggagccatggtggtggaggaggcggtggtttgtgcatcaccattcatgtcgctaaccttgttgatggctctgctgcaccaacgaaggcgatgagcgttgaggtagttgcggagcgcgatttggcgaaagatgaaggcatgtactgtggtgggagtggaggcttagtgactgttgatgttgtcctgactattgcatttgtcaggtcgtgtttacatgtagtagtgttaacttgtgaacgaaatggtggatatggtggtggggtggtcgtggcaaatacgatggctatggaagggagacatttatactctcaagaggcaagtaggacattttatggtttcggtagtcgtcgtgaaagtggaagatga

SEQ ID NO: 35189 - DNA, 602 bp, Glycine max
  Peptide Sequence Number=SeqID_151967
atgacttcgttagctactgagagatacaagagcaggggtgctcctggcttgagtcaactcaaaattagcgatgtggcaatgaatggatttgccttttcgatgaactttgggaagaacctgggcaacgtgaagttcactatgatgatggagacctcaaacaaccacggggtcatcttagttgacgaggttgatgccttgaagtccttgtccgtaaaggtgatgggatggagacttcgttgtagggatggtgtgaaggtgttgcttttgggattggctggactgtcctccataggaaaatcctccattgatggcgatgatcatggaatgcaatactacctcaagattgagatttcggatttggatggctatgcacccaaatatatccatgaactttctaagggactcgtcctctgcttgtcgcagattggtcaaggcaaccaaggtcatgcgaggagacctactagtggtgtactgtgcactgaatcgttcaataaaggtgtcaaagctgtctatagacctagtgtgaggaaggtgtacaaatgcttgtctggatctgttgtctcgtcgtaccacttgaggttatgtggtttccacccacaagg

SEQ ID NO: 35190 - DNA, 487 bp, Glycine max
  Peptide Sequence Number=SeqID_151968
atctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttaa

SEQ ID NO: 35191 - DNA, 183 bp, Glycine max
  Peptide Sequence Number=SeqID_151969
atggttagcacttggtctggcctcaaacgcaagaccccccttacagactcccatcctcgtccgacaactatgacaaacacagacactctgcaacaactcagaaaccgcatcgcgaagatggagcgacgccataaggaagagttgacaaagctaaaggctgatcatgaccatctagaggctcgt

SEQ ID NO: 35192 - DNA, 670 bp, Glycine max
  Peptide Sequence Number=SeqID_151970
atggaagagcgtgtgttgaagcaagtagtagaagaagaagagggtggaaaatcaaaaatgggagaagagagagaagatccacagaagctaaagcgattagcggcagattcatacgactacgacaacgactctcgatggcccgattactggaacaacgttctcatccctccccacatggcctctcgtgacgacgtcgtttcccacttcaagcgcaagttctaccagcgctacgttgatcctgattttgtggtggagccaatgtctgttggtggcagttcatcccagccagtgcgttcatcaactacctcctcatcgtcgcccctgacaaataatcaacctcgtgcaagaagttctggatcaactaatagaacttcagggacatccacaactgcaggtccaggtcctagtccaacacctttgcgttgggatcggcagacagttctattttctgtcaatgcttgggaagtacttggaagagccttgtgtttgggtggagtcaaacagttctaccctcaatatagtgacatcacatgccgagattggacttggattcctgctgataatctcattgttctcgcaatttgtgaagggaggcccattatgccagcaccatttatatggcagaattttggccttccgtcatctgccattggtaacactggtttctatg

SEQ ID NO: 35193 - DNA, 438 bp, Glycine max
  Peptide Sequence Number=SeqID_151971
atgggtgaagtagacgaggtgcaagagcggataaaggctgacatagaggccctgaaagagcaaatggccacaatgatggaggccatgatgagcatgaagatgatgatggaggtcaatgcagctgcagttgtagttaccagtgccgttgttgaggtggacccaactcccccattcgacctcaaccaaataaaccatccaacctcggatatgataagtcagggaggcaaaaaattgggaagtacgggcggcccccattttgtgcaagttcaaaacaagcatgccttcccgccatgtggcttgcctcctaactatgcaccacccaatgtggtgcatattcccaatgagaatgtcaataactccactcccatactcgttgagagccaacaaccccaagctgatcatgcacatgtctctcaacccatggggggggacacatga

SEQ ID NO: 35194 - DNA, 579 bp, Glycine max
  Peptide Sequence Number=SeqID_151972
ctgagaggaaagtggaaatatatcatacagagctggatgaatttaaggctgaattggagaggcataacttccataagcgcctcaccaatttagctgacagtagcattgacctagcattggtgaaggagattgatgcagacaacctcaatgcctttttagaaacacctgtggcgcttgctgagggtgaatctttacccgcttactcaagatactacaggatgcctattgacatcagggaaatcgaggctgctctgtgcatacctggccgagggtttattttaaaagctgaaggtcaccttgggaagatcctcggaaaagatctaaccactcttgctcgggtctggagtgttctctcatactccaacctggctccgacttcccacacctcggatttgactgtggatagagctaggttaatctttggcctagttactcagctagacctgaatgtcggagctctcatctctggacaaaccatatcaatggcccagcctaactcttttagactcgggttccctgctcttatcacagctttatgtaggtccagaggagtcgtgtctgacaacttggtctttgaac

SEQ ID NO: 35195 - DNA, 156 bp, Glycine max
  Peptide Sequence Number=SeqID_151973
attacggaagaacttcttccggaagaagcagtgtgcacttctggaagaagttcttccgtaaacttctttcagaagaacttcttctggaagaagcagtgtgcacttatggaagaagtttttatcaattacggaattacttcttccgtcaaaatttaa

SEQ ID NO: 35196 - DNA, 177 bp, Glycine max
  Peptide Sequence Number=SeqID_151974
atggcattaggggtcatggcagctcgctcaggtgagttgttgcttcaacctgaagtaaccttgctcgcccaggcgagttggggaagtaaagataaggacactaatttcgatcgagcgatcttgcaattcgattgggcaactggtgaaaaccaaggaagtgaaaccgagaaaacatga

SEQ ID NO: 35197 - DNA, 375 bp, Glycine max
  misc_feature (341)..(341): n is a, c, g, or t
  Peptide Sequence Number=SeqID_151975
atgaacgtttcgaattctcttcctcgtacttcgcgaatccagttttacctcctgttttcacatttcagtactccactttatccttctccttttctccagacacttccttttgcattttcatgcacagattcctcattcaaccctctatccttcccttccttcagcaactactctacaatggagtcatcagaggaccccatcatccaagtcaaagatgaacaactcatggtttcaccattatccggtgaaaacccagttcacagaactgcttatttcatcaaaccttgcgtggaagactcggcaactcttcctcattccatgttctcttctggaagaacagncactgtcaattcggaccacgcgaagtttgcttga

SEQ ID NO: 35198 - DNA, 1281 bp, Glycine max
  Peptide Sequence Number=SeqID_151976
atgcatttagactacaaatgcaatcttggtactgccccagttcatggaggtcatggcaagatatacttggttgttgataacagaatattggtgattagttatggaaacattgcaacttctgagcctgaatcaaaagttttcttcggtccgggaccaggtcgtgtggcagaggctgaaattattgggctctcagtgagcacattaggctcgactatttatatcaatgtcaagaacagaggactctttgcatatcattcacatggacgcttgatttggagtgtgggacctgtgctttaccagtttggctaccgtcaaggatgcaggaaaaatcttacagattgttactttgcttcagttcctgtgcttgatcaatgtgagggtagtatatatgctcaggcaatgtggaaaaggggtatctcaaacacagaaggtgaactctattgtttgtcagttcgtagccgttactttagatggattcaggattttagttcattagacaaaaatttcaccatcactcctggaaacaatggtcatctgtttgtaacatttccagccaaggctcttgtactggctctagatgtcttttcaggtaatgtcttgtggcagagaagtattggaccattaagcaaagttgactctgcacctgtagtggattccaatggatggatatctattggttcattggatggattcctatactcgttttctccaaccggggttcttaagaaattctcaagaatgaatgcagaaaactctatgattcaagttggtccttttcttgattgctcaggatttgcaatctacagttcacagatagagatggaaggaaaagttagccgcacaattggtgaatacactgttgtttcagcaattagaccaaaagccgcgttatttactgtgttggttcctgcaactggatcaatctactggtctgaaagctatcctggtcatgtttctactttattttctgagagtgatctaagtcaatttgtcatgaatgaggagattcttcttgctttccttgctgcctcaaggattggcactccattgcaatgccgtactataggtcagaagcttgcatcaagctgctctcaagaaagaaccaagcttgtcagcatctacacaggtaacgaaagggcaatagtcttgtttctgctctttgagtctgctctcttgttggtactaatagggcttgtaagattctgctgtacattctgggcaaaagagaagcttaaagatcaaggccttggaagcttccttgacaagagacaaacgctttga

SEQ ID NO: 35199 - DNA, 942 bp, Glycine max
  Peptide Sequence Number=SeqID_151977
atggaagagcttgagaggattcaatctgctattgagcatgtagttgaggtattctctatagatgttgttgaaagacaagtagaagttgaacagagagacaaggttgacattggggctcatgcgcttgatccaaagatacaaaagttggagttggaaaagcataatcttcttaatcctagaaaggaaggtttcccaatgattgaccttttctcctatcaatattgggacaacttacctgaaaaagagaagcatgcttatggattttatggtgaaaacgaacaagtcttcaatcctaatagtctgatcttcgtgcatatgcccacagatagaaaggtttatccttttggagccagcatctggagaagtagagaggctgcatttgctgacatgcccttctttattcccttgaatttacaacagctgggcaaagaattattgattgaagatgaagaagatgcttactctactcaacttgatcgtttgttcaaacataagcttgaagctctcaaacacaagtctgaactcacaaccctggatggatatgccataatgagattcttcttcacacatcatgtggatcctatcattgaagaagttgagtttgacactgcatttggattcctggctattcaagaacttgtcagaaccagagaggcacttgctcaagccttgaatgaatgtgcccatgttgagaaggaggcttgcaaatggtctttgatcaatgatttcttctacaagaaatccactgggtggaaacctcctcattctccaacacccctagttagtcttgttaatttttcctttgactctaagactctagtgatgagtttcttaggaagtttgatgaagaagctgccaaacaaaaaggggacaaaaagtaaaaaagttgaagcttggcatcatttgagaaggaatgcaaagtcggatgaaagcatcaattaa

SEQ ID NO: 35200 - DNA, 279 bp, Glycine max
  Peptide Sequence Number=SeqID_151978
atggaagggggccaaggagggtcaaggttgaagggttggggtgtaaagaatctctacttcagattcttgggtgttggatggtctgaaggtttggggttaaatggtggttatttgttagatttcttggattggtctgaggatttgggattagatgatggagcatattcagggaagttatcagccattcccattttgacaaaggtcaatccattaagttgtgtgggacctgcagatggttctaacacaaacacatctaccccattattcctcatgatctga

SEQ ID NO: 35201 - DNA, 411 bp, Glycine max
  Peptide Sequence Number=SeqID_151979
atggacctcgacggagggtcaagttttgactttgaggatcttgttctcaatgtccatggtggagtggaccatcttggtgatgctctcgtcgtgcatggttgcaagcatggtgacgaggcaggtgttgctagtgccgtagaggacgatgttgagggccatatagatcttgacatatttgcaactgagcttctcccgcgtgacattgatgttgtgataggttgtggcgacgtcactaatgacttggttgaggatctagatggactcaaagatgatgacaaagttttcgtggtctgcgacggtgatgtcaaggacataggtgtcctcacaagtactaaatacaagtgtttcattttcatgggaacaagccccagggaagccaaaatccatggaaagatgaacaccctcggctaa

SEQ ID NO: 35202 - DNA, 1041 bp, Glycine max
  Peptide Sequence Number=SeqID_151980
atgaattcaatcattgcaacaaaaaggttacctcctgagcaaactgtggttgaaggggaaggcataattagcaagttgcatgaaagcattcttggtaagattctgtctttccttccaactacagatgcagttcacactagtgtgttatcaaaagggtggattcatgtttggaaatccatcacaggcctacagtttaatgatgctttgcaccctttggggaaaaagatgcaaaaagaacactttgtgtgttttgtgaaaaaggtgattcttcacctagccaattcaagcatccaaagtttctctctttgtttaacatgttatcattatgattcaaccctggtaagtgcatggatttcctctatcttgcaaaggggtgtccagaatcttcatattcagtatgccgatgaaatcctatttccttcttgttccctctttagttgcaattctctagtgcaattggtgcttcaaatgaaatgtactattagtgttccaatcttttcttctctcccaaatcttcaaaaccttagcatttctgggataaggttagtgagtgaatcctccaattattcagaagatctaattcttaactttccagttctcaaagtgcttgaagctagaggatgtgagtggttaactaagcagaacattggtatcaaagcacctctactggaaaggttttccatagcaatatggaactctctatcaaataaatcacataaatctgccatcaagatttttgctcccaatctagcagatttctcttatgggggtgatcttgagcaagaaatcattctactgaattcagcatcaattcacagtgcatctgttgtgattgttgctgatgaagacaaaatgaccaatgttggaaaacttgggtttcaagtacacaagcttcttgcacaaatccgtgaagtgaagcaattgaaattattgttttacaagagtgatggacaaatctttgagagagaagatataaaattattcactaaattgctcttgcaggatttaactgatgagaaagatctttttaggaattattag

SEQ ID NO: 35203 - DNA, 507 bp, Glycine max
  Peptide Sequence Number=SeqID_151981
atggtgacaaaaaatcgtcacatatctttttcttcttttcctttcctttcgttatcttcttcccttctcttcctccccaacacaactccaccttcatgctggccgtcaatgtctccatcctctccgacttcggcagcatctgctcacactccgattgcatccctcactgctttgaccaaattggagacgcggccagcctcgaaaaaatgcgcatatctggggagggaaaatcaagatggtgatgatctgtcgggtgctgtaaggttgttggaagaagtcgaggatggtggctttgcccaatgggatgccatggtagatgacggtgaagttggactcgtcgtacctgatctcgaccttgttggggttggtggcagcgaagaggaggcgaatggagagagagagagggaagcagtggagaggggattggaagtgatgcccatgtactgcacccccacttgctccagatcgaactgtggcttcttcggcatcatcgctaaggaacgataa

SEQ ID NO: 35204 - DNA, 1130 bp, Glycine max
  Peptide Sequence Number=SeqID_151982
atggagaaccaaacaagaaaagataagaacaaagatttcattcctttagctgataattctgtgcctctatatgatcgtggatatactttgggattgacttcagctgatggttcaagtaatgtggatggtggtctggagattattgatgctgctgctaggtgtttcaattgtggttcttacaaccactcattgagagagtgtccaaggccccgtgacaacactgcagtcaataatgctcgcaataaacacaagtcccgacggaaccagaattcttcttcccggaatccgactcgttattatcagaattctcctgctggaaagtatgatggtttgaggccaggtgctctggatgatgcaacacgtcaacttttgggcttgggggagcttgatccacctccgtggctcaacagaatgcgagaattaggatacccacctggatatcttggtaaaatgcatttctttcacaataccttgcctatgatctacccaaacgatgtggatgatgaggatcagccttccggcattacaatatacactgatagggagattgctgaccaagaggatggggaaattatggaagcggatgcttccaaaccaaagcgtaaaaagactgtcaaatttcctggaataaatgctcctattccagataatgctgatgagagattgtggggcactagggctggaccctcgagttcagatatttcaagaaacttgtcattgccacagcacaggtcgaattatagtactgattatggcagccgtggatatcatcgcgaacatagattaggggatcttagggatgatggtccaccaggggaccctggacatagttcatctaagttcagttttcatcctaggtttggtggccatgattctgcactaagaagtccttcaatggcaaggtctcaatctgacaggagtagaagtccgatgcatgatgaagaatccccaatgcctttttctttccattctcttcattattcgtcttcagagaggcatttttcacccttggacccagattctggtagaccagggagtcggacctctgaaagtatgtattatgacagggaccgcgatctttcatctcgagttaaggacaggccagatgatcgtcaccaccgcagttggag

SEQ ID NO: 35205 - DNA, 2190 bp, Glycine max
  Peptide Sequence Number=SeqID_151983
atggatccctctcgccgtgccccacgcgccgtgatcgaccccgtcccgaagatccggcaagtggggttcttcgccccgcccgagagctcccagtcgggtcctctcgacccgacccactcctctcccccaatctccaactccctctcccccgtcatgatcccgcccccgcgccacctctccgacaacctcctcctccacgacccccgccctgccgcctctcccctctcctccgcctccgccgtcgccgctgccggaagcggaaactccttcgactccgcggacttcttccccgccccactctctcccgcgatgccgtcttcttcgtactccagcaggattgccaccggcggcgccagcgacggtgggtacttcaaggggaacggcgccggcggaaagttggcggcgtcgtcgtttccccgcggaggattcgacttgaccgcgatgaaggcggcgagccttgtgccggcgagcgagttgactacggtttccgtggtgaatgattcgctcgggattcctgaaaaagaaaaaggaaacaaaacaggagggtcagcagtggaagtgaaggaccaacctaatagttcaaagcagcagaagccaaaaccgaaaacctcaaaagctgaaagacgtgcactccaagaagctcaacgggctgcaaaggctgctgaaaaaggtgaaggaagtaaggcatctggaactgcggcttcaacgaatccaaaaccagctaaagctgtaaagcctgcacagaaagttgataatgcagcaattgcagcctctgaaaagaagggaggtgagattccaccagaaaaggatagaaagaaagatgctcctcaaccacgcttgcagtatgacgacaagagccgagtggagaaagctaaacgtcgtgcagtggtgaaacaaactgaagctaggaacagagttgagttgttcaggcatttaccacaatatgaacgtgggagtcagcttccagatcttgaggcaaagtttttccatctttctccagtgcaccctcttgtttataagttatttttgggttttagtaatatatttaatgtagtatgtgttgcactgagcattgcaatgccaaacagcactgtgagcccttctcaaaatagcatgcatcaagattttctaaattttttgagtgaaaagaatctgtgcaaattgcttgatgcaattatcaatttcgttgactgttatattgcactgcatcttcttgcctgtgatactatctgcaacataggaagtcatgctgaatggcatccaaatgaaagtaaagtgggcttgcagtatctaactggagatatatctggtggcaatgctcgttgcattgcaatgcttcaagcatttcaagaggccatcaaagactacaaggttccacctgagaagactcttgtgagagacttgacagcaaaaattggtagttatgtatcatttcttattgagtgtcgacctctgtcaatcagcatgggaaatgcaattagatttctcaaaagtcggatagccaagctacctttgaccttgtctgaatcagaagcaaaagcttctctcgagtcagatattgagtgttttataagtgaaaagattatacttgccaacaaggtgatagtgaagcatgctgtcaccaaaataagagatggtgatgttcttctaacttttgggtcttcatctgctgttgaaatgatactattgcatgcacatgagttgggaagacagtttcgtgttgtggtagttgactctcgtccgaagcttagagggcaacttttacttcgccggcttgtggagaacggtcttagctgtacatacactcatataaatgctgtttcctacataatgcacgaagttactcgagtttttctgggtgcatcagcagttttgtctaatggaacagtatattcaagagtggggactgcatgtgttgcaatggttgctcatgcattccgtgtacctgtcatagtatgttgtgaggcctataaatttcatgaacgggtacagttggattcaatatgctcaaatgaacttggcaatccagatgtcatttcaaatgtactgggtagagaggatgtcaaacacttggatggctgggccaatattgaaaatctgcaacttttaaatctggtttatgatgcaacaccttcagattatgtttcaatgattgtcacagattatggcatggagaattattgtgagtga

SEQ ID NO: 35206 - DNA, 273 bp, Glycine max
  Peptide Sequence Number=SeqID_151984
atgccattgcctagcactgttcatgcatcctccaccaacgagcctggagccccgcgaagcgctgttcatatgtcctccacctacgagtttggagccatgcgtattgattgcttagtgcaattctccatcctcgccttttttccggagccccatgaatgtcattgcctagcactgttcatgcatcctccaccaacgagtctagagccccacgaaggtattgcgtaccactattcgccaattctccattctccactttttttcggagcgccatga

SEQ ID NO: 35207 - DNA, 342 bp, Glycine max
  Peptide Sequence Number=SeqID_151985
atgggaagtcgcaaggaaatcagaatattatggcgtacactattacacttgaccacaacattcagtcaatggcgcaaggcatggcctaagcctttcccaccggcgagcgacaggtgctcccctaactggcgggtgcaattctatgtgtccctacgcctatatccgatcgatgctctgcgtgctcagacggtatttcttaaagaagatgatcattggcgtaagggaagagtcgtgagttcgagaacgagatttcgagaactttcaggtgggagagaagatgaatattataaaggaaatatacaaatgttttggaagattcttctatcaaaaagagaattttaa

SEQ ID NO: 35208 - DNA, 462 bp, Glycine max
  Peptide Sequence Number=SeqID_151986
atggctaagcagcttgaagcagcagaaggagataagaagccaccacttgatttctgttgcacaataatgctaattggaaagacaggagttggcaaaagtgctaccatcaactctatttttcatgagttgtgggaaaccaacaaggttgatcaagttgtgggaacaatggagggtatcaagttttttttagcactcctactaggaggtggttccttgtctacgcttgagcttcgcgttatgaattattggcttggggatcttgctgttgagagcaaggtgcaatctcaagtcccagttgtacaaacatgcaagccttgttggcctgatcaatttgaacaacaatggagaataagcattcgacttaatagttcagaacagtctcaaattgctttgattggtctcatccctctcctatggaagctacgtggttatctgcaagaattgttgtttggacaatcatga

SEQ ID NO: 35209 - DNA, 192 bp, Glycine max
  Peptide Sequence Number=SeqID_151987
atggcgttgagcgattcacacacgacgctcaagtcattgctcattttaggtgaagtgaaggaaatgaagttagttagcaaatcagtagttgatgtgttttatattgtgcttgtggctgttatccatgctttctcggtgagagctcataatggaagtcgaaaatttggttctgggctaaccaactcgagttag

SEQ ID NO: 35210 - DNA, 3480 bp, Glycine max
  Peptide Sequence Number=SeqID_151988
atggcttcacctgtcctttcagcactagaggattcactcaatcctcatagtccatattatgtgcatccgagcgagaatccatcaaccgcccttatcaatgtccactgcactcagtgcgaaaaaaagctggaattcattgatggttctttgccgcaaccagcgcccgatcacattcttcatactgaatggaaacgttccaataacatggtggtttcgtggttgatacattcagtatcaccttcaatcagacagagcatattatggctggataatgccgtcgacatttggagagatatgaaatcaagatattcccaaggcgatttgttgagaatctctgaattgcagcaggaagttgcttccatcaaacaaggtgatgtctctgtcacagaatattatacaaaagtaagagtaatatgggatgaattagaatcatacagacctgatccaaaatgtagttgtgttcaaaaatgtttatgtgatgctctcgaaattgtgaaacaaagaaaggtacaagatcaatttatacagttcttgagaggattgaatgatcaatatagcaatgtcaagtccaatatattgatgatggatcctcttccctcaatcaataaagttttgtcatatgctactcaacaagaaagaaaactcaatgggactgtaagtatgaataatctcagcttgattaatgctgctaatgcttcacatcctaggaatctatgtagctattgtggaaagaatggacatgctgtcgaagttgctggaaaaagaatggctatccaagtaatttctcatcaaatagaggaagaggaggtcgaacttttcttggtaatgggagaggctccaatattgacagaaatgccaaagtgtgcaattactgcggtgcctggtgctaacatcaataacacagctacagaaccaatgaataatgagaatccagcaacaattactgcaatccaggaaggaaaaaattcagagatgaagttaacatcacagcaataccaagctctaatgagtttgctacaacagacatccaccaatggatcttcttcttctacacagatagcccatatcaatcaacttggtacagtttctaaagctgattctattataggaagtgttttacctataatctgcaacataaacaatgattctgacctcaatacttggcttcttgactctggtgctactgatcacattgcatcttcccttgatctatatagtgaatgtaaacagatccctcccatcaccgttagccttcccaatggagaacaactgattgctagatattctgggactgtgcatatttcagaatttcttgttctgactaatgtgttgtatctacctaatttcaatttcaatttgatctccatttccaaattgactaattccatgcattatcaacttatattcttggctaataaatgtctgatacaggaaatctccaccaagaagatgattggtacagttgatgttgaatctggtttgtacaaactcaagacaacctccaaccatcacaacagtacaccccttgctgtcctcaacccatccaattatgccaattctttctttggctgtctatgttacactagcactctcaatgctaacagaaaaaagctagatcctaaagccttaccttgtgtgtttttgggttttaaatcccacaagaaaggctacattgtgtacaatcttcatacacgaaccattgaagtgtctagacatgttattttttatgagaactgctttcctttctcaactatcaatattaatgatcctaccatccttgctcacccttccatcactactcataatccacaagctttctctttccctatatattccccttctccttcacctttacctccccaatctgaacctgtacctattaaccagccaaacactaaccacacctcctctgcacccactcctcgtagaactgacagaattcaaactagacccaccaaatacattgactatcaaaccagtttcacatcagccattgttaccaatcatccaggcactaaacaccctatttcttctgtgatttcctataacaagctctcttcatcttatcacagcttcattcttaatgtctctgctaattctgagcctaagtcttataatgaagcctgtaaacatgattcttgggttcaagctatgcatgatgaaatttctgctctagagaggaataatacatgggtgctcactgatttacctcaacataaaaatgtgattggttgcaaatgggtgtacaagatcaaacataattcagatggctccattgaacgatataaggcccgcttggttgccaagggctatacccaaattgaaggtctagactatttggatacattttctccagtagccaaaattactatagtccgtcttttgcttgcattagctgcttcgaataactggtatctcaaacaacttgatgtcaataatgctttccttcatggtgatcttcctgaagaggtgtatatggttctacctccaggtatgaaatctgctaaacctggtcaggtttgtaagttacaaagatctctttacggtttgaaacaagctagtcgtcaatggtatgctcgattgtctacttttcttgcacatcatggctttaaacagtcagttgctgactattctctctttaccttgaaaagagcaaattcattcactgcattattggtctatgttgatgatattgttctaagtgggaatgacctctctgttatctcttccattacaaaattattggatgacacttttaagatcaaagaccatggcaatttgaaatatttccttggctttgaagttgctcgtggcacctcaggtattaacatttgccaaagaaagtatgctttggaccttctcactaatactgatatgttgcattgcaagcctttcattgcttctcctactactgcacattacacagctctttatcgcattcttcgctacattaaagttgctcctggtttgggttttttcttcccttccactagtgaactacaactcaaggcatttagtgattatgattgggctggctgtgtcgacaccaggaaatccattactggtttttctgtttatcttgggtcatcactcatatcctggaaatctaaaaagcaagtcacagtctccagaagttcctctgaagctgaataccgtgctctcgcttctgtaacttgtgaaattcaatggctcacatatttgcttcatgattttgatattactcataagcctgctttagtgttttgtgacaataaatcagctctccacattgcagccaatcctgtcttccatgaaagaaccaagcatattgaaatagattgtcacatagtttgtgacaagctgctttcgggattgatcaagctcctgcccattgcttcacaacaacaacttgttgatgtttacacaaaagctttagctcctggtgcttttcgttttatctgttccaagctgggtatgaatgacattcattctcgagcttga

SEQ ID NO: 35211 - DNA, 237 bp, Glycine max
  Peptide Sequence Number=SeqID_151989
atgggattgaggagcagaatcatcttaggcaatagtcaaatgtcgggccaaatccaaagacaacgacaaatcgaggtaaacggtaacgcgaccacagtttgctatgcaatgtcgtttcctgctttgaggtacttagggacagacgcgagtagaggcaatgtcgttttcatgatagatggattgtcgtcccatgcccagcttcggacaagcgggaagcacagctgggaggtagcctag

SEQ ID NO: 35212 - DNA, 726 bp, Glycine max
  Peptide Sequence Number=SeqID_151990
atgaccgaaatcgccgtggttgtaccggtcgctgcatctacgacggcgagcaaggagaagaatgcacccaaagagcgtcgtcgaggggttgaggaattaaagagtgcagaagacagtgatagtccatgtccaagaatcacgttggaattgcggatcggagctccggtggattttgtggccgttgaagccagcaagggtggtgccgacacggtggttgccgttgtgcttccaattttttccggcaagggcactttaaagaaaatcagaatcagaaaccaaaatttgattgagaaatcaacggctgagcacctaatgtctgtggagagcgaaactgggtcgtttcgggactctgaaactcggaacaatcttcgaagaattcttgagtcatgctctaaattggcggaggctggagattttcatgaatctgaaaacacagcagtttcagagcttgtcgagttccttgattctttgttggatgctgccatgtctgacctggatagtgaaaatgcagagaatgatgcatttgaagctatctctgagatccatagatatatttgttctccttctattgaccaggaagttgttgatgccctttcctttgaactgccaaaggctgtttcaaagtttgtggggatttcaagtagatttttggacttggcaattagcatcattgatcagtttattgtgaaatgtggtccaagggatatgctctcaattctctgtaat

SEQ ID NO: 35213 - DNA, 1593 bp, Glycine max
  Peptide Sequence Number=SeqID_151991
atggaaagaggggtggcgaagatccggaaagccctaagatgtagacttttatcaaagctttttctggaatgtaaagagcaagatgttgagttgtggaactcaacgattgcttctgcttatggatttcatggtcaaggacaagaagcaatcaagcttttcaatgagatggaacaagaaaatctgccggaaagtgaagtaatattcttaagatggctaaccaaagaggaaatgggttttgatgacatgtcttgtggagggacatttgctacattaggttactcaagtaagatcatcaaggctgccagttacattgtccctcctttatcagggctctcaaaggtcttactttccattcagaggcgtcagtttgagcaagtaaaagtagccgttcctataattcttaatatattgaaggctgtgtctttggagtcagaagaagcagaacttgaggatgtatttgacacagctgttgagattgcaaattctatatatgaagtttgcaataagttggagagggacacaaaggagaagctccgagctcttcttggtctatatgtcatgcaatgcatggctcttgtttcagctagcataagctataaagcttccagttgtccttcttcggtattacaactgtcacaaatttcttcatattgtggtttatcatatctcagtctagtaacaacttatgatgtagagattgtggctgaatctgtgtttggaggagaagataaagatcactgtaccggttgtttttctcatgtcaaacatggtgctgctctttcagtggtttgggggcatgtctcaaaggaggttgctcaaactgctaaagaggatttgattgccatcagggatgaacttcgtaataaccaaacaaaaaggtggcaagcaataggaacattaaagcatgtactttactttgtaaatctaccatgggaattaaagaaacatgctatcgacttcttgcttagcatcacagatgaaggtgtctccagaaactacaacgaggaacgttctgaatggtcatcttatgtgccaagccttttctcggctttgcaggctgtaaaaatggttatcatgtatgccccagagccagaacttagaaaaaaatcctttactgtgctgaaaggagtacttgctgatattccaaattctcaaagatttgacattatgaaagcattgattacaaataccgactcttcctcgatgatcgccattttcatcgatcttgtcaggaaggaaatgcatacagcaatctgcagtagtagatcaatagtaaaagatgccccacagatagataacaaagcatttccggatacctccttttggaatcccgggatccttgagttggtggagttggttctaagacctccacagggcggacctccttcccttcctgagcagagtgatgcggtgttgtcagccctcaacctatacagatttgtattgatgacagaatctgcaggtataatggcagagagccatagtgattatgatgagtttgcagttgacactgtatgcaccctaaatccacttgagttggtgttgtatcggtgcattgaactcgtagacgagaagcttaagcaatccacataa

SEQ ID NO: 35214 - DNA, 213 bp, Glycine max
  Peptide Sequence Number=SeqID_151992
atgactcctccacggcttccactatggcatagaggatgggcaacttaccaagatgtcttcctcgcccgacacaataaccaaatgcccctttactacgaatttcaatttttggtggaatgtgtgggggcctatctgtatagggaggtcgatctcccccctaacttctcggcgggtgccgtcgaaggcacagaccaccatggaacttggctttag

SEQ ID NO: 35215 - DNA, 396 bp, Glycine max
  Peptide Sequence Number=SeqID_151993
atggctgagaagacaaagaaaaaactagaggaagctgctcagtctggaagcactgagggtgtcattaaccctccatctcccatcagaggacacgtgaagtggaagatgacccgcatgaagaaaactgggcagatgatgtctgaggccgcaaaggaaatcgctgacaagattgattctttggaggaacagacgtcacaaggttcgtttgtcccccatggacgtcaggatgtcctgactacttccattggacgaccaaaacaccctggccatgtgcgtgctgctggagccagtgtcacgatcaagcaatacttcagattggctccacaaagctcccgcaattcctcctccatccctcccgaagaactcgagaagctgactcaacaaattagggactag

SEQ ID NO: 35216 - DNA, 522 bp, Glycine max
  Peptide Sequence Number=SeqID_151994
atggctcgcacgaagcaaacatcatacattgctaaacgtgacccctccaatgaaggctcgttgcaggaaggagaaaatattgcagagagacatcatagacagttagagctacaaccacaaccacaaccaaggtcaaggctagttgctgataggatcattagacctccatttggaggaggtctagttgattggtcccttcttcagtcttatagggaccactgtgcttgtcatatttggataggagtggtcagaattgaagcttgtcaaccacaatgctcaagtactaccactctcgactcatccataaagatggcacgaggaaacgtcttccacctacctgttagagagatgaccatcactctggattatgtgtcttatccattgcacttgcctgtgataaacaggctcattgatcatgtcccctcactctttgacagagagacaatgaagattctgctgatgactcatttggtcgttccaacaaagacaaaggttgtagcgatggcaaacacaagtgttaag

SEQ ID NO: 35217 - DNA, 315 bp, Glycine max
  Peptide Sequence Number=SeqID_151995
atggagaatgtatttgctattgtgtattgtgatggtgacatactttcatcatctaaagtagtattgtttgaatgcccaagtggttcgaaattcatcacaataagtgagaacatgtcacttgatgttgtaaggaaaataattgtggacgcgccatcgaagctacacccagttgttaagccctcctgcgatagttgcaaagcttattgtatgagttggggatggctagtgtcctttggcacaactctaaggtccaacaagctctacatagcttctactgccatccagaatcaatcccgcaataacaattacaattag

SEQ ID NO: 35218 - DNA, 896 bp, Glycine max
  Peptide Sequence Number=SeqID_151996
aaaaatacacaaaggatgtcgatattagtgtgccacaatgtgaggaggtggatgctgaaaaatgttcagatagtgtggatcatagtgtgccacaaggtgtggcggcggacactgaaaaatctacagatgatgtgccactggatgacgaggtgcttgctgaaaaatatgcaaaggatgtccatcctaatgtacaagaagtaaagggtgtgacttctaaaaatgctgcagatgaagtggaacctttatatgatatgccactggactatgctggtcttaatgaagaaaatgtagtcgctgaaaacatttctaaattctttgatgactttgaggatgacaatgaagaagatgaaggttatgatgatgaatctgaagattattatgatgatgatgttaacagtgatcttgactttgtcaggaatctttcaggtgtgcatgctgatgactcatctggcactagtcattatagttatgactctaaatctttgaggtctatacctagtagtgatgaagaggataatggcaaaaagagattagagtctcctcaatataattctgataacggctttggccaagtgcactttcagctaggaatggaatttgatactatagctatttttaaagatgcagttaaggactacacaattaatcttggcagggaagtaaagtggattaaaaatgaccttacaagatgtaaagctcgctgcaaagtaaaagactatccatgggagatttattgtgcatggagcaaagctgcaagaagctttcaaaactcacaagctaataggaaatgggttgcaaacaagctagttgagaagttaaaggtacaccctactttaactcatcatgaggcacatgcccatatgaaggttgactatggtgtgaaagtagaagagtga

SEQ ID NO: 35219 - DNA, 780 bp, Glycine max
  Peptide Sequence Number=SeqID_151997
atgtgcgtcgtgttcgcgttttgggtcttgggtggtggggatggtgtcacgttctggtcgcatggtaaacctccgcgttctcgcaaatggccactggaggaagcacaaccagtatcgagaatggtgtgtgtcgcgacaacaaggagagaggagtgggtagtgcgggaaatagaaagagaaaatattgaaacgggagaaagtgaaagagtcttcaatcacaacgaagcgagcttgagtcttcaaacacagtttgttgttgatgtttctgaggtgtgtgagtgttttaagtcttgcaaaagaaaaattgatttaaactacgcaaggtcaaggctgccgtatatggaaaaacatttgttgagagagagatttcctcccacactgccatgccttgctaatcactttgctcatcctctttgcatatgcaagggtaaggctgcgtacaacatccctcctccataccttcgcatagcgaagagcctctggacaatgggattggagagaggttctgctagataccatgatgggtatggtagactaagatcgtgggcatacagatcacttgactcatacaagcatgagttgctgcgtgtgctttatccactatttttccattgcgtcatggatcttgtggcaaaagggcatattcaggaagattttaaagctcctaatgaggccattagcgcaacatgcattttatgcttctgtataacgattcataattccattggatattctcagcttgaaactttttcaacacctttcgtgaagaccatgaaatga

SEQ ID NO: 35220 - DNA, 477 bp, Glycine max
  Peptide Sequence Number=SeqID_151998
atggcggcgccatggcagaaaggcgtcgcgaaaattaaaagactcaagggaagtattaagacctggaatagagagcaatttggtgaccctttcaagaagtacaagaagattgaggaagagttaaaccagttggaagcggacacaactgacagacatctacagccccaagaactgttgaccaggaggaagttgcaggaagaattatgggtagcggctctttcacacaagtccttaatgaggcagaaagcgaggttgagatggattaaagagggtgattgtaattccaggtacttccatttgttgatcaattcgagccgcaaaaataactgcttaaacggagtgatgatagacggctcatggattgaagagccatcagcagtaaaagaggcagtgaggatgttctttatgaatcgttttcaagaatctgactataacagactgcgtctggatgggatatgctttaggaccattgattga

SEQ ID NO: 35221 - DNA, 100 bp, Glycine max
  Peptide Sequence Number=SeqID_151999
atgggccagaagcgatgcaaccagagcgacgcggcaagaaagcgacaagagcacagtgagaacgcaatgcaaccagttgtgcttttagtgtctatcgatg

SEQ ID NO: 35222 - DNA, 1113 bp, Glycine max
  Peptide Sequence Number=SeqID_152000
atggcttccttagacgccagcagcacttgggaacttgtccctttacctactagcaagaccactgtcggttgtcgttgggtttatacagcgaaggtcggtctagatggcagtactgatcactataaagctcacttggtggccaaaggatgcactcagatttttggtcttgactacggggacaccttttcccctgtggccaaatttgcctatatggatcagcctccaagttttacagttggtgactcccaattggtctgttgccttcgccgttctctctacagtttgaagcagtctccttgtgcatggtttggctgttttagctctgctttgctccaatttggcatgacccgttgtgaggctgatccctcaatgtttttcatccatttgccatctgacctttgcatctaccttgttgtctatattgatgacattgttattattggcaatgattctgcgggtattctttgccttaaatctcatctccacagtcaatttcagattaaagatatgggtccgctcaaatacttcttagggattaaagttgcccaatcctcctctggcattgccatttcccaacggcagtatgctctggatatcttaaccgagaccggtatgcttgattgttgtcctagtgatactcctatggatcctaatgtgaagcttctcccaagtcagggggagccattggaagacccaggaagatatcgacgtctggtggacagacttaattaccttattgtcactagaccagacatcacttttgcagtcagcctactcagtcagtttccaaaagccccgactgatagtcattggaatgctgcaatgcgcatacttcgatacatcaagaatgcacaaggtcatggattgctatatgaagacaaaggcaatgccaaaattggaacttatctcatggaggagcaagaagcagaaaccgttgcaagatctagtgccgaagctgagtatcatgtcatggtactttcaagagaaatcaccactgattttgttagctccaaagaacaactggcagacatgctcacaaaatctctcaagggcactcaagttgacgatatttgtaacaagcttggatcatatgacatttatgctccaacttga

SEQ ID NO: 35223 - DNA, 5995 bp, Glycine max
  Peptide Sequence Number=SeqID_152001
atggaagctagggttgaagcgttagagactgagatctcagaagtgcgatccgctctcgtcaaggtgcagaagtcggtgacgacaaaccacactaatttgatagcaatgttggagaaatgcttgggtaagtcgttgctggttgatgaaggggatgtgagcttctcttttaacggctcgccggcggtgacaaaaaagagggacccacatagtactgttgtcaacaacctttgtggagttgcattgacggaatttcgtcagtccgttaagaaggacacgacaccgaaggtgaaggtgagtttggcgcagttgagtatggaaggaccaacgattcacttctttaactctctcatcgcagtggaagagaatttgacatgggatcggttgaaggaggcattgttaggtaggtatggtggtcacggagaaggagacatttacgaacaattaacagagttgaaacaagaagggacggtggaagagtatatcactgagtttgagtatttaactgctcaaatacccaaactccctgagaaacaatttctgggttattttttacatgggctgaaagaggagatatgcggaaaggttcggagtttagccgccatgggtgagataaatcgaaccaaaattttgcaagtaacgagagcggtggagaaagaagtcaagggaggtggactgggctacaatcgtgggcctagagcgggtagtggatctttccgaaccgggtcaagaagaaatgggtctgattgggtcatggtgaaagggacagaagttgaatcaaggtttactcacttgtcttacaatgagttgatggagagaaaacaaaaggggctgtgtttcaaatgtgggggtcctttccatcccatgcaccaatgtcccgaaaaacaattgagagttttggttgtggatgacgaggaggatggagaggaagaggccaaaatattggcggtggaggtagaagacactgaagacgaagagaagggagaattcagtgtgcttaacctgcatcacatagcacatgagactcctcacacgatcaagttccaagtggggctacacaacttcatttctcgaaaattggtgcatcaaatggagtggccagtggaagctactccccaaatgaaggttaagttgggagatgggttccaaaccgcaacacaaggtgtgtgtgaagggttggaaatgtatattggtgattttaagttgaacccggatatgcatttgtttgagttgggaggaattgatgttgttttgggcattgaatggcttaatactttgggagatatgattgtaaattggaagcgacaaacaatgagtttttggaaagaaaaaaagtgggtgacattaagaggaaacgagggatgtaaagagtcaataatagcgctacagagcattttgaacaagcccaagcccaatatgctaggagtgttgtgggaggcagagaaggtagagcctgtggaagcccaaaatccagaattaacaaaggtggaacaagcagagttggaggaaatgttgagtaagtacgcacaagtctttcaagaaccgtcggggttaccaccaagaaggaaaatggagtatgcgatcaatattgtggaaggccaaggagctgtgaacgtgaggccttaccgttatccccatcaccataagaatgaaatcgagaaacaagtcaaagagatgctgtctacagggattatacgccatagcaccagctcattttcaagccctgtcatattagttaagaagaaggacaacacatggaggatgtgtattgactatcgagccctcaataaggtcagagtccctgacaaatttcccattccggttatcgaggagctattagatgagttgaatggagctaagttttattccaaactggatttaaagtccggttaccaccaagttagagtaaaggaatctgatgtccataagacagcatttaggacgcatgagggacattatgagtttcttgtgatgccctttggactcatgaatgccccttcaactttccaaagtctgatgaaccatgtgttgagtctactgtccacccacagtctagtcgccaatagaaagaagtgtcactttgctcaaagggcagtagagtatttggggcatttaataacagaagagggagttgctgtagaccctagtaaagtggccagtgtgattaagtggccacagcctaagaatgtcaagggggttagaggattcttgggcctcacagggtactatagaagattcataaaagattatgggaaagttgcgagaccgctaactgagcttaccaagaaggacaattttaaatggggagaggaagctcaacaatcttttgaagctttgaaggaaaaactcactacagcacctattcttgctctgcctgatttttctaaaaattttgtgattgaatgtgatgcgtcgggaggaggtgtaggagcaatactgatgcaagacaagagacccatagcctattttagcaaggccctgggaacacggaatttggttaaatctacttatgaaaaggagttaatggcggttgtgctagccatacaacattggagaccctatcttttggggaggaagtttgtagtatccactgatcaaaagagtctgaaacaactgttgcaacagagggtgattaatgctgatcagcaaaactgggctgccaagttgttggggtatgattttgagattgtgtataaacaagggagattgaacaggggggcagacgcgttgtccagaattaacgaggggctggagttaaacactattaattcttatgtgaaatggacgcaagaagaacaagtgcgggcagaaaataagcaagatgagaagttacagagaataacgaaggaagtgcaggaagatcccattctttggcctggatatgaaaggcttgccgcgaatgtatactgggtgggcatgaaaaggaccattcaagagtttgtgaagggctgtgacacctgtcagaggcagaaatatatggcatcatccccagggggtctactccagcctttaccaattcccgcgcaagtatgggaagatatctctatagacttcattacaggcttgcccaaatcaaaggggtatgaagctatcctggtagtggtagacaggcttcatggagtaccactgtctatagtgagtgatcgagaccccatatttatgagtagtttttggaaggaattgttcaaaatgcaggggacaaagctcaaaatgagtactgcatatcaccctgaatctgatgggcagacagaggtagtaaataggtgcctagaaacctatttaaggtgtttcatttcagaccagcctaagacttggatgtcatgggtacattgggctgagtattggtttaacaccacattccatgccgccacagagaagacacctttcgagatagtatatgggaggcccccaccggtgttgaccagatggttgcagggtgaaactagagtggaagctgtgcagagggatttgctggacagggacgaggctctgagacagttgaagagtcaactgttaagagcgcaagacagaatgaggaatcaagctgataaaaggcgtgtggataggagttttgtgtgtggagaatgggtgtttgtcaagcttagagcacatagacaaaagtctgtggtgtccagaattaatgccaagttagctgctagatattatggcccataccctattatagagaagataggggcagttgcatacaggctaaaattaccagaggggtccagagtgcaccctgttttccatgtgactttgttgaagaaggctgtggggagatatcaggagaaagaagaactaccggacctgttggaagaacacattgagatgtatgaaccagaggcagtgttggcagccaggaaagtgaaacagcaaggggaagaagtcaaacaggttctaattcattggaagggcaaaactgtggaggaagcaacatgggaagatgagattatgatcataagccaatttccaaagtttggccttgaggacaaggccacatcagaagaagggggtattgataggacccagccagctgcaggaatgccacatgagcagttgattcatcatgagtcaaatgggcctaaggtttggaaggatgtagtgggagggggaaaagggcatatgggattggaggaatattctagaatgggctctaatgcatctttcattgcctcaatttctaaggtagcggatccacttctgttgaacgactatagacctatctcattgatcggttgcatgtacaagatagtagctaaaatactagccaacagattgaagaaggtggttgatgaagctaaaaggagtcagaagccatgtattgtgtttaaggttgactatgagaaggcatatgatttcgtctcttgggacttcttgatctatatgctaagaagaatgagattctgcaccagatggatccaatggatagagggatgtctaaaatctgcatccatttcagtactgataaatggcagcccctcatctgagttctccccccaaaaggggctcaggcaaggggatcccctagcaccgctcctcttcaatattgttgctgaagccataactggcatgatgtcacaagcagtgggtaaaggcatattcaggggtttcttggttggtcggaacaaagtggaaatcaatgttcttcagtatgcagatgacataatcttctttggcgaggcttctatgcagaatgtcaaagcaatcaaggcaattctgaggacctttgaacttgtctcaggcctcaagattaatttcactaaaagcagttttggagctttgggcatgtcggatcagtggaagattgaggctgccaattatctcaactgtagcctgatgtcctttcctttcacttaccttggtgttcctattggagcaaatccaaggagatgtcagacatgggaccctatcattaacaagtgtggaggacaagctagtgcgattacggaggagattcctatggggatattagcacgttcaacctcgcactgcttggcaaatggaaatggaatctgttcaagcatcagaggaaaatgtgggccaggatactggagtctaagtatggcggatctaaagctggtatttcaccatccgcaacatggtcctgtattggataatgcaaagttgtggagggtcagatgtggtgataaattcatgttctgggaggacaattggatgggaggagccggtcccttactagccaaatacccgaggctgtatgctatttcctgccagcaaaatcacatcatccagcagatgggaatgtacagggatatagggtgggagtgggacttcagatggaggcaatcattgttcgagagcgagatagatatgactgactcattcctaagagatgtcgaatgctgcattattcaaccccagaacagtgatcagtgggtgtggctggcagatacggctggtcaatattcagccaaaagtgcttatagtgtgctgaggggggagtcacccgaggaggtccaagttgaagcttttcaggaattgtggaaattgaaggccccaaacaaaatctcagcttttgcatggaggctattaaacgataggttactgacaagagcaaacttgacatggcgacaaattgatctagaggacaatacttgtcctttttgtagcagcatggaggagagcgctggtcacttgtttttccactgcagaaaatttctccctggggtacaagagctaacagatggaagtggtggtgttcgactatgggatgtgcagagtggggaatgtgtttgggttttcattggtcacaggagtatgattttatctttggcaatgtctcctgatggcctcaatttggcatctggtgatgaagacggcacaatcatgatttgggacctctctagtggctgttgcatcacgcctttagttggtcacacctcatgtgtctggtcactcactttcagttgtgaaggttctcttctagcatctggatccgcggattgcactgtcaagtttggggatgtaactacag

SEQ ID NO: 35224 - DNA, 273 bp, Glycine max
  Peptide Sequence Number=SeqID_152002
atgacagctgattcattagaggatataaattttgaatctccacaagcatttgattctaattttttgtctgaggatgaaaattgtcaatccaacagtaatgaacctgcaatcgatactgaaggctattctaacttgggtgatcaagccatgcaatgtagacattgcaatgcaaaaatgtggtataatgaaagaatttcaaaagataaaaatacagcaagttcaaaattcagcttatgttgtggagatgacaaagttgaacttccattattataa

SEQ ID NO: 35225 - DNA, 231 bp, Glycine max
  Peptide Sequence Number=SeqID_152003
atgaataacagaaagaaaccaatccataggaagaaaaaggaaaaaggttttagaattaaggagactggtttaaaaattgcatatgggttccttaatcacatgatcattttcacccacaaaccaatgaagtgctctgttacaagcaaacaagtacatattcataaacaaagaccattcgagaagaaaacaacaggagttccaaagttccaaacttttggaactcaacaatga

SEQ ID NO: 35226 - DNA, 168 bp, Glycine max
  Peptide Sequence Number=SeqID_152004
atgggtactcatggagtacttgaacatgtgactatagccataaactcatcatctccaaacaaattagtggactccaaatctaacgcatcaatctttccagcatttagaggtgaggtcttgtgtgtcaaggcatcaatgctcctacaggtttatcatgtgtggaagtga

SEQ ID NO: 35227 - DNA, 444 bp, Glycine max
  Peptide Sequence Number=SeqID_152005
atggcctgcactcagttaatttgtttctgctttgtaatttggagtctggtcgtaggagcgagtggaccaagcaatgccggcaacggtgctggtgcagtgtgcttcttactcttcttcgtcttcttctttgacttgggagcgggaacctcaacgttgggtgctaccacgagtgccagagttgtcgatgccagtgcagggggagagttcactagaacaggtgctggtggaaaactcactgaaactggcactggtggcgagctcacaggtgtcacagcaggaggagtggtcgcgggaggtgtggccaccagaggagtggttgttggagttgaagtagcagctttagacggaggagatgctactgtgggagatgaaacgggaggggttgcggttgcagcattgggggatgaagtgggagaaacaacagcgcagttgatattggtttag

SEQ ID NO: 35228 - DNA, 1444 bp, Glycine max
  Peptide Sequence Number=SeqID_152006
ttccaacccctccccttccttcccttcatcatcttcttcataccctccttttccttttctcaaccttgagaatgcttctgcaagcaacactcttcttcatgatgcactttctgtgccttacataccaactcatcataacccttcaagcatccaagaagcactgaacaattttccagtcacagatcataactgtggtggtggcggtggcagtggttctgcaatgaccaaacctgaccctaatggtggtggtgctcctcagtatggcatttcttgttttctcacaaagaagccacctaagaaagacaggcacagcaagatttacacctctcagggcttgagggaccgaagggtgaggttgtccattgagattgctcgcaagttctttgatcttcaagacatgctagggtttgacaaagccagcaacacccttgagtggctcttcaacaagtccaagagagcaattaaggagcttgcaaggagcaagcacagcaacaacaacagtgatgaaggagccaagagcttctcttcttcatctgattgtgaagatggctgtgaagtggtttctgagatcaagcacaaacaacaacaactcatcacttgtgatgctgctgctactactccacacaacctacaacaagggttggattcaggtgataacaagtcaccaacaacattgatggctgcaaaggagaggatgaagttgaagaggacacagaaggaacctgcaaagatgaaggagtcaagggagaaagcaagagcaagagcaagggaaaggactagtaacaagattattatgtgcaatgttaacaccaacaacacaggagggaaggtgctacaagacttgaagaaaaagtgccctgcaattgaaaacaaccacactcaaattatgcatcaatcaaggtcatcacctactcatcaccctcaccaccttgtgggaaatgaaacacctagagatgacttcaacgttattgaggaatcaattgtgatcaagagaaagttgaaaccatctttgatgtcctcttctgatcatcatcatcatcatcaccaaaaccttgtgatgcctaaggaaccaccaagcttcaacaacaacaacagtgagtaccaccccttctccaatttgtctccgaattgggatgctaatggttccactggtcgctccaacttctgtgccatagctagcatgaatctatccacagggcttcaaatctttggaaagtcttgggaggagtgcatcaatccactatcatctgattcgaatgaaactcttgtagttggttggccaagaaatcatatggaggcatctttctgtgttttccaccagaaactcgtcctatattccctttccacaatgtttgtacctcttctaccttttgctcatcatcatctcagccaatggcgtgtgacagttggcagaaaggttgctgctgcttgtattggtttctga

SEQ ID NO: 35229 - DNA, 264 bp, Glycine max
  Peptide Sequence Number=SeqID_152007
atgacaggtgttgtagcgttgccgcagagaatgcgtgagagtgagagtgagaatgagagtacgagagatgaagttgatgacaaaaccgaatctaataatactgctaatagtcaagtatgccaaatgcacagaacattaagtatgacgcaatcctaccccctaaggacattggatagaagactccaagaagattgggccaaagatgcaagagaaggccctagggttctcatgagccttagggtagatttcgagcccatgggctaa

SEQ ID NO: 35230 - DNA, 197 bp, Glycine max
  Peptide Sequence Number=SeqID_152008
cattcttagcaagctcaaaatctaaagagagtcttgctcagaatctcaaagaagttctccaactacttcaacaggaagtggaagaagaaccttccaagaaggaagctgaatcatcagagactaatgatgaccaagaagacgatccattctaccagaatgaagatgactgtttcggtatatcattagacgaagattaa

SEQ ID NO: 35231 - DNA, 3606 bp, Glycine max
  Peptide Sequence Number=SeqID_152009
atggccgaccacgcgacaaggaagaccacgacggacagactcgaagacgccattacccgattgacccatagcaaggcgtccctctccgataagtacccagaattatcaggcaaagtcgattccatcttggatcatcttcgcctacgagacacgaattctaacaaccccaacacccatgcgtccaccgcccaaaggaaccatgtcaagttagatattccgaggtttgacggccgcgacccgctcgggtggatctttaaaatcacccaactgttcgattaccagaacacccctgaagaagaaaggatcactgtggcatctttctatcttgatggtgcagctttaagctggtaccaatggatgttccgcaacgggttcatcacgtcatggacgggttttttacaagctcttgaatccaggtttgctccaacgttctatgaagaccccaaaggcgcccttttcaagctagcccaacgaggcacagtcaatgactacctcacggagtttgaaaggctagccaaccgagtcatcgggttaccaccgccgtttatgctcagttgtttcatctccggcttatcaccagagatacgcagagagggtatcgaatggctcaagcagtttgggccggttattactgactacaccgcccttattatgaagtttcaccatttgggccaggccattgagcttcacgcagacgtttcaaataggcccgaacctgtctcagtacctcaagtaaaacgcttggtccgcaccgggtccacatccgccctattccacttaaatctactacccgtaaaccgacccgaaccgccacgtcatcatcttcctcaacatcatcttccccaccccgaccctgcaatcgaaaatcttctccggcgctaccaccaaattttcaaaacacccaccacacttcctcctccccgaaccgttacccaccacataaacctcctcccttcatcatctcccatcaacgtaagaccatacagataccctcatttccagaagaccgaaattgaaaagcaagtctccgatctgctcgcggcaggcctgatacgaaccagcataagtccatactcctccccagttcttctagtgaagaagaaggatggaacatggcgtatgtgcgtggactaccgtgcccttaacgcagtcaccgttcgcgataggtttccgatacccactatcaacgaattgttggatgaactagggcaatcatcttggttctctaagttggatttacggcagggctttcacgagatcctgatgcatgaaccggatattgagaaaacaacattccgaacggatcaggggcactatgaatatcgcgtgatgcctttcggtttgagtaatgccccttctacatttcaagcggccatgaacaacttgctcacacctttcctgagacgttgtgccacggtatttttcgatgatattctagtttatagcaaaggagttgaacctgaaccctctaagattcaagctatgctacaatggcccactcccacttctgttagagaacttcgcgggttcttagggctaacggggttttatagaaaatttgtaagggattacgcgtccatagcctcaccacttacaaccctcttatgtaaggatgccttcgagtggaatgaagattctcaagctgcctttgatgcccttaaatccgcaatgactcgagctcccgtactagctcttcccaatttttctgagccatttaccgtagaaacagacgcgtcgcaaaccgccatgggcgctgttttggtacaaaaggatcacccagtggctttctttagcaaagtatttggtcctcggttaacccatgcctcaacttacatatgtgaacttcacactatagtcacagcggtacgaaagtggcgtcaatatctcttagggagatctttcactatcctaacggaccataagagcatccaggagcttatgacgcaggtaattcaaacccctgaacaacattactacctctctaagttgttagggttcgattacaccatccgctacaagtccggcgcttctaacattgtagccgatgctttgtctcgtgcaccaccaccttccggccagcttctgttactctccgtccctcacttggatttcatctcagacctccaacgatccttacatagtgaccaggagtttcaaacactgctctcaaaaatccaagcccaaccctcagattaccccaaccaccaacttcacaatggcctcattctttcccagggacgaatctggttgcccaacacaaacccgtatatacctactatcttactcgaataccacgcaacgccattagggggccacatgggtgtcgccaaaacaacacatcgtctcgagtctagcttcacttggcagaatctcaaaacagatgttaaacgttttgttcgagaatgcaaggtctgtcaacagaccaagacaagcactcgccggccgggaggattgctccaaccactttctcttccaacaggggtctgggaagatatttccatggattttataacccatttaccagcttcccacggttacacaatcatcttcgtcatagtagatcgcttctccaagggcgtgcacttaggagctctacccacacacttctcggcttacaaagttgcaaccctcttcattgatttggtatgcaagcatcacgggttcccccgcagcatcgtttcggatcgcgatcccgtgttcctgagctcgttctggcgagagctatttcggttgcatggaaccctcctccgcatgagtacggcgtaccacccgcagaccgacggccaaacggaggtaatgaaccgagtactcgaacagtatctacgctcctttgtccactcacagccggcaaattggttccgttacctagccctcgcggaatggtcctataacacatcccttcatactagctccggtttcacaccattcgaggttatttacggcaaacctccgccgtcccttcctcattaccttccaggccacaccactaacgaagcagtcgacaccttgctcaccagtcgtcaggagatccataccaaactccggcagcgtttattaaaggcacaagaggctatgaaacaccacgctgattcgaaacgagaagacgtatcattcacagttggacagtgggtctacgttaaactccatccacatcgacaacgttcagtcaccggagacactcattccaagctctcgaagagattctttggacccttccagatccttgaacgcataggtcccgtagcatatcgccttcggttgtcggacaatgcacgcatccaccccgtcttccactgttctcttctccgagcccatcacggtcccccgccatcttccttagacacatggcccttgcaggttgttgatcacaggccaattccacatccattatgtttcttagactcaaaaatggatcacactacatctccccctacgcgtttggtcctcactcaatggaaaggtcaaccccccgaagacaccacttgggagccttggtctgagctacgcgactcctaccaccttgaggacaaggtggttttcggggaagggggtattgatatgctcatgcataacccagcacccgaagcaactaacccatcactcgga

SEQ ID NO: 35232 - DNA, 942 bp, Glycine max
  Peptide Sequence Number=SeqID_152010
atggaagatccgagggcgctgtatgtggcggagcagaaggcgagagaggcggttgcaatgaggtctaaggtgcagaaggagatgatgttgaaggagaaggagaggaaggagcaggagttgagggcattggcacagaaggcgcggtcggagagaattggaggggagagaattggggttgtaccagcggcaccaccgtctgtgcctgtggatgaggaggatatgagaattgattatgatcatgagaaggagaatccgagggagagggagagggagaggagttttgtgaaggagagtagagatgagagggaggagaggatgcagcgtgagaaaattcgcgaggagaggaggaaggagagggagagggagagaagattggaggctaaggatgctgctatggggaagaggagcaagattacgcgcgatagggatcgtgatatcagtgaaaaagttgctcttggtatggcttctaccaagccgggtactgaggttatgtatgatgagaggctgtttaaccaggataagggaattgcgtctgggtttgccactgatgatcagtacaatgtgtatgagcatgggttgtttactgcgcagcccacactttccacattgtataggccgaagaagaatattgatgatgagacttatggaggtgcggatgagcagttggagaagattatgaagactgataggtttaagcccgataaagggttttctggggcttctgagagggctggtccaagggatcggccggttgagtttgagaatgaggaggctgatccatttggtttggatcagttcttgactgaggtgaagaagggtaagaaggccatggagaaagtgggtggtggagggactatgagggcaagtgctggatcatcgatgcgggatggtaatgagggaggttcaggtaggactcgcattggatttgaaagagggcattag

SEQ ID NO: 35233 - DNA, 1191 bp, Glycine max
  Peptide Sequence Number=SeqID_152011
atgcagctctttgtgaggcttgtgaacaagacctccattctcacacacggttgggttgggcaagtagaggattttccatccaacatctacaacctagctaggcaaagacaagcagcacaaagaggggaggttgcagcagagatggaaggtaaaaccatggatgaagaagcaagaaattttttaaatgtagggttcatcagagaagtgcaatacaccacatggttagccaatgtggtgatggtaaagaagcctaatgggaagtggacgatatgtactaactacatagacctaaataaagcatgccccaaggattcctatccgcttttaagtatagatcgcttggtcaatggagcatccaaattcctcattctcaatttttttggcgtgtattctagatacaatcatatctcaatgttcaaacaagataagcaaaaaacctcattcatgattgacacaactaactactattactactcagttatgccattcgaccttgagaatgctggagccacttatcaaaggttgatggacaaaatattcaccaatcaactaggaaggaacctagaagtctatgttgatgacatgatgctctatgtagatgattcatccaatgaaaaaagaagtggagctggagtcatcctagaaagccaaaatgaagtaatcctagagcgatccctaaggttcaagtttgagacgacaaaaaaccaagctgagtacaaagccctcttggttggcctgagatttgctaaggaagtaggagctaagtacctaaagtgttggagcaattccaaattcatcacagaggctttttccaaatttgaccttcaacatattgttagagagaacaacgaaagagttaacttgctatcaaagttggctagtacaaagaagaaaaaccaacatagaacggtcatcaaggttgtggcgagtgtaactcccatcgaccaagaacagatgactaagatttgggacttcttggagaaaggctcactcctaaaaaatccaacagcgacacaaaggcttaagagaaatgccagctattatgtgatagggggaggagacctatacaagaaaagcttcattggccccctgttgaagtgtttaacccgggatcaatctaaatatgtaatgaatgagatgcgtagagggatatgtggaatgcactcaggatctcaatcaatgagtccttag

SEQ ID NO: 35234 - DNA, 408 bp, Glycine max
  Peptide Sequence Number=SeqID_152012
atgaaaaatgttgctaccgatctcatttcctcagcttcctctctggtggagtctcgatctaaaggtcacatggctcactctatgctaaaattcaccattcttaaggctcttttagtcaacatccaccctcctaaagccactcttattaaacggttctgccagagggtccctggtcatgttggttttggccaattgtttcgtgaccactctagaggttttattggtggtttctctacttacataggtattcaatctcccctctatgttgagattttggatgtcatccttactttggaaatagccaagcagaaagggtggggcaatctttggatagagtgtgactcctcttcaactattcaagcttttaagaacccctctttggttccttggagccttcgtaagcaatga

SEQ ID NO: 35235 - DNA, 792 bp, Glycine max
  Peptide Sequence Number=SeqID_152013
gaggcctgggactgttactcagataatgtgcttgccaggaacgttctactagaaagaaatttcaagttgtatatcaatgagttcgatgatttcagaagagaattgattagaagaaactggcataaacagctaaccaggttgacagagggaagcattaatgtagcaattgtgaaggaattctatgcaaatctatatgtccctgaggacaagtttccaaagcaagttagggttcgagggaacctaataaaatttgatgttgattccctcaacacctttttggagactccagtggttgtggagcaaggggaaagcttaccttcttactccaggtttgctagactgaggcctgatcctcaggagcttgcagcccgactgtgtatccctaagaggggatttgttctgaatgccaagggtttgttgtggaagcttttgaggaaagatcttaccactcttgcccaaacctggagtgttctatcttattctaacttggcctcgacatcccatacttcttatcttaatctggatagggccaagttagtctacgggcttgtaatgaatatgaacatgaatttaggatcactcatttctggtcagatttcactcattgctcagtccaactcctcgtggcttggatttccaactctgattactgccttgtgcaaggcccaaggagtcacctcagattgtcttaccttcgaggcattgggtagaagactccaagtagattgggctagagatccaagggaaggccctagggttctcatgagccttaggatagatttcgagcccatg

SEQ ID NO: 35236 - DNA, 204 bp, Glycine max
  Peptide Sequence Number=SeqID_152014
atgaaatttctcacaacactctctggctgtaggaaagatgtagaagtgaagtttcctctaatttcgggaggatctgatgtacctccaaactatattgaaactgaagaggcagtgaggaagctgaattgggaaacctctaaacttgctgcagataaacacagagagcagcaattattggattataggaaagggaaacttcactag

SEQ ID NO: 35237 - DNA, 222 bp, Glycine max
  Peptide Sequence Number=SeqID_152015
atggctgaagagtgtgctattttgaactgtggtggagcttaccttcatagagcttttttagttgcttgtggagttatgatacgtaaccatgatcatgaattcattttttatttttcaaggagacttgggcattgttctgtgttagaggttgagttatgggctattctccatggtttgaatgtggctttcgatgctgatgaagctaagggtcgaattggatag

SEQ ID NO: 35238 - DNA, 195 bp, Glycine max
  Peptide Sequence Number=SeqID_152016
atgaataggtggatgactatgcagaacctcatgctagaggacacgggaacacaacgctctgataggattatatatgtgaggggtagagggtgtcacaacttcggtgacggcgggaggcagcaacgagaggggagggtcctacgacaaaggagcgaggtctccatcgattttgaagacgaaggagttgatttataa

SEQ ID NO: 35239 - DNA, 621 bp, Glycine max
  Peptide Sequence Number=SeqID_152017
atgggagctgcaggatacaagttggaggtgcaggatttaaatgcctacaatgaagctttggcccatgtagtttatcaaaaacaattttttttaagaaaacgaggtcgtttgggctttggaggtttaatactcactctccctgttaccttagtttcactgcatcgccttcgtcgatcgaagtggagcttcgatttcataggcggcgttgaaggtacgattttccgtttccattgcttcttttatttcccttatattaggacaaagcgttggagagggttaggaagaaatggggttgtcattgatatcaagagtctcggaagagttcagttgggctatggtgtgaaaaagctagatggaagatattatcagggcctgctgatgcaaatgagcatgatggctacaccggaaatcaacaaagagttgcattacctaaacaaggaagatcggttattgcgttggcttttggttaagcagcgtaatacaaaatttgggcttgactcctatggggatgaaggcagatatgagctaagcaaattctcccagatcggtaaacatggtgatgaggatgaggatgaagatgatgaggaatatgaagtgaacgaagaagaaacagtgaactaa

SEQ ID NO: 35240 - DNA, 591 bp, Glycine max
  Peptide Sequence Number=SeqID_152018
atgagacctagatttttctctccctctcccttcccgacggcggaccaaatcatgctggcagccttcattcccccgttgtttgccttcatcgtcgtactggcttcgtttgaaacaaatctattcaaccgatacggaggttttggtgggaggtgggaggtgggagcaccaggcagtgtagttgcggagaggagtttggtgcagaaggagcggaggatggaggggtcgacggcgtcggggtggcgatggcatgccgtcgatgtcgggctcgaccttgatgagagagttgtgtttttttttttttgtttcttgatcggtttttggtttctagatctgagaaaaagagggagagccgttgtcgttgccatcgccgctacggtgggttcacggtgtgggttgttggtggatttcctgatacttcacggtggtttcgtcattgtcttcgccgtggtggtttcgatggtgtcatggccgttggctcttggtggcagcgacgcccattttagtggtggattagacttgggagagatgaggacagagggacaaagtggcaaaaatgaagggaaaaatgaaaaaatcttagcctttaattaa

SEQ ID NO: 35241 - DNA, 135 bp, Glycine max
  Peptide Sequence Number=SeqID_152019
atggcgcctatcccgccagaaggaatgacggtaccccttgcctgtcccgctgctgcgactagcggtacccactatcccgccattagcactggcggttcaagcttcccaccagagtcaatggcgacacccacgtaa

SEQ ID NO: 35242 - DNA, 279 bp, Glycine max
  Peptide Sequence Number=SeqID_152020
atgtctataaaggctatttccattcaggctgtgtcccagaggatgtttctgatcttggattctcatggagatttacatttgctatccctatcaaattctggcataggagtagatatcaccggtaatgtcttgcaactgcctcatattatgaaagtgcgaagtcttgctgttcttcctgatctatctactaaaatttgggaccagtgtaatccaagagacaaagtgtctcccaatcatgctctctcatctatacggaaaggacaaagtgttaggatataa

SEQ ID NO: 35243 - DNA, 627 bp, Glycine max
  Peptide Sequence Number=SeqID_152021
atggatgtggaagaaggaactggaaaaatcgaagagaagagctttcacgaaaaactggctctagataccattttagaacaggctgctatggaaagagaagtggaattggagcacagagcagttgagtcatccactgcacttgcaaggatacagctgcatgtcaagttgtctatgcggctaaaaaattctgtatatgaactttgtaatctagagctttttcagaaaacatgtaatcagattctaagcacaggcagctatcactgtcagttacttacgggattgcatttttgcgatattttcacacatctttttgtgttagcctatttacttagagatgaggttggctggagcatttttgggcagctatgggctgcttatattgcttttggcatccttagagtagcagatgagaggacagcaaaagccacagaacttgagcagaaggtggcacttctcgaggttgaatgtgcatctttaaatcaagaactacaagatatggaagcccgtgtgcgccgggaacaaaaaaaggcaccagaagaggcaaatcaagtaattcaggctgaaatgcaaaaaatgagagttgaaatggctgccatgaagagggatgctgagcattactcacgtcag

SEQ ID NO: 35244 - DNA, 498 bp, Glycine max
  Peptide Sequence Number=SeqID_152022
gcttttgacaatttgaaagccgcaattaccaaggcaccagtactggcattgcctgatttttccaaagcctttacattggaaactgatgcctctggtattggcattagggctgtattgagtcaggaacaacacccaatagcttttttcactaagaagttcacacctaggatgcaaagacagtcagcttatattagggagtcctatgccatcatagaagcagttgcaaaattcagacattatttacatgggcatcgatttgtgatcaaaactgaccaaagaagcctcaagtcactcactgagcaagcaatccaaacaccagaacaacagaaatggctacacaaattgctaggatatgacttctctattgaaaacaaactggacaatgagaatttagttgcagattccttgtctagatcatttttcatggcatggtctgaaccaaaacttaagttaattcagttgttgaaagaggcaatacaagctgactctcagttgtag

SEQ ID NO: 35245 - DNA, 429 bp, Glycine max
  Peptide Sequence Number=SeqID_152023
atggacacctatgttagtcctttgaccgctcaaatcactcctaacgttgtcggagaagaagaagctgacgacagacagaggtcaccaaagcaatgtagtttacaaaagaaaggtgaaacaaaagatattgagctggtagaggaggaacaggcacgtaccaacaacaaccaaaccttaggaaatagcctaagcgtgtccacacgacactctcacttagggaactgtgctgacccccctcccataggtgatcagcctgggagcccaaaggtgttccctactgttggatcgagtggcctcagaataattaagaaagggggcctacctccaatccccaagcgacctgcggtccttgagatttctttcaaccttgtaaaaatccttttacaagcaaagatccacaagggatgtaccctcccttgttctctttga

SEQ ID NO: 35246 - DNA, 312 bp, Glycine max
  Peptide Sequence Number=SeqID_152024
atggtttttcacttaaggcttgtaatgagcttcaaaacaaagaaaggggaacataggctcaaaggggctatcaaaggaattaattcaaggaagtatcaacaagaatcaagccaaggctattgtgcaagcaatcaatggggcaaaacacaccaaaagattatgttgatggatgattcaaattctcacaaaggtaaacttatcacttttaaattgagctttcaaaactatcatgacatgcagaggaaaaacaaggatttcaaatcacaaaatgtcaagagacttttattttcagaacaattacccatttcttga

SEQ ID NO: 35247 - DNA, 366 bp, Glycine max
  Peptide Sequence Number=SeqID_152025
atgaccatgattacgccaagctcgaaattaaccctcactaaagggaacaaaagctggtaccgggccccccctcgaggagaaagcttggttaggacgggaattgcttatcatgtgagtgatggcatcttgaaagttgcgggaaatagtgaagctaaagtgcttattttactgatgctttcagtggctggattaggcgcctttatgagctctacaggcgtggttgctgtattcattcctgttgtaataatgatttgtcgtcaaatgaatatttccccaaaacgattaatgatcgaattcctgcagcccgggggatccactagttctagagcggccgccaccgcggtggagctccaattcgccctatag

SEQ ID NO: 35248 - DNA, 528 bp, Glycine max
  Peptide Sequence Number=SeqID_152026
ggtgcactgattgatgaatggaaattcgatttttctgtgcatgatgcccgctggttggtttgcaccaaccaagtggatatggccagaaggcttcttgctggttcgttggcttttgaaagtcgcatcctccattaccttattgttcgcattttgcttcctagatcttcaaaccttgcccaggtttctgaagaagatctcattatcatgtggacctttcataaaggttttcaaattgattgggcacaccttgttagatatcgcatgcataaggcattgcgattgaaagcccctttgccttatcctcatcttattacccttttccttcaacacttcaacatccctcttgattctgaaccctatgttccaatcaagagatcattccttataggtgcttcagtcatagcatcctttggttatattaaggagcatgatggctcttgggtaaagaagggtgctagaaatgttggtgaagaaggacatgagggagaagattcatctcttctttcgaagattttggaaagggactaa

SEQ ID NO: 35249 - DNA, 450 bp, Glycine max
  Peptide Sequence Number=SeqID_152027
atggttgactcaaatttcactttttcattaggtgcacacacttttggtcgttcccaatgtcaatttttctcccaaaggttgttcaacttcagcggcacaggaagtcctgatccaaccctaaactcaacctatttggccactctgcagcaaaatagtccccaaaacggaaatgggtctacattgaacaatcttgatccttcaacccctgacacttttgacaacaactatttcaccaatcttctcatcaaccaaggtcttcttcaaacagatcaagaactcttctctacgaatggctcttccacaatctccattgttaacaactttgccaacaaccaatcagccttcttcgcagcatttgctcagtcgatgatcaacatgggtaacatcagccctttgactggaactcaaggagaaatcagaacagattgtaagaaagtgaatggaagttaa

SEQ ID NO: 35250 - DNA, 160 bp, Glycine max
  Peptide Sequence Number=SeqID_152028
atgtattgtagttaccaaccagataatgcaacaagatcggttgtgtctaggccaaccgcagagaatttggatgagacattggctaggctctcaaatggagaaggaagggagctattggcaccagcttggtttgcagttagaccatcccttcttccgagta

SEQ ID NO: 35251 - DNA, 348 bp, Glycine max
  Peptide Sequence Number=SeqID_152029
atgtcgatttcccctgcggaagtatccattggtctgtgccgtcatgacataggtaaggatcgtgcccacaagacacccagtggacccggaggagcccaacaaggtcttggagtgattgtcgcccccagcaaggtcatcaggccccctactaaccgagctttcatcaagaagtactgttcccccaggcaggcgcaaggcgaggcaccacaacagcctggggatggccggcagcgggcaatagacgcaccgccaccacctccagagcccctcaactcatctacaaaggctagagcgttgcctacgacccgtggccgactagcaggcgaccaagtccaaagccaaaggtaa

SEQ ID NO: 35252 - DNA, 1386 bp, Glycine max
  Peptide Sequence Number=SeqID_152030
atgaactctcagccagagcagaccgcgtttattgaagacaagtcgatagattttgttcccgccggggagcgtcatggccatgcccgcagcctgtttaccctgtggttttgcaccaatattgcgccgctggcggtcgtgaccggggcgatctccacacaaacgtttcatctcaatattctctcggcgctgagcgcgattatcgccggccacctgttcggcggtatttttctggcgctgacctctgcccaggggccacaggtcggaataccgcaaatggtgcagagccgggcgcagtttggccgctacggctcgctgttggtgatcgtgttcgccacggtgatctatctggggttctttatttccaacatcacgctttccggcaaggtcatccataacgtcatcccgtcattgaacatgggcgtggcgacggtgattggcgcggtgttggcaacgttgatcggggtggtgggctaccgtttcatccacaagatcaacaaaatcggcgcctgggtgatgggcagcgcgctgattctcggattggtattgatgttttctcaaccgctgccggcggatttttggcagcggggatcgttcagcattgccggttggttcgccacgttctgcatcggcgccgtctggcaaatcagcttctcgccctacacgtcagactattcgcgttacctgccggcggaagtcggcattgccaaacccttcctgtatacctacctgggcgcctgcagcggcaccattttggccttcgtgttcggcgtggtggcggtcaatctggtcgccggcagcgacgatgccatggaggcggtgcgccaggcgacgggagggctggggccggtgttgatggtgctgtttctgatcaacatcatctgccataactcgatgaatttgtacggcgcggtgctttcactcatcactgcggtacaaaccttcttaccgcagtggatgccgaatgcgcgtatacgcacgctgttctcggcgctgattttgctgggggcggtgtgggtggcgctggttgcctcggccaacttcgttcatctgttcctgaacctgatttttgccttgatttcggtgctgctcccctggtgcatgatcaacctgattgatttttacctgcttaaccgccaacgctatgacatttcggccattttcagcgccgacggcgggcgctacggcctgctaaacacccgcgcgctcggcgtttatttcggcggtattgcggtgcaggtgcctttcgtcgagaacgcattcttctccggcccttacgccaatctgatcccgggcgcagacatttcctgggtgatcagcatggtgctgaccggtatcgcctacccattgtgttgttcgcgacgggctaactgggcggtgcaattataa

SEQ ID NO: 35253 - DNA, 447 bp, Glycine max
  Peptide Sequence Number=SeqID_152031
atggcagcgaccaagtcgggtcttgcttcgtcgagttctgcaagtgtgaagaagaagagaggttgttctagtagttattgttatacttatcttctattcaacaacattgcagatttttttaaagaacttccacagtttgttgttaaagctggtccaactttaagtaatctatatggcatagattgggaaaacaggcttgagattgttatttatttatcatgtaacttacatataaaaacttcaagaggtgctgtgtcccaaggcaatggatctgtatcaaagtttgttatggcagataaaaagatagataacaagattcttatggtaacaaagaaagaaggattcctccataaaaaccatgttgatgtggaatcgaaaagacaacttctgaagcagcaaatgctctttgataatcaccaaagagatattcaagtagggagcaactaa

SEQ ID NO: 35254 - DNA, 408 bp, Glycine max
  Peptide Sequence Number=SeqID_152032
atgatgctagcgtggcatgatggaggcgtgatggttctggatcaaggtgggggttgcgacttggatctgggttgggtcggggtcaaaaagaggctaggtggcatgtcaatggtcttgatttggttagaggggggtcgcgcgacggtgcttgaggacagcgatggagtgacgcgggattttggggaagggaagtctgagggttctattcaacttgctcgtctcctgcggcgtgttcaacaatcggcggcgaaaatgccttcccacaagacgttcagaatcaagaagaagctcgcgaagaagatgaggcagaacagacccatcccttattggatccgcatgagaaccgacaacactatcaggtacaatgctaagcgcaggcactggcgccgcaccaagctcggattttaa

SEQ ID NO: 35255 - DNA, 204 bp, Glycine max
  Peptide Sequence Number=SeqID_152033
atgaggtgtctctgcatgtcatcggacttgccgtctccggatgacaaaggtgcggataaccatgaggtgcggataaccataaggtgcctctacgtgtcatcaaacttgctgtctccggatgacgaaggtgcggataaccatgaggtgtcttcgcatgctatcagagtcgattgtctctggatagtaagggcgagactaaagtag

SEQ ID NO: 35256 - DNA, 1073 bp, Glycine max
  Peptide Sequence Number=SeqID_152034
tggtgcctgaatcaagtccgggggtgaaacaactggtggaagaagggaaggttgttggagatcctactaataatatagagattgagttagagaataaaaagcagggatccattactggtgtcaatgttgggaaggaaaaagatggaagtgatggaggaagtgtgagtaacgtgattggttcaggaggagggaacatgcgaaatacgatctttaaggatgatgttcctaaacaagttgaaattcatattacgaatggatacaagaattcccaaggagctcgagctagtgaaattgttgctcaagttagtgctaaggatacaactttgtgggcaggggggagggggggcaagaatcacacaaacgatactttacagctcttaaagatgaatgttccattgaatggcattagtggtgataagttaccgattgtcaaggagatggaggagaatgcgatggttcctttgaattccatggaccatatatcaggtggacatgatgaagtaatgctacagaacattgattctaatgaagaaagtggcattaaggtggaggttattagacactcttgtcagttagttcatatgagagtgagatggcgtgataaccaagcttggttcctaactatggtttatggagctctaaaggttgtgggaatgcaaactctgtgggatgatttgttttacattagtaatggtttaactagaaaatgggatgttattggtgacttcaacagtactctgtcaactacggagagtatagggagttgtaattttcatggccaccatgaatggttgaataggattatgtggtggatgaagtctaatcatcgtcctcttctcttgaggttagataatctggctaataaaaacaaccacaggaggcctttccactttgaggcaacatggaccttccatgatggttttcaagaaaattgggttaatggtcctaagcaattggaaggaacggtaactacttactacaaagatctttacagtgatgacattgtttattatcattttggtgttactcatgcttttccaaggcttgatgatcatgatttgaatgagctttag

SEQ ID NO: 35257 - DNA, 645 bp, Glycine max
  Peptide Sequence Number=SeqID_152035
atgacttttcttccaaaaagggtgtgtgatgaaattgataaagcatgtaggaactttatatggggggatggaagagaagagggttgttgttggtattcagtggatgagatggaaaactttgtggctagccttgctcatctggagaggaggcataaggctatttttaacagtgaggtatggtctattatggaagttattcagcgaccttgtaatttggctcaagcatacaaagataatggtctcatgtttaaatctctctcttcttctaattcgggtgcctccaacattgatggtatttgctggaaatctcctaagcatgaccaggttgcccttaattgtgatgttgtggtcattcaattagggaaccaagctgcttatggtggggctattcgagatcatcatggggcttttatttgtaattttcatgccaaaaatgggtcttgtgctgtcatttatgcagaactttgggccattcttttgggcataaagttggcttggtctcgtggttttagaaggattcgtgttgattcagactcattaaatgctatcaaattgttggaaggaagttgtagtagattccgtccttgttataatctggtcagagatattcatcaagggtatgcaaattcagggaatcactactaa

SEQ ID NO: 35258 - DNA, 225 bp, Glycine max
  Peptide Sequence Number=SeqID_152036
atgaggcactgttatagtctccaatacaccaaatcaagaaacagtttctcctcttcccatgtgaagagaacacgaagcatttatattgttgagccgcgtcatggaatcgagagctccaagtgggccatttttggtaagcagaactggcaatgcgggatgaaccggaagctgggttacggtgcccaactgggcgctaacctagaccccacgaagggtgttggttga

SEQ ID NO: 35259 - DNA, 330 bp, Glycine max
  Peptide Sequence Number=SeqID_152037
atggcctcatatggtgtggcgtctcctctctctcttcctttctccattccgctgccattcatcttccaagaagcaaaggaatccattgatgaagaagatcctaggcctacaagctccaatggagcttgcatcagtgaaggaaactgcccattcctggtcattaatcttgggtttgctttagtcgctctcgtcttgatacgtcttggaatagtagaggggatgacacatacatttggttcagagattggttggactttgttagctatttttagggcaggagccacctgggcaatgttagagataagggagcagcaacatggaacaacctaa

SEQ ID NO: 35260 - DNA, 274 bp, Glycine max
  Peptide Sequence Number=SeqID_152038
atgggttgcatgccacaatttgaggaaccactagaaaggatgaccttcttcagtatatggctttgtcgtgccggcgaaggtgcgtcgatttggtggcactgtcgcatcatgcttcaccctaaggaagaggaaggtgaggcacaaacgaacgagaaaggggaaagggaaagagaaaaaaaaggaaggggagaggggaaggggaacaatcatacgaagaggggaaaaggaaaaagaggaagagaaaaggaaggaaggggagaggggaaaaagaatg

SEQ ID NO: 35261 - DNA, 465 bp, Glycine max
  Peptide Sequence Number=SeqID_152039
atgggatccaaaattcttccaaaatgggcatcgaagccttacgtaatgggaatcgacaaagctggaagaggccccattttaggttcattcccttttccattctccactttcccccttttttcttcctttaaacatatttccatcattgtttctgggcttatggtctacggttgcttatactgtgctcagtcctatttgaggaccctttccatgttgagttttgcagggttaatgaggcttttgacacaaaattttggagttgtgttctgttcagagcatcaaggtgacacatggatgctgttagggttgttactatggtttgtcaggttcaccaatgttgagccactaaaagatgctagattcaacagatgctatgttaaggttgaattattgcataataagggaatagattcaaaaattggaaaagttgctcttgataaaactgtctacaatgatccattttag

SEQ ID NO: 35262 - DNA, 266 bp, Glycine max
  Peptide Sequence Number=SeqID_152040
gttttgagagttttttgttagatccaaaagcaaagccaaaagaaagggcaaaatggtcttttcacaaagatttttaccccaaattcgcccaggctagcaaccagctcgcttgggctaaagatcttacttcagccctaagcaagaaactcgccgagccatgcatttttcaaggaatggagaatccatcagcattcaatagtgaagaaagcatgcagaggctgaggaagaagaaggagaaaaagaaaagtggagttgaggcgttgtag

SEQ ID NO: 35263 - DNA, 555 bp, Glycine max
  Peptide Sequence Number=SeqID_152041
atgagtagcaatgatcaaacttctggtgctagtctctacattagggctttaatttgcaacgctgctgctggtgcctctgctgagttgcatcgtgcaggggcaatagcggctacatttgtgtgcccattggatgtgatcaagactaggctacaagttcatggccttcctcatgggcagaaaggtagtgtcattatcacaagcttgcaaaatatagtaaggaatgaaggtttcaggggaatgtaccgtggcctttcaccaacaatagtggcattacttccaaactgggcagtttatttcacaagttatgagcaactaaagggtcttcttcgttcacgtgatggttgcgatgaactcacaactattggaaatattatagctgctgctggtgctggtgcagccactgcaatttctacaaatccattgtgggttgttaagacaagacttcaagagtctatgatcttctcatttattgttcttaaaccctatgggtatctgcaagtggggagggtacaggtatgggtatatctacccaacgggtatggggatgagaattaa

SEQ ID NO: 35264 - DNA, 240 bp, Glycine max
  Peptide Sequence Number=SeqID_152042
atgagtgagatgcgtttgggtggtagcggtgtggcaacacacacggagaaaagaggggatgagtggtggtggccgcagggtaataaagtgttggtctttcaatatgaaaggttcttttacgatgacattgtggagcgtgtagaggcatttgagtgctacgatggcgatgcatgtggtgtggaagcagtccatgagtgcattgatggcggcggtgggagccatgcccgaccgcgacgatga

SEQ ID NO: 35265 - DNA, 336 bp, Glycine max
  Peptide Sequence Number=SeqID_152043
atggtcgaagaccggtggcgaggggtggtgagcgatgttaactttgccgtagaagtagatggtccacacccaatactctgtgccgtgatacaagggaatattgtagcagtgcttcttgacttggcgctttctggaggtagtgggaaaagaggacaggtcggagctagtgagggcagggacgatgccaatgtcctagttgaagggtggggagagactgtggaagaagaagatgtcgtcgtcctcgaattcgccgtgtgcggggtgcaagctcctgcggcggaagtgcacacaggagtgcgtgttcgcgccgtactttccgccggacaacccacagcg

SEQ ID NO: 35266 - DNA, 1134 bp, Glycine max
  Peptide Sequence Number=SeqID_152044
atggcggcgcagtggtggcgctccgccgccggccaccttcgaacggtggcggcgggccgtggttccttgtcgggattccagcgcagcacttatcacacgatccaagccatcccaagggagtgcagcggcagcaaagtctcggcgagagaccgaacgcaaggtcgaataccttgcgtcgttttcctccagaaccttctggaaaaaaaccccgacgcgcgttcggaatcgaagaagcacttgctcaccgtcgagaagaagcagattaaggccattctcgactccgccgacgcgcctttcttctgttccacgcgcttccctctccagatccgcgccggttccggatcctcgcatttgctcgaatcgggaaccgttttacctatcaagattcatagggatgaagagagtgggaagattttgaatttggtgtttgtttgggctgaggatggaatgaaattgaaggtggatgtgcctgttgttttcgaaggggaagatgcctgtcctggtgttcagaaagcttcatcaatggcagaaaataattcttctgcgccctccttttctcatcatttgcatcaatcctttccctcaatctcaaaaaagcttgatgattccaactatctgttctggcaacaagtagaaccagtgataaaatcttacaaacttcatctatttgtggcaaaccctacaattccgatgcagtttctcactgaaaatgatcgtgatgcaggaattgaaaatcctgactatgaaatttgggaacagcaagatcatgttctgttaacctggcttcagtctacattatcgaagacaattctatcgctggtgcttccatgcactcattcctatcaagtctgggagaaaattcttgagtacttccatttgcaaacacgagctcgagctcagcaattgcgcagagaactgcgtcgcacaatgcttgatgataagacgatgaaagagtttcttctgagaatcaaagcgatctgtgattcgcttaatggtgtcagagatccggtgtcacatcacgaacacgtcggcatcatccttgaaggccttccgacggagtatggtcctgtaattgcagtagttgaaagcaagtttgagtctcctctgattgctgatgctgaagcgctttactag

SEQ ID NO: 35267 - DNA, 651 bp, Glycine max
  Peptide Sequence Number=SeqID_152045
cgggacgacgccgtcaagtcgctggcgtacgaggcggaggcgtgtctgcgcgaccccgtctacggttgcgtgggcttcatctcgctcctgcagcagcacctccgtcaaatccagacggagctccacaacgcgaagaaggagttggcaaggtaccctagcccccaggccatgcaggttcttttagccaatccagggatgttgcaacatggtggtattgttgtgcctcatttacatcaaccagtgttcaacgctctgtccaaccagatggttggacagaacgttggacagcaggagtttctagaaactcagcaaatgtttctcgcaaatagggatcatcaacatcagcagcaacagcaacaacaacatgttatgcttcggagctacgaacagcaagagtttatgaagtttaataatggtgtgtttgagcctagtgttggtggagggtttgggaaccaagcggaggagttcttgtctccttccttggctcttggaaatttcgagaatgttgagtcttaccagatgcaacagcaaggggaacaacatcatcccattgaggcgcagttgctcctctcgccacagcaagagtcacaaggacaacatcagcaacaacagtgtgcaagtgaggatgggaggaatgttgttcctgcttga

SEQ ID NO: 35268 - DNA, 400 bp, Glycine max
  Peptide Sequence Number=SeqID_152046
atgacgttgctacttagcaacattctgcccagcaatcgcaatgccgatctccccctgcgaaagtatcggttggggtcgcgcccacaagacaaccagtggatccggaggagcccaacagggccctggggtttccagctcgggttacgggcctctattagtcctacagggtgcccgtcccccccagcaagggatcgcgcccgcaagacacccagtggacccgaagaagtccaacagggtcttggagttgccagctctgattacgggcctctatcaattctacggagtgtctgtcgcccccagcaagtactgcgggcaacggacgcaccgccaccacctccagagcccctcagctcatctacaaaggctggagcgttgcctacgacccatgtccgaccagcag

SEQ ID NO: 35269 - DNA, 495 bp, Glycine max
  Peptide Sequence Number=SeqID_152047
atggctcagaagcagtgggatgaaactcttgtgcttgttttgggtggaattgcacgtatattacggttgttctttccttttttctcgagcttaagtaacttctggtctgatgggttcactattaaaagatcatgctgggaatcattgcttcaatttgttgagaatagcattttaaatggtagtaaagaggtagcacttgcagcaatacattgtttgcagacaactgttaactctcattcgtctaagcttgttctgagaaagccttctagttaccgtgccaatgctgctgataaagtgatgcaggagattttgcatggtcttggagagctttacgtgcaggctcaaggattgttcaatgatgttgtatacacacaactgatagcaatcatagatttggctgtgaagcaagccatgttaactaatgataactttgaaatggaattttttttccaacaataccggggaataagaagcaagcaaatattctttacataa

SEQ ID NO: 35270 - DNA, 414 bp, Glycine max
  Peptide Sequence Number=SeqID_152048
atggcagaggcgattaaaatagagttatcccaaatagcctcgccacactcacccccgatagacgtgccggaccctcaggtattaggtgcacatgttagcaccaaaggaagctgtgttgaagctgctgcaaatgctcttcctgaagagcctcctgctattgatgtgacaactatgggcttgtacatagttggtaaggactgtacacggctagtggccttgggtaaggagttttataatgccgccacaatacacaatgtcccttacacagatgatgtcgtaagggattcacacaataatgtgtcgaaatcggttggacgtgttgagaggtgcaatataggtgatggagaggatccattgggagaattgatgaagatcttgtatgccatttaccaaaagccagttcaactaccatag

SEQ ID NO: 35271 - DNA, 339 bp, Glycine max
  Peptide Sequence Number=SeqID_152049
atgtctggaatcaactaccccaaaaacttaagctatagggtgaaagcacatgaacggttatatctaaaatgtcagtgtaatatgttcttgaataatggcatgcttcatctagggctaggaatgcatggacaaaagctttcaaagagcatgtgggaagattgcctttgtaattacgtatttcctacattggatcgtgcttctcatatggttgctacatcatcaaaagatgaatggcaagggaaagaacttggaactcgaggaggaaaagcagttcacatgctcatattgacattgagcctgtattatgtattttgtttatttgtagcctcagtgatgtga

SEQ ID NO: 35272 - DNA, 915 bp, Glycine max
  Peptide Sequence Number=SeqID_152050
atggccgagaaaacaaactcaagagtgaatcaaggtgatggtactgacaatacagatgtggtcgtcgaccctccatcccctattgcaagacatgtgaagtggaagaaggctagaactaacaaatttgggcaaatgacatctgctgcagctcaagaaatcgcagacaaaattgatgatttgcaggaacaatcaacacagggaacttttgtcccgcatggtcgtgaagacattttgaacactgccattggccgtccagagcacccaggtcgggttcgtgttgctggacatggtgtcacgataggtaattactatggaccgcgtggtagtggctccaacacttcttcggcgacgatgaccgcagataaattggtggaaatcataggaagtataaagcaagagttgaggaaagaggtagaagacgaaaacaaacggactatcgacttattgcaaaagcagttggatgcgatcaagagtgagttatcacaaattcaaacgcaacagtcagctccttgtagaccgtctatccctgatgtattggttgcacgtgtcagcaccaaagaaagttgtgccgaggctgctgcaaatgttgttgctaaggagcggtctacacttgatgcttctattgtggggttatacattgtgtgtggtgatagtacacaggtggtggctgcgggaaaaatgtatggagttggtggcattatacacaatgttgcttacgcagatgatgtagtaaggatttgtgttgacacaatttacgatggtgacgccactgtcccgtttcccactgcagagattcagtatgtcagggacgcgagtagcacattcattgcatggcccagacatctagtgaagcctataactgatgattcaaatcataatgcgcgtttgccagttggacgtcttggtgagactgag

SEQ ID NO: 35273 - DNA, 393 bp, Glycine max
  Peptide Sequence Number=SeqID_152051
atgggggcgtattctgcagatgaaaagttgttggtgcatttctttcaagacagcttagccggagcagcagtggcttggtataccaatctggaagcttctcagatccaatcatggaaagacttggcgacttccttcattaggcaataccaatacaatgcggatatggctcctgatcggaaccagcttcagagtatgaccaagcgagaacatgagtccattaaagaatatgcccaaaggtggagacatctcgcagcccaagtcgtcctgcccatgacagagagggagatgatcacaattatggtagatacgttgcctacgttctactatgaaaagctgataggatacatgccagctaattttgcggatctcgtcttcgccgggagaaagaattga

SEQ ID NO: 35274 - DNA, 712 bp, Glycine max
  Peptide Sequence Number=SeqID_152052
atgccgccaggccacgctcggtcgcgcacaggtacagcagctgcgagatgtggccgacatccagcgtcaccgcacgatacgccttggcgtggttgcggtacttccagaagcagcggtcgtaccgcggtgccagcaccagcagcgccggtgcatcggcgaaccactcctgaccggacagcatccgccgtgccagcgcgggcaatgcatcaggcggcggcgagggcagcggcagcacggcgtgctgcaccgggtggtagtggtacaggcccggtgccagtccttccacgttctgcaccagcaggaaaccttcggtgggatgcaggccgccaccagagggcacgttcttcttcaggaactcggtatcacgctcgaccttctgcaccgcgtgggccatcagcgtgcgctgcagcacctgggccagcagcggcaatggcagcgcgcgctgcgggtcgaaattgcggcaggtcgtgcgctgcgccagcagcgcgtcgaacgcggcctcttcactgcgcggcagcggctggtagtcgccctgcagggcctgcaccaccggtggtggcggccccagccgctggcgcaggccggcagcggtatgcagcccctggcgacgcatgtcctccacgctgtccaccgcctgccagcgcgcatggcgatgggccagtgcggccaacggccaccactggctgcgtcgcaatgcctcatcacgcatctg

SEQ ID NO: 35275 - DNA, 1110 bp, Glycine max
  Peptide Sequence Number=SeqID_152053
atgccgatgtcgatcgtgccttcggtttcgacggcatcgggcagagcgcgatggccatctgcggcctgggctggcgcagtgccacgctggacacggccgaattcgatcctgctggccgggtggtggtgggcgacgaccgctgagcggtcgccgccgcggcgttcacgccgcctcgaagtccaccagtactgcaccgtcacccacctggtcgccggccttggcgcggtaacccttcaccgtgccgtccgccggtgcctgcagcgtgtgctccatcttcatcgcttccagcaccaccagcggcgtgccgcgcttgacctcggtaccggcggcgaccagcgtcgcaacgatcttgcccggcatcggcgccagcaggctgccggcgtcggccacggcgtggtccgattcacccaccggatcgtgcagggtgaaacggtgctggccgtcggcgccgaacaggtacagctggtcaccgtcgcgcagcagctgcaacgaccagcggcgctcgcccacctgcaccgtcaggccctgcatactggccgtgccgatcacctgcaccggcgccgcatcgtcgcactgcacgcgccagccatcggcctgcgcccacaccttcagcgtgtgccggcgctctccctgctgcagcggcaatacgcgcggcgcggacgcgccaaggcgccagccgtcctgcgcctgccacggcgaatgcgggtcgcgcgcatcgctgccggcaccggcagtgcttgcaacagcggccacggcggccagctgccacagggcatcatccgtatcgcccgctgcactcaatgccgcctgttcgcgttcgatcagcgcggtatccagcttggcgtgcgcgaacgaatcggtgttcaccaggcggcgcaggaagccggcattggtggtcacgcccaccacctggcagtcggccagcgcctggctcatgcggcgcagcgcggcgtcgcggtccacgtcccagacgatcagcttggcgatcatcgggtcgtagtacggggtgatgctgtcgccttcctccacgccggtatccacgcgcacatgggcagacggagccggcaggcgcaggcggcgcagggtaccggtggagggcaggaagccgcg

SEQ ID NO: 35276 - DNA, 522 bp, Glycine max
  Peptide Sequence Number=SeqID_152054
atgtggactgagaattggactggctggtttaagaattggggaggaccaattccacatagaactgctcgggatgttgcatatgctgttgcacgatttttccaatatggtggcacattccaaaactattatatgtaccacggaggtaccaatttcggacgaacttcaggaggaccatatattaccacttcatatgactatgatgctcctttagatgaatatggtaacaaaaatcaacctaagtggggacatcttaaacaactccatgagcttctaaaatcaatggaagatgtcttgactcagggaacaacaaaccatactgactatgggaacctgttgacagccacggtttacaattattctggaaaatcagcttgcttccttggaaatgcaaattcatcaaatgatgctacaattatgttccaaagcactcaatatattgttcctgcttggtctgtgtctatcctaccaaattgtgttaatgaagtttacaacactgcaaaggttattcttatacgtaattaa

SEQ ID NO: 35277 - DNA, 309 bp, Glycine max
  Peptide Sequence Number=SeqID_152055
atgtctgtcgaccgagactactttagtctccatttcatcaaccagaggcaagtgagcccgtatacacgcagagacatatatggtcatctgcacccattcgtcaaagagtcgatgtccatcgaccgagacttctttagtctccatttcgtcaagaataggcaaaggcaagcgagcccgtatacacgcaaagacatatatggtcatctgcacccattcgtcaaagactcgatgtccatcgaccgagactactttagtctcgatttcgtcaacaagaggcaagtgagcttattgacacgtagggacaaatag

SEQ ID NO: 35278 - DNA, 108 bp, Glycine max
  Peptide Sequence Number=SeqID_152056
atggcgcttagcacaatcaaattgagtttaggccacaagaagcttggcgacaataggtcgcgcttagccaaggataagttgtcgcttagcgatcaagcagcagcttag

SEQ ID NO: 35279 - DNA, 261 bp, Glycine max
  Peptide Sequence Number=SeqID_152057
atgacaatgtctcacacgcgatggatcgaccgggtggtcactggtgagggtagaacaatagactgggcagtggggactcagattgaacaacgacaaacaaagtggcgtgatcctatggactataaccattcaataagatgcagcggaaggcaaaggagaagaggagaggggaggcaccatccattagggaataagccaaggaagaaggagcttcaccaccaagaattgccttggataagaagcttgaagaggatgctttaa

SEQ ID NO: 35280 - DNA, 207 bp, Glycine max
  Peptide Sequence Number=SeqID_152058
atggagatgagaaaccaaccttttatgaagagagtgtgcgatctgaatcaagagagaacaaaggttgtagccaccgtgagagtgtgcgacctgaacgaaggttgtcgtgactgtgagagagtgagagtgagggtcttgaagtcgcaagggagagtgcatgtagagaggaatgagcgagaacggaggtccatcaagtctcaactctaa

SEQ ID NO: 35281 - DNA, 441 bp, Glycine max
  Peptide Sequence Number=SeqID_152059
atggctccaacggacacttctatcatgccttgtggaaggttcaacgttgaacatgatccatccgctgccctagctcttgcaagttggctaacacaagagtctagaagaccatcctttcttacccacaatgcattgggtatcatggttcgttcgcaggcgttaccatggtgtccaatgcatgcaattaagaaggtggtcacacataactttcgaaggtttatagagataccatcctctttgatatcaaacattgtggcggtaaggactaccagcgacaatgtatcatcaaagagaaaaactctagatgaggcttcactgtcatcaagcgagttggagacccagcatgaccacagatcaacctccactacctatgtcaccatgaacccgggtataggtgatggaagcttgcttgtggggcttctatggaggctagatctttga

SEQ ID NO: 35282 - DNA, 240 bp, Glycine max
  Peptide Sequence Number=SeqID_152060
atgagggcctttggaactaaggcagctcacccaggcgagctgatgcttagtccaaatgaaactggatcgcccaggcaagctgcagctcacccaggcaagctggttccttcagccctaagcaacttaggggcacaggtaagtaaagataaagacactaatttcatccaagagatcttgctatccaaccaacaactggccaaaaccaaagaagtgaagcctgtaaaaagaataaatggatga

SEQ ID NO: 35283 - DNA, 231 bp, Glycine max
  Peptide Sequence Number=SeqID_152061
atggatttggtatttggaaaagagaaactctttgaacctcctttggaagttggcagcaaccatggcctttacaaggaagaagatggaccgagagggttcatgaatgaaaatgaagtgagctttacaactatgctagaagatgatactgtatttgagaaaagaggaattggtgaaacacaacccttggaattcataattgatgagggtgagcttattcttatccttctttaa

SEQ ID NO: 35284 - DNA, 747 bp, Glycine max
  Peptide Sequence Number=SeqID_152062
atgactaacataatccctgagactcaaatccccgacgaaaccgtaaaccctaattacaccaccgaacattacccacaacaagaacttctgccaccacagattgatccccaattctttgaaaccctaagcctccctaatcataattcccccaaccctaaccaagatcacgattctaccatgcaagacctaatccctatcaccctcactatcgttgtcgacgatgacctggagcctgacgctaccaccgactgcagtggcggcacaaccacccaacacacgatgaagcagaagaaaaaaggcccaaagagaatcgcgatggagagaaagtctcgcgagaagctccagatggctactttagagcaaatgaaagttgataaaaatgttatgaaactgacagaagatcaaaaggtgtgtttcgccatcctcatcgagcttcatgacctgatcattttgtcatcatcttttgaggcctcccagtcttttacaggtagtggtaagagttacctagcaaagatattgcatgatcttgaggttgaaaatggtggtgatgctcctcgaattcattccatggatgattattttatgactgaggtggaggatggcaaggcatcaaaatcttcaagttcaggaagaaacaagaagcctatgacaaagaaggtcatggagtattgttatgaacctgaaatggaggagatgacttgtggaagggctggagagagagggcattatatgattgattgtgcctag

SEQ ID NO: 35285 - DNA, 165 bp, Glycine max
  Peptide Sequence Number=SeqID_152063
atggctagcgggcagggcaagtaccacaggcctccttatgtggtggctcgtggtccacaggtgtacccctcgaatctccccaataattggtatcagagccgatggttcaagttggtgaccgactcagatgagtatgcaagtaccacaggtggccagaatggctag

SEQ ID NO: 35286 - DNA, 207 bp, Glycine max
  Peptide Sequence Number=SeqID_152064
atggctatactcgtggatgataaagacttcccctcgaaggggagactaacatgtggaagagactcacacttcagtggagatgtgttgggttacaagtgtgaggtgtacccctcgaatctccccaataattggtatcagagccgatggttcatgttggtgaccgactcagatgagtatgcaagtaccacaggtggccagaatggctag

SEQ ID NO: 35287 - DNA, 1473 bp, Glycine max
  Peptide Sequence Number=SeqID_152065
atgctggaaatctcaacttcacatgaaacccctctagagaacgcggacggcggctccgcggcggtctcggacgggtcgaaagccgagcacggcgaggacgatgaccggaatcccgccgcgaaccggtggccgagagaggagacaatggctttgctcaagataaggtccgaaatggacgttgctttcaaagacgcaaacctcaaagcccctctctgggaacaagtctcaaggaaattatcggagctaggttataataggagtgcgaagaagtgcaaggagaaattcgagaacatttacaagtaccataggagaactaaagaaggtcgttttggaaaatcaaacggtgcaaaaacttaccgatttttcgagcaattggaagctttagacggaaaccactcacttcttcctccgacaacaaccgttggtgatgatgttgtcctgaacgcggttccgtgttcggttagtgcggcggcgcacgagcattcgagttcgacgacgtcgtgttcggggaagaagaagaggaagctgacgcagtttctggaggggttgatgagggaagtgatagagaagcaagagacgctgcagaggaagtttgtggaagtgttggacaagtgtgaaaaagatcgaatggcgagggaggaagcgtggaagaaggaggagctcgaaaggatcaagaaagaacgcgagcttctggctcaggaaagatcaattgctgctgccaaagacgaagttgttcttgcttttcttagaaagtttgcagaagcagaaggcacggtgcagttactcgagaaaattcaggttcaaaacgacaaacagaaaaacatgaaacaaaatggcggtaatgataatgctaatggaggtggtggtgtcacagttgtcactgatatggataaacaagaatgtggaaatactaatgttcgtgttagtgttgggaattttgtgcacatgagtagttctcgttggccgaaggatgaagtggaggcattgataaggttaaggactcaaattgatgtgcaggcacaatggaataataataacaataacaatgatgggtctaaagggcctctttgggaggagatatcttcggctatgaagagccttggttatgatcgaagtgcaaagaggtgtaaagagaaatgggagaacataaacaaatacttcaagaggataaaggagaagagcaagaggaagcctcaggattccaagacgtgtccttattatcaccaccttgaggctttgtacagtaagaagcctaagaaggtggatcatgggaacgagttgaagcctgaggagctgttgatgcatatcatggtgagtcaaagtcaagaacagcaacaagagatgcagactcagactcagtcaccatctgaagatgctgagagagatcagaatcagggagataatgaagatcaaagtgagtatcagactcagatggttgataataatagtccttccattgcaattatgagttaa

SEQ ID NO: 35288 - DNA, 213 bp, Glycine max
  Peptide Sequence Number=SeqID_152066
atgaagaatatccttcaaacatatgaggcagcttccgatcaagctattaatctagcgaaatcagaggttttctactgcaaaaatgttcccttgccccaacgtaatatgatttcatctaccctaggtgttaccaaagaccttgggtcagaagtaggaggagtgtgtttggatatatccgggacagagtttggaagaagattcaaatctggaatg

SEQ ID NO: 35289 - DNA, 261 bp, Glycine max
  Peptide Sequence Number=SeqID_152067
atggagattcccacaagcttctaccttcttgactcaatgcacatggacattcagttcacccacttcacatcagaacccatcttaagcataatgctctcatatagccctagtcaacatggatcgacctttgctcaacaaaggccgattggtcctccgcaatgcacttgtgaagcagtggccactaaaacattgtccaggatccacttttgctcaacaaaggtcgaaatgctcctccgtgatgtccatatttgttcacggtaa

SEQ ID NO: 35290 - DNA, 261 bp, Glycine max
  Peptide Sequence Number=SeqID_152068
atgtcggtcatggacctagtactttgcttacctttggctttggacttgaccgcctattggtcggccatgtggtggcagtgcgtctgttgcccactgccagctatccctaggctgctgcggtgtctcaccctacgcttgcctgggggtgcagtacttcttgatgaaagcccagttaatagggggcctgatgaacttgttgggggtgacgggcactccgtggaactgataaaggcccgtaatcacagctgggaagtagggtga

SEQ ID NO: 35291 - DNA, 954 bp, Glycine max
  Peptide Sequence Number=SeqID_152069
atgcagagcccaattcctcttaaactttccgaaataggtctcagggggttcctggtagtgaatctcgaactcgtcgtcggcaacaacggaatcgtagtcggcattggcggcggcgagtctgatcttgatgtccctgaatttctcggtggccaagccgagggtgagcttgtggcagcggcgctggtgggcgatggagaggagggtgatggggatccagcagtggcggcattggaggcggggggactgggccagggccaggaagacgaggcccaggaagatgaagaatatctggaagagcttgtggagctccttcttctggaggtcgatggcacgcttcttctccaaggttttctcgaagtggagctggattatggtgttcagggcctggaaggctgtttctttcgactggtgctggtgctggatgctgctttcgtactctgccatggatggaatctaaggtcttcccttgtccttgtcccgacaacaacgttgccacatttcttcgcccagggccaacctcgtcaggttcgacgcttccgagatcgcaaaggacaagcgcgaattattttcccttcagtggcatttctcactggtagtgatcttgttcctgggcctgctgctggagtgtttccttcaaggggtggtcatggcattggtggaagcatgcttgtagaattgttgatgcttaagttcaacacttggaagcagggcctaatgacccccgttggtttggtggtattggtggagatcctgcttttcctggaggattgccaaaataaacttgcaagtaaattgaaaaggggtgtttctagtaataagggtgtaagttttaattgccaacaaaaatacaattttaaggcccatatcttgtgggctgtagcgtgctcattccatgattcctatgatgtaggagagccagaaagaaacgaggttagcgagacaacctcggcgtag

SEQ ID NO: 35292 - DNA, 477 bp, Glycine max
  Peptide Sequence Number=SeqID_152070
atggatagcaagaaagaggacaggagatcttcggaccaaataaattttcagcgaggaaaaatcagaagagaatgtttcttcgaggactttgacggccatgagcaaatattccaggcaacatttggtaacaaatggtatacatggtccttcaacaattggagaagttcttcctctgaacattccacatctgggtttgaatggagggaacattcaaataggacaaacaagtggaaaaatgaaagtgatactgagcatgaagatgatgactcatgttgtgaaggatcaagttctgataggactgttctgggtctgcctccaacaggtccattaaagattgaagatgttaaaaatgctatccggttatcggctttaaaatggcatcctgataagcatcagggcccttcccagccaacccaccctactcgaaactcagtatcacctacaaactgtcttcttggatgtaggtgtaaagtataa

SEQ ID NO: 35293 - DNA, 174 bp, Glycine max
  Peptide Sequence Number=SeqID_152071
atggtggaaaaccttcacgaaatcgcccacggagggggaaaagagggaggtggttgccgcccagctcgcccaggcgagctgggttgcttccaccagaaggcacagctttctgttggaacaccctggaaggtccaagtgggcctggttgctatttgcacaccccctgtttactaa

SEQ ID NO: 35294 - DNA, 1419 bp, Glycine max
  Peptide Sequence Number=SeqID_152072
atggagaaggcggtctataacaactggttgagttcagaagatgttaaactcgaagtgaaaggggtggcaagcatcgctaacacagatgataattttatctgcgcaacattggactggtggcctgctaataagtgtgactatgaccagtgtccatggggacaagcaggcattctcaatctggacttggataacaaaattctaacaaatgctgtcaaggcatttaatcccctgaggatcagattaggtggctcactggaagatcagattgtttaccaatttgggaagcaaaagaaatgcccacatttcaaaaagaaggctgatggtctttttggtttcagccaagcctgccttcccaaagtgagatgggatgaaagtgaaattaatttttgggttgaatgctctcactgggaagagaaattctgcagaggacaagaagaactgggaaatgagctatgtgctgaggggatatcagccagagtagacagtgttgaatatgctaaagacatcactaggctcagacatatagttaatctactgtacccaattgcttctacaaggcctaaagtgctaggacctggtggtttctatggtaaggaatggttttctagcttcttaatgaatgttgggcctggtgtggttgatggaatcactcaccacatttacaaccttggtgctggtgttgacaaggatctcatcaatagggttcaagacccatatttattgagccaagttgctgaaacttacaaaagtgtagctcaagcagtcaaggaattcacaccatgggctggaccatgggttggggaatctggtggagcctataacagtggtggcaaagatgtgtcaaatacttttgttaatggcttttggtacttggatcagctgggcatgacatcaaccttaaaccacaaggtttattgtagacaaagtctaatcggaggaaactatggtttgctaaacaccacaacctttattcctaacccggattattatggagctcttctgtggcatcgacttatgggaagcaaagtgctttctgtttctcacgaaggatctccatttctgcgtacatatgctcattgttcaaagaaagggcctggtatcactgtgctactcataaacatgtccaattccacaactttcaatgtgttcctcatcaatgacatgaatctgtacccggtcctgaacacagtacgaagtgtaccaatgaagatgagggaagaataccatttgacaccaagagatggtaacattcaaagtgatgtggtgatgttgaatggaactccattggtgctgaccaagtcactagacattgcagaaatgaaaccaaagctggttgatccatcttcttcaatcaaagcagggcctgattccatagtatttgtacaaatcaagagcttcaatgcaccagcatgcgcataa

SEQ ID NO: 35295 - DNA, 528 bp, Glycine max
  Peptide Sequence Number=SeqID_152073
atgacatcaaccttcaaccacaaagtttattgtagacaagcactagttggaggaaactatggtttgctagacaccacaaccttcattcctaacccagattattatggagctcttttgtggcatcggttaatgggaagcaaagtgctttctgtttctcacgaagggtcgccatatttgcgtgcatacgttcattgctcaaagaaagagtctggtatcaccgtgctactcataaacatgtccaactctaccactttcgaagtatcactcctcaatgagaatctgtaccacccggaagtaggattaagaaacagaaacacgccgagagaagagtaccatttgacacccaaagatggtaacattcaaagtaaggtggtgctgttgaatggaactccactagtgctgacccagtcactgcacatcccagaaatgaacccaaagctggttgatccatcttctcccatcaaagtgaagcatgattcaattgtatttgtgcatagcaagagtttcaatgcaccagcgtgcatgtag

SEQ ID NO: 35296 - DNA, 801 bp, Glycine max
  Peptide Sequence Number=SeqID_152074
atggagaattttttgaatcagatgagggattcgaaaataacatttcagaagactcaatctttcaaaggagagaagaaacagggtggtgagaattggctccagaaacagttttcaaggaaaaggagtggtgatcatgactccagagacatggaccacgctgctgcggtagctgctgctgcattcgcaatcaacttgcaagatgtttctgaacagaagagtgagaccctagaggcctcattgacaaagaccaaaagcaaggttgatggcccaaaacctccaattcccctacttaatagtgcttccaagcgattgtcaggttcatttagatctaagaatgaccaaggtaagaagccagaagagaccattacccctgcaccatcaatgagaaagagttcaactttctctgatgaaaagcctgagtcttcaacaaagccttcccctgtaagacaaccaactgttaccgaaaggcgcacaaaagcagatgaatgggagagagccgagtttcaagagatcagacaaaggtacgacaagttgagagaggtgatagattcatgggaaaacaaaaagaagatgaaagctagacgcaagctggataaggaagagagaggagttgcgcaaagaaggatgaaagctttggaagattttcagaataagattacggctatagatcaaattgcagatggagcgagaaccaaggcggaagaaagccggaggaatgaagaacaaaagacaaaagagaaggcaaatgtaattcgaacaacaggcgagatgcctggcatttgcttctgcttctgcttctga

SEQ ID NO: 35297 - DNA, 273 bp, Glycine max
  Peptide Sequence Number=SeqID_152075
atgcatacatctcccacggacaatttagttcctctggacttggacattgaagctatgttaagaaggaacagagccgagaggagaagaaaattactacaagacaggacagtagcttccattctagaggaagaagctcattcttctgattctgcatcatctgacttaccatcatcaagggaatccacgacatatttactagaagccgttatcatggctgatgaacaccaacaaagggttacccttgaggactactcaagcagttcagtaccataa

SEQ ID NO: 35298 - DNA, 243 bp, Glycine max
  Peptide Sequence Number=SeqID_152076
atggcctggacagaggcatcatctattccaagagcactagtttcaattattttaagattgccaagacttaaatttgctattgtaactttgggaaaagatggctgcataatgcttgagcgatgtgtggatgatgaaggttctcacatagaagaaatggacgttgaaagctgtttgacaacattaaaagagagaaaggacgatagcacagccatgccaacctgcatagcctcggtaataacctga

SEQ ID NO: 35299 - DNA, 525 bp, Glycine max
  Peptide Sequence Number=SeqID_152077
atgcacgccctcaccttcagagggctgcatgccctcaccttcagaggactacacatcctcaccctcagagggctacacgccatcaccttaagaggactacacgtcctcaccatcaaagggctgcaggccctcaccttcagaggactacacgtcctcgccatcagagggttgcacgccctcacctttagaggattacacgtcctcgccatcagagtgctgcacgcccttacctttagaggactacacgtcctcaccatcagagggttgcacgccctcacctttagaggactacacgtcctcacaatcaaagggctgtacgccctcacctttagaggtctacacgaccttcgccatcagaggaatacacatcctcgcaatcagaaggctatacgccttcaccttcagagggctacacgccctcaccttcagaggactacatgtcctcttcatcagagggtcgcaccccttcaccttcagaggactacacatcctcgacatcagagggccgcactccgtaacctttag

SEQ ID NO: 35300 - DNA, 651 bp, Glycine max
  Peptide Sequence Number=SeqID_152078
atgtcttcggattctgttcttcctctccccgaaaatcccatcattgtggggtttggtggggttggagtggattttctggcagtagtgccatcttttcctaaacctgattccaagattcgaaccactgaattcacgttccaaggtggtggaaataatggaaatactatgacatgtgctgcccggttgggcttaaagccaagaataatttccaaggtttcaaatgatggtccgggtaagactatgctggaggaactagaagctgaaggggtggatacctctttttttgtggtctcgaaggaagggacttcaccatttagctacgtcattgttgacaaccaaacgaaaacaaggacttgtatattcactccaggatatcctgaaatggtccctcaagatcttccacgagccaatttgttatctgcactggatggagcaagaatggtctattttgatgcaaggatgcctgacagtgctcttgtcattgctcaagaggcatttcaccagaatatacctatcttaattgatgcggaaaggcctagggaaggattgaatgacctcctgagtttggctgattatgttgacctccttctagagtggaggaggggacttgctttaggacacatcacacatgcattgcatcataaagaataa

SEQ ID NO: 35301 - DNA, 108 bp, Glycine max
  Peptide Sequence Number=SeqID_152079
atgaagatcagaaaatacccaaaagggaggtcaaaagggttgacccctggctctcccaggctagcccctggcttgcctggggccccaaatagcttaggggtgaagtaa

SEQ ID NO: 35302 - DNA, 225 bp, Glycine max
  Peptide Sequence Number=SeqID_152080
atggttggtgctgaatgtcaaaaaatacatcggttccatctgcatcccttttcactaagggcggtgacaaagggagcggcggaggaaggtggaggagggatggggaaagaggagagtaactgcatggagcgggtgtcgatgcggcgggtgggcctgggagcacggattcccatggctcttgcggttgcatcctccacaattcaacttcacttcactccggtgtga

SEQ ID NO: 35303 - DNA, 363 bp, Glycine max
  Peptide Sequence Number=SeqID_152081
atgcaactcaccaagacaaaccggacaagttggagaaaacttcttggcattgaaattggtataaaatgcgtcggcggcaaagtgatcggcgaactcgatcaagacgctatagcgatcttctgttccgtcgttcctgatgaagagaaggtggtggagacggtcgaggtggggcccacagaagggaatgaagtcgtggaaggagaggtagttggggacggcgaggatgaagagaagagaagagggagaggagtgggaagaggttcggaacaagtggagcgcgcctctgcgttggctgaatttagggttgttggtttgggattggaagatggttcggggatccagagggtgctcctcttccactga

SEQ ID NO: 35304 - DNA, 2742 bp, Glycine max
  Peptide Sequence Number=SeqID_152082
atgattccatctcatctcgtgctatttaaactgtctgatgataccattatttcgtcgctcacaacaattcttctcttctctctctatctccgttttctctttctccttcttgttcttcttcttcaaatccctagcccccttttgttgtataaatactcagccagaagagctctaacacaagaaaaagctagagagagaaagtggagcgagaaaaatactgaaaccctccctcgccattcttgttctgctccgtccctctcgatctgcgtcagggattctctggcaggtattgttgatctgttcggttctagatcttttcgtgcggcttttgttgacggcaccgtcatgtcttccctcagcagagagcttgtttttctcatacttcagtttctcgatgaagagaaatttaaggagactgttcacaagttggagcaagaatcgggatttttctttaacatgaggtattttgaggatatggtgacgaatggggagtgggatgaggtggagaagtacttgtctggttttacgaaggtggatgacaatagatactccatgaagatcttctttgagatacgcaagcagaagtacttagaagcattggacaagcaagatcgagcaaaagcggtggatattttagtgaaggatttgaaagtatttgctgcatttaatgaagaactttttaaggaaatcacacagttgttgactttggacaactttagacataatgaacagctatccaagtatggagatacaaaatctgcacgaggcataatgctggctgaactgaagaaattgatagaagctaaccctctgtttcgcgacaagcttcaatttcctactttaaagaactccagattgcggactctaattaatcagagtttaaattggcaacatcaactttgtaagaacccaaggcccaaccctgacataaagaccctttttgtggaccatagttgtgggcaagtgcaaccaaatggtgcacgagccccttctcccgttaccaatcccttaatgggtgctgtcccaaaggctggaggtttcccaccacttggtgctcatggtccatttcagcccacaccagctgctcttccgacatcccttgctggatggatggctaacccatctcctgttccacacccttcggcttctgccggacccataggtttggcagcagctaataatgcagctattttaaagcgccccagaacccctccttccaataacccagctatggactatcaaactgctgattcagatcatgtattgaagagaacaagaccttttggattatcagatgaagtcagtaatctaccagtaaatttgcttcccgttgcttactctggccagagccatggtcagagctcctattcctctgatgacttgcccaagactgttgtgatgactctcaaccaaggttcaattgtcaaaagcatggatttccatccactgcagcaaattctacttcttgttggaacaaacatgggcgatgtcatggtgtgggatataggcagccgtgaaaggattgcacaaagaaattttaaagtctgggaacttggagcatgctctgtggcgttacaagcatctctttccaatgattactcagcatcaatcaatcgggtggtgtggagtcctgatggaacactttgcagtgttgcttattctaaacatattgttcacatatattcctatcatggtggggatgatcttagaaaccacctagagattgaagctcatgctgggagtgtcaatgatcttgccttttcatatccaaacaaacagctttgtgttgtgacctgtggagaggatagggtcatcaaggtatgggatgcagttactggtgcaaagcagtatacttttgagggtcatgaagcacctgtatattctgtatgccctcatcacaaagaaagtattcagttcatcttctcaaccgcaactgatggaaaaataaaagcatggttgtatgataacatgggttctagggttgactatgatgcacctggtcattcttctactacaatggcatatagtgctgatggaacaagattgttctcgtgtggaacgaataaagaaggggaatcatttctagtagaatggaatgaaagtgaaggagctgtgaagcgtacttatcatggtcttgggaagagatctgtaggtgttgttcaatttgataccaccaaaaataggttcttagctgctggtgacgagtttacaatcaaattctgggacatggataacacaaacatgctgacaagtgttgaggcagaaggtggattactggcttcaccctgtattagatttaacaaggatggaatactgttggctgtctccacaaatgacaatggagttaaaattctagctaacgcagaaggaattaggctgcttcgaacggtggaaaatcgtacatttgatgcttctagagttgcttctgcagctgttgtgaaggcacctactattggagcttttccttctaccaatgtaactgttggaacaagccttgctgatagagctcctccagtagcagccatggttgggattaataatgatactcggaatttagctgatgtgaaacccagaattgttgatgaatctgtggaaaaatctaggatatggaagctgacagaaattaatgaaccatcacaatgccgctccctgaaacttcctgatagtttatcatctatgaggctgatgcctgtacttgtattctattcccatcaatgcatccatgctttccttccctattaa

SEQ ID NO: 35305 - DNA, 525 bp, Glycine max
  Peptide Sequence Number=SeqID_152083
atgaagattgtcaggcatcctaatatagttagattgcacgaggttttggctagccagaccaagatctacataatccttgaatttgtaatgggaggggaactatatgataaaattgttcagctgggaaagctttctgaaaatgaatctaggcactactttcaacaacttatagacgcagttgatcattgtcatagaaagggtgtgtaccatagagacttgaagcctgaaaatcttcttcttgatgcttacggaaatttgaaggtttctgactttggattgagtgcattgactaaacagggtgctgaccttcttcacaccacttgtgggaccccaaactatgttgcccctgaggtactcagcaatagaggatatgatggtgcagcagctgatgtttggtcatgtggagtcatcctatatgttctaatggctggatatcttccttttgaggaggcagaccttccaacactgtatagaagggtattctaccttttccttataatcttgaagaaaagacttgaacgttga

SEQ ID NO: 35306 - DNA, 226 bp, Glycine max
  Peptide Sequence Number=SeqID_152084
atggcattcttgggagaaacaagcagtcagaccattgctaactcgagattagccttcatttttccaaatggaccaatcactcataaccaaactggtgtttattttcaaagtctcactccaacaccaataacaccggatggtatactcaacctgcttcaatccactatcactcctactcattatgcaattatgtattacaataggaagtggaacataccacgccaag

SEQ ID NO: 35307 - DNA, 276 bp, Glycine max
  Peptide Sequence Number=SeqID_152085
atgcagcggacattggcaaatggtcgtcattcacctaaggaaaatgttgttgtctggttttgttccatgcataacagaccagacaactaccttaagggaatacttaacagtgctttgaaaggacttgatgatactccacagcctaaatccaaggctggtgctagatggattgttgttaagtattttaacgatgttagaccattggaagcagagagattgaaggcacttcgcatccagtgggctaaattttatctcaaagttagaaatgaaagttag

SEQ ID NO: 35308 - DNA, 363 bp, Glycine max
  Peptide Sequence Number=SeqID_152086
atgccgtcaaatggaaaggcggatatccgtgatcggtctaaatcgaatgagaaggaacatgatgcacgtcagaatcgatataaggaaaacaccgcttcattcagctccacttatcgcctgactaaaaagaaaggagatagggttgaatatggattgaatggaataggtctttccctagccgcccgccctatagaggggcctgttgaatttgtaagactcaaaacctccgtcaaacctactgaggaaggggatagtgtcaggttcctctctattgccaagaagtcaaaaagacaaaattccaccagaagcgagaaagcttctgtaaatcagagggtagaaggtgaagcggtggtggtgatctag

SEQ ID NO: 35309 - DNA, 498 bp, Glycine max
  Peptide Sequence Number=SeqID_152087
atggccaacgaggcttatgaagacttcctgatgaggctaggtgtcaagcacctcataacctctgtcgaacatccccataccaatggtcagatagaggcagccaatagagttatccttagggccttgcacgctagactcgacaagtctaagggtctatggaaagaggtactccctaacatactctgggcttatcattgttcaccccagacaacgaccaatgaaactcctttccaactcacatatagcacagacgccatgatccctatcgaagttggggaaccatcgacaaggagaatgatgttccagcaacaacaaaatgaagaaaacatgatggcagaacttgagacaaaggatgaatcccaagagatggccaaaatcaaagaggaagttgtcaaacaccgagcactaagaagatacaatacaaaggttcaacctccaacctttcaacccattagcctcgtatggcgagtccgaggtgaagctagaaaagatccctga

SEQ ID NO: 35310 - DNA, 387 bp, Glycine max
  Peptide Sequence Number=SeqID_152088
atggcgactagtaaatatttgactgctcctggggctttcgacagtagtcccagtgtgtccattcaccacatggcgaagggccaaagggagctcaagctatggatattgtcaagaggggtgcatggaatgcctatgaattgtgaagtcgaggatgtctaccctgagtgtcagcaaaaagtagtcggtgcgcaccactttggttgcaagggagcttccttcggtttgaaggtcgcaaatcccttcatgaagttctctcgtgacatacaccccccgaatcaggaaattcttgtagggtgtcatccagtctggttcctccccttcttctgccataacttcctcagtgtctatgctgagagtttggagggtctcctagatgatagtcttgag

SEQ ID NO: 35311 - DNA, 2551 bp, Glycine max
  Peptide Sequence Number=SeqID_152089
gaatttacaagatagtggaactctcaagcgggttgcttggggactggacgtagacacaagggagggtcacgagttcattgagctcctaagcatggacaagagttgtccaatgtcgagaatgttgtccagggtggacatgcttttggttttgcaagtgaggtttaacatgtcagctacaagccagagtagcgctcgcacattgctcttgcatatgtgtcactcgttgagtgggcatatactagagacatggtacgtggtaacccctagtggaccgagaggtcatctccatcggcagttcttcctcaaaggagactcatcggcgcagcctttcgctgcttcttcagtcggggaacctgttttgatcaccatgactctccccatttctgtttttgggaagcaagaaggagtggtgatgaagttaacgggcaaagttgattgggtctccttgaacagtgtgtccaaagatttgttcgagtttgacttgaatgatgttgttgctgatggcttgccattgatgttcaattgggacatgaagcctcacttcccgttctactggcagtcagacccaaccaggttcaagtctttcaacgaggatctgttgacccttgtggagagggtcagcaaggatatcttggagcagctgctgggctcgctgaacacgcagaccattttgtttcttccctcaacgagtgatctcttcactgccttggacgggtggacctgttggtgggactgtgccgctgtctattgttcctctcactggaaagggggtcaaccagctgctggggttggccctactgacaaagttgttgatgtctcccctaacatgccttccattattttggctaagaggaatcatgatgatggtgttggggtgtcatgttgcaagaagttgagggcctcttccaaccttcacgctatgagggaagctgttaggttgacgcctggttcgagtcacccattaagtttacaggatccgccttcagctccatcaattgtccaggcttttactcctgttgttgttcctattcctgctcctccacctcctcctgttgtgcttgttcaggaggtttctaatgctcttgctgctgaacttagtgcattggctgcttctagcggtcccgtcatggttcctccgtccaccatcactacatcgttgttgagtgccaatgtggcgaccatgagtactcttgtggtgccacctcctctttctttagctccacaagttccctccttgactatgttggcgtcggtgtcgccttccacctcttttcatcccaatgtttctttagatcacatctacacttcccgcgatgctgattcactagtggagtgccctaaggtagataatgctactgtcgccttcgctgaagttatgaagtcgaaccaccaactgttttccaaggttgacagtgttcttgcaaagttgttgtgcaccatattagatggcggtgagctatttgagcactgcaaaggcttgcagagggagaaaagtaaattggctagcgaggtagagaacactgctactgagaagtataggcttgctaaggtggtttctgacttagaggccagcttgaaggatttggagtccaggatggaggagtccgagcagaaggcgtctaggcagaaggaggccaacaaagagcttgaagatgagctactgatgtacaagaagcaagctatggagcagcatgaaaagggttttcataaggctgttaggcaggctaggttcttcgtgaaggaccttgacttgggtcattttgaccctgtcaaggacatgaaggacgatgttttgcttgatgaggaagatattgctgctgaggaggaggctgacgaggagcaggatgttgggaccaatgatatgcttgtcatagttcctaaggaattagcttaccaagggcatgctttgggtttttgtaggagtgcataccaaggatggtccttgggtttttgtaccaatggcagaccttgggtttctgatgttcctagaggctcaactagggcagaccttgggtttaatgagctttggactagggacacgttcatcctcggttttggtgaggctcaccaagggtggaccatggatttgacaagccaagggagatgcattgaggctcacaaaggacggaccttgggtattgacaagcctttggagaagcaagacacaccaaggacggaccttgggtctgacgagcctttggagaagcgagacacaccaaggaaggaccttgggtttgacaagcctttggagaacaagactcgccaagggcagaccttgggtttaatgagcctttggagaagtgagactcaccaagggcagaccttgggtttaacgagcctttggagaaatgagactcaccaagggtggaccttaggtttgacgagccttcagagaagcaaccaaggacgcctctgccctgggttttgtcaaggctcaccatggatagaccttggggtggaccttgagtttgatgagcctttgaagttgcgaccagtgacgcgcctctcctgggttttttcaaggcttgccaaggacgtacctttggtttaa

SEQ ID NO: 35312 - DNA, 687 bp, Glycine max
  Peptide Sequence Number=SeqID_152090
atggatgacatctactatgttgctctcatgaataagctattatgggatctaggtgtttaccatgtatttaataagttggacgatgactctaagcacaacatcatggttaaaggttctattatggccaagaagcaatggttcaacaaaacaaaccttaaagcaatgaaagtggcaatggaagaagaagtaagaacaaagaaaaggaatgagcaacaagcaatgtccaacataactcattcaaacactcgtccaaggattgctccagtcagacaaagtccatggaagccatctgagaaaatctcaactgctcaagtgctaagggatatgagtgagatagaggatgaagttcctctgattatcccatggaagtgcaagcaagaaatccaactctacaagaagcaccatctactagggaataagccatggaaggagaagcttcagcaccaagagagtgtcttggataagaagcttagggaggaagcttcaatggaggaaaagaatgagagagagaaaggggggagcacgaaattgaaggagaaaagagagggagagaagccttggatgttcatcatcaatggagtcctttgcttcttaaagatcaatggcagtgaaatggagaaggaagaaagattattggagacgccacttcaaggagaagatgagtcaagaacaagctcaccaccatag

SEQ ID NO: 35313 - DNA, 324 bp, Glycine max
  Peptide Sequence Number=SeqID_152091
atggcggatgacgtaacagaaaatgacggatctaaagggcaccacttcacccgcgatgctgtttgccttcatgaaggtgttggtcaccattccaggctcgtgctcgcgccgccgttccaggcttgtgctcgcgtcgtcgttcctgtcggtggttgcatcgccgttcgtgccgacattggctgcgttctacgtgcagactgcagagggtgtcgcgactgggtgcggctgggtgcagttgggtgcgggagggtcgcggtatggacgctgggtgctggggagggtgcggctggtttgcttttggttggagagctgcgttttgattaa

SEQ ID NO: 35314 - DNA, 327 bp, Glycine max
  Peptide Sequence Number=SeqID_152092
atgcataccaggggatcgcgcccacaagacacccagtggacccggaagagcccaacagggccctgggatttccagctctggttacgggcctctatcagtcctatagggtgcccgtcccccccagcaaggtcatgccatcgtgacatagggatcacgcccgcaagacacccagtggacccggagaagtccaacagggtcttggagtttccagctctgattacgagcctctatcagttctacggagtgcctatcgcccacagcaaggtcatcaggccccctactaaccgagctttcatcaagaagtactgcgcccctaggcaggcgtaa

SEQ ID NO: 35315 - DNA, 420 bp, Glycine max
  Peptide Sequence Number=SeqID_152093
atgcttaatcctcaagagaaaacaacactagagcttctgatgagaatcatgaaactggccaaatacaggcaaaaggcccaagtggagaaggacgaaggcctaagtggagaaggacaaagcccccgagtggagaaggatgaaggcccaagtaatccttgtggcgtctatcctgacttatcttccttcactggaagtgacgtctacccagacttatcttccttcaccggaagtggcgtctaccctgagttatcttccttcaccggaagtggcgtctaccctgacttatcttccttcaccggaagtggcgtcatccaaaccttcgtagcctgtatcaaacgatccgccccgaaagattcacatcatctggtatcagagcttcgactcttgatacagactttttttaaaaaaaatgctgtttga

SEQ ID NO: 35316 - DNA, 1197 bp, Glycine max
  Peptide Sequence Number=SeqID_152094
atggaagctgttaagttggtgtctagtgatccaagtgagagaccagacacataccgagtcgcttacataattcatttcttgcttggtgctggcaacttgcttccttggaatgccttgatcactgcagtggattactttgcctacctctatccaacaaaacacatagaaaaggttttctctgtggcctatatgatttcatcagtgatggtgcttcttgggatgatcagttgggggggttggagcaaaacaacattgaggctgagaatgaacttggggttctccatgtttgttatgtctcttatggtagcaccagtcatagactggacctcaagcagcaccaagctcaatgagagaccgagtggcgcctacagcttgacggttgcagcagtggtgatatgtggtttagcagatggcttggtgggtggaagcttgataggatcagctggaaagctcccaaaacagtatatgcaagcagtttttgctggaactgcttcttcaggtattataatttcgatcttgaggataataaccaaggcatcactcccacaaaccccaaagggactcaaaataagtgctcacttgtacttcatggttgccaccattttcctcctatgttgtattatctttagcaacttgcagcacaagttacctgttatgcagcagtatcatcagaggcttcatcaggagagcaccgtatgcacagggacaaaattttgggcagtggcaggaaaaatcaagggggcagcgtttggaattttcataatctacatagtgactttgtctattttccctggatttatagccgaagatcttgaatccaagattctaagggattggtatcctattttactgataacagtttataacttagctgatctaatgggaaagtctttaactgccttctatgttatgcaatctatgacaagggcaatatgggcagccacagcaagactactattctatccactctttgtagtgtgtcttcatggaccaaagtggctgaaaacagaagtaccaatggtggttctgacttttctgctaggatttagcaatggttatcttactagtgtccttatgattttaacacccaagtcagtgcccttgtcagaatctgagttatctgctattgtcatgacagggttccttgggtttggcttagttggtggttcagttcttggctggttctggatcttatga

SEQ ID NO: 35317 - DNA, 237 bp, Glycine max
  Peptide Sequence Number=SeqID_152095
atgggtcggggtagcaaaagtgtgtgggcggataaccatcggatgtctccgcatgccaccggactaacgggtcgggatagcaaaagtgtgtgtgcggattactgtataggacgtctctgtgtgccactggactcacaggtcacgatagcaaaaggtggggtattcgacaaaagcggggcttttgctcctacgtatcctcaatttgtgatgaggaacttagacctacgtacttcttga

SEQ ID NO: 35318 - DNA, 159 bp, Glycine max
  Peptide Sequence Number=SeqID_152096
atggattacctggtcacgggtcggaaaaaaaaaaggaaggaatttgcattttctcgtatgaaaaatatagcagcagtggaaaatgtgaagatgtatataaacatgagggtgaaaggccatagcaacagtgaatgggtgcttcagaggagtgtgttgtga

SEQ ID NO: 35319 - DNA, 549 bp, Glycine max
  Peptide Sequence Number=SeqID_152097
atgtgcagtgtgaaaaggcaattaactctttgcaaagcagttagtcagccagcaatacatcctccaataattctgaccaaaagaggcttatccatcagttttcccaccacattttcgctttcattggctggtgaggatgctaatgctgcaatacttgatgcagatgatgatgaggagctgttggaaaaagtaaagagggatagaaaaaagagacttgagagacaaggttatcttcaggacctggtgtataaactgagtgaagttggtaaagcaattgaaaacaatgatctagcgacagctgcttctgtctttgggagtggcactgatactgattgggtccaaaatgctaatgtagctttggataagttgagtgccagtcctgaagaaaagaccgtggtggacacattcaattcctcactagcttcattgatttcatcagttgctgcgaatgacgttgagtcctccaaacttgcatttgtgtcttcggccagtgcatttgaggagtggagttccttgacggggctggctgttcagcttaaagggttttga

SEQ ID NO: 35320 - DNA, 378 bp, Glycine max
  Peptide Sequence Number=SeqID_152098
atgcacttccaaagcttctctcttctcatacacattggagcacagaaagagccatcacacgggccacctgatacacaaaaacaacaacatatgatggctcaattaaggaatgtggcaattcttgtcgtagtcgttgtggctgcagtgttactacagagcacagaagctaaagattacgaggtgggaggtgccacaggttggactagttttcctcctggtggtgcttctttctattccaaatgggctgcaaattttacattcaaactaaacgacagtctagttgaagttaatgtttgtgaatctgtgatggaattgttcttttgcagtcttcaacttcgaatctggaagccacagtgtggtggaacttaccaaagctaa

SEQ ID NO: 35321 - DNA, 1080 bp, Glycine max
  Peptide Sequence Number=SeqID_152099
atggcatgtctgaggaggaagaagcactgcgtccaaggccaacaacgcgtttcattttcaaattttgatcatcctcgccagtcaaatatgattgcaaataatattccttcacccgatgaagttgttactcttctcagagcagaaaaaataaggaacgttagaatctacgatgctgatcacagtgttctcaaggcatttagtggaactgggcttgaaattgtagtggggctccccaacgggcagctgcaagacatgagttcgaatccagaccatgctttgaactgggtaaaagaaaatgtacagtcatttcttcctgatacacgcattcgtggaattgctgtaggcaatgaagttttgggtggcggtgactattctttgtggggagttcttctgggcgctgttaaaaatatttacaatgctaccgtgaaacttcatctagatcaactggttcagatttctactgcaaactcgtttgcagttttttcgcagtcctaccctccctcctctggtaaatttgatgataatgttaatcagtttatgaagccactactggagttcttccagcagattggctctcctttctgtgtgaatgcttaccctttcctagtctatgcgagtgatcctgaacatattgatataaattatgcactttttgaacctacaaagggaatttatgatccaacgtatcgtctgcattatgataacatgctcgatgctcagattgatgctgcctatgctgctttggaggatgctggatttgacaaaatggaagtcataattactgagactggctgggcctctaatggagatcaaactgaagctggagcaaatgcaactaatgcaaggacatataattataacctgcgtagaaggcttgcgaagaggaaaggaaccccacatagacctaaaaatgttgtgaaggcatacatttttgcattattcaacgagaacgagaagcctgggcattcatctgagaagaactatggactgttcaaggctgatggaagtatatcatatgacattggttttcatggacttaatgctggacattcatctctgttatctcttaaggtaccataa

SEQ ID NO: 35322 - DNA, 201 bp, Glycine max
  Peptide Sequence Number=SeqID_152100
atggcttgcttggaccagcaacattctgaaaaggagggacaaactattgttgttgtttttgttgtggaggacttgtccatctcagatttggatgattcctccaacctggattgtatctattgcttgaaaggtcataattattctactgttgttggttttgctgctgaggagaagaacatagaccacagactcttgcaacag

SEQ ID NO: 35323 - DNA, 420 bp, Glycine max
  Peptide Sequence Number=SeqID_152101
atggaggaagaaatggattctgacaaggccatttctttcaacaggtcgtttccaaagcgcttagtggagctccaagtttcgaagcagttgagacaactttcagcaatggaattgtatgacaaatcattcgatccaaacgatcattttttgaaatttgaatcgacattgtactacaagggagctttagcctcgataatgtgtcgcatgtttccattgtcattaaagtccaccgtgttgaagtggtttcaattaaagccattgaggagctggggaactattgagagaatacatttcacgattcaacagcgaggcaacagtcgcgagaagcctacaatctggagttgtgctgatgttggcaaaggacggtgtgagagaaggatctcctttctttatatccatatcagaaactccagtagataa

SEQ ID NO: 35324 - DNA, 246 bp, Glycine max
  Peptide Sequence Number=SeqID_152102
atgacaacattggtaacgacaattgacagtacaagtgacaatgatagtggtgttagtagtggtggtggtggtggtgatatcgacgatgataataatggtggtagtgctggtagtgatgacaatgctaggtgtgacaatgagattaatgttggtggtggtgataatgattatgattgtaatagtgataatgttagcgacaacgacattagtagtgttagtgacggtggtgtcaatggtcatgcataa

SEQ ID NO: 35325 - DNA, 204 bp, Glycine max
  Peptide Sequence Number=SeqID_152103
atgggagattcagctaaagttgtgataaaacaagacatgaagggaagaaggcataaatatgggtttaacaacaacaaacgtgagaaggcacagaagaaaagggtggtggatgatgaaactgccgacaaacatcagctggatgaacaccaagagcggctacgcaagacgcttgcacttgaaggagggaaggatatttgcagctaa

SEQ ID NO: 35326 - DNA, 219 bp, Glycine max
  Peptide Sequence Number=SeqID_152104
atgaaagatattgagctggtagaggaggaacaggcacaaattggtgctgatccttctagtgagacctccaataaatctgagaattataaggaggaagcacggaagaaaacacagaagcgtaaaccaaagagggtggagagtgtcaacgctgctgcagaagcctttggtgatgactggaaaattctgattgctctatgcattgtgaagccgaagcagtag

SEQ ID NO: 35327 - DNA, 225 bp, Glycine max
  Peptide Sequence Number=SeqID_152105
atggagggcttgagggacacacttgatgaagctcctaaggaccaaccttgtgaagctcccaaacagtatgggaacaaaagcatgttgagtaaggtgggaatgccaaactctggctacaacatcacaaagtacatctatgccacacttgacataaacctccccaacatgacttgtaacaacttttattcatcttctgctcgacggattggttacatggctatgtga

SEQ ID NO: 35328 - DNA, 322 bp, Glycine max
  Peptide Sequence Number=SeqID_152106
aagtactaaagttgatgtctcgctaagcgagctcaatgcgcttagcgagtatcatccgctaagcgaggcatcaacacgcttagtggataagaggaatctggaagggaatctgtcacgcaggcacgtgctcagcgcatcatcagctcgctcagtgagtcatttgtcatcttctaggcttagcgtgagtttggcgctgagcgaaaattcacttacttgcgctaagcgcgagaatgacgctaagcacgacgtcgaggtcagtgagcccttttcaagcatagaattgcagaaaagagaaaaaaggtctgaagagagcgttgaatag

SEQ ID NO: 35329 - DNA, 213 bp, Glycine max
  Peptide Sequence Number=SeqID_152107
atggaaaccctaactttgtcaggcaagatactgcgaatcgctacagactttgcagacattgacaaaaacttgtcttctcttttgttgacattgtgtgacatgctaggggcagatacactcgtcgaccttgtgatatcgaatgcaactgctctcgtatacccatgccaaccaggtcttggcgacacttcaaaccatcctttgtcatgcctttaa

SEQ ID NO: 35330 - DNA, 168 bp, Glycine max
  Peptide Sequence Number=SeqID_152108
atgttgatgctgattcgagcatccatgccttactttggagtgattgaacaaatttgggagcttgattacaatgaatttagagtgcttgtctttaagtgtaaatgggttgatggaaataccgttgtgcatcaagatgaattgggatttactttagtagaccttaataag

SEQ ID NO: 35331 - DNA, 150 bp, Glycine max
  Peptide Sequence Number=SeqID_152109
atggaactcatgggaagggccctttattacaaccaaaaggcttttactacagctgcctcaaagttggagaagactggatatgacattgttgctcatgaaaatgctgcaaaaagtggatacagtttgaagaattttgttattaaagtgtaa

SEQ ID NO: 35332 - DNA, 380 bp, Glycine max
  Peptide Sequence Number=SeqID_152110
gtttatacggataaccactcgggtatctccgcccgtcagcgtgactcaaaagtcagtatgacagatcttgtgagcgcggaagattatgcttttcgttttacagatagcaaaaaggtttatacggataaccactcgggtatctccgcccgtcagcgtgactcaaaagtcagtatgacagatcttgtgagcgcggaagatgacgcttttcgtcttacagatagcaaaaaggtttatacggataaccactcgggtatctccgcccgtcagcgtgactcacaagtcagtatgacagatcttgtgagcgcggaagatgacatagcaaaaaagaatgtttatacggacaaccactcgggtatttccgcccgtcagcgtgactcaaa

SEQ ID NO: 35333 - DNA, 486 bp, Glycine max
  Peptide Sequence Number=SeqID_152111
atggagcaatttgaccaaaattactttgtggaaattggaattgattattttaaaccaaaacttccagacgttatttttgatgatatatttgagtacgaagatggattaaaaatcaaatttgtccatgcaccaggtcatactccagattcttcttatgtttatatccctgaagaaaatattctgataacaggtgacactgttataaatactatacatcctgaaattgttgaagatagtaatttaaacgtatggattaagacacttgaaaaacttcctaaagccaaacatgtaataccaggccatggagaatatggtgattataaattagttacagatatgattgattatattgaaaaaatcaaaaagataataattggtgaattgagaccagcagattttgaagctgatgaaaatttctctaagagactccatcccgaaatgttagagtggagtttgaaaaatcttttatcaaaaactaatttttag

SEQ ID NO: 35334 - DNA, 720 bp, Glycine max
  Peptide Sequence Number=SeqID_152112
atgggttattatggctacggtaattacggtgatgagctcatgcgactcggtattacagattttctaaaaaaattcaatatacaatatgtcactgcccttccaaaaagaattagcaaagacacaatttctcggtttaatatttttgaaatattggaatacatttacgacagtgatgctgttatatacggtggaggcggtttactccaagatattacaagtacaaggagtttcttgtattatgcttctgtgataaatctgagcttaatcatgagaacacctgttatactcttcggaaatagtattggtcctgttaagaaaaaagcacctgcgcaaagaactgatatggaaatatcaaaaaagcttgctaaaaaacttgaatgtgagctattcgaagatatagaagatgttgacaaatttacttcacttatattatcgtcaaaattcgtcatctctgaaaggtttcatccagttgttgtcgcgtcgtactacggtattccatttatctcacttgaaaattcaaaatcacagagatttttcagaaaatacacaagtcgaagagaatttttcgcaagaaatttgattgatatagaaaaaagattagtccctattttaaatgagcctttgaagcttaaagaaataatggataaagaatgcgatgaaagttataaaaaattatataaaacattgctaagagcaacatcaaacataatttataaatag

SEQ ID NO: 35335 - DNA, 285 bp, Glycine max
  Peptide Sequence Number=SeqID_152113
atggcacatttactgatacttgttattcctttcatcatcaaccccgccgtatctctgaactttgccactgttcttcgtgaatccaagctcttactcactgattccaccagttaccaaacccttcgcaagaatcatcccttctcagatttcttacaatgtcgcaaggacaagcagttccatttgctgggaagtggcaacgctttacagtcaggaatgatggagaaaaggtggttccagaaccatatggtgacacagaacagacagaaacctgggaatcagaggtga

SEQ ID NO: 35336 - DNA, 238 bp, Glycine max
  Peptide Sequence Number=SeqID_152114
gtggcgactccttgcgtattccttccttggaacacgcacccgcgagtcacgcgtcgccctcccgccgaaggatggtccatggcggcgttggctagcagcagcggtggtaaaggatgatccctttcgcttctttgatgattttgtcggaagtggtggcacaaaggaggagtgtggctgcgcagcgccactgcatttcgtgagtatttatagaggaggatgtgatgtaatcgattacaag

SEQ ID NO: 35337 - DNA, 618 bp, Glycine max
  Peptide Sequence Number=SeqID_152115
atgttgaaaggtttaaatctgtctgctgatgaacatatatcatcactgaagcaaaattctgggcaaaagaagagaagaaaggaaactgcttcaggcaagaaggggactgataaaaatgctgcaggtgctgttctttttgtttcattttggccaggatcctctatgccttcaagatctgatcttgtctccgtgtatagcaagtttggagctctgaatgaagcagaaaccgacatgttctgcactaactacacagctagagtgtccttccttagaacttctgatgctgagaaggcatataaccattcccaaaacaataacccttttggatctcctactgatgtcacttttcagcttcagtattcctctgatggatccaagtctggacaacagggtgaaagatcaaagaacaagtctttgccagcagctacagcacctgttgcattctcacagggtactgaagcatccaaattgatcttcatacagcagaagcttcaaggtatgactttgatgctagaagcatcgggtggcaaatctcctgatatgatggcaaaggtagagagcgagatgaaggctcttttggaggatgttaacaaaatggttgaagcttctttgttttag

SEQ ID NO: 35338 - DNA, 245 bp, Glycine max
  Peptide Sequence Number=SeqID_152116
ggcacttgtgttggaaagaatggacagctccatttttcgccttatagtttcgtcgtgtcttctttttactttcctgctggaagctgttcatggcagcaaaaaggcaagcttgttgttgctcatttagctataacatgttacattgtatacttgggagctcattctcatggtcctagccctacctctcttgacctcgaaatcgctacccattctcattatgatttactagcttcagtcttgggaag

SEQ ID NO: 35339 - DNA, 249 bp, Glycine max
  Peptide Sequence Number=SeqID_152117
atgaggaggtatttgaggcctcttgtggctaatgtagctatagttgccaaatgccatttaagtgcagtctataggcatgaaaaggggaaactttttgcccaattcgttgatttactacaattctatgaatggtttgagattaatgatcatacaggaacacaattaacagatgataaggttcttgaatctcattatagccgaatgcagtcattccagctacttgcatttaaaaagatggaaaagatataa

SEQ ID NO: 35340 - DNA, 432 bp, Glycine max
  Peptide Sequence Number=SeqID_152118
atgggggctgagagtgaaagtgagaatgtgaggagttttgaagaaaagaggaaaaattgggaatggaaagagagacagaaaaccttaaccttcgtgagaatgacattgttgagaatgaattgtgtttgttggggagaaatcaaacctcggttttctgcgatttcagatcccagaacttatggaatggaaggcttgttacttagggctcttgaccagaattgcatgaagaaggtttcagaccatatttgttcagggtgcaactatttcctaaaactggctaaaggaagtaggaagaaatcatttgggagcaaaggtggtggagggatggcgaatatagttgataataatacgttggaggtgctgaatactccattcaaacacgaggaagtgaaagagtttgttctacaaacatttttgggaggtagtgggtga

SEQ ID NO: 35341 - DNA, 1692 bp, Glycine max
  Peptide Sequence Number=SeqID_152119
atgaagcactattccactgtttccctttctcaccgattggaactcaagggaattcagcctgacctttttactttgaacattctcattaattgtttctgtcatatgggtcaaatcactttcggcttctctgtattggccaagattctcaagaggggttacccgcccagcaccgtaaccttgaatacactgatcaaaggtctctgtcttaagggacaagtcaagaaagcactgcactttcacgacaagctattagcacaaggatttcaactcaaccaagttggttacgggactttgatcaatggagtatgtaagataggagacacaagagctgccatcaagttgctgaaaaagattgatggacgactgactaaacctgatgtggtaatgtacagcacaattattgatgccctgtgcaaatatcaacttgtaagtgaggcttatggtttattttctgaaatgactgtcaagggaatttctgctgatgttgtcacttataatactctaatatatggcttctgcatcgtgggtaagttgaaagaagcaattggtttgttaaatgtgatggtattgaaaactatcaacccagatgtttatacctataccatactggttgatgcattatgtaaagaaggaaaggtgaaagaagcaaaaagtgtgttagctgtgatgctgaaagcatgtgtggaacctaatgttattacttataatactttaatggatggatatgtcttactttatgaagtgaggaaggcacaacatgtattcaatgccatgtccctaatgggagtgactcctgacgttcacacttacacgatcctcgttaacggattttgtaagagtaaaatggtggatgaggcattaaatctctttaaggaaatgcatcagaaaaatatggttcccaatacagtgacatacaattctcttattgatggtttatgcaaatcagggagaatatcttatgtttgggatcttattgatgagatgcgtgatagaggtcaacccgcagatgtaatcacctacagttctttaatagatggattatgcaaaaacggtcatcttgacagggcaattgcattgttcaacaaaatgaaagatcagggaattcgaccgaatatgttcacattcactatacttcttgatggactatggaaaggtggaagacttaaggatgcacaagaggtttttcaagatcttttgactaaaggatatcatctcaatgtctacacatacaatgttatgatcaatgggcattgtaaacagggcctgctcgaggaagcattgaccatgctgtcaaaaatggaagacaatggttgcatccctaatgcatttacttttgaaactatcatcattgctctctttaaaaaagatgagaatgataaggcagagaaacttcttcgacaaatgattgctagaggcttgttagcttttaagttccattctctatctcttgggtttatctctatctacattgttgagagtggtacaacatcggatcttagaatcatcgatgcacctttccatgaccagctctactttgctgttgctaatcaaccatgcttgcttgatgttggaattgatgcaatgaaaaatagcaagcacaaggtgggtttctgtgtgctcacactagggttagttgaagttgttaacagtgttgttggttggaaaggagggcaagtactcctggagttgtga

SEQ ID NO: 35342 - DNA, 186 bp, Glycine max
  Peptide Sequence Number=SeqID_152120
atggttgtggttttcaagtggcggtatgacctgaaggtttgggtactgctacttctcgcaccaccacgttcaacaacagaccccaacgcttgtacaagctttggtggagctcgtggtcagtttcaataccatgttctcatcttctctagcgccatcggtatcggtattggtcgtcaaagactctga

SEQ ID NO: 35343 - DNA, 411 bp, Glycine max
  Peptide Sequence Number=SeqID_152121
atgggaaaaattgcatcaactcaaggtgatgtttacagttttggtgtacttgtgctagaaatagtgacgggtagacgcccaacagatgtccttgtccatgaagggtcttgcttgcatgagtgggttaagaaacaatatccacacgagcttggtaacattgttgaacaagcaatgcaaagatgctgctcttctccctctggcatgcctaatcagtatcacaaatttgggcaagatgttatgttggaactcatagagttggggcttctctgcacacaccacaatccttcaacaagaccaagcatgttggatgtagcccaagaaatgggaaagttgaaggactacctttctcatctatcatcttctctgttgaggctgactgaagataaatttagccagaaaataaataactaa

SEQ ID NO: 35344 - DNA, 228 bp, Glycine max
  Peptide Sequence Number=SeqID_152122
atgatggacattgattgtgcaatcttgcttcttatctccgtcaaggacaacttgacctaccaacgcaataatcaagcttttgatctagataatttaatttttgtggaacttaatgatgatgcacaatctgaggaagaccttgatgatgatgatggagatggagatgatgatgaaagtgatgatattcatggagatgatcctcttagaggattggacatgcttctttga

SEQ ID NO: 35345 - DNA, 138 bp, Glycine max
  Peptide Sequence Number=SeqID_152123
atggatagatctttgaataacatggtgacaatgacaagtaggaagggctcagattttgtatcaaaagccattgatatagctgctaatgagattcttggtgttgctactcctggacaaggtttgctgttatgctcttga

SEQ ID NO: 35346 - DNA, 756 bp, Glycine max
  Peptide Sequence Number=SeqID_152124
atgtatgcattacacgtggggaactcaagacacaacaacttaagcaacgttaagggacgtttgggtatagtggcacgctcacaggggactacgtatgagttgatgacacgctttgtggtttcggtatgtttgtcgggtgcaagtgcaaagacttgtgcttcgattggaacactatctttttatgtaaattgcttagtaatggatgacaggacaaaggggaaagaggacggagtaaattgttcaacccttctggtatttgaggattctctcgaaattagtgagcaaaattgtttccgtgaaaaaaatctaagtcgaggtgcttccgtaacgcttccgagacgtttccatgagcgatttcgtgaagattcttcaccgttcttcatcgttcttcgtcgttcttcggtcttcaaccggctattgtcccttgtgacggacgcgtggggtgctaataccttgcccatgcgtaaaaacaactcccgaacctttcacacttttcgtagatcgaccacacctttttcgatttttctgacgttttcctcaaataatcgttggtggcgactccgcgcattttcctttcttggaagacgcactcgtgagcctcgcatcgcccttccgtcgaaggcgtgcattcctgatgcaatcctccctaggaagggaccaatcactagaaccatgagcaagaggctccaagaagattgggctagagctgctgaagaaggccctagggttctcatgaaccttagggtagatttctga

SEQ ID NO: 35347 - DNA, 2434 bp, Glycine max
  Peptide Sequence Number=SeqID_152125
atgcttccattttcaatggttctgtttctctttataaccattgttcactcaggagtttatggggaggagaacgtgaccttagtgagtgaaaaagagtcacttgtttcattcatgtcaggcattttttctgaccccaaaaacgttctaaaaagttggaagtccccaagtgtacatgtttgcaattggtatggtgtaagatgcaacaatgcaagtgacaacaagatcatagagcttgctcttaatggaagctcacttgggggcactatttcccctgctcttgctaatctttcttatttgcaaattcttgatctttctgacaattttttggtgggtcacattccaaaagaactgggctatttgattcagcttcaacaactcagtttatcagggaattttcttcaaggggaaattccctctgagttgggttcatttcacaacttgtactaccttaacatgggaagtaatcagcttgagggtgaggttccaccctcacttttttgcaatgggtcttccacattgaggtatatagacctctctaacaattccttgggaggacaaatacccttgagtaatgagtgtatccttaaagagcttaggttcctcttactttggtcaaacaattttgtaggccatgttcctttagctctttcaaactccagagaactgaaatggtttgacgtggaatcaaataggttgagtggggagttaccatctgaaattgtaagtaattggccacaactacaattcctctacctatcatataatggctttgttagccatgatggtaacaccaaacttgaacctttcttctcttccttgatgaatttgtctaacatgcaaggcctcgaattggcgggaaataatctaggagggaagctacctcaaaatattggtgatcttcttcctagtagcctgttacaacttcacctagaagacaatcttatacatggttctataccttcaaacattgcaaaccttgtcaatctgactcttctaaacttttccagcaacttgctaaatggatcaatacctcacagcctctgccagatggggaagctagagcgaatttatttgtcaaataattcactatctggggagattccttcaacccttggtggcattaggcgtctggggcttcttgacttgtcaagaaacaagctttctggctcaataccagacacttttgctaacctcacacagttaagaaggcttttactttatgacaaccagctttctggaaccatcccaccaagtctgggaaaatgtgtcaatttggagattttagacctatcccacaacaagatttcagggttgatccctaaggaagttgcagcctttactagcttgaaactctacttgaatttatcaagtaataacttagatgggcctttaccattagagctctccaaaatggacatggtgctggctattgacctatccatgaacaatctctctggcagaatcccaccacagcttgaaagttgcatagcattagagtacttgaacctttctggaaactccttagaaggccctctaccggattcattgggcaaattggattatattcaagcacttgatgtgtcttcaaatcaattgacaggggtaataccacagtcccttcagttgtccttgtccactctcaagaaagttaatttctcttccaacaaattctcagggagtatctcaaacaagggagccttttcatcttttaccatagactctttcctaggaaatgatggtctttgtggctcggggtaccccaccataaaatgttcaaaagaaagaatgcaaatggcaatagttagcaaaggagattttgatgatgaagacgaggaaacaaaggagctcaagtacccaagaatttcatatagacaactcattgaggccacaggaggctttagtgcttcaagccgaattggttcaggtcgatttggacaggtctacaaaggaattctccgagataacacacgaatagcagtgaaggtgttagacacagcaacagctggtgatattatttcagggagcttcagaagggaatgccaaatcctgacgaggatgagacacaggaatttaataaggatcatcacaatttgcagtaaaaaggagtttaaggctcttgttcttccactgatgccaaatggtagtcttgagcggcacttatatccgagccagaggttagatatggttcagctggtgaggatctgcagtgatgtagctgagggaatggcctatttgcaccactattctccagttagagtagtgcactgtgatcttaagccgagcaatatactacttgatgacgatttcacagctttggtaactgattttggtatcgcaaggcttgtaaaaagtgatgacaacatgcccacaagtgactcatctttctgttcaacacatggcttgttatgtggctcccttggctacatagctcctg

SEQ ID NO: 35348 - DNA, 507 bp, Glycine max
  Peptide Sequence Number=SeqID_152126
atggactctgggcataagccaactttttcaaagtctgaaatttttgttccttttcatttgtctgctgatactttcataacatgtgttatggtagaaagtcatctaaattgcggccacccttggcttgccttaacagcagcagccacttcggagctccttcattgtgatgggtgtaggcattattttatactgctgcaagagctttttaagttccattctctatctcttgggtttatctctatctacattgttgagagtggtacaacatcgttgcttagaatcatcgatgcacctttccatgacgagctctactttgctgttgctaatcaaccttgcttgcttgatgttcgaattgatgcaatgtatacaaagccttccaatcagagcaacttcatttgcagacatcaaattaaaaaagttatgctagagcctagagggaaaaatagcaagcacaaggtgggtttctgtatgctcacacaagggctagttgaagttgttaacatgtaa

SEQ ID NO: 35349 - DNA, 243 bp, Glycine max
  Peptide Sequence Number=SeqID_152127
atgaagtatccaaactattatcagtgcttcagcctcgatgaagtaaactcctcggagttatcagtgcttgataatcttgaagcagatgatgagcaaagctttatagagaagtgggatagagacaacagcattctccaccaactcaaagtcgcgcatgattcaagactcaaaaattgtctgagcctgagtgacaatgtgagagattgggaaacaaaacgtgaggtggccatggaaatgtattag

SEQ ID NO: 35350 - DNA, 109 bp, Glycine max
  Peptide Sequence Number=SeqID_152128
atgataaaaaagacaacaatagataccatagagccctataccggggcaattagaggcaccatgcatgagcctcaagcggacctaggggcagatcaaaagttctcacccg

SEQ ID NO: 35351 - DNA, 162 bp, Glycine max
  Peptide Sequence Number=SeqID_152129
atggtgccagagatagatgttgggaaggtgacctcagacccattgtctatttatatggatgtggctttggaggttaatggtgcatttaagtctaacccaatccaggaggacgcctatgactgggtcatcaagagtgattcgatgagtagtggtgagtactaa

SEQ ID NO: 35352 - DNA, 165 bp, Glycine max
  Peptide Sequence Number=SeqID_152130
atggaagacttgatcacaacactgcaccaacttggggagctgaaattggagaaggccatgccaacagatgattcaagcgtttggaatgaccttatggccacctacgagcgtgtattgcagcttaaacaggacaagttcaagtcaccaacctctcaatggtggtga

SEQ ID NO: 35353 - DNA, 363 bp, Glycine max
  Peptide Sequence Number=SeqID_152131
atggaaacatcatcgtcctccaatgattcaaagaaagggcatgaagtacttctcagcttcagaggtgacggcacgcgtaacactttcactggccatctcaacgttgctttgaaaaggtgtgacatcagaacctacataaacgaccacgacctcaaaagaggggatgaaatatcctacaccctcctcaaagaaatcgaggatgctaatctttccgtcatcattttctccaaaaacttcgccacctcaaagtggtacctcaaagtggtgcttggacgaggttgtcaaaatactcgagtgcaaacaaaggcacgggcaaattctgctgcctgttttctaccatgtggagccatccacggtgcataa

SEQ ID NO: 35354 - DNA, 735 bp, Glycine max
  Peptide Sequence Number=SeqID_152132
atggcgtcagcatcatctttttcattcattcctcaagaaaccgacgatgtgttcataagctttagaggcgaggatactcgccacactttcactgctcatcttcttgccgcattctacaggctaaaaataagaacctacgttgactacaaacttgggagaggggatgaaatatcaccaactctcataagggctattgaggagtccaaggtttcggtgattgttttgtccaaaaactatgccacgtcgaagtggtgcttggaagagctcgtgaaaattatggaatgcagaagaacaaagggtcaaatcgcgataccggtcttctatcatgtagatccatcagatgtgcggaaccagacaggaagttatgcagatgcttttgcgaatcatgagcaacgattcaaagacaacgtgcagaaggtggaactgtggagagctagtttgagagaagtaacgaacctctctggatgggattgcttggtcaacagatctgatgatgtccacaaaataccacacaagatgtccataaaaaatgtacaaaaagaaccatcatcactgctaatatccatcgtatcaagacatatatctaaaaaattgccacagatgtctactgccctgcatcatcaccctggaaccagtaaaaataacataaaaacaccatacatctgcaattcctatttccttcccagaaatctaattattcctagcacgagcaatgcttatatactagaggattag

SEQ ID NO: 35355 - DNA, 165 bp, Glycine max
  Peptide Sequence Number=SeqID_152133
atggagagaggccgacaggcgacaccacggaggctaggtgacggagagcatgacggatgtgttgttgagacctataagaatatccaaaacaagctctgtgacatcatcacccactacctcccaaaactgattgtagaacaagctctttcacttcctcgtgcttga

SEQ ID NO: 35356 - DNA, 2022 bp, Glycine max
  Peptide Sequence Number=SeqID_152134
atgtcgctgccaacaaggttaaggttttctgtctctctttccattcccaatttttcctcttttcttcaaaactcctcacattctcactttcactctcagcccccatccattcaaaatgttgacgatgccgtttcccaattcaatcgcatgctgtgtatgcgtcataccccacccatcatccaatttaacaagattttagattcctttgcaaagatgaagcactattccaccgctgtttccctttctcaccgattggaactcaagggaattcagcctaaccttattactttgaacattctcattaattgtttctgtcacatgggtcaaatcaatttcggcttctctttattgaccaagattctcaagaggggttacccgcccagcaccgtaaccttgaatacactgatcaaaggtctctgtcttaagggacaagtcaagaaagcactgcactttcacgacaagctattagcacaaggatttcaactcaaccaagttggttacgggactttgatcaatggagtatgtaagataggagacacaagagctgccatcaagttgctgaaaaagattgatggacgactgactaaacctgatgtggtaatgtacagcacaattattgatgccctgtgcaaatatcaacttgtaagtgaggcttatggtttattttctgaaatgactgtcaagggaatttctgctaatgttgttacttatactactctaatatatggctcctgcatagtgggtaagttggaagaagcaattggtttattaaatgagatggtattgaaaactatcaacccaaatgttcatacctataccatactggttgatgcattatgtaaagaaggaaaggtgaaagaagcaaaaagtgtgttagctgtgatgctgaaagcatgtgtggaacctaatgttattacttataatactttaatggatggatatgtcttactttatgaaatgaggaaggcacaacatgtattcaatgccatgtccctagtgggagtgactcctgacgttcacacttacacaatcctcattaacggattttgtaagagtaaaatggtggacgaggcattaaatctctttaaggaaatgcatcagaaaaatatgattcccaatatagtgacatacggttctcttattgatggtttatgtaaatcagggagaataccttatgtttgggatcttattgatgagatgcgtgatagaggtcaacctgcaaatgtaataacctacagttctttaatagatggattatgcaaaaacggtcatcttgacagggcaattgcattgttcaacaaaatgaaagatcagggaattcgaccgaatacattcacattcactatacttcttgatggactatgtaaaggtggaagacttaaggatgcacaagaggtttttcaagatcttttgactaaaggatatcatctcaatgtctacacatacaatgttatgatcaatggacattgtaaacagggcctgctcgaggaagcattgaccatgctgtcaaaaatggaagacaatggttgcatccctaatgctgttacttttgacattatcatcattgctctctttaaaaaagatgagaatgataaggcagagaaacttcttcgacaaatgattgctagaggcttgttagcttttaagttccattctctatctcttgggtttatctctatctacattgttgagagtggtacaacatcgttgcttagaatcatcgatgcacctttccatgatgagctctgctttgctgttgctaatcaaccttgcttgcttgatgttcgaattgatgcaatgtatacaaagccttccaatcagagcaacttcatttgcagacatcaaattaaaaaagttatgctagagcctagaaggaaaaatagcaagcacaagttagacatcctaaccaaattgaaagagtgggagaagtcagaaggtataaataggaggaaaactattgagttagattggatttggagtgttgttggttggaaaggagggctagtactcctggagttgtga

SEQ ID NO: 35357 - DNA, 483 bp, Glycine max
  Peptide Sequence Number=SeqID_152135
atgaggtctcacatgaggatggggattcctattattttggtagataaaggaagggagataagagttagaggagtaaagacccaagtaccttcttcccaaggaaagaatgatcttaaggcctatcttgagtgggaaaccaaacttgaacaaatatttttctacacccggcgtaatgaagagaggaaggtaaaggtggcagcccatgaattttctgactatgccttaatttggtgggaccaagtagaaaaggagagggaaaggaatagggactaccccatagatactagggaggagatgaaaagtttgatgagaaggagatttgtaccttcatgctaccatagggagttgcacaacaaactccaaaggattacccaaggaagtaggagtgtggatgagtacttcaaagagatggaggtagccatgattagggccaatgttgttgaagaaagggaggctaccatggcatgtttccttcatggttaa

SEQ ID NO: 35358 - DNA, 795 bp, Glycine max
  Peptide Sequence Number=SeqID_152136
atggcttctaaaacctctaacatgtttccttctactaatgaatcttcttcttctaagagtaggaacatcaagtgcttcaagtgtttgggaaatggacacatagtgtctcaattcccaaacaagaaaataatggtgttgagggagaatgaaagaatctctagtgactcatatccaaattccccaacaacaaatgaaggagaagtggagtacaaagcctatgctatggatggagacttgttaatggtaaggagacttttgggaggtcaagccataacaaaggaacaagacaaagagaaaatatctttcatactagatgtgtcattcaagagaagcaaagggatggttgccaaactcaacctaaagactactgcacatcctaagccatacaagcttcgatggctaagtgaagagggagagttgctcatggaccaaaaagttttgattaatttctccataaggaaatatgcagataaaatattatgtgatgcaattcccatgaaaacttgtcacattcttcttgggagaccatggcaatttgatagatgtactatttatgatggtcattccaataacttctcctttgtacacaatgatagtaaattcactcttgtatctttaaccccaagagagaaaattgggagtgttaacccaaggaagaagggcaacaatgattcattgagcctcgttgctgcagcccctttacttagaaggccgacttgggagaggattaggtattggaggattaatttgaggatgaatttcctcaaagaaggaatgaatgatggagatcaatga

SEQ ID NO: 35359 - DNA, 267 bp, Glycine max
  Peptide Sequence Number=SeqID_152137
atgaaggatttagtggccaaaaggcatgatgttttgcagattcagagagagcaatccaaccgtaagatgggattccgcgggggtgcacctttcatggtgaagcagtccatgtcattttcaggcattgagaacaagtgcgatgaagtacatggagaagatgagttatccgatgatggggtcttccagtgtggggagaagaagaagaggttgaatttggaacaggtgaaggcccttgagaagagttctgatctggcgaacaagctttag

SEQ ID NO: 35360 - DNA, 159 bp, Glycine max
  Peptide Sequence Number=SeqID_152138
aaaagcaagggagggggacttgcggccatggtgtcaggcatatattatgagggattatgtaaagagattcacaatgattccatactaatcgttatcttcttcacattcttctcaacagaacaaggacatttactgtgcaaagggtgtcttagtagatga

SEQ ID NO: 35361 - DNA, 390 bp, Glycine max
  Peptide Sequence Number=SeqID_152139
atggagctctacaaagtaatgatgaatgtggaagagaaaaccgcagttcccgataaccatacgttccattttgttctgaaggcgtgtgcttacacgttttctctctgtgaaggaaaacaagtgcatgcccacgttttgaaacatggtttggttcatttttatgcgacatggggatgcctaaacttggcaaagaaaatatttcataagatgagtgagagaaatgaggtttcatggaatatcatgattgattcttatgctaaaggtggaatctttgacactgccttgagaatgtttggtgagatgcaaaaggtgcatgaccttgatgggtatacaatgcagagtgttataagtgcttgtgctggtttgggtgctttctctttgggtttgtag

SEQ ID NO: 35362 - DNA, 801 bp, Glycine max
  Peptide Sequence Number=SeqID_152140
atggcttatagggatgtgaattcatggaattcaatgatattggattttgcaatgcacggtgaggctgaggctgcattggactattatgtcagaatggtgaaggtggagaaacttgtgcctaattcaatcacttttgttgatgtcttgagtgcatgtaaccataggggaatggttgataaagggattgtgcattttgacatgatgactaaggagtacaatgtggaaccaaaattggagcattatggttgccttgttgacctttttgctcgagccgggcgcatcgacgaggctctaaacttggtatcagaaatgccaatcaaaccagatgctgtaatctggaggagtcttttggatgcttgttgcaagcaacatgctagtgttgagctaagtgaagaaatggcaaagcaagtctttgagtcagaggggagtgtgtgtagtggtggtatttatgtgcttttgttgaaagtgtatgcttctgcttgtaggtggaataatgtaggattgctcagaaaactaatgagtgaaaagggtgtgactaaagattctggttgcaatccaatagaaatagatggagaggttcatgaatttgttgctggtgacaccactgatccacaaagtgaaaatgtatacaagtttgtgaatgaaattgagaagttagaatcaatagggtatttacctgactacttaggggcacctatggttgatgagattaatgatggaaaacagaatactctgagggtgcatagtgagagactagccatagcttttggtatcttaaactcaatctggcgtgccaattag

SEQ ID NO: 35363 - DNA, 525 bp, Glycine max
  Peptide Sequence Number=SeqID_152141
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataagtaaaataacgttaaaaagtcaagctcaacagggtcttctttccccgctgattccgccaagcccgttcccttggctgtggtttcgctggatagtagacagggacagtgggaatctcgttaatccattcatgcgcgtcactaattag

SEQ ID NO: 35364 - DNA, 657 bp, Glycine max
  Peptide Sequence Number=SeqID_152142
atggtcgagatttcttcaaggcaaccggttgtaacaggagatttcttcaggacaacccgccgtgccaaccagcttgatgaaatgtctgagagctctgaggaggagggtcagattgtgaacaaagaaagggttagggaagagaagggagaggatgagagattgcggcgtggaggaagagaagatgaaggagatggttggggtggtagggattctcgtccagggaataaccagggtgaaagattcgctaccactgcgcttcctcatgtcatcctcactcgactcgttgttgcttcttctagccatacaaaccctaattcaattcgacggaagccaaatccaaaatcgaagaacacagagaaagcacaaatttcaaagacttcacttcgagcacgcgataaaaataactgcatcgagggtgttggaggtgccgagggtgggaaggtttcctgcgttgtcggagagggtgaggccgatttggatcaggtggaggcgatccacgttggctttgagcatggcgtagtgcgcggcgggttagcgatggcggaaagaggggtcacaagcgtaggagcgtacatcagaatacctcacaatccggttgccatcattaaatctggtccatttaatatttttattattaaatcggatggacccaaatga

SEQ ID NO: 35365 - DNA, 1209 bp, Glycine max
  Peptide Sequence Number=SeqID_152143
atgattcctgatgccttaattgaaggtactatgatttccaagagccctggggaagcaattgtaatcattgactccatagcaactggtgattatcaaagtcaccatgataaggctccgattcaaaggaaagatgtgatttttgtggtggtgaccatcagaatgaccactgctcagcacttggtgattgccaacatggggaggaggcccattatttgtagaatcaaggcaaacctcaacaaagttttcaaggaaattatcaaggctaaagaggtgatcaagacaacaacaagttccaacaccgccgccaccacgttccgttccggcatggagctcttccaccgcgcgaaggcggtgcgcctccgcagccaccacgacaagtacctcctggccgacgaggacgaggagtccgtcacgcaggaccgcaacggatcctcccgcaacgccaagtggacggtggagctcattccggagttcgacaacatcatcagactcaagagctgttacggaaaatacctgacggcgtccaaccagccgctgctcctcggcgtcacgggccgcaaggtggtgcagagcgtgcctcggcggctcgactcctccgtcgagtgggagcccgttcgcgacggcgcgcaggtcaagctcaagacccgttacgggaactttctcagagccaacgggggggttccaccttggaggaactccgtgacgcacgatatcccgcataggaccactacacaggattggatcctctgggatgtggatgttctcgagattcatgtggtgttccctgctccgcctccgattccgcattccgattcgcttgattttgagtccaatactccttctgctgttaacatcaaatctaccaccttctccagacaagagtcaacagattcgaatgtgagttcgccgccaaaggtggaggggaggactatatactaccatgttgcagaagataatggggatgtggatgatgagaatgtgcagggttattctttgaatttcaaagggaatggggttgagcagttggctcggaagtttgaggaagaaacgggacttgagggagttattgtgtgcactcgaagtcctttgaatggaaaactctaccctcttcgcttgcagcttcctccaaacaatgtcaccatgcaggttgttttggttcttccctcgtctaaagtggcaagagaatttgaggagcaaggtatactatga

SEQ ID NO: 35366 - DNA, 501 bp, Glycine max
  Peptide Sequence Number=SeqID_152144
acctccccctgccgaagtgtcagctggtctaggccatcatgactcagggattacgcctccaagacacccagtggactcagagaagtccaacagggccctgggatttcctgctctgatcatgggcctctgccagttctatggagtgtcggtcacccccatcaagctcatccgaccctccatcaatagagccttcatagaaaagtattgtatgcctaggcaggtgcatggtcaagcactgcaacatccagaggaggacccacagcaaccagctgcagatgcgccactactacctctagaggagggggcaggtgcagttgaacgagacattataccgcctggagacgagaccgatttggagacaaggttagaacccgcaagggcccctagggatgatagaggagctcagggactccaggtcctcacaattatcatttccaagactatcacagtcttctttgcctccgagactatcaagtctgttggcatgcagagacaaccaag

SEQ ID NO: 35367 - DNA, 225 bp, Glycine max
  Peptide Sequence Number=SeqID_152145
atgagcggagttgccaccaacgtttatttgaggaaaatgctagaaaaaccaaaaagaaaggtcgaaggtctgcgtgttttgaaaatgagggttcaggagttgtttacgcatgggaaagcaaaacaaggcatttgggatgaaggtcagctcgtccaggcgacctgttacttcattttgaagcaaccttgctcgcccaagagaggtggttacttcaccatgaagtaa

SEQ ID NO: 35368 - DNA, 243 bp, Glycine max
  Peptide Sequence Number=SeqID_152146
atgagaggcaccatgcatgagcctcaagcgaacctaggggcagatcaaaatttctcacccgatgatgacaaaaagcccaagagaatgacttcgagattgaatcaagaatcaagtttcaagaatcaagaatcaagaatcaagaatgatcaagatcaagattcaagactcaagattcaagaatcaagaaaagactcaatcaagataagtactaaaaagtttttcaaaacattgagtagcacatga

SEQ ID NO: 35369 - DNA, 327 bp, Glycine max
  Peptide Sequence Number=SeqID_152147
atggagcatttcaacaaagccaaagccaaagccatgaagctccgcagccacctcagcaagtacctcgtcgccgacgacgacaaactctgccaaagcaaacaaggtgccaccaaaagggcaggggaacaaggtggtgctggcgaatttcgactagggcatggattggaagttggagtgggaacccataacaaacagtttccacatgaagctgagaagctgtttcctgtgaaaattgtttctttcacggagagcaagttttcgtcattggattcggaggataagcttccgggttcggaaggagagtcgttgaggagtcagaactcgcag

SEQ ID NO: 35370 - DNA, 576 bp, Glycine max
  Peptide Sequence Number=SeqID_152148
atgctagatccagcctctgaattggtgccaccaccatcttcacccacaatttcttccatttcttcctctgatcttgacactgagtccaccggatcattcttccatgacagaagcaccacattggggacactaatgggagtgaacttcccaaccattgcattcagagtcccatcgcagcaccggaaccctaattccgccgccgaggacaccggcggcgcaaggagggccgccgccgcagtcaaaaagaagaaaaaggctacctccatcgcgacggtggcggagaggcggcggaggtggtggcagctctgccgcgacggcgacgccaggccagcgtctctcggggagtttctggaggtggagcggaggttcggcgacggcgcgttctacggcacggcggcggagctcgagggagtggtcgccggccaccagcagaggaacggcagcagggtgctcttcgccgacgggagggttcttccgccgccggaagacgtcgacgatcgagcaccgccgacggagagcctctgtaatcggtttccggtttcgcttgccggaatttgtagcggcggtgcggcgtag

SEQ ID NO: 35371 - DNA, 234 bp, Glycine max
  Peptide Sequence Number=SeqID_152149
atggcagaatctgttcttaaggatgagacactaccagaatgtttattcttaattcttgatgaaatcattaagactgttctaatctttctgccaggttctcctttgctatcttcgaatatgctgaatgaccaagatcagttaagggagttggaaaatgcagttgtcaaagaaactgaagctaaaatgaactacagaaaaagggtagttgttgagcatacaaatgataacagatag

SEQ ID NO: 35372 - DNA, 231 bp, Glycine max
  Peptide Sequence Number=SeqID_152150
atggggtctgcctggaaaaccctcaacatcagtaacaacttcttcaacaggtgctcttcattcaattcctctgcggtcgtaggagggtcctcaacaacacgctcttgttgtcactgtctacaggctgatacagcaggccttcgccactgggggacatcatcgtcactcgggtctctcttccccatggcttttcctattgctcggtctaaagtccgaccaagacctctctag

SEQ ID NO: 35373 - DNA, 276 bp, Glycine max
  Peptide Sequence Number=SeqID_152151
atgttaaattctacaacagatggaagagggtgcatagtaatcaagcgagtgaataaggccacggcatcatcgatagcatcaaacccagatttttttttcgcattttgtttttgggaatcagaaaagaacctcagaaagacactaaatttggaaatcgcataccttaatcttgttgtcgtagcagcgtacaacatggcggccttccttccaaagttgaagaaaaagattggatttttcggtgattccattcaatgtctcttcccaaacttcgaatga

SEQ ID NO: 35374 - DNA, 934 bp, Glycine max
  Peptide Sequence Number=SeqID_152152
atgaagcattacccaactgctatatcactttctaaacaaatggggttgagaggaatcacaccgtccatagtgactttgagtatcttgatcaattgttactgccacttgggtcacatgggttttgctttttctgtgttgggcatggttctcaagaggggatatcagctcaatgccataaccttgaccacaatcatgaaagggctttgtatcaatggtgaggttaggaaagcattggaatttcatgacagtgtggtggcacaggggtttctgttggatgaagttacttacgggaccttgatcaatgggttgtgtaagataggactgacaagagaggcctttgagttgctgcacaagatggaagggcaagtggttaggccgaatgtagtaatctacaacatgattgttgatggtttgtgcaaagatggacttgtaactgaggcgagggatttatattcggatgttgttggccggggaatagaccctgatgtttttacttacacttgtctaattcatggtttttgtggtttggggcagtggagagaagttactcggttgttgtgtgatatggttgatagaaacgtcaacctgaatgtttatacctacaatatattaattgatgcattatgtaaaaaaggaatgcttggaaaagctcatgatatgcgtaatttgatgattgaaagaggtcagcgaccagatttagttacttttaacactttgatgagtggatattgcttatacaatgatgtggttgaggcgagaaaattatttgatacatttgctgaatgtggtattacgcctgacgtctggagttataacatccttattattgggtattgcaaaaataataggattgatgaagcattgagcctcttcaataaaatgaattacaaaaagttggctcctaatattgtaacttacagttctcttattgatg

SEQ ID NO: 35375 - DNA, 213 bp, Glycine max
  Peptide Sequence Number=SeqID_152153
atggatgttgtcgaaggagatgggttggatgatgaagggatgtcctcagttctcgctctctttcttgatgccatcgacaagaaaagaatttgtcctcttccttgggcatttgtcaatgcttggcttagcgcgaggatcacaccacttagcgaggttttgcagatccgaaaagctgcaactttcgctaagcctggatatggctggcttagctaa

SEQ ID NO: 35376 - DNA, 690 bp, Glycine max
  Peptide Sequence Number=SeqID_152154
atgaaggtacccagtgagctatcttcagaggagaaggacttggtagacataagtaataaaaatatcaaaggaggggaagatatagtgttctcaagggagtcatcaaaacttatttcttatgaggatgttattgatatgaatgaagagaccaagctttattttgaagttgtttctaatagtaaggaactttgcttttctaaagggaatagtatggatataaaagatgacttagacactgatgatgaggaagaggagaaagaagaagggataactattcaagagaggaagtttagagagtgtgaatgtactacattaatacttttggagaacgagcaaagaaggattaggagaccatggttaactgttgttatagtgaagttgcttggacgaaaaatatggtttaaagccctagaatcaaggttgaagcaaatgtgggtcaagaaaggggttttacatgctcttggagataggattggatgcacagttagggttgataagaacatttattctctagaggcaaggaaatatgctagactatgtgttaaggttgtcctaaaaaggatagagttcaaggttggattggaaataaaattggtgctagtgaagaaaatcagggtcaacaagatgaatctatttggtgctagtgaagaaaatcaaggtcaacaagatgaatctgtgaaaaatccataa

SEQ ID NO: 35377 - DNA, 225 bp, Glycine max
  Peptide Sequence Number=SeqID_152155
atggatgaagaccaatggatgtatgatagtatgatgtctgaagaagttgaaatgaatgttgaaaatgaggaagatgctgacgttaaagttgattgctcatatgtctttaattcttctcagttgtttggtagccgtgatgaagttttacaatgggctcgatcgttggcccatgacattggatttgttgccattataatgaggtcagacaccaatattggtgtttga

SEQ ID NO: 35378 - DNA, 966 bp, Glycine max
  Peptide Sequence Number=SeqID_152156
atgctaactcatctcagccgcacccccgccgcatgcggtggtgccacctccaaacatttcctcgtcctcaggcagttcagctccgccgccggcgccgccgtttcctctgtgtctgattccgacccaacacttccctcttcttccgaatcacagagaaaagcatctagatggttgctgtttctacctggggcaatcacatttggcctcgggacttggcagattattagaagagaagaaaagattaaaatgttggaatatcgagagaacaggttgcaaatggaaccattaaaattcagtagtgcttattcatcaaatgaggaattagattctctggaatttaggaaggtggtgtgcaaaggatattttgatgataaaaaatcaatctatgtgggaccacgttcaagaagtatttcaggaatcactgaaaatggttactatatcataacacctcttatgccagttcccaattgtcctgacagtgtgagttttccaattttagtcaacagagggtgggttccacgtagttggaaagacaaatttttagaggcttcagaagatgaagatttggaagatgctcttccttccccttctcacgatgatggaactaaatcttggtggagattttggtctagaaagcctgttattgaggatcaggttgcatctgttacacctatagaagttgttggcgtagttcgtgaaagtgagaagccaagcatatttgttccggcaaatgatcccaaggcttcccagtggttctatgttgatgttccaggcattgctcgtgcttgcggccttccagaaaataccatctatgttgaagatattaacgaagatgtgaatccaagtaatccttaccctgtgcccaaggatgtgaataccttgattcgaagttcagtcatgcctagggaccacctaaactatacattgacatggtatgcaacttacttttctcttgctgaatattga

SEQ ID NO: 35379 - DNA, 576 bp, Glycine max
  Peptide Sequence Number=SeqID_152157
atgaagaacagggcctattattccaataacaaggtcttcttcctctttgtcatgttcttctcttcatctcttcttcaccttggtatgtgtgatagtgcagcttctcttgatcagcttctacctggcctagcacaaggtgattttctacaagatgcaaaatgcatgcaaaggcttcttccatgccaagaattcctgaaatctccaaacaacccttctccggcttgttgtgaaccattgaaggagatgcatgaaaataacacacaatgtctttgcaatttcgttaacaacactccgttgtttcagtcccttggtgcttccaaggatgagatcttgaagctccctcaagcttgtggcatcgatgttgaactttctaagtgcaacaacacaacagcaggaggaggatcatcccaagaatcaagctcatcaccggcatcagaaggtgaatatgctgcatctgaagaggagtcttctgaatcaacaagttcaacaaatatgattaccccacatggaatcgtttattttggtgtacctggctttgttgcattgttgacagctctagtattttcttcatactag

SEQ ID NO: 35380 - DNA, 276 bp, Glycine max
  Peptide Sequence Number=SeqID_152158
atggggtggttcaagcatgctggagagtcatacatcaaagtacctttcttaggagctatctcatacctgactttggctgtttctccattctgtataacattttccattctctgggcagtttatcgcaacgaatcctttgcctggattggtcaagatatacttggaatagcactgataatcacttgtagatttcgcgacccttctaatgaagtttacttttgtgtgattcctatgagtaaaaggaaaaggaaaagtcatcaccagactaagatatga

SEQ ID NO: 35381 - DNA, 2190 bp, Glycine max
  Peptide Sequence Number=SeqID_152159
atggcgttcgagatgccattggatcagataaagcacctccgaactcttctccgcagagaggccaatctctcgtggtacgagcccgagaaggaggaaaatctcgcgctcccgaagctcccttccgtcgccgaaaccatcgcgaagctcgattcctcgccgaactacctccgctgcaagaattgcaatggcagactcatccgcgacttgcaatcttccgtctgcgttttttgcggcacgaatccccagaacgacctcccacccgaacccttcaaattcaagagcaccattggatatcggtggctgctcgagtcgcttcaactcgatggatcggagatggtggcaccagtagtgaatgaaaatgaatggaacagggggaggagtgaatcgaaagatgagattcccttatctgaactgctagatttggaaattagatggccttctgaggctgagagagttcagacaagtacttcggatccggccgtgtttcaggggaaaagttcattgaatttggctggagttgatcttgatagtttttttgaccgtagggaatctgattctgatatgtttgaacagaacttggcttctgaaagacaagttggtggtgcttcagataagagtttgcaggctagtgaaaatcttagtttgtttcagaatgtccaagcttcggaagtagatgctgggtctgtggaaaatcagagtggtaattcattttccagttgggaggccagctttacgtctgctagttctggtcctgttcatgaagtatccaaatcagttgatcattctaaagttgaattggatatggcatctggattctcaaaacattctgttggtgtaaacaagaatgatgatttcaatctttcagcatccacagaagacgattattttcagggtgatggatggagtacttccaattcagaggtacattgccagactgggaaatcagaatcaaccatggatattagtggtacaaaaacagcagaaagtgctaatggttcaagtagaaatcttgactggatgcaagatgatctatggcaagggagtgataacaagacaactgatactgtggctactgctgaagataaagattcatttgatgaatggaatgattttactggctcaggtagcacacaagatccttctagtactatttccaattcaaagactaatgcccagactggaaatgttggatattctgttgattttaatgttacaaaaacattaaaggatgctaatagctcttctaacaaggattttgactggatgcaagatcagtggcaagataacaataacaagacaacaaataccatcagtgctaatgaagctgctgactcatttgatgcatggaatgatttcactggctcagccaatacacaacattcgtactttggtttatccaactcagagataactggccaggctggtaaatgtcaatttacccaggaccataatgatatgaaaacaactgaaagtgctactggttcttcgagtaattttgactggatgcaagataaccaattgcaggggagcgataacaaggcaactggtattgcaactactaatgaagtagctgatgaatttgatgcatggaatgattttactggctcagctatttcacaaaatccttccagtggtgtttccaactctgcgattacagcccagattgggaagtcagaaattactgctgatcttaatgacatgaaaacagaagagggtactaatgcttcttctcacagaagttttgactggatgcaagatgaccaatggcaagtcagcaatagtaaaacaaatgataccaggactactaatgatattgattcatttgatctttggaatgactttactagcttggccagtacacaagatcattccaacaatgttttgaagcaaacagtaaattctgcagaaaagacctctgaaacgaatttactcagttcgtcaaacagctcacatgataaagattttagtgggttttcacagcatgatctattttcaggacagtttggtagttcattgagttcttttccagctacttcttccaacagggtggctgaagtggatatcacgagaggaaactctggagatgtttccactgcagtagggtcaaaagatgacgtagagatgttgatgtcacagatgcatgatctctcctttatgcttgagaataatctttcaattcccccaaagtaa

SEQ ID NO: 35382 - DNA, 525 bp, Glycine max
  Peptide Sequence Number=SeqID_152160
atgaagccttatctggatctacaacaattggagagagagttccatcgtagtcaagaaaaactacaatttgctttcctttggcactatatactatctgttcaaaggtgttcagagctgaagggtgataaagctgcaaagagtggtgaaatagaagcagagtcaggtgatgagcataactacacagagaatcataaaccatgcaacatgtccaaggagagtggaaattcaatcccaatcccacacaagggtcaaggaatagctgaaaaactcacattggagtttacatttcacttatggtgcctgatgggacttcatgggacttctagttcccagtgtggtgtcagaaagttggaccttcaatgtactgagaaaacacaacagcaaaccattgaaattagtgcatttggaagattttatttacaacttatcttatggcatacatacttattaatgtcaggcataggcacgctgcttgccactttagaagcagttgaaacaactttagaggcagctgaaccactttag

SEQ ID NO: 35383 - DNA, 363 bp, Glycine max
  Peptide Sequence Number=SeqID_152161
atggtgatagaggaagatgaagttgaacaagcaccaacggtgacaaaggaagaggaacaaccaccaacagaggaagaggaacaagcaacaagcaccaacagaggaagaggaagacgaagaacaaatatgacaaaggaagaggaagatgaagaagcgaccgtaggaggagagggaatcgcgctgtacagacaaaaaactaggagtttttataatattagggtgaaggacaattttgccattttatcacaggtgttgggtgccccagcaaaaatgctgggtgcaccaaattcatcttcccaaaacccctcttccgctaaccttatagcttccatgggtacacatgtcctgaagttcgtctcgtaa

SEQ ID NO: 35384 - DNA, 273 bp, Glycine max
  Peptide Sequence Number=SeqID_152162
atggccttttatggtggcaaccaaattggtttcttggacattgcacttggtagcttcttagggtggctgagggtgacagagatatccaatggggtgaagttgcttgaccaaagcaacacacctgagttggtgaaatgtgatgaaaggttttgtgcacatggtgttgtcaaagatgttatgccagagatatggaaggaggagttctacaccattgctcgtttctgggctgcctttcttaatcccatgccaaagttctttagcttttacatataa

SEQ ID NO: 35385 - DNA, 333 bp, Glycine max
  Peptide Sequence Number=SeqID_152163
atggaaggaagagggattttgatggaagaggaaacgatgcgaacgtcgccgtttcgaagcattgtgttctccgtgtttcatttcattgagcaatttgaatcgagatgctgcaggaggaaaggcttcaaagaagggctgcaagtgccttatgatgagactcgacctgatcatcaagtgcagaaactacagttgatatcaggtgtgagagcatttttgagtgagcaacaagggcttattattaagtggaaaaaaagaggtgatgataataaaaagaaaagcaggcaacaggggcttccccacaccatcctctcccaacaagagccccctgcttaa

SEQ ID NO: 35386 - DNA, 804 bp, Glycine max
  Peptide Sequence Number=SeqID_152164
atgaaagaggcattctctcttcacaaccagatggttgagaagggtctgactcctaatgttgtcacttatactgcattagttgatggcctgtgtaaacgtggagaggtagatatagcaaatgagcttcttcatgaaatgtctgaaaagggccttcaaccgaatgtctgcacatataatgcattgatcaatggtctctgtaaggtaggaaatatagagcaagctgtaaaacttatggaagaaatggatctggcagggttttatcctgacactattacatatactacactcatggatgcttattgtaagatgggtgaaatggccaaggctcatgaattgctgcggattatgcttgataaaggacttcaacctacaattgttacattcaatgtgctaatgaatgggctttgcatgtcagggatgttggaagatggtgaaagactaatcaaatggatgttggacaaaggtataatgccaaatgcaacaacattcaattctcttatgaagcagcactgtattagaaataacatgtgtgccactactgagatttatatgaggatgtgtgctcaaggagtgatgcctgactgtaatacctataatattttgattaaagggcattgtaaagctagaaatatgaaagaggcatggttcttgcataaagatatagttgaaaagggatttagtctaactgatgcttcctataatgctcttataaagggtttctataagaggaagaaatttgtggaggctaggaagctatttgaggagatgagaacatgggttcattgcagaaaaagagatatatga

SEQ ID NO: 35387 - DNA, 192 bp, Glycine max
  Peptide Sequence Number=SeqID_152165
atggtgattgtaaatgttatcaagcttaagaatgaagctcatacaaaccatgaaattgatactgaagaagagcaagcacaaatgcgtgtgaaaactcagccatgcgttctcgatgagacagcaaatgcaggtgctgatgcagtcggagtagaaatagcatatgcagaaataggtgcaacaatgcactgctag

SEQ ID NO: 35388 - DNA, 249 bp, Glycine max
  Peptide Sequence Number=SeqID_152166
atgcataaacagaatcagaaggactttcataggcttttaatgaggcttggctacaaaaaatcattggtttttctaggattcaaaggcttagattctaagagagcacaaatcctagacttatccaataatttagctcacaaagggtgcaaaggatacaattatcattcaagtcaggctaagcacgccctgtgcgctaagcctgaatgtctttctcttgaggctgagctaagcgccagcatgctgcgctaa

SEQ ID NO: 35389 - DNA, 147 bp, Glycine max
  Peptide Sequence Number=SeqID_152167
atggaagaagaggaaacacaaataggaaaggatgcagtgagattgaggagggacgaaaaggatggatgggatgatatagaagccatggttaatcatcagttacacctatgttctgctggtgagaggatgcagagaaaaaggtattaa

SEQ ID NO: 35390 - DNA, 690 bp, Glycine max
  Peptide Sequence Number=SeqID_152168
atggtgataatagtctcactagtaggaacactggttcagcctttggtactccattgtcccctccagagccaactaactgtgttcaaccaacggtgccggttcagcttttcatgcaacaagcaaatgttcattgtgcctattgtgatggtggctataaacaaaagggtagctatatttctacgagagaatcttgggagcttgatcgctgacccaacaacctttgctcttccattttggaactgggaccatcctaacggcatgaaaatgcctttcatgatttacacagatgaatattcttatctctatgaccatcttagggaagcaattgaccttccatggctccacgttagtccggatatacatgttaaaccagaaaatcttgctcctcgggttggtgcaaaacaagctttggatttgaaggcattgcggttccctctcactttgaattccattgaacgtacaactgtgaacatgccaaaggtggagtcaaggaacgaggaattaatggaggagttgctactgatagatgttgagtatgataggtctgaagatgtgaggtttgatgtgtatatcaacgacaaagccacaatcgtaactgatctgttgaaagagttggaagtaaaagacgatgatagtactattgctgtgacactggttccaaagtatgggaacaagcctgttacagtataa

SEQ ID NO: 35391 - DNA, 186 bp, Glycine max
  Peptide Sequence Number=SeqID_152169
atgacatcttttggaactcctgctatttttgtcgtgttgcagatctctatgtatgtggccatggaagagattgtcatgaatcaactagatgagggaatatgtatatttaatgttggctgcttgaacttctggtcggactatgctggtgaagtactaaggtgtagaggaaatagagtaatcctctag

SEQ ID NO: 35392 - DNA, 2283 bp, Glycine max
  Peptide Sequence Number=SeqID_152170
atgtgcgccaaatatgaatgcaagggtgttgttaatagtcccatattggtgggttacgcacaagtatcatcacgggctcagtctggaggcttaaaaagtgcagatatttgtactccagagacagcatatgattttgaaaacccaaaggagtctgaatctcctcgttttcaagctatattacgcgtcactagtgcacccagaaagaggtttccttcagatatcaaaagtttttcccacgagctgaattcgaaaggtgtctggccttttccattttcgaagcctcggcggttaaataaccttgaggagattttggttgttattagagcaaaatttgataaagcaaaggaagacgtgaactctgatctggctatttttgcggcagacctggttggaattcttgaaaaaaatgcagatactcatcctgattggcaagagaccattgaggacttgctagttttggccaggagctgtgctatgacttcatccggtgagttttggcttcagtgtgaaagcatagttcaggagttggatgataggcgtcaagagcatcctccagggatgctaaagcagcttcacactcgaatgcttttcattctcacaaggtgtacccgattattgcaattccataaggaaagtggtttggctgaggatgaacctgttttcaatctccgtcaatccagagtcttgcattctgctggaaaatttattcctcctagtgtgggaagggatactaaaagttcaagtgctgcaaaggccttaaagccttcatcgaaaaaagcttttagtcaagagcagagtatgatgggttggaagaaagatgttatgcaaccagaaaatttatctattcctgctgatgatgacaatgcaaaactctttgactcttcttcaggcaggaatcgaatggcttcttggaagaaattcccttctccaacaggaagaagccctaaagaagctgttcagttgaaggaccaaaattatgggagggttgaatcttcaaaggcatcaaataataagagattcacttccgatgtggatctctctactgctaagccatctgagcttcttcctgtcaaagattccttggatcatgcttccaaacaccaacacaaagtttcctggggatactggggagatcagcagaataataatagcgaggagaattcaataatctgtcgtatatgtgaagaggatgttcctacttcacatgttgaagatcattcaaggatttgtgcagttgctgatagatgtgatcagaagggactgagtgtcaatgagcgtcttgtcagaatttctgatacactagaaaagatgatggaatcatgcacacaaaaggatacccaacaaatggtgggaagtcccgatgttgcaaaagtgtcaaattctagtatgactgaagaatctgatgttccttcacctaaacttagtgattggtctcgcagaggctcagaggacatgcttgactgtttccctgaagccgacaattctgtttttatggatgacctaaaaggattaccacttatgtcatgtaaaactcgttttggtccaaagtctgaccaaggtatgacaacatcctctgcagggagcatgactcccaggtctccattgatgacaccacggacaagtcagattgacttgctcttggcagggaaggatagaaggaaatttgatgcacttactgtggagacctttggaacacgtattgagaagctgattcgagagaagtatctgcagctcactgagatggtggatgttgaaaagatagatacagagagcactgttgatgatgatatcttggaagatgatgtggttcgcagcttgagaacaagcccaatccattcttcaagggatcgcacctctattgatgactttgagattataaaacctatcagtcgtggggcatttggaagggttttcttggctaaaaagagaacaactggtgatctttttgcaataaaggttctcaagaaggcagatatgatccgtaagaatgctgtggaaagtatattagcagaacgtgatatcttaattacagtacgcaacccttttgtggttcgattcttctattcttttacatgtcgcgagaacttatatcttgtcatggaatatcttaatggaggtgacctgtattcattattaaggaatttaggttgcttagatgaggaagtcgcccgtgtatatattgctgaagtggtgcttgcattagagtatttgcattcactgcgtgtggttcatcgtgacttgaagcccgacaatttattgatagcacatgatggtcacatcaag

SEQ ID NO: 35393 - DNA, 678 bp, Glycine max
  Peptide Sequence Number=SeqID_152171
atggctcacaggctggttttcgagttctgggaaaagtcccatttggacgttggaaactcttttgatcgatttactgagaggttgatttatacttacaaggactggggtgcacatccccgtgtgtttgatgtgttcttcctagttcttgttgaggcagggttgcttctagaagctgggaaactgtttgataagttgttaaattacggtgttcttgtctctgtagattcttgtaatttgtttctagctaggctatctaacagttttgatgggataaagacgggaattagggtgttcagagagtatccagaagtgggtgtttgttggaacactgtgtcgtataacattattcttcattcgctttgtcaattgggaagggtaaaagaagcacataatctggttgaaggaaaggtcttgaagctcatggaagagttgcagagaaagggattgaaaccgaatcaatacacgtacattagcataatttctcttctttgtaagactggtagagtagttgaagcagggcaggtcttgagggagatgaaaaatcagaggatttttcctgataatgtggtgtatacaactctcatcagtggttttggcaagtctgggaatgtttcagctgaatacaaactctttgatgaaatgaagagtaagaaaatagttcctgattttgtgacatag

SEQ ID NO: 35394 - DNA, 216 bp, Glycine max
  Peptide Sequence Number=SeqID_152172
atggaaataagaggagatagctactctcttcatgtgcaagagagagggtttttcattgtcaattcaaatatgcaagcaacaacctttggtcgggttctgtcacggaaaccagtagcccgacacaaggttgcggctatcgtctcaggaaaacggtttcgaagcttaggcgaagatggagcatggccaaggctacccggaaaagagcgaaacgaataa

SEQ ID NO: 35395 - DNA, 1137 bp, Glycine max
  Peptide Sequence Number=SeqID_152173
atgcaacaacattctcatacactcttcactaccatcaccataatcctcttctcattcttcttccctctaacattttctgacctctcatcggagcgcgcggcgctgctcgccctgcgctccgccgtgcgcggccgcaccctcctctggaacgccaccgccgcctcgccctgcgcctggcccggcgtccaatgcgacgctgccaacgctaccgtggtcgagctccacctccccgccgttgcactctccggcgagctcccagccaacgtgttcccggcgctcaagaacctccacaccctcagcctccgcttcaactccctctccggcaccctccccgccgacctcgccgcctgcgccgccctccgcaacctcttcctccaacagaaccacttctccggcgaggttccggcgttcctctccgccatgaccggcctcatccgcctcaatttggcctccaacaacttctccggtccaattccggtccggtttgggaacctcacccggttgaggacccttttccttgagaacaaccggttcaacggttcgcttccaaattttgaagaactcaatgaattggctcagttcaatgtctcatacaacatgttaaacggttctgtgcctaaaaagttgcaaacttttggtgaagattcgtttttagggaataccctttgtgggaaacctctagcaatttgtccttgggacgacgggggtggtgagagtggtgcaaatgggaattcaaattcaagtggggttggagggggtgaagggagtgtgattggaggggagaagaataagaaggggaagctttctgggggtgcaattgctggtattgttgttgggagtgtggtggttcttttgttggttgtgtttgctttgattctcttgtgtagaagtgggaccaagactaggaatgttgataatgttaataacattgtggggttgaaggaggagcagcatcagcatcagcatggggaggtgggaattgagagtggcaattcggagaatggtgggggggggggaggtgggaatttggtggctgcagcagtggcggcggtgagtggcggcagcggtggtggtggtggtggtggtggaggaggaggaggaggaggagataagaagttggtgttttatggtaataag

SEQ ID NO: 35396 - DNA, 234 bp, Glycine max
  Peptide Sequence Number=SeqID_152174
atggaaataaggaaatacaataggctagtgcacatggaaaataagggaatgcaggttaggctggttcagaacaacaagaaaagggagatggatctcatatcagagaatcttagctcgtcaatgatagtgaaaactcttgttttaaagcttatgaatgataacttgaagaacccaaaggctacaccttcaacaaagtccaaagctacgagattctattctacacattcaacatga

SEQ ID NO: 35397 - DNA, 951 bp, Glycine max
  Peptide Sequence Number=SeqID_152175
atgttgctggaaagtacaaagtgtaatgtaatgggtgaagatctctcagaacagaagaagagaatggggagagtgagagagaaagaaaaatgcggcgactatgaagctctcagaaaggctcgcattttagagaatcaggctcgcttggagtctcttggtgttgccaataccgtttctcagctccgacaacaagccaagaagcaacaacaacctcgtactcacccaaaaaaactgtacggtctcacccctttgcgccgctctcagcgaatcaacaaccttacgccgccaccctttcagccttccacacccataaaacaagagaagaaggtaactgtgtgtgaagagaaagaagaggagcagaggcctgccaatgctcctttcataaacctaagcaatgcagatcttttgctttcagcagagagttctgctcggcgctgtgatagcaagggcagaggtagtgtctacaatccagttttggggatatgctgccatttttgcaggcaaaagaaattgtgtggtgaagaagattgcaagagatgtggcaattttgatgtgaatgaaccatgcctgggaaagactgattgttctgtctgtcactctagcactggtgttttttgtagagcctgtctcaagattcgatatggagaagaaatagaggaagtgagaaagaacaaggaatggacgtgtcctcattgcatagaagcaaaaggaataaaccctcactggatatgtaacagtgtgcagaattcctcaggagttaagacacatattaaactacaagatgttgagaatatagagttcaatatgcctgaggaaacgaaaaatgcctccaactggaatagcagtatacagaggtcaagtaacaccattttcaagcaagtttcatataaaattcccacttgtgaagaaattaattatttcatagaaggattatggatgttgagaccgtag

SEQ ID NO: 35398 - DNA, 405 bp, Glycine max
  Peptide Sequence Number=SeqID_152176
atggctagtgaagaacccataataagagataatgttagcgactttagtgacgaggatcaagagcacgatgttcatgaaagtggagaaccaagcaatcaaagtcagtatgagtcatcttcatattttgaaactattaatagccaacttttagaagatttacagtactcaaatccttatcagaacagagggagtggcagtacaaatgacctttatgaatgcatgatatttgaatcaaaacaagcaactctgaatgccattaagcaatttcattttctacattcgtttaattttgatgttgaagagaacaagagtgacaatgattggtatccaaatcaaaaccttgattgtagacatgctacaatgctttggttatactgtgacatacaaaaaagcctacatagctaa

SEQ ID NO: 35399 - DNA, 506 bp, Glycine max
  Peptide Sequence Number=SeqID_152177
atgccttgcaaaccccgctgcatctactgcacaatctacatatttatattcattttcatgctttgcttcttcctcttcttgataataatcaacccttcaagtgtcaagttctacgtaactgaggccaccctcacacaattcaacctcacaagcaacaacaccttgtattacaacttcaaggtcaacatcacagtgacaaaccccaacaagcacatgatagtgtactataggacgatcaaagcaatagcttggtacaaagataatgagtttgatagggtgagcttaacaccctttgaccaaggctacaagaataccacctttcttcgagcagtgtttgtagggcaaagtgtgattatgctcaaacctaaacaacttggtgagtacaaagatgagacaagtattgggatttacaatgacttggctgtggattttgatcttagaattagagccaagtttggaagaattaagagcaggcgtttcagtccaaccctttgttcagtgtcgcc

SEQ ID NO: 35400 - DNA, 777 bp, Glycine max
  Peptide Sequence Number=SeqID_152178
atgactgaaatagaggaggtgcaagagcagatgaaggctgacatggaggccatgaaagagcaaatgaccacaatgatggaagccataatgagtatgagaaaaatgatgagtatgaggagcaagcattccttcccaccgtatggcttgcctcctaactatacaccacccaatgttgcacccactctcgatgagaacgtcgataactctgctcccatacccatgggggagacacatgaagcaccccgagaccatactctagctgactctgagcctcacctcggatattccactgaggggcaggcgtttggtggcatacccctgccaaacactttggggggccctcagtatcgcccacaacccttacattttgcggcagaaagactacctcctgccatggtggaaagggaaaaaattgatcatatagaagaaaggtcgaggcccattgaaggaggcagagattatacctttgctgacatggcaaaattgttcctagtgcctgacatgatcattcctctgaagttcaaggtgccggattttgataagtacaaggggactacttgccccaagaatcacctgaagatatactgcaggaaaatgggggcatacgcaaaagatgaaaaattgttggtgcatttcttccaggaaagtcttactagggtggccgtcacttggtacaccaatttggagtcttctcgggtccgttcctggaaagacctaatggttgccttcattaggcaatatcagtacaattctgatatgactccgaatagaatgcag

SEQ ID NO: 35401 - DNA, 186 bp, Glycine max
  Peptide Sequence Number=SeqID_152179
atggcattaagggtcatggcagctcgcccaggcaagctgttgcttcaacctacggtaaccttgctcgcccagggaagtaaagataaggacactaattttgttcgagcgaacttgctattcgaccgggcaactggtgaaaaccaaggaagtgaaaccgagaaacatgagaacattgaagttctgtag

SEQ ID NO: 35402 - DNA, 162 bp, Glycine max
  Peptide Sequence Number=SeqID_152180
gtgttttccttctcatgggtagcttgtggaaatttgttaagagatgatgacactgggaaaaatctaaaaggttttatttgcaacatggcatctattcagcagtactccaagatgaactttgcggggtgtgatgtggggattatgtatggtgctacctattga

SEQ ID NO: 35403 - DNA, 264 bp, Glycine max
  Peptide Sequence Number=SeqID_152181
atgttatggtacatcacaccaccgtttgtggaggagctcatggaggaccaccaccgtgagaaagttctgccaaatccgataagaacatttggcgcctatcgtggggcaagtgaaaacttctccttcgacccttacagccaaccaagaaagaccaccatgggggtaggcatccaccatacttggaatgcctaccatagggaccctcgaaaatgggagtctggcaaccgtggtggacctcccgcgtcaggtgctcgacgatcatga

SEQ ID NO: 35404 - DNA, 897 bp, Glycine max
  Peptide Sequence Number=SeqID_152182
atgttgtcgttagaggttttcctcataggggagagtttaaacaacgaccccgctcagctccatggtgattctgacgtccctagtgaccaagtctccaatgttcatgctggcgatgtcatcactagttgcatcgtggtttgccctaacgcgggtactaccgcttctacaggtggtctcaccattgagaaaaagacccacccttatttcgttgtgtgttttattcctatggaggatgaggttgagtcccctcggtcgaatcctcctcgaaataccatagatttatgcttagaggctatgacgatccaagtgattccacgttggccattcattccttctcttcctccccttagaaagcctagtgtgactaaggagtaccttcccattgctcttctggcttactccttggttcatgaggaagttaggtcctatgcaagtagtttcctaacctatgagtccatcgtcgagtttctcaacttgattgaattttgtcacattggtcgctcatatgtgatgtttgttgagtcttgccgggaaagtgaacatgttttcatacgtgcttttctatgtgagactcatgttatgtatatttattcatctttcttctccatacatctcctcactattccttttgataaatttaaggttgacgttttgagagaattgaatgtcgctcctacccctaaattccttcatcattatactattaaggaaattataaagagtggttggatctcctttactgacattttcgataaggtagtcatcagaccctacaccaccttttacaagaattatcaagaagacatagttgttcttcataagtttcctagaggccttcattgcaaaaccttggcggaccttccctttcccatgactctagatgctgacttggattag

SEQ ID NO: 35405 - DNA, 1206 bp, Glycine max
  Peptide Sequence Number=SeqID_152183
atgcagtggggttctgctctcaggtgtgagggatggaagtcccgagctgacgaggatacagttgatggacaggtgaaatgtgaaaagtggattcgtgatgatgatagccatgcagaagaggcaaaggcaacatggtggttaaccagactgattgggcgaactaagaaggttactatagattggccatacccttttgtagaggctagattgtttgttctcaccgtgagtgctggcatggaaggctaccatgttagtgtggatggaaggcatgtgacatcttttccctatcgcacgggattttctcttgaggattcaactggtctatccataaaaggggatgttgatgtgcactctatatatgcagcttccttacccacatcacatccaagttttgctccacagatgcatcttgaattgcttcctcaatggaaagctccacctcttgtacacgtgaatgtggagcttttcattggaatactttctgctggcaaccattttgctgagcggatggcagtaaggaaatcatggatgcaacataaactaatcaaatcttcaaatgtcgtatctcggttctttgttgccttgcatggaaggaaagatttaaatatggagataaagaaagaagcagattattttggcgatattattatagtcccctacatggatcattatgaccttgttgtgttgaagacgatagctatcactgaatatgggattcgctcagtggctgccaagtatatcatgaagtgtgatgatgacacgtttgtcagaatagagtctatcatcagcgaagcaagaaaagtaggaagtggtagaagtctctatataggaaatatgaattaccaccataggcccctacgttctggcaaatgggcagtaacatatgaggaatggtcagaggaagagtatcctacctatgctaatggtccaggctatacaatctctgcagacattgcccagttcattgtatccaacttcgaggagcacagattaaaattatttaaaatggaggatgttagcatgggaatgtgggtagagcaattcaacagttcaaggccagttgagtatgtgcacagcttcaagttctgccaatttgggtgcattgaagattactacactgcacattaccaatctccaagacaaatgacctgtatgtgggacaagttgcaacaaaagggaaagcccctatgttgcaacatgagataa

SEQ ID NO: 35406 - DNA, 369 bp, Glycine max
  Peptide Sequence Number=SeqID_152184
gggaaccgggacacggcggcgtacaccatcatacctgaccacaacattcaatcaacggcgcaaggcatggcccaggccttccgcgttgttctacgtgtccccctacacccgcacccgatcgacgctccacgagctcagacggtatttcttgaagaagatgatcattggcatgagggaagagtcaggagttcgagaacaagatttcggaaactttcgggtggaatagaggatgaaggttataaaggaaaaacattttggaagacgtccaagatcaaattcgccgtatccaaggcaagatctaccttcatgagggacacaagtgacaagggggttgctagcagtgacatcgatcaagatgcgatggtgtag

SEQ ID NO: 35407 - DNA, 606 bp, Glycine max
  Peptide Sequence Number=SeqID_152185
atgaagagggtgaagaagctatacccatttttggtcctacccaacaggcctaaacctcttcaaattttcatggctgtgatgttcctctacttgctcttcaccaccttcgaaatcgaaacctctcttggtttcagaacgaggtttgtgtcagtgtcctcattgttggggaatgaagatcaacaccaacgtacccattccagcaaagcctcaaactttccctcacaaggggtgttccaaggctcactgcatcgaaaagccttgcagggtttgcagaaagtttccaccttgagtttcatcgaggctttgaatgacaccactgtggaagaaaacatgttttctgaactccacaaggctgctaggcatgcttgggttgaagggaagaggctctgggaacaagttgagagtgtgaaagaaaccatgaatgtggcaaggttcaaggctgagaacctttctgattcgtgtcagcattcaatttcattatctgggtctgaattgaggaagcagaataaaggggtcatggtgatggtgcttccttgtggtttgacattggggtctcacgtgactgttgtgggaccccacgttggctcactgggaggacgatcctaa

SEQ ID NO: 35408 - DNA, 201 bp, Glycine max
  Peptide Sequence Number=SeqID_152186
atgtcatgccttcaattcattaggagctgcccacttggtaaaacttggtcactgatcaaagtagtggctggttgggtagttaacaacacctccttgaagcaaaaactccaagctaatgaccatgggtatctggctaatcagaccactgttaagaaaccaagaagttctaagaaattcatagccagagtcaatggctcctag

SEQ ID NO: 35409 - DNA, 669 bp, Glycine max
  Peptide Sequence Number=SeqID_152187
atggcttctaggaaaagaaaaaaaccatctacacccacccaagttagatttgacagatcaagattcacttcccaagaggcctgggaaagatacacatatgttattgttcctaggaagcatttgctagagaggaacgtggtggtctactatacagagttcgatgagttcaaggaggaactcaaaagacgccactgggacgaggagttggctgactttgaggatgacaacattgatgttgccattatgaaggaattctacgccaacctctatgaccccgaggacaaatcacctaagcaggtgagggtgagaggtcatctgattaaatttgatgaggatatgcttaatactttcttgaagacccatattattatgaaagagggggaatcactctgtgcttattccaaatttgcactcctaaggcctgttaagctctgtatcccagggaggggattcgagcttaatgttgatgggcagcccctgaagattttgaggaagaacatgaccaccttagctcagacatggagtgttctttccttctctaacttgattcacacctcccacacttctaatgtcactcttgatagggctagactcatttatggcattattatgaagatggatatgaatgtggggtacctcatctcccaccagatctccctcactgcttaa

SEQ ID NO: 35410 - DNA, 435 bp, Glycine max
  Peptide Sequence Number=SeqID_152188
atgactcactccttaaatgatgttgaagctatacatgcaacaccagtatccatttgcaatcctactaattacgacattggttgtgacgatgttgttaacaaccaaaaaaatgagaatgaaatcccacctgcgacacaaaattcaaagccaaaacgaggaagacccttcaaaacgccacctgaatcgattaaaaattggtatgttatacgcaaagaacgaaagatcgccaacaggttcgatacgacttatattcatatggagacagactttcggtgtcggtctttgaaggagattaagaataatgagaaatatggaagtcctcctcgacgtcaaaaagtgaaagcacaagccaaagaagaaagcaatgacaaaacaaaaaatgaaacagaatttactgaaaactacaagctcatgagtaggactgaaagtggttaa

SEQ ID NO: 35411 - DNA, 120 bp, Glycine max
  Peptide Sequence Number=SeqID_152189
atgaggcttcacagttatcaagcgagtcagagagcaagcatgactacagatcaaccttcactctctatggctcacatagacccggagcaacctaagtatatcacatgtcgtctatcctag

SEQ ID NO: 35412 - DNA, 288 bp, Glycine max
  Peptide Sequence Number=SeqID_152190
atgaagaacttgtggctttgtttcagttacttgtttcctgcaacaatcattcttgttttgcttactccttcctcagttgcacaactatcaccaagtgagggtagaattctattccaagttcagaagcttcttgagtaccctcaagcccttcaagggtggaatagatggaccaacttgtgcttcctcccttcctcaccttccctcaagatagtttgctccaatggtcatgtcacggaacttacaatcattggaatcatatgctgcatatatttctcctacactaattaa

SEQ ID NO: 35413 - DNA, 1002 bp, Glycine max
  Peptide Sequence Number=SeqID_152191
atgtaccatatgagacttgtgagtagtgaatacccaccaactaatcaccactacccagacaatgtcttagtggacatcatgggtagttaccaacttgagtccctttttaggtacctcaccccgccattagagaaggagctcagaaataatgggagaagtctactcacagatcagactaagaagaatctggtgagaacgtttggcactcacagtggggccagagtgaaatttccttcaatcacaaaagtatatggtagcgaccaggagttcaacgttaaggtcaactaccatggaaggaagttcaggaacacaaggattcagatagcaattggaggctctacagaagaagaatgcaaaggaaatggttgcattatgacaaaaacaagaagtagatatgcaagctctgtaccaagaaaacgaggatggaagcctttgaacattgatcgatatgatggaaccaaaaacaatgatgaacacttggaggcatatattgcccagggacccgcactaacaaggttgcatcaacttccccctcgaatgatcgactcttttgacacacttgctgaatgttttggtgcccaatatgtcacatgtcaacctcatcatagcattggtagcactgatcaacctacaagtagcccttcatgccatgatagcggcactaaagccaaaagcgttcatagacagtctgtgcaagaagaggagtcaaaggtggctgcagaggcaaattcagaggtggatacattggaggtcggggcaacaataatcaacagcttgagggagaaggcgagcaaagacaacaagaaaatccccttggtaccaccaatcacattcatagatgcagacttcgtagggaatgatccaacacaagatgaccctatggcgataccttataatgtcctacatggtaagcctactttaaacaagttaggagccattatttctacacctcatttagcaatgaagttccccttattcgtagggggaattgtcactgtcaag

SEQ ID NO: 35414 - DNA, 243 bp, Glycine max
  Peptide Sequence Number=SeqID_152192
atgatagaggactttgagtcatataaaggtgaggactttgagtcctctaaaggcgaggactttgagccctctgaaggcaaggaccttgagtcgtctgaaggcgaggaccttgagcccgctgaaggagaggaccttaagccctctgaaggtgaggaccttgagtcctctgaaggcgaggaccttgagtcctctgaaggcgagaaatttgagccctctgaaggcaaggactttgagtcctcttaa

SEQ ID NO: 35415 - DNA, 846 bp, Glycine max
  Peptide Sequence Number=SeqID_152193
atgggggagaaacatgaagtaccccaccacaatctagccgacttcaagccttgcctcggatgcgctactgaggagcaagcagttagtggtatgcccccgccaaacactttggagggccctcagtttcgcccacaactacaacccttgcattttgctgcgggaagaatccctccaactatgatggaaaaaggaaagttggatcatatagaggaaaagctcagggccattgaagggggcggagatcatgcttttgctgacatggcagagttgttcctagtacccaaggttgtcatccctccaaagttcaaggtgccgaattatgacaactacaagggggctacttgtcctaagaaccatatgaagatgtactatcagaagatgggagcatgctcaaaaggcgaaaaattgttgatgcatttcttccaggaaagtcttactggggtagtcgtcacatggtacactaatcttgaaccttcccgagtccattcttggaaggacctaatggttgcctttgttaggcagcatcagtacaattctgatatggctttggataggatgcaactacagaacatctgcaaaaaggagcatgaatctttcaaagaatatgcccaaagaaagggagatgataacaatgatagtagacacttaatggtgttctactgtgagaaaatggtgggttacacaccttcaagttttgtggatttagtctttgacggtgaaaggatcaaagtgggtctgaaaagaggcaaatttgatcatcctgctttgatgaatgagaaaactggggcaaatggagagaatgagatggagggaggaacccatgttgtgactgtcgttcctatatga

SEQ ID NO: 35416 - DNA, 381 bp, Glycine max
  Peptide Sequence Number=SeqID_152194
atggcagcaggatctattgaggaggcatggtttgattcagttgcagtatttgactcagactgtgatgatgactaccagagtgttattgatgccaaccgtggagtttcaactgaacatgtgcacaaacctggggagctatcaaaacgacattctgcacatatctctgagagtattagaaattcagatgctgagtttttagatgtagatgctgcaaattctcatggctcgaaaagggatgatggagatttgcacaactgtgggattcttccatgcaattgcttgtcatgtcttccatctactgatcaggcatcattaagttctagtcctcctaatagtacaaggaagaaggaaaataaatacgaagaagatgtacagtcttga

SEQ ID NO: 35417 - DNA, 777 bp, Glycine max
  Peptide Sequence Number=SeqID_152195
atgcaagaagaaaatgccacaaattctcatggtaaatgcgacaaaagagtaaatgaagcaaatgaacctgtttttcttgatgaattttcctcagtggatgcaggctcgaaaagggatgatggagatttgcacaactgtgggattcttccatgcaattgcttgtcatgtcttccatctactgatcagggatcattaagttctagtcctcctaatagtacaaggaagaaggatcctacgaaacattcctttaaatggagtgggaaggctacgctatttacgattccaaatgcacccttaccttctcagaacaatgaatcttatagtgcaaaatttcctcaaagacaattctacaaagaccactcgcaggttctcagggacaagaagaaagaatttgcttcaaaccatgctggatattacccacttggtgttgatgtattcttatgtccacggaaaatagaccatatagctcggtttgtggaacttcctgtgatgagctcttcagggaaacttccagccatactagtagtgaatgttcagattcctatttaccctgccacacttttcaagaggttgatggatgatgaagttgaaaaggtaaagagttttcgtggagatacaattgttcccttcagagaaaggttgaaaattttaggccgtgtcgtcaaccctgaagatcttcatttgagtgcaccagaaaggaagataatgcagacttacaatgagaaacctcttctttcgcgtccccaacatgaattttactcagaaataagcgcgtga

SEQ ID NO: 35418 - DNA, 276 bp, Glycine max
  Peptide Sequence Number=SeqID_152196
atgattccagtggagattcaagaagaagcttgtaagagaatagcaactcggaagcatgagtcgaaattgaataaaaagggatttagagttggcgatcttgtatggagaatgagaggagaagcacagaaggaccatgctagaggaaaaattactccaaactgggaaggaccctttagaatcactgcaaaaatgcaaaatagagcataccgacttaaaaagcttgttggaaaggaaattccgaggacctggaaagcaacacacttgaacgatatgtaa

SEQ ID NO: 35419 - DNA, 243 bp, Glycine max
  Peptide Sequence Number=SeqID_152197
atggtagcgttacttggttatacttgtcgcaacctatcctacgacgagagtgtggcgaaaagccaaaggagcgtctcccaaaaaggaaaacatcgaagagaatcattaatgcgttggaccttgaaacgatctcaagtgatgtttgatgaaaaacggagagaattgttgaggcgttggaccttgaaacgatcttttaaacttgaaaaacaaagagaatcgttaaggcgttggaccttgaaatga

SEQ ID NO: 35420 - DNA, 501 bp, Glycine max
  Peptide Sequence Number=SeqID_152198
atggagggatttgttgttgtgtgttatgatggggatatggtattagcttctgaagaggtattgtttaattgtcctaatggtcctaaattcattaaaattagtgaggaaatgttgcttcctactttgagaaaagcaattacaaatgccatcaaaggtgatggttgtatggagtatgactgtatagagcttaaagacgataatgatgttggaaagatgtttttcatcttttcgaagtttagttctaaaggatcgatcaagttgtatccaatggttggtcaatttgcaaaagaaatctttgtcctactacataaaccaagatcctctgaggagattattgctttgacgcctatagagccctatgtggcacaacctcgcccaatgacaccaaatgttgatcccactcatccaatgcttgattgcatttctcatatagaggacatggggatgtatctctggtcctcgagaggttcaagggctttacgtgatgcacatgaagactag

SEQ ID NO: 35421 - DNA, 222 bp, Glycine max
  Peptide Sequence Number=SeqID_152199
atggcaactcgcccaagcgagctaatgcttagtcctgaagaaactggcttgcccaggcgagctagtcccttcagccctaagcaatttgggggcctaggagatggtggattcgtgggaattgaaggtcgatccattaagaacttctatagtggcttctacatacagaatagtcattacatgttcaaagcacatccaaagttttggggttcgcttggaaagtga

SEQ ID NO: 35422 - DNA, 216 bp, Glycine max
  Peptide Sequence Number=SeqID_152200
atgaggcatagcttgagtgagcccagagcaaagttgaagctggtcaaccatggtggtaaggttatgccttatcctacccaagcaatggtgaatgcttacgtggatgggtcatgcctttcgagcttgtatgatgcgcgatacacgactgcaaataaaggcataatgaacacctttattgagagatgggacaatgagacctcttccttccacctataa

SEQ ID NO: 35423 - DNA, 2112 bp, Glycine max
  Peptide Sequence Number=SeqID_152201
atggcttctgcttccaatcctcctcctccccctcctccaccaaggaacggtggcactccggttgaatctgtgatcaaaggccatcgtcttcatcatcttctcactaatcctcaaattccgctcgatacaccactcttgccgattgtgatattggaaatacctcaccttagttcttaccttgggggcaacaagatcagctcctacacttgtggctacaatccaccatttccggcgaagttcttccaagactcgttggttgcaaatcgtcctaacatctttgggacaagcttcatttgcattttcagtccattatccgaaaatgtcaacatagtacttgatggtttgcctgatgaatttgagtctcttattactttcgttagtggaaagtttgaatctctctctgttgatgagggccagtctagctcctcatcaaactctggatcgaattacaacaactataatggtggaaatcggttctttaactctggttgtggtggtggccgtggcagaggttgctactccaatgtgcagtgtcagatttgccataaaaatggacatgaggcttctttctgctattacaggcatgatgatgattatgttcccactcaaccaatggattaccccaaccaataccccaattactctcaatctctgccttcacccaaaatcccaatccctctcccaatcaggatcaaaatcagaaccctaattgctatcccaatcagaattctaatcaacctcagcacaaccaatataatcagttataaatgcatggctgcagatggaagagtttacatctccaaagatgtagtctttgatgaacttaggtttccttttcccaagttaatgggggaaccagcttcagaaccttcttctattgcttcacacagtcaacaaattttgactgttctgccaatttctcacacagaagcttcctctgtctctgcttctctaacatctgctccttctgcatctgcttctccagcagcctctattcagtcaccagcagcttcaacatcagtgaatattaatcatgcttctgcttctcaggatttaccacttccagtgcaagaaactttgccttcagtcactgtttctgtgcaagagaacttgtctcaagctggtgattcttctcctgctgtgcttttcagacctgataacattcatcccatgtgtactagggccaaagctggtgttgttaaacccagacttcagcccactctgcatctaactcattctgaaccgaagtctaccaagacagccctttctaatcccacatggtttgcagccatgaaaactgaatatgaggtcttgattaagaatggtacctggtcccttactgaacttcctcctaataggtctgctgttggttgcaaatgggtgtttagggtaaaggaaaaccctaatggtactgtcagcaagtacaaggctaggcagccaaagtgtcctttgacaacgagaaagatcgagagaatgagtagagagagaatcagagggtgggagagagttaggcatagaggcaaggtcttcgagagacaaagagtgagactgagagtggattctcaacagacacaagccaggaacagggatgggcaacaacaacactacaaccaaacaaattggagggatcgaaacgagatatcatccttctatttcacgcgattctccgacgatgtctccgagaaggacctgtggtatcaattcaaaaaatggggacatgtgagggaggtattcgtatccaaacaaagaaataagaatggtaggaggtccgggtttgctagattcaaaggtgttaatgacgtgtacatactcgaaaggcaattggacagcattgttatcgaaggtatgaagctatacgccaatatcccaaaatacgggagacagaggggtagaaagacaatttcagaagataaacagaaggggcaagtgcaaaggaatgagaatgaagcatctcgtcctatacaaagaggtgcaagaacaaaccatggatcgtatgcgaaggtggtcgcgaggaaaggaaatatgaaggcaccacacagtcgcgaaggtgggctattatcagtatacctcgagacctcttcggatatgcagaaatggttcagcgaagcttag

SEQ ID NO: 35424 - DNA, 282 bp, Glycine max
  Peptide Sequence Number=SeqID_152202
atgggtgtcgttacgcaatccgtgaagttccgtaatgtttcagaaaggaatcagcaaaaaaacaccaagggggggggttccaacagaaggcggtgccttctagtggaagcaacccagctcgcccaggcgagctgggcggcaaccacctccctcttttctcctataaataggggaaagatggtagagcaaaaatgttcagccgttctggtatttaggattctctcgaaattagtgaggaaaattgtttccatgaaaaaagtccaagccgaggcacttccgtaa

SEQ ID NO: 35425 - DNA, 474 bp, Glycine max
  Peptide Sequence Number=SeqID_152203
atggcgtccaaggatagggttcaggaatggaaccatagattggaaagtacttggtgtgaaggagcatctttgagtgtttatgtacaactgtgttgttatgggatgccattggttgatgaagcaaagttggttggttacagttgtagacgagaatggatctcaacaatggaattgtctaaggatgtcattttccttgagatgggaatggatgaggatgatcaaccagaaatggaaaataattcaaataattatggtgaattgttggcagagagttccataaggtttattttttatgatgagatcaaaaagttagaagatttcagaacacaatgggttgaaaagatttccctagtcattttcaagggttttgattgtcattctcgagattatgtgaataacaagaggcaatggcaagagggtgaagaaggatggactgtgtcgaagactctaatagaagccttggattatctttaa

SEQ ID NO: 35426 - DNA, 727 bp, Glycine max
  Peptide Sequence Number=SeqID_152204
atggagaatgctattgtgaaaggttggctcattggggctatggaacctgatttgatgaatttgtatgttcctatgcccataccaaagagtatttggactgctttatctcagacttattatgaagggactgataggtcagctatttatgacttatctagacgagtaatgcaaatgagccaagatggtaggcctgtttccatatattatcctaacttgcgtgcaatatggaaagaattagagtatcgcaagccaataacattttctcagcctaatgatattcttcatacgaaaccttttcccaatctagacaatgcatttgttgttgtcaagagtgaggagcaaaggagaaatactatgctgcatagtcaagtgacttctagtgtgactatggcaactaaaactgctctaactcggaatctgttacgaactaaagggcaagtttcagattccaattctcaccctttcaatgccaaaatcaaacaaattctaaagttgctcctaaacaacaataagtgggaacatcccaaaagaaaggaattggtgctaaaaccaacaccaccaccaagggtagcgacaatgcaaacatatgaaaagtctcaaaagggtcaagaggtggttgagtcaaaaccaacatcaacaatgctaaacaagggtgaagaggagtttgaagcaaaaccaacaccaacaatgctgaccaaagtcagcacaactgaaaggcctcagaaag

SEQ ID NO: 35427 - DNA, 249 bp, Glycine max
  Peptide Sequence Number=SeqID_152205
atggagagtgtatctgttgttgcgtattccgatggttacatactttcatcatctgaaggggtattgcttgaatgtcctagtgatcctaaagtcttcacaataagtgaggacatgtcacttgatgctttaaggaaaacaattatgaacatcgttggagagacaattaatcaagcactaagcatgcatggattactagcaacaaaatacagagtaattggtgaagaggaaaaactgatcagaattcaatag

SEQ ID NO: 35428 - DNA, 824 bp, Glycine max
  Peptide Sequence Number=SeqID_152206
atggagttttcagcaattagatgtcaacaatgcctccttaatggcattcttgaagaagatatttacatgactcagcctcctggattgaaaattccgacaagcacctcgtgtgacccttctttattcatctacactgattccaataacactggtttatatgctactgacctaggaagtcttgactatttcttgggaattgaagtcagatctcagcccaatggtgctcttattctaactcagtccaagtacattagggatttgttgagtaaaacaaagatggacgaagctaatctcatctcttctccaatggttagtggttgcaaattgactaagtcagggtatgaatctttccctgatcccacacactacaggtctgttgtgggagccttgcagtattcaactattactagacctgagataagtttttatgtcaacaagtttcttccttcttccactggacctccattctcttacatgcatactgtgatgctgactgagcttctgacccagatgacagaagaaacacaggcagaatatcacagcttagctttggccatagcagaggttacatggataaagtctcttctatctgaacttcacattcctcatgccacaccagttatcttttgtgataacatgagcactgttgctcttgctcacaactcagtgatgcattcttgcactaaacatgtggagttggagttgttttttttcagggaaaaagttatggctgaacaacatcaagtcatccatgttccagctattgataaaaaagcagacattctgactaaggctcgtactccttcaaatcttactacatacag

SEQ ID NO: 35429 - DNA, 171 bp, Glycine max
  Peptide Sequence Number=SeqID_152207
atggccattcaaaaacttcttgaacagttgtggctcttgggagttattttcgaaaattccttactggctttaaaaattaaattcaaatttcttaaggttgttataaaatgtttaaaacttctggtaatcgattacaagccttgtgtaatcgattactggcttgaaatttaa

SEQ ID NO: 35430 - DNA, 237 bp, Glycine max
  Peptide Sequence Number=SeqID_152208
gttaagcaggatgcattctttcctgcagatctgcttttcttggctagcactaatgcagatggtgtctgctacattgagactgctaatttggatggggaaacaaatttgaagattaggaaagcattggaaaagacttgggattacgtgactccagagaaggcatctgagtttaaagatggaagtgttaaatttgggatcacaactggatttaagcaggagaatcgtggaagatactag

SEQ ID NO: 35431 - DNA, 291 bp, Glycine max
  Peptide Sequence Number=SeqID_152209
atggcttccgcaaccaacaatggtgcttctccgcctcctcccacaccgccacctacattgctggcggcgactgggtcttcaacttcgatggcttttttgcacactgttactgcaaaattgaccgattcgaactatcttttatgcagatctcagacactgctcgattctttgcttttgattggggattctgtatcaatgaatgagcatattgacatcatacttgatggcttgcacgaggagtatgagacgattgtgactattcttggctctaaaactgagcctgactcttga

SEQ ID NO: 35432 - DNA, 393 bp, Glycine max
  Peptide Sequence Number=SeqID_152210
atgaccaagaatagggtgttgaaagagcataacaagattttcctaaattggtttaaagatacaatttttggtgatgacaatgcttctgaaacgttaaggaagttagcagatgggtctaaaggaaatgttagaacttggcagggatacaatatcaacaagtatttgttctataccaaatcacaagatgacaagaatccttgtgatgaaaggtggtcagtggttctacacggaaaaatcattggtattaatcctaaagatgatgattcaacccttgatacttgtcacgctcctttctccacacacatgcctaaccttaatggagaagaagaagttgatgacgtccatgcaaatcataatgatcatgatgaagtagaattaattaacatcgtataa

SEQ ID NO: 35433 - DNA, 813 bp, Glycine max
  Peptide Sequence Number=SeqID_152211
atgggcaaagttcaagatgtgtcttatgagattttaaatgtgctcgagtttaataggaagcgtcagtctgttgtttgtcgttatcctgatggaaggcttgtactatactgtaagggtgctgataatgtagtctatgagagactagctgatggtaataataatatcaagaaagtcaccagggagcatttggaacaatttggatctgctggattacgcaccttatgcctagcctacaaagaattgcatcctgatgtttatgaaagctggaatgagaagtttatccaggccaagtcttctctaaatgatcgtgaaaagaaattggatgaggtggcagaacttattgaaaatgatctcattttaattggtagcacagccattgaagacaagcttcaagagggagtaccagcttgcatagagactctgcaaagagctggtattaaaatttgggttcttacaggggacaagattgaaacagcgataaacatagcctatgcatgcaacttgataaacaatgagatgaagcaatttgttattagttcagaaactgatgcaattagagaagttgaagacaggggtgaccaagtggaaattgcacggtttattatagaagaagtgaaaagagaactgaagaaatgcctcgaggaagcacagagctcctttcagtccctatctggaccaaaattagcacttgtaattgatggaaaatgtctaatgtatgcattggatccaagtttgagagtgatgctgctgaatctaagtttgaattgtcacgctgtagtttgctgccgagtttctcctttacagaaagcacag

SEQ ID NO: 35434 - DNA, 384 bp, Glycine max
  Peptide Sequence Number=SeqID_152212
atggacactgcggcatcatctctcattgtacttgaaatattttgcattttaacaatggaaacatattttatggacagggttcaaagatggttcttcccctatgattatcagattattcaagaaatgcatagagatgaggtagatagcactggtagagcacagctgctggagatagggaaccagcttacaccagctgaggcaaggagtcatgctatatctcaactcccacgcgaaatatcaaagcacactgggtttgcttttgattcacctgggtatgaatccttttttgcctcacagctcggtgtatatgctccacccaaggcatgggatgtagcaagaagagctagcatgagatcacggccaaagattgggcagcaaaaataa

SEQ ID NO: 35435 - DNA, 288 bp, Glycine max
  Peptide Sequence Number=SeqID_152213
atgcaacgccgatctgactttgagcattggtatcatggtcctgcccccaacgcgtgcattagtggttgtaggaacgtgatgcataacgacggcggtgtgatcggagagcacatggaagtggcgatgtcgacgcaggcagattgtacaacagaattgaaagttgctaaaagcaagctgcgttatcgttctcgttgggatcttattcgtatattggctactgttgcacggtggcatgtgcaagtcgtggtggtgagagaagatgaaaacaagaaaaaggaaatgggttga

SEQ ID NO: 35436 - DNA, 255 bp, Glycine max
  Peptide Sequence Number=SeqID_152214
atggaccaagaatacataccatggagccctcacgcaaatccccactctccattcagtcagcttcatcaacaactccttcttcgacccaattcctcccttcaacaaacttggagccttcaaggccctttacttagctcacaactatgtccacccaacgatgagcagggatcacatgtaggaggtggtgcaagtgcacgtgccgagttcaaaccacagcagggcctccgaggtggggagcaagaaggagtctactaa

SEQ ID NO: 35437 - DNA, 192 bp, Glycine max
  Peptide Sequence Number=SeqID_152215
atgagcaccacatcctcaaccgcatcaactgagaggaaaaatgccatcatgcgaccaccactgatcatgcaatttatcgctgccttcaacaatgacaagaataccatacaacttccagccttctatcatactcaatgggcaccaaactatcctgagatggttcatctcagatacaatggagccatttatgaa

SEQ ID NO: 35438 - DNA, 384 bp, Glycine max
  Peptide Sequence Number=SeqID_152216
atgaaggcccaagtggagaaggatgaaggcccagaggcagagacactatcaagactattaattgttgctgaaggcccaagtaatccttgtggcgtctacccggacttatcttccttcaccggaagtgacgtctacccagacttatcttccttcgccggaagtggcatctaccctgacttatcttccttcaccggaagtggcgtctaccctgacttatattccttcactggaagtggcgtcatccaaaaaaaaactcttcaacctgtatcaaacgatccgctcctactcaagttcgcatcaataggccagcctatagaagtaatccacaagaaaccaaagagattcaaatacaagtggatgaactcattagcaaaggttgggtaa

SEQ ID NO: 35439 - DNA, 387 bp, Glycine max
  Peptide Sequence Number=SeqID_152217
atgactggagtcaaaccttgggtcaaggttccatgtatgcattccttgagccacagtcatcttgaaagatggcttaaggaatctgaccgagaggtgtacgttggaccttacttccatcatgtaatgacgaaattaaagacaaccttgtctcctaaaagtaaggtagctgcacctaagtggattgaagttaagagtcacgttcaaaccggatgttatgaatgtggatattacgtaatgcattggatgtggaacatcataaccagcgagataaagagtgactggtccatgtggtttgctgatgcgacatcgttggacatcgacaacatcacaacaattcgaaacaaatgggcaagatattttttaaagactgcgtgtaaaaagggctaa

SEQ ID NO: 35440 - DNA, 189 bp, Glycine max
  Peptide Sequence Number=SeqID_152218
atgtctatgtgcaaaaaagaaaatattttaggggttggacctgaatcaggaagtgagagtgaccgagtaaacccattgtgtggtgtgctttgtcatgtactcctaagcgccccagtgttgtttttcactgacatggtgaggcttcatatgatgagtcacatgctaaagatggagagacttagtctgtga

SEQ ID NO: 35441 - DNA, 255 bp, Glycine max
  Peptide Sequence Number=SeqID_152219
atgtcattcaggacttgtgggaaagcttgggcagagcaaatgaggaaaatgagtgaccaaagaaatgcttgtgcattgctggttatgggaaagcttggaggggttgatggggacctggtgctgagaggaacgaggataagggctacgtgggggtacgcgagctcagttgaaggtgggcaactggggatggtgggttcatgtgtgatttgtggatgtgggagagttgatttgcaccatctcccgatcgccacctag

SEQ ID NO: 35442 - DNA, 294 bp, Glycine max
  Peptide Sequence Number=SeqID_152220
atggaagcaaaagcgcaaaaatggtggcctatgggcgaaaatctgcaaaacccatgggtgttgcattttttgaatgagggaggggagttttgggtggagagaaactccccctcccctcgtttttatgtttccaggtgcaggggtgctcgcccaggcgagctcactcgagccccccccttagggatactagactgcctcccagctgcgcttcccacttgtccggagctgggcatgggacgacgaatcatcgatcatgggtctagcctctactcacgtccgtccctaagtacctga

SEQ ID NO: 35443 - DNA, 401 bp, Glycine max
  Peptide Sequence Number=SeqID_152221
atgggtatggagtatcagaagattcatgcttgccccaatgattgcatactgtacagacatgaatttgaagaaatttcaaaatgccctaggagtggggtatcacggtacaaagttaaggatgatgaggagtgtagtagtgatgaaaactcaaagaagggccccccagcgaaggtgttgtggtatctgccgattgttccaaggtttaagcgtctttttgctaatggagacgatgctaaagaccttacatggcatgcaaatgacagaaactgcgatggaatgatccgtcatccggatgattgctcccagtggaagaagatagatcgcccaagacagccaggaaatgacattgatgtttatctaagtccgttgattgaagacatgagaaagctgtgggatgaggg

SEQ ID NO: 35444 - DNA, 622 bp, Glycine max
  Peptide Sequence Number=SeqID_152222
gcttctttgtaaacttaaccacactaagtcgtctacagtcttacggctgaaggcgatttggttaaaggctaagctacctttcgagttgtggcttggccagtgctgtcctgtcgacccttatttaaaaggtcgattgatctggaagcttcaacaagctttcagacctaaggatcttgtggtgcctccaacgagtacttataagtctgagacttttgagtacttagaggatatgacacttctaagatcttggactgaagcctggctcaagtacgtcaggtggtattacgctactgctttatccccagatgtttccatcgaggattttatccaagctcctgttgttactactcgctctttccagcgaggagtgagaacctctttgatgctgaggttgcggctcatcgagaactgttgcggggagaccatagctgaggctgggcttgatcctaaacctctaactatcctaggttctaggttaggtggaagtgaaaagactaagggagatgcagattacagcattgctgattcagaggagattactgatattgtggggacaaatttaattttcatgacaggccctgttattgatctccttctggtcatgcagcatagggttccatga

SEQ ID NO: 35445 - DNA, 294 bp, Glycine max
  Peptide Sequence Number=SeqID_152223
atggtacctaatgcatggttaactaagaaaggatgtttcttcgggcatctcaatttcataattacattttccatgcatagcttaaaaaaaggacacgctttacggcgcccttaccgaactcgtgctagagctagagtaatgggtgaagcagaggaggtgcaagagaagatgaaggccgaaatggaggccatgaaagagcaaatggccacaatgatggaggccatgatgagcatgaagaagataatggaagccaatgcggttatagttgccgctacttgcgctgtcgctaagtga

SEQ ID NO: 35446 - DNA, 378 bp, Glycine max
  Peptide Sequence Number=SeqID_152224
gaatttaaaaatgtctttcctaaggagattcctcatggactgccacctttaagtggcatagaacatcaagttaatctctttcccggagcttcattgcctagcaggccaacttataacagcaagccccaagagactcagcataaggatgcacaggccaaagttaagtatgtgaaaagattgtatgaccaagtgaaggtgcaaattgcaaagaagaatgaaagttatgccaagcaagcccacaagaaaaggaaggaagtggtacttgaacccggtgatgatcctgggtatttgagggcaaatgttttccaagaaggagggaatgatgagaatcctgaaactggccaaatacaggctaaaggcccaagtggagaaggataa

SEQ ID NO: 35447 - DNA, 582 bp, Glycine max
  Peptide Sequence Number=SeqID_152225
atgatcggccctatcgatgagtcaatctcttataagggtggacccttagagggctacacgccatcgccttcagatgactacacgttctcaccttcagagggctactcgccctcaccttcagaggactacacgtcctcgctttcagatgactacacgtcctcacctttacacgactacacgacctcgccttcagaggactacacatcctcgccttcagaggactacacgccctcgccttcagaggactacacgctacacgcccttgccttcagaggactacacgccctcgcctttagagggctacacaccctcgccttcaaaggactacacaccgtcgccttgagagggatacatgtcctcgccttcaaagaacggcacgtccttgcctttagtggattgaacgtcctcgtcttcagagggctgcacgtcctcacctccagagggctacatgccctcgccttcagaggactacacgccctcgccttcagaggacgacacgtcctcgcctttagaggactgcaagccctcgcctttagaggactatcgtccttgccttcagaggactacacgtcctcaccttaa

SEQ ID NO: 35448 - DNA, 477 bp, Glycine max
  Peptide Sequence Number=SeqID_152226
atggcctccagaaagaggaaagctacaacatctcgacctcaggagccctatgataccaccagattcacttctgagggggcctgggaacgttattcacagaacattcactcctggaacattcttctggagaggaatgttaatctttttgtcacagaatacgacgaattctgccgggagctgatcaggcggaactggcacaaggccttgactcagttcatggacgggcagattgatgtggccctggtcaaggagtttaactcgaacttgtcgcgcacggatcctcaggaggttgcttcaaagctctgcattccagggcacatatttgttctaaatgctgaaggagcgccctggaagctcctgaggaaagatttgaccacattggcgcagaattgtgtagaagcaaacttcatgatgatgaaccaagcaattttgatgatgccaaatgatgcaatcctaccccccaaaggcattggatag

SEQ ID NO: 35449 - DNA, 255 bp, Glycine max
  Peptide Sequence Number=SeqID_152227
atgatgggtgttaaacattttgaggtggtcaaacgaaggtcgcatgccgacaaacaatggtccccggacgaaattaagctcagtgatgcaatccaccctaggaaaggaccagtcactagagtcatgagcaagaggctccaagaggattgggctagagctgctgaagaaggccctagggttctcatgaacctcagggtagggtaccctagaaatataggatttttcagcacttgtattttagagcacttagactag

SEQ ID NO: 35450 - DNA, 163 bp, Glycine max
  Peptide Sequence Number=SeqID_152228
gtgtcctagaggtgttttaaagggttctaaggttcaaaagtggagggaattgagagaactaagaaagaagaagaagaaagaagaggaaacgaagccgaggcgctgccgaatcatgactatgatcaatctctacatcgttccttgttcagtgttcttcgtgtga

SEQ ID NO: 35451 - DNA, 531 bp, Glycine max
  Peptide Sequence Number=SeqID_152229
atgcctcctccacctctaggaatctcacaatcactcaaaaactcacaaatcttcctaaaagatcaaaacttggcttctttgctctgttctttgcctctgtgtatttcactcttcaagcccttacggttgttcagctctcttctcttttcttctattccaggcttaaaaaggctcactaacctcaccattctcgtgaggcgtaattctggttggctcttgaaagacaaccttctgatacagcttgttataaaggtgacatcaccatatggaaacaatcttcatcacaaggagaacacaagacatgccaaggattgggattctattgctagaaaagagaagattgagggattcaagcttgagctgagaaagctagaaggagcagtaaattccatccatcagaatttgctctatcttaagggaagggaagctgaaatgaggactgtgagtgaaaaaacaaatggcagagtggcatgtttctggtttgcaattgtggtatttgaagcggtactttcagaagaagaacttatatag

SEQ ID NO: 35452 - DNA, 321 bp, Glycine max
  Peptide Sequence Number=SeqID_152230
gttgaatttgatatccctgaagcatgtgatctgaggacaaaaaagaaaatacttcagattgtgagagagcggtggagacaatttaagtctgatttgacattgaaatgggcacttgtagctgacaaggaaagtgtcaacgacactgtatgcgaaaagtacgacattagcaaggagaagtgggcccaattttttcaaacccacaaagacccttcgtgggaggatgtacgaaagaaggcacaggccatccagaaacaaaacactacccctcacgtgttgtctcgtgggggttatgaatatttagaaaacaagttgatgggttag

SEQ ID NO: 35453 - DNA, 240 bp, Glycine max
  Peptide Sequence Number=SeqID_152231
atgacgtctgaggcagtaaaggaaattgttgagaagattgattcattggaggggcaggcctcacagggttcctttgtcgcccatggacgtcaagatgtactgactgctgccattgggcgaccagaacaccctggttgtgtgcgtgctactggagccggtgtcacgatcaagcaatattttggaccagctccaaggacctccctcacatcttcctccatggctcctgaagacctggagtag

SEQ ID NO: 35454 - DNA, 552 bp, Glycine max
  Peptide Sequence Number=SeqID_152232
atgggatcaagtcaggcgccttcgcttaaaaagaggttctatcaagtcaaggtcaagagcctaggagtctccagtctgaaagagttaggacggttgatgggtcagctccagcgacaatcttttcgcaaagcttacggtaagatctgggacctagccatggcagaggtctccacagaggccattgcctccctcgcccaatattatgaccagccgttgaggtgcttcacctttggggacttccagttatcacccacggtggaagagtttgaagaaattctgggatgccctctgggaggaaggaaaccatacctattctcaggattttatccctctttagctagaatttctaagatagtccaaatctcgacgcaggaattagaccacagaaagcaagtgaaaatgtggtggttggagtaccaaggaaatgtttggaagcaaaagccagagtcttggcaggaaaaggcagcgattgacgcttttcttgcctttcatgaccgcaaggaaagcccggttgtcactatcttagccgatttatatgacaccttcgactga

SEQ ID NO: 35455 - DNA, 758 bp, Glycine max
  Peptide Sequence Number=SeqID_152233
ccaccagcggcggcgtagtcatcagcgccaccgcaacagacccagaatgctcagactggtgcgacagccaaaccgcccagcaggaaggcgatggtctgcggaatatagctcaggccaatgtccgccgggctcagacccgcggcggcgaggataaacggcgagccgctgggctgcggcgtgctttcgtggcgcgcacgcggcgcgctggccagtttcagtgtgccgaacagcagcaccagcgtcaccagcgtgagcgcgaggaagatggcgcgccagtgaaaatgggccatcagccaggcacccagcagcggtgccagcgccgcgcctgccagctcaccgctgcggcgcacacgcctaccgcctgcacaaagcgcagcgccagcatcagccagacgttagtcacccacagcatggcaagacagctcagcgcaaacaggctcaggccggccagtaaaatcggcttacggccaaagcgatccgacagcacaccccacagcacctgcgcacaggcaaagccgcccagaaacaggctcaggctggcgctgatggtgcccggtgcggaagcaaagtcgcgctgcatggcgccgaaggcgggtaaatacatatcggtggccagaaagccgagcatgctcagcacggcaaggttgaacggcggggagtgtaaaaggcgcggcggcgcaggagctgcaccgcgtgccctctgccataagctataccgtgcgccagctggaaggctggctggcggtaccgctgtttga

SEQ ID NO: 35456 - DNA, 846 bp, Glycine max
  Peptide Sequence Number=SeqID_152234
atgtcccgagtcgatcggcggaccggctctcaccgttccacatccgaccgggacacatcgccggcccccatccgcttccctcccgacaatttcaagcactctttgactctcttttcaaagtccttttcatctttccctcgcgttacttgttcgctatcggtctctcgccagtatttagccttggacggaaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtagtgggatcctctag

SEQ ID NO: 35457 - DNA, 1557 bp, Glycine max
  Peptide Sequence Number=SeqID_152235
atgtcaagttgcagcaagagatgcctagtactgttggaaaagtgcaagaacgtgaatcacctcaagcaggcccatgcccaagtattcaccactggccttgacaccaacacctttgccctaagcaggcttttggctttctgctcccacccttatcagggaagcctcacctatgcatgcagagtctttgaacgcattcaccaccccacactttgcatatgcaacaccataatcaaaaccttcctcgtcaatggaaacttctatggcacctttcacgtcttcaccaagatgctacacaatggtttgggccctgacaactacaccatcccttatgtgttgaaggcttgtgcagcccttagagattgttctttggggaaaatggttcatgggtacagttcaaaattgggtcttgtgtttgatatctttgtgggcaatagtttgatggcaatgtattctgtgtgtggggatgtgattgctgcaaggcacgtgtttgatgaaatgcctaggttgagtgcagtgtcttggagtgtgatgatctcggggtatgccaaagtgggtgatgttgattcagctaggttgttctttgatgaagcacctgagaaggataggggaatttggggtgccatgatttctgggtatgtacaaaacagttgcttcaaggaaggactctatttgtttcgtttgttgcagttgactcatgtggttcctgatgagtctatatttgtgagcattctttctgcttgtgctcatttgggggctttggatattggaatctggatacacagatacttgaatcgaaaaacggtgtcgttgagcattcgtttgagtactagtttgctagacatgtatgctaaatgtgggaatttggagttggctaaaagattgtttgactcgatgccggagagagacatcgtgtgttggaatgccatgatttctggtttggctatgcatggagatggagcaagtgcactcaaaatgttttccgaaatggaaaagactgggataaagcctgatgatataacattcatagctgttttcactgcttgtagttattcaggaatggcacatgaaggtttgcagttgctagataagatgagtagtctgtacgaaattgagcccaagagtgaacattatggttgtctagttgacttgttaagccgagccgggcttttcggagaagcaatggttatgataagaaggataacttctacctcatggaatggctcagaagagacattggcttggagagcatttctgagtgcatgctgcaaccatggacaagctcaactagccgaacgagcggccaaaagactcttgcggttggagaatcatagtggggtctatgttttgctttcaaatttgtatgcagcatctgggaaacacagtgatgccagaagggtgaggaatatgatgagaaacaaaggggtggacaaggcacctggttgtagctcagtggagattgatggggttgtgagtgagttcattgctggtgaagaaacgcatccacaaatggaggaaatacactcagttttggagatattgcatatgcagttagactag

SEQ ID NO: 35458 - DNA, 1542 bp, Glycine max
  Peptide Sequence Number=SeqID_152236
atgaatgtgaaaacaaccatatgttgtgttctccttttattattttccacatcttcagctaaagatgtggaccttagagtgaaaggggtgacaagcattgctaccacagatgaaaactttatctgtgcgactctagattggtggcctcctaacaagtgtgactacaacgattgtccttggggaaatgcaggcattctcaatctggacttgtataatgatattttcttaaatgccgtcaaggcatttaatcccttgaggatcagactaggaggttcactcgaagattggcttgtttaccaatttgggaaacaacgggaatgccccctttttcaaaagaaaaatgatggtctctttggtttcagcaaaggctgccttcccaagaagaaatgggatgaaataaatcactttttcaacaaaactggggtgaaactcacttttggattaaatgctctgtctggaaagaaaccttccaaggaggacaagaagaactggaaaggagactgggatccaacaaatgccatagatctcatggagtacacaatttcgaaaggatacaatatagattcatatgaattaggaaatgagttatgcgctgatggggtaagtgccagaatagacagtgttcaatatgctaaagacatcactcagctcagaaaaacagttaatctactataccaagatgcaaatacaaggccaaaggtactaggccctgctggtttctatggtaaggaatggtttgatagcttcttacagaatgttggacacggtgtggttgatggagtaactcaccacatttacaaccttggttctggtaatgataaggatcttatcaacaagattcaagacccatattatttgagtcaagttgctcaaacattcaaagatgtctcggatgcagtgaaagaattcgaaccgtcgtcaggaccatgggttggggaatctggtggagcctataacagtggtggcaaagatgtgtcaaatacttttgttaatggcttttggtaccttgaccagctgggaatgacatcaaccttcaaccacaaagtttattgtagacaagcactagttggaggaaactatggtttgctagacaccacaaccttcattcctaacccagattattatggagctcttttgtggcatcgcttaatgggaagcaaagtgctttctgtttctcatgaaggatcgccatatttgcgtgcatacgttcattgctcgaagacagagtctggtatcgccgtgctactcataaacatgtccaattccaccactttcgaagtatcactactcaatgacatgaatctgtacccggaagtagtttttaaaaacacgcagagagaagagtaccatttgacacccaaagatggtaacattcaaagtaaggtggtgctgttgaatggaactccactagtgctgacccagtcactccacatcccagaaatgaaaccaaagctggttgatccatcttctccagtcaaagtgaagcatgattcaattgtgttcgtgcatagcaagagtttcaatgcaccagcgtgtatgtag

SEQ ID NO: 35459 - DNA, 759 bp, Glycine max
  Peptide Sequence Number=SeqID_152237
atgacccttatgcccttactcaggtcgtgccctccttacttcactcgggtcgtgcactccctccctcacttaggccgtgccctcacttcgtccttcactcaccgactgacaaagtgtctcctatgtgtcacgtcctcgtcgtgtgccaccatcatcaaagaggtaagaaccctactgtattttgttgctgttagtttcaacatcaggagtcttctatttcagcagtccaaagccagggtcaataatccaaaaacgcttcttcttcgaatagtagttgaaattggatgtattgagagggctctatggtacaaagggatcgagctgccaatagggtgcactacaactacctgtggcattcgcgactcttccaatgacgagaactcattccctaccagcggagatccttataatcaggtttcttttaagggagatgctgggaagtcttttgaaaggcgtggttatggtggaccacgaggtccttaccgtggtggtggtggtcatcgtggaggtttcagcaatggtgaaattggtgaagctgaagaaggacaacctcagagagcatttgatcgttgtaatgggattggacgtggaaatgaattcaaacgtgaaggttcaggacgtggtaattggggaacccaaactgatgaacttgctcaggtaactgataaggttgcaaatgaaactgaaaagaatttgggtgatgagaagcctacaatcgaagaagatatagttgatggtaacatcactaatttatattaa

SEQ ID NO: 35460 - DNA, 1215 bp, Glycine max
  Peptide Sequence Number=SeqID_152238
atggcgcgtgcacccttcacttctttccccttcgtcctcattatccttctgtcaatcgtccacctttcgcactgcaagaccctcaaacgtgacgttaaggctttgaacgagatcaaggcttcgcttgggtggagagtggtgtatgcgtgggtcggtgatgacccttgtggagatggggatcttcctccttggtctggtgtcacgtgttccactgtcggtgattatcgtgttgttaccgagcttgaggtgtatgcggtgtcgattgttggaccttttcccactgctgttaccagcttgttggatcttacacggcttgatcttcacaataacaagttgacagggcctattcctcctcaaattggacggttgaagcgtcttaaaatactaaatttgaggtggaacaaactacaggatgcaattcctccagaaattggtgagcttaaaagtttgacgcatctgtacctaagcttcaacaatttcaagggagaaattcccaaggagctagcaaatcttccagaccttcgctatctatatctccatgaaaaccgtttagctggaagaataccaccggaattgggcacactgcaaaatcttcggcacttggatgctggtaacaatcatttagtgggtaccataagggaactcattcgtattgaaggttgctttcctgcactacgcaatctgtatctaaacaataattattttactggaggaatacctgcacaacttgctaacctaaccagtcttgagatcttgtacttgtcctacaacaaaatgtctggagttataccatccactgttgctcatattcctaaattgacatacttaataaactatcggagaaaggtaattgagaatcataagatgtctaaggttagaaaagttgttaaagtagacttgggtgaatcaaaagttttgggcaaagataagtggtggaatggaaagaaaatcaagaaatttgtaccaagagttattgaagaaaaagttttagttatatggatcaagatatcaaagaaagatgagaactatttttataagcttttcaaggatgggtacttggatcacaatcagttttcagggagaattcctgaacccttttacaagcatccatttttgaaagaaatgtacattgagggaaatgcattccggcctggtgtcaaccccattggtttccacaaagtgcttgaagtttctgatggagacttcctcgtttaa

SEQ ID NO: 35461 - DNA, 295 bp, Glycine max
  Peptide Sequence Number=SeqID_152239
gagggacaaattttgtgagtgctatgtctgcaatattctccttgtttttaattatatctactaccttataattaactatcaggtgcgaacactggatcccaaagctgtcaatgatgaaaattgcactggaaatactagtgatggtggcaacaacacatgtaattctccgtcactttctctctcttggggtataaggaggtgcaagaacttggtgaagtgcaggctcggagaagaacaagatgaaagtgaggaggaagctaagagagccacggttttgtttccaaacaagaaatga

SEQ ID NO: 35462 - DNA, 861 bp, Glycine max
  Peptide Sequence Number=SeqID_152240
atgtttgggtttagaaaagcaccagcaccaactgaatcagataagaagacaacccttactgcagaaaaaagaactacttcagaacctgtcctgccagttgcaaaatctaaaggaaactatttcgacgatgacgacgacgactgggggaggaagccttcctcctccacagcatcaaaggacaaagacaggtacaagaatggtttcagcaactctggggggctagagaaccaaagtgttcaggagttggaaaactatgcagtgtacaagtctgaggagacaacaaacagtgtcaacaattgtttaaggattgctgaggacatcagaggggatgccacaaggacacttgacatgttgcatcagcagggtgagcagataaccagaactcacaatatggttgttgataccgagaaggatttgagccggccttgtgtcccttctgtgggtgaaaaactcctaaacaatcttggtggcatgttctccaaaccctggaagccaaagaaaaccagagaaatccaaggacctataattacaccagataagccatccaaaaagaatgtacataataaggaagacagagagaagttgggcttagctcctttgcctaagggacgctcagcccctaccacacctccaaatgaatcatccaatgcctatcagaaagttgaacatgagaaagctaaacaagacgatgcactcgaagatctaagtggcatcttaggtgatttgaagggtatggcaattggcatgggatctgaacttgacaagcaaaacaaagctcttgatcatcttggtgacgatgtggatgagttgaattctcgagtcaaaggtgccaaccagcgtgcacgcaaattagtagggtga

SEQ ID NO: 35463 - DNA, 252 bp, Glycine max
  Peptide Sequence Number=SeqID_152241
atggtggtcgtcggtgttggtgatggttgtcctccttgtccaaggtgttggtggtggttatcgtctaaacactggctacacaaaagaaacattatggatgagttaggtatttactttggtcatgtacttgtgaatgaacaattaaatgaggttgtgaatgacactatgattgaggattttcctatagttgaggatgatacaattgtcaatgtaaatggcattgtggaggttgatgaagatgtgacttactag

SEQ ID NO: 35464 - DNA, 252 bp, Glycine max
  Peptide Sequence Number=SeqID_152242
atggaaatggtcctatggggcagctttgaagagaatatggttggaggtgtaggtcatgaggaccccatgagtttcattaatatggagccaccaaaggacaaggacatatctatttatgggttttggtctgtttctgaggtcaaattgggctcattcttggctccatgtcgtattttccctagaattgctccggagaaattacaatgcttatatatgcatgatgacatgcagtatgtgcgtggtcataattaa

SEQ ID NO: 35465 - DNA, 249 bp, Glycine max
  Peptide Sequence Number=SeqID_152243
atggcaaaacaaatccttgggcgacgtcagcaaaaaattctcatgaccgatgtcatccatcctcccatgtattctacacccattaagcagagcaccccatatgctagcatctataggctgacatgccgacttaattatctcataagctccaccgatattgccaacatggcttataagatcaactatagaggcaaaatgttctgcattaaacactatgccatgttggaccaagtggcctcaataacttaa

SEQ ID NO: 35466 - DNA, 3246 bp, Glycine max
  Peptide Sequence Number=SeqID_152244
atgggaaccaaagtccagaatcttccaggatataactcaatgagagatcttaatgaggaatctagcagttgtggctggccactattttatggggataaatcactaacaaatgggcagtactataataattatctgccaagttctacaacagatgcatgttctgcatacgataaggatgttgtgaagcagatgatgcttgagcatgaggctgtttttaagaatcaggtctatgaacttcaccgtttgtacagaatacaaagggatttgatgaatgaggttaaaaggaaagaaatacacagaaacaagataccagttgaggcgtcattttccgctggtcacatgacatctcaattaacaactgaagatggacaaaaatggcatatttctggctttcctgtgggaaattctacttgtgctaaaacatctgtgtctggagttgaggttattcattctcctttgggttctatgaaagggatcggcaaacaaactagtccatttccctcccccaatgggtgtagtagttcaaaagatgttgaggtgcttgagtctagaccctcgaagttgaggagaaaaatgtttgacctacacctccctgctgatgagtacattgatactgaggaaagtgaaaaactcagtgatgaaaagacaagtgatccatcattctttcttcctgatagaaactgtaaaaatggaaaggatggtgatgcgaaacttttttgtggcaatggtgagaagactggtagccaggaggacacttcaagatctgagcagtctttaaggagaagaaatggtttggctgacttaaacgaacctgttccggtggaagaaacatacaattctccatatgtcccccttctgaaccgtaatccctgtcaaggggcaactgaatactctgatatctctgccgctaccaaacaaaagttggagttttttggtctgtctagggagcagttgctcaactctcatggaactgacagttgggctcgaagtaatggacatttggagaacaatggaggtggaaaagggtggcatcaatcaatggctgagtcagggcaagctaaaagcaacacacaacctgttcctcaagtcctcaaatcacctttatcttcccaaacaatgcaagatgcacttagcaaagttcataaacctacatctgattatctaaatggtcgaaacaaggctgacatgtggagggaaaagactgtcagtgatttacatatcagtgaaagaaatcatgaatactccatcaataagcaacctgagtctgtgataccattacatagacctggtctttttgcagctgctccttcctctgatttttctaagtcttggtctcattcggcttcttcttgggaaatggccaatagcagcctaagccagaagttgatatcaattcagacacctccatgtataaatgcatctggtgctttgagtaggagttctcagtcacatcaaattaatgggatattggaagaatgctggcctctaaatatcaattccaagcctaaccaaggttttcgaagtgatgcacctatacagaatggattttaccctgggtcttcatctgggtccaaggaaccatcaatgaacatctcttcaattagctatgactatctcaatcataaaaatgattgtaagataattcctgatcacttcatcaacaatgtttcatcaaaatcatgtaagggttcagattcaaattgcaatgacatgacatctggaaaagattttgacttgaatgtgctgcttccaaatggttcatccaacagcttagttccccagtcaggtgttaggataattgatggagaaaagaacaatgaggagcgtcatgcggtgttgccttggcttagagggaagacaacttgtaagaatggagaacataacactgcaggagagtcgagattattccatgatgcctcattgtccaacaaagatgaaactggaaagggacctagcagaaaatttatgcacaatataacttcaattttgtgttctaatgacattgaggcaaggaggaaggagttaaacgaaagctctagtaataagaaaattcttggtgttcccatttttgatatggctcatatttctcctaagaaggagttgtcttcaatcacttctctgtctgtgtcgaatcctaatccatctgatgtggaagcagcgggaaataagaaaaaacggatatttgatatgaacttgccttgtgatgctgctgtcgttgagttggacaaagaagcattcactgaaactgctgttggtaagacaaggtctcctacaacagaagcagactctagaaatcaaattgatctgaacttgagtatgagtgaggacgaaggatctttcacaactataccaagtgacaatgtaaaaatgaaggcacaaatagatttggaagcccctgctcttcccgagacagaagaggatgctgttcttgaagaaaagctgcttgaaacttctctagcatcactgcaagtcccacaagacacagttgaactagcaaaggatgaacttatgacaaatgcagcagaggcaattgttgtcctgtcatctcttacctgtgatcaaggggatgattgtgtgatcagcaaaagtccatcagaaagtccaaaggtggacctgctaaattggtttgcagatgttgtttcctcatgcaaagataatgtagagggaaactgtgatgtttcaagggaaaaagatggcgaggacaacgaggggcattcctctgaaggaatggattactttgaggcaatgacattgaacatgccggagaccaaggaagaagactacatgcccaagcctcttctccctgaaaacttcaaattggaagaaacaactactttgttaccaactcggacacgaaaagggccagcaaggagagcgaggcagcggagggacttccaaagggacatccttccaggccttgcatcattgtcgaggcatgaagtgacagaagatcttcagacatttggagggcttatgagagcaacaggttatcaatggaattcaggattaactaggagaagctcatctaggaatggtggtggcagggggaggcgacgggtgcaagttgccccgtctcccctgacactggtggcaaccaatgaaactagcacccccctgatccagcagcttaacaatattgaagttggattggaggatagaagcctaacaagttggggcaagacaaccagaaggccccgccgacagaggtgcccggctggtaaccctccgttgatccagttaacctaa

SEQ ID NO: 35467 - DNA, 984 bp, Glycine max
  Peptide Sequence Number=SeqID_152245
atggtgcaagttgtgtcattgagcactctggcaacctgtggaaatagcaggttatgtggatcctcaccatcttggatggcaccctttgagccatacaagagatcccaaattacctcttccaatggcagacacttggtttggaacaattctgtgcagagcttgttcttaacaaggcacagtgattttagggctgaagcagcatggatgtttagagggggagaacaagggttggatgcgagttcggagcacagcgagagcgctaatgaggatatcttgatgttcttctttcagctcgacttggccacaagagtgcagtacgctttaaatatggagcagtatgacattgcaaagcagctgaggaacaaacttgccgaggttgaagaagaggtaatcaagcaacaacagtcaaaaaggggattgtcttcaaaaggtgaagcacaagataaagctataagtattatacgtcttcgttcagacctccagaaagctattgagaatgaggattatgccttggctgctgaattacgtgatgaaatttccaaacttgaagcagagtctctagctgcatcagctacagctttggcacatgaaaatgctcaatatgcattccgcttggggcagaaagtgagacataaaaaatttggctatagagctgtgatctgtggaatggatccagtatgcagtgaatcaagttcatggatggaaaatgcacaagtcaaaaaattgtctcgtggttccgctcaaccattttatcaggttcttgttgatgtacatgctgaaccaaatctattagtggcatatgttccagaggagaatcttttaacacctgataaaccagacactggaagattcgatcatccctacatctcttttctattctatggaatggattcagcaggagatttcatcccaatcaagcaactaagggagaagtacaataaaccaaggcatgaaatacccattgacccaccaaatgatgaatga

SEQ ID NO: 35468 - DNA, 171 bp, Glycine max
  Peptide Sequence Number=SeqID_152246
atgactgcttctcaaaataattcacaagtagcaaaggatagttcagcctcaggagaagctggtagccccaagaagatattgttggctgggatatctgatgttcattgcttctatgcatcctcaaggttggtaatttcactagagtattggcaaggagggttgttgttgtag

SEQ ID NO: 35469 - DNA, 1794 bp, Glycine max
  Peptide Sequence Number=SeqID_152247
atgacattgtacatgccattgttcaggtcatgttctaccttaaggtccctctcccaactccacgcccacctcgttgtcactggtctccacagcgacccacttgcctccaccaagctcctcgagtcctacgcccgaatgggttctctccactcatcaagactcgtttttgaaacccacccatcacccgattccttcatgttcggcgtcctcatcaagtgttacctctggcaccacctgtttgaccaagtggtttcgctttaccaccaccacattcaaaagggttcacgcctcacccaaaactgcaccttcctctacccttctgttatcaaagctatttctgtcgttgggggcttggttgtgggcaggaaagtgcatgggaggattgttaaaactggacttggcactgatcatgtcattggcacttcgttgttgggaatgtacggggaattggggtgtttgagcgacgctcgcaaggtgtttgatgaaattcgtgtaagggatttggtttcatggagttcggttgttgcgtgttatgttgagaatgggcggccgagagaagggttggagatgttgcgttggatggtttccgagggggttggaccagactcggttacgatgctcagcgtagctgaggcttgtggtaaagttggttgtctgaggttggcaaaatcggtgcatggatatgtgatcaggaaagagatggctggtgatgcgagtttgaggaattctcttattgttatgtatggtcagtgtagttacttgcgtggagcaaaagggatgtttgaaagtgtcagtgatcccagtactgcttgttggacttctatgatttcatcgtgtaatcaaaacggatgctttgaggaggctattgatgcttttaagaaaatgcaggaatcggaagtggaagttaatgcagtgacaatgattagtgttctgtgttgctgtgctaggttaggctggttgaaagagggaaagtctgttcattgctttattttgaggagagaaatggatggtgctgatcttgatctagggcctgcactgatggatttctatgctgcatgttggaaaataagcagttgtgaaaagcttctctgtttaattggaaacagcagtgttgtatcatggaacacactcatatcaatttatgcacgggagggtttaaacgaggaggccatggtgctctttgtatgtatgttggaaaaggggctaatgccggactcatttagcttagcaagttcaatttcagcttgtgcaggtgctagttcagtacgatttggacagcagatacatggtcatgtcacgaaaagaggcttcgcagatgaatttgttcagaactccttgatggatatgtattcaaaatgtggctttgtggatttggcatacacaatttttgacaagatttgggagaaaagcattgtgacatggaactgtatgatttgtgggttttcacaaaatggaatttcagtagaagcactcaagctatttgatgagatgtgtttcaattgtatggacattaatgaagtgaccttcttaagtgcaattcaagcatgctccaattcaggttatcttctgaagggaaaatggattcaccataagctcgttgtatctggtgtgcagaaggatctttacattgatacagctctggttgacatgtatgccaagtgtggagaccttaaaacggctcaaggtgttttcaatagcatgccagagaaaagtgtggtgtcatggagtgccatgattgctgcatatggcatacatggtcaaataactgctgccaccaccctcttcactaaaatg

SEQ ID NO: 35470 - DNA, 764 bp, Glycine max
  Peptide Sequence Number=SeqID_152248
atgaatgtcaacaaggaatatgatgccctggacttgaacgggaaccacctcgcaaagaaagtggcactgaaggtattgaccattgtccaccataactcgaaagtcatgagcgacaggcgggtcgggtgggtttatatgatgggagtcctccttagtgtcgtcatcatcatcaacgatgataaggaaaaccctagaggcgcatttgtggtcgcggtggaacttctcatcgtaattgaagcaaaggtcgcactcgtgcccctcgaaggagtgggtaacaatggaggaggaagtgtcgaagaagtgggtaaaggtggagagcaaggcacaggctttaatggttgcaaggcctggacctcgggacggatttccgacgtgagtccagagatgaaacagctcaaaaggaacgacgaaggaagaccaataatgcggttagctaagtcttcaaactcggagagcgaatcgtgtttaaagggattgcaggaagactggccaggacgtgagttgaccattattggtcatccactaaaaccaggccagagtgcaaccatccatgtagaacgaagcaatggtcaagcacttgtgttctggagtggagtgtgcacggaagttgctgaagaaggaggagcagtcgaagaagaaggggaagaagtagcagagtccttggtggctaagctatggatcagttcatcaagcttgagtgtctgggacaacgagagcaccaaaatgttaggttcttcactcacaactttggacttcgagggcca

SEQ ID NO: 35471 - DNA, 501 bp, Glycine max
  Peptide Sequence Number=SeqID_152249
gtcgaatggcatcaccttgaactcatagtaaccatgatgagtttgaaaggaagttttacagatatcgtcctcatgcatgaggatttaacggaaactatccttgatcgttatggcattcaatgcatggtagcccacacagaagcgtcatgtgtcgtcatgcttcttaaccagcagaacaggggaggagaaagggctggtactagggcggataagtcctttctgcaacatgaagtctacttgggcttcaatctcttgtttctgaaaatgggggtaccgttacagccgcacattaacgggttcagaattggggataagaagaatttgggtagaggacgtttgggtcaaaggaagctctgtaggggtaatggaaatgtgaaaatatgcattgacgtcctttgtgtggatgatgtgatgaagttgtggtggagtaagcatttgaagtgtagagtcaacttcgcctttgagctccacgagatggtcatcatggaaaaactgcattga

SEQ ID NO: 35472 - DNA, 198 bp, Glycine max
  Peptide Sequence Number=SeqID_152250
atggcggggcaaccagacctaggttggatgagaagattacaacaaatacttggacggaagcaccagcacaacctgcatgcaatatatgtcctccacccaacccttggactaaaattgacagtattggcacttcagttgcttgttgacaatatggtgcgttatgaatcagatttcattaacagatttaaacctatttaa

SEQ ID NO: 35473 - DNA, 885 bp, Glycine max
  Peptide Sequence Number=SeqID_152251
atggcaaacttggcaacctcactctcattcttcactttggcactgttggcactagcaagtggttcaaatgctggcagcattgcaatctactggggccagaatggcaatgaaggcacactagcagagacatgtgccacagggaactatgagtatgcaattttggcctttttgccaacatttggcaatggccaaactccaatgataaaccttgctggccattgtgatccctatagtaatgagtgcaccaagttgagctctgacatcaaatcttgtcaagccaaaggcatcaaggtgttgttgtctttaggaggaggtgctggtagctacttccttgcatcccctcaggatgcaaggcaagtggctacttacctttggaacaacttcttggggggaagctctccttctcgccctcttggacccgctgttcttgacggcattgactttgacattgagggaggatcaaacttgtattgggatgatcttgcaaggtacctcaaagggtacagcaacaagggcagaaaagtgtacttgactgcagcccctcaatgtccttttcctgatgcttggataggcaatgccctcaagacaggtctttttgacaatgtttgggtccaattctacaacaaccctccttgccaatactctagtgaagttaccaaccttgaagatgcatggaagcaatggacttcagatatctcagccaacaagatcttcttggggctaccagcttccactgaggctgcaggcagtggattcattgatgtgaatgatcttacatctaaagtgcttccagcaattaagggctcttccaaatatgggggtgttatgctgtggtctaggtactatgatggccagagtggatacagttcctccatcaagagccat

SEQ ID NO: 35474 - DNA, 1380 bp, Glycine max
  Peptide Sequence Number=SeqID_152252
atgtatgggcctgtggccacttcagattcagccacatcccggggtggattgccaaatgactgtggggactctgttgtgactttggatcaagttccgaggtggattgatgctgagcattccttacagtacgacaatggagattcatcattttccagttcatacttccctgatcccttggcattcaagttggggacggagagcggtggtggtgtgtcaaggtttcctgttgaccatgaagttaattctaagatatacttgtggagggggaacccctggaaccttgaggttgatgctgtggtaaattcgacgaatgaggttttggatgaagcactcagcagccctggattgcatgctgcagctggacctggtcttgcagaagaatgtgcaactttgggtggatgtcgaacaggtatggctaaagtcaccaatgcctacgaccttcctgcaaggaaagttatccatactgttggcccaaagtatgcttcgaagtaccaaactgctgcagagaatgctttaagccattgctatcgttcttgcctagaacttttaattgatcatgggcttaaaagcattgccatgggatgtatttatactgaggcaaagaactatccccgtgagccagctgcgcatgtagctataagaactgtgcggcggtttcttgagaagcagaaagacaatataacagctgttgtcttttgcactaccagcacaactgatactgagatatataaaaggttgcttccactctacttccctcgggataaacaggaggaggagatggctttgtcaaagcttcctgcagatgttggagatgagaatggtgagactgtcatagatgagcgtaaaatcagaataaagcctttgcctcaaaaaaaggtttcaaaagaatcaaaacctgctaaagctcctgttgatcttcctgttagtgatgtcggttcagttcgcaggacttcatcacatttagatacatatttggatcctgccttcatgtctttgattaaagaccctgatgaaagacgtatggagcagtgggagaaaactgttcaagcacaaagaggctggaattttgctaacgtgcttggatttggtgacttaggtggacctccattgtctgccgctgaagaatattctctgcactctagatatctttcaaaagcaaaatccttaaatttgtctgaaattgcagagatgaaaattatctatcgcggaggggtagacagtgagggtcgtcctgtcatggttgttgtgggggctcactttttgcttagatgtcttgatctggagcgatttgtgctttatgtggtgaaggagttcgaacttataatgcagaagccttacactattgtatactttcactctgcttcatctctgcagatgtga

SEQ ID NO: 35475 - DNA, 804 bp, Glycine max
  Peptide Sequence Number=SeqID_152253
atggagatggaagtagacatcgagaagaagcaacaagacgtggtgaaagagaaagacttgttcaaagctgcagaagagggcgaggcatcaacgttcgaagctctctcttctgaaatcctctccaaagccctctctctcagaaacgaagacgctcgttcccttctccacgtcgcagcttcttccggtcactcccaggtagtgaagatagtgttgtcttgtgatgcatctgctggtgtggtgaattgtgctgatgaggaagggtgggcgccgcttcactctgcagccagcattgggagtgtggagatagtggagactctattgagcaaaggagctgatgttaatctgaaaaataatgggggtcgtgctgctctacactatgcggccagcaaaggttgggtgaagattgctgaaatgctcatctcccatgatgccaagattaatataaaggataaggttggttgcactccattgcatcgggcagctagcactgggaaatctgagctgtgtgaacttttgattgaagaaggagcagaggttgatgctgttgatagagctggtcaaactcctctaatgaatgctgtgatttgctataacaaagagatgcaccgaggtgcatggagggttacactcactgcaaattcatgtgcagaatctgcaaatgaatgttttggggtagcccttcttctgataagacatggagcagatgtggatgtggaggacaaggaagggtacacggtgcttggtcgagccacgcatgagtttagaccaatattaattgatgctgccaaggccatgcttgagtga

SEQ ID NO: 35476 - DNA, 275 bp, Glycine max
  Peptide Sequence Number=SeqID_152254
ctgggatagaaggggttgctgaagtggatgctggagtaggagctacagaagtagaaggaagctcagatggccttgccctcaccttcctagcccctcggatagagactgttaatgaccgggctcaagcgcttgaaggtaaggctgtcagagacaacccctctggctttgcaaataatgcggtgattagagcagggaacccaagtctagaggtgttagactgggctatagaggtcatatggccagagatcagtgctcctatgttcatatccaagtga

SEQ ID NO: 35477 - DNA, 713 bp, Glycine max
  Peptide Sequence Number=SeqID_152255
tggccttttccgctggcgccactcctggcatcattgcgcttagcctcagcgcgggcattcccgcagcaacggccttcccttcccttgcctatattttccaccagcatgggaagctgaaagacgcttatcttcagctggagagggcccatgttgaactacaggcacggtcgcggatcgaccacatgaccggtcttctcaaccgtgaggcgctttttgaagccatgaagatcagccgttcccgtatcgaaaccggcaccctgctcgttatcgatgccgaccacttcaaggcgatcaacgatacgtttggccacggcgtcggcgaccgcgccttgaagctgatcgctttcgcgcttcagaatgtgacgcggaagggtgatctggtcggccggatcggcggggaagaattttgcgtgttcttgccgggcgcaagcggagaaaccggcatgcgcgttgcacagcgtatacgcgctgaagtggagaacacaccgtttcatacgaccgagtatcaggtctatccgttgacgatcagtatcggtgttgcgtctgcgccgaagaacgagacgaactcgcaggtgctaagccgtgcggaccgttgtctctatatggcaaagcagcgcgggcgcaattgtgtggtcttcgatgaggaaagcggacgtctggccagcgcgtccatcgtttccatcgcgagtgttcgggaagtggcacgcggttag

SEQ ID NO: 35478 - DNA, 582 bp, Glycine max
  misc_feature (70)..(70): n is a, c, g, or t
  misc_feature (92)..(92): n is a, c, g, or t
  Peptide Sequence Number=SeqID_152256
atggaaagtaagaaattgcaaaaaacggttcgcccgcgctcgatcgaccgcgatcatgtgctcgacatgnccgagaagctgtttgaggaagncggcatccttgcgctgaccatggacgcggtggcgcaggccgccggtgtaaccaagggcggcgtgcaatattgcttcggcaacaaagacgggctgatgaaagccatgatcgaacggctgggcgaccggttcgacgatcaggtggcggcacgcaagcggcataagaatgacgcgatctcacacatagcggcccatatagcggtgacgcgcgaaagcgacgcagacgacgattcgcggtttgcagccatgatggcgagcctgatacccaactcccattatctcgaggaaacccgcgcctggtatcgcaggcaatgggacgggctagatgtttcgacgccggaaggacggcgggcgcgcttggcattcattgccaatgagggcgcattctggctgagaagcttcaacctgttcgagctgacacagaaagaatggcagtcgatcttcgatgatatcgaagagcttcttggcgagcattcaaaagggcgcgaatag

SEQ ID NO: 35479 - DNA, 240 bp, Glycine max
  Peptide Sequence Number=SeqID_152257
atgaagaacaaacgaagaatggatgaagaatggcagaaaaccttcacggatttactcacggaaacgtctcggaagcgttacagaagcacctcagcttggattttcttcacggaaacaattttttcacccaaaacagctgaaatgcatagcataggggaaaaggggggaggaggttgcagcccagctcgcccaggcgagctcaactcgccaaacgagctggatgacttcctttttaagtaa

SEQ ID NO: 35480 - DNA, 675 bp, Glycine max
  Peptide Sequence Number=SeqID_152258
gtaagggtgcgagggcacctaattaaatttgatgctgacaccctcaacaccttcttgaagacaccagtggtcatagaggaagaggagagcttgcccgcctactccaggtttgctaatctgaggcctgttcctcaagagcttgcagctcgtctatgtctcccttggagaggatttgagttgaatgcagacgggctgcctctgaagatcttgaggaagaatctgactactctggcccagacctggagtgttctatccttttcaaacttagccccgacatcccacacttctaacattactctggatagggctaagttgatatatgggctcgtcatgaagatggatatgaacttggggtccctcatctcaggtcaaatctctcttatagcacaacatgactcctcgaggctaggttttccagcccttattacagctttatgcatggcccgaggagtcacatctgattctctgacctttgaatccttgagcccagccattaatttggcttatattaaaaagaattgttggaacctggatgacccttcggtcacttttcggggaacccacaaatttagggccagaggatctaaggcaccatctacttcagctccccatacctcaactccttctacctttcctctcccttcaccaccagcaactccagttcttccaatgtga

SEQ ID NO: 35481 - DNA, 561 bp, Glycine max
  Peptide Sequence Number=SeqID_152259
gtttggcactgcacaaactcttgtgtcaagttgcaaaagtattctagttttgatgaccagagtggggagaagcctctgcttttgcccattcgaagcttgaaatctcgcttatctgaagaagatattgatgttcaatctctgaacatgtcaatgagttctaaaagattttcaagctattcgaatagaaaagcagaagttgaagctgttgatgttgatgttgatgctgatgttcaatatctaaataggtcaacaaccttcaaaagtttttcaatcaattcaaatagaaatgcagaagttgaagctgatggtgttgatacagatgttcaatctctaaataggtcaacaatttctcaaggattttcaagcaattccaatagaagagctgaagttataatgttgtcttcaaacacttatgttataatgttgtcttcaaacgcagaggattcggtgaggaagaagggcttctacaagtcttgtcctccaccacctccgccaccaccaccaacaatgtttcagaaatcaatgttcatgaagccaaggtttgatggttcatccaactaa

SEQ ID NO: 35482 - DNA, 483 bp, Glycine max
  Peptide Sequence Number=SeqID_152260
atggataatttgttgatgcaattcaaggaaacaactaaatcaactcaacgagcattccaaagtgcagaaatccaggttggtgagctggcagaagaagtgactcaatttatggccagaagagaagaagactttgttgaggttgaagctcaagaggaaaaccctataaaagagcatgagtcaagagaaaaagatgaggagaaagatgaggaacaagcacaacaacaatgggagaagtactcaatagtagaaaaccaacaagaatgtattttccaaatcattaaccttcctcatcaactgattgtcaagaaagggaggcaaggagagcatgaggaaaccttaagtgccattctttctttaatcactaacacctctcctacaatgatttggaatgtactttcagaatacatgaagttcatggaatttctagctaaaaggagaaactgcaaggaagatgtcttctgtgtgactttcatgccaccttga

SEQ ID NO: 35483 - DNA, 1599 bp, Glycine max
  Peptide Sequence Number=SeqID_152261
agggattgtatgcccttgccttcagagggctacacatactcgcctccaaaaggatgtacatcctcaccttcagagggctacacatcctcgactctagagggccacacgtcctcaccttcagagggctacacgtccttgccttcagaggactgtacgtcctcaccttcagagggctacacgtcctctcctctagagggttagggttgtacatcctcgccttcagagggctacacgtgcccaccttcagagggctaaacgtccttgccttcaaagggctacacgtcctcgcctttagagggctgtacatcctcgccttcagagggctacacatcctcgccttcagagggctatacattcttgccttgagagggctacacgtccttgccttgagagggctacacatcctcacctctagagggatgcacgtccttgcctttagagggctacacgtcctcgcttcagagggctacacagggctgtacatcctcgcctccagagggctgtacgtcctcgccttgagagggctatacattctcgccttgagagggctacacgtcctcgccttgagagggctacacgtcctcacctccagagggttgcacatcctcgccttcaaagggctacacgtcctcgcttctgagggctacacgtcctcgcctccagagggcagtacatccttgcctccagaagggctgcacatcctcgccttcagagggctgcacatcctcgccttcagagggctactcgtcctcgccttcagagggctgtacgtcctcgccttcaaagggctacacgtcatcgccttcagagggctacatgtcctcgcctctatagggctacacgtccctgcctctagagggctacacgtcctcgcctccagagggctacacatcttagccttcacagggctatgcgtccttgccttcagagggctacacatcctcgcctccagagggctacacgtcctcgccttcagagggttggctacacgtcctcgcctcagagggctacacgtcctcgctttcagagggctgtatttcttcgccttcagagggctacacgtcctcgcctttagaggattgtacgtcctcgccttcagagggctacacatcctcgccttcagagaactcaagttcttgggccacccccctgatctgggaggagggctaactgtgcgagcacaaccagaggaggagaccgctacagggagacgagtgtggatcatgcgcaccaacacatggataatgttgctacttagcaacattctgcccagtgacaacaactctgatctcctcctgccaaagtggatcgtgcccccaagacacccagtggtcccagagaagtccaacagggccctggggtttccagctctgattacaggcctttgtcagttctacgaagtgtccgtctcccccaacaaggtcatcaggccccttattaacagggccttcattaagaagtattgtgcccccaggctggcgcaggcgggcgacagacgcaccgccgccacctccagagtccatctcagctcatctacaaaggctggagcattgcctacgacacatggccgaccaccaggcggccaaccaatgggggcag

SEQ ID NO: 35484 - DNA, 171 bp, Glycine max
  Peptide Sequence Number=SeqID_152262
atgactggagatgcatcaaagtttacacatatctctcccaagaaaaacgggcatgtaacttatggtgacaacaacaaaggtagaattcttggagttggtaaaataggtcttaagcacaacctacttagtgttagtcaattatgtgacaaagggctatctagtatcatttaa

SEQ ID NO: 35485 - DNA, 825 bp, Glycine max
  Peptide Sequence Number=SeqID_152263
atgtattggttccttgttttgtttctcaatctcacatatggtagtgttttagatgctagccatggtaaaacacttccttctactgttgtggttggcactgtttactgtgacacgtgttttcaacacactttctccacaagaagccatttcatttcaggtgccctagtagctgtagaatgcaaagttggggattcagtgccaagtttcaataaagaagtgaagacaaatgagcatggtgaattcaaagtggaggtaccattaaaagtgtggaaacatgcaaaaagaatcaagggatgcactttcaaattgataagtagcagtgagcctcattgttctgtggcctccgttgctacctcttcttcagtgagcctcaagacaagagagcaaggggaactcatattctcagctggattgttctcattcaagcctaccaaaaagccaaacttttgcaaccataaacaaagtgttccaaactccaaggcacatgtgaaaaatgaatttcctccaaatacaaacccttcaacattagataaaaaatcagctgaagatacctttttcccattccctccaattccatttctacctccaatcccttttctacctccactcccattcccatttcctccatttccatttccattcccacccctatccccacccccaaccccaaccccagtcctccctccaaccccactcccagcaccactaaacccaccacttccagcaccacttagcccaccaccattgccaccactaagcccgccaccatacacctctccatggccacaactaagctcaccactgcgcatccccaaccgagtctag

SEQ ID NO: 35486 - DNA, 129 bp, Glycine max
  Peptide Sequence Number=SeqID_152264
atggcaactgaggctaaaatggctcatttgcatgttgctattgaaagtctccaagccgtgatgcttattgatgattttatgcattctaaaggctactttatggaacctccaaacttcaacacaaattaa

SEQ ID NO: 35487 - DNA, 207 bp, Glycine max
  Peptide Sequence Number=SeqID_152265
atggcggccacttctcactttgagtgcgttgttccaatacttgtgagcactgtagttttggcggagtttccaaaactagtggaatttgtcgtagctgcctgtgagaaggggattactacaaccaactttggtggttcttgccttggcgccttaaacgtattcctacagaatgagcaacaagaagtattggcaaagtggccttgctaa

SEQ ID NO: 35488 - DNA, 261 bp, Glycine max
  Peptide Sequence Number=SeqID_152266
atgacaaatttgtccttctgtgccaagtatgcgactttattaacggtactaaattttgtattttcatctttcagggacacatttgtcagcgaattacacattgagggacaaaagtggctatttacccctttgtatttagtgggcttagtggtgctggaagtgatgttggagggagaaatgggggtgggagtaggaatggaagtggaggaattgggaatgggaatggagggagaaaagggattgggaaaaatgtatctttag

SEQ ID NO: 35489 - DNA, 222 bp, Glycine max
  Peptide Sequence Number=SeqID_152267
atggaatgcttcatgctggtgctggttggcttcctcgacaatgtcaatggcggcgtcgaatttggttatcagcaaaatggaattgaagaggcaaggagagggagaaaaacagagcgtggattctctacttctcgttcttggatgtgtcttctcgagagcctagggaagatgaaagagacattgaaagaaggaaaacgagcaaagcaaggagagaggaattga

SEQ ID NO: 35490 - DNA, 300 bp, Glycine max
  Peptide Sequence Number=SeqID_152268
atggaggatgtgggtgagttgaacacgttggtgaggtatttggagagattgggggagactcgtgaaaagttggtgcttttgtttctcaataagagaaagaacaatgagttctgggatttggttaagaagaccaaggagaatggtgtggcgaagaggaaggagattgaagggaagtggctcgtggtggtggtggcaggggacgcccctaagtttaccaggtcaatatctatttcttctctttatcttgctttcctaaatgaagcaactgacaaagttagagccaaaattggatctctttag

SEQ ID NO: 35491 - DNA, 321 bp, Glycine max
  Peptide Sequence Number=SeqID_152269
atggcttggggatatttggacgtgggtagaaatggggttggagctgggagaagtggatttggagggagaaatggatttggggggagaaatgggattgggggtaggaatgggattggaggaaactggattggtggaagaaaagggattggaggtagaaatgggattggagggaaagggaaaaaggtatcctcagttgatttttcatctaatgtagaagggtgcttgaatgagaataacccagctgagaatatgcgttctccttgttttattgccttgagattcactgaagaagaggtatcaactgaggcaacagaacaatga

SEQ ID NO: 35492 - DNA, 207 bp, Glycine max
  Peptide Sequence Number=SeqID_152270
atggaaatccttgaaagctgcgtaaaagtagtggagaaaacttcaacaaatatttggtcaagaagaggtaaagctactattggtcctcaggttcgaactagcaagagcatactgaagaatgcatccaatgttgaagttgcaatgagcagtgacaaggatatcagaaacagaacagataaagaaaacatcagtccgaatacaaattga

SEQ ID NO: 35493 - DNA, 942 bp, Glycine max
  Peptide Sequence Number=SeqID_152271
atgtccggagaatctatgaacaagcctgccgctaccgcgctctttcatccgcgtaaccgccatcagggccgttatgattttgctgccctgactgccgcgcatccgccgctggcggacaaagtgcgccccaacggttacggtgagctgtcggttgatttcgccgatccgcacgcggtgctgctgctgaaccaggcgctgctgaaactgttttataacctgaactggcagctgccggaaggctatctgacgccgccggtaccgggccgcgctgactatatccatgcgctggcggatctgctggccagcgataacggtggcgtgctgccgcgcgatctcgacgtgatggatattggctgcggcgccaactgcatctatccgctgatcggtcacgcggagtatggctggcgctttaccggcaccgacatcagcgcggacgccgttaacgccgccagtcagattgtggccagcaatcccggcctgcagcgcgccattcgcctgcgccgtcagaagcaggagagcgcgatttttactggcgtggtgcataagaacgaacgctatcacgcggtactgtgtaatccgccgttccacgcctcggcggccgatgcggcggccggcagccagcgtaaagtacgcaatctcggcctgagcaggcaggcgccgcttaatttcggcggtcagcataacgagctgtggtgcgacggcggtgagcgtgcgtttatcggccggatgatcgatgaaagcgtcgcgttaggcgatcgtatcgtctggtttacctcgctggtgtcgcgcaaagagcatctgcccgagctgcgcgatcggctgaaggcgcaggacgcttatcaggtacgcatcgtcgacatggcgcagggccagaagcagagccgctttatcgcctggacatttttaccgcccgccacgcgcgcgcagcggctggcacgctaa

SEQ ID NO: 35494 - DNA, 420 bp, Glycine max
  Peptide Sequence Number=SeqID_152272
gctgaatttgatatccctgaagaatctgatgtaaggacaaaaaagaaaatacttaagactgtggggaagcggtggagacaatttatgtctgatttgacgtcgaaatgggcacttgcaaaaagtacgacattagcaaggagaaatgagcccaattatgatgtgcgaaaaaaggcacaggctatccagaagcaaaacattgcccctcacgtgttgtctcatgggggttatgaatatttagaaaagaagttgatggatgagaagaaaaagaaaaaattggaggaagttgctcaatctgggagcactgacactgtcattgatcctccatctcccatcaaacgacacgtgaaatggaagctagcccgcaccaagaaaattgaccacatgacatttaaggtagcaaaggaaactgctgacaagatt

SEQ ID NO: 35495 - DNA, 237 bp, Glycine max
  Peptide Sequence Number=SeqID_152273
atggctccctatgaagctttgtatggtaaaaggtgtaggacacccttacattggctagagccccaggaagacctcaccttaggacttgaagtgatgaggactgctgagagtaggcagaaaaattatcaggacaagaggaggaaagacctggagtttaagccgatcattgcacagagcacaagaccaacaagagaaataatgaaggatgtgatccatggtatgaacgctgaaatctaa

SEQ ID NO: 35496 - DNA, 207 bp, Glycine max
  Peptide Sequence Number=SeqID_152274
atgttctctactggtttctttgctgatggcgaaaatgcatattcctttgggtcctcgggtttctactctctgttcttcgacaatgacaacattctccgtcttctttacgatggtcttgaagtttctgccatgactagccccatccatggctggcatcttggaaagctcattaggacgcagtgcatgctcgacggagtagtgaagtga

SEQ ID NO: 35497 - DNA, 156 bp, Glycine max
  Peptide Sequence Number=SeqID_152275
atgaagcctccaaggaaacatgccacttttaaggaaagttcagcaagctacgagatttgtaaacttactggtacaatgacctacgatgcacaacagatacacttcttcgagatggcagacaggtcacggcaggggcgacctcactatgcgtactga

SEQ ID NO: 35498 - DNA, 617 bp, Glycine max
  Peptide Sequence Number=SeqID_152276
ggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagacgaggaggccgggcgcacggggcgccgtggtcatcccctccctccacgacg

SEQ ID NO: 35499 - DNA, 219 bp, Glycine max
  Peptide Sequence Number=SeqID_152277
atggggtccaagtggaccctaagaaaatcaaggccatccaagaatggcccaccccttaaagtgtgggagatattaggagtttccattgcatctagtagtcctaattctcttctaatggtgagacaatctgtgtttcctgagcctcagagtgtcgttggcttcgactcgaagaacccttgcgcctttttgatggttccaccatttgagggatttaattga

SEQ ID NO: 35500 - DNA, 472 bp, Glycine max
  Peptide Sequence Number=SeqID_152278
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatggaatcgggttaaaattcctgaaccgggacgtggcggctgacggcaacgttagggagtccggagacgtcggcgggggccccggaaaga

SEQ ID NO: 35501 - DNA, 588 bp, Glycine max
  Peptide Sequence Number=SeqID_152279
atggttaaaactagagagttaggtcgtgccttagccagggttatgggtagagccttggggagagaggatcatcatgatttagatgatgttctccaacggcgaaggcctacgacatctgcacgtaggcaacgggaagctgcccctattgctgaggatgatcctatgcttactgaagacgtacatgcacatgctgaagaagttgttgatgatgttgagggatttccaagtgggctgtgtgacccatcagtgctgactgactatggtgaccatgttgtagtcatcgtatggaatgaagagttttcctcccatggaaggaaggttcagaaatttgggaggcctgttccaaaaattgaagggctagtcgctgcccttgaagcacggatgcggcacctcagcggcgtgtcccgcgtcggaagcgcactggacacgcattcgggtccgacttcggtgcgacgcggtgtccgttgcttccgccgtcaccggacacggttggacgccggacgcgcgcgattggacgcgacccaccaagtggacatgcatgattggacgcggcccaacaagcctcaaccattgtttttatttatttaa

SEQ ID NO: 35502 - DNA, 330 bp, Glycine max
  Peptide Sequence Number=SeqID_152280
atggccggcaacgggcaacagacgcaccgtcaccacctccagagcccctcagctcatctacaaaggttggagcgttgcttacgacccatggctgaccagcaggcgaccaagtccaaagccaaaggtagcaagataccttggatacgcatgagttttgatgataacaaagatgatcacaaaaagctcaaaagtcaagatcacttcatgataacaaagatgatgacattcaagaatgagttcaagattgagtcaagaacacttcaaggatcaagaggaaatttgatttcaagaatcaagaatcaagattcaatattcaagattcaagaataa

SEQ ID NO: 35503 - DNA, 399 bp, Glycine max
  Peptide Sequence Number=SeqID_152281
atgagtttgaaaaaatgcacaactgccccatgtgtggggtatcacggtacaaaagtgaaggatgatgacgagtgtagcaatgatgaaagcatcaagaaaggccccctagcaaaggttcaagcatctgttgctagtgcagatgacacaaaaaaccttacatggcatgcagatgggaaaaattatgacaaaatgctctaccatctgacttattcctctcattggaagaaaattaatagcatatatctagaatttggcaaagagcgaaaatacatgatgttgtctatgatgatatcaggcccaagacaaccaagaaatgacattgatgtttatctcaatcccttgattgaagacttgacaaagttgtgtgacgaggaggttgttgtgtttgatgggtattga

SEQ ID NO: 35504 - DNA, 888 bp, Glycine max
  Peptide Sequence Number=SeqID_152282
atgcacgctgagcgtaagcgtcgtccggcggcgctgcgcgacatcctcgcgctgccgtgcgatctgacccacgtggacagcgaagccgaatttggccgcaagctgggccgctactcgctggtcaacaacggcttcgccattcgcggcctgcgctgcgaagcggtgaacggtagcctcaaccagtttgagctgcgtctgattgatgccattgccggcctgaagccggagagcgagcgtctggccgcgctgtcacgcgcgctgaaaacccgctttaacgatgagatcgaaagcagcagcatcactgaaggcgtgttgcacattaccgcttacggtcaggcagcagactatctggcaaaaatctttaccgcgctgccctcgctgccgctggaagaggtccagccggcgcacgaaatcacccgtaccttcgcctcaggcgccatgagccacggcgcgctggtcgccccggcgcacgaagcggtggcgcacggtaccaatatggtgggcggaatgagtaactgtggtgaaggtggcgaacactattcacgccacggcaccatccgcgcatcgcgcatcaaacagctggcgtccggtcgtttcggcgtatgggcggcttatctggccgacccgatgctggaagagctggagataaaaattggccagggcgctaaaccgggcgaaggcggtcagctgcctgcaccgaaagtgacggtggagattgcggccgcacgtggcggtacgccgggcgttgagcttgtatcaccgccgccgcatcacgatacttattctatcgaggatttggcgcagctgatccacgactgtaaagcggcacgcgtgcgcgttatcgtcaaactggtgtcgtctgaacgcatcggtactatcgcagtcggc

SEQ ID NO: 35505 - DNA, 273 bp, Glycine max
  Peptide Sequence Number=SeqID_152283
atggtgtttggcaccggttgcggtgcaaggccgaggggtcgctcagggttgatgtttcattgtcaaactcgggaacaaaagccacaaggaaaggggcaaaatgctatgcagggggaatggttgagggacttgcaattgaaggaacaaaaggaaaaacgcagggagaaagaaaagaagaaaaaagaaaagttgaggctccaccgaatcgaaccgtggatcgtttcctacatcctttctcttgctagccttataccatgtgcaacagtcgattag

SEQ ID NO: 35506 - DNA, 390 bp, Glycine max
  Peptide Sequence Number=SeqID_152284
atggatacaacatcaaaactaatcataatttgtacaatacacattgtgaattgttggcatcaacaccgaataggcacaagaaaggatgtgacctcgaattggaagattagagctattagcaagaagatgcattctcgaataggcgcacaaagggagcgaggatcggactttgctaagggacaaaggcggagccgtcgtggagaaatagacagcgaattaccgccatggagaaagggaaatgccaccgtgcaagattcagtcgcggagaaagggaaatgtccgctaaggattcagaaagagagctcgagggtttttgatggagggtttgctaaggattcagaaagggggcttgagggttttggagagaggattatgaattttgtgtcatag

SEQ ID NO: 35507 - DNA, 543 bp, Glycine max
  Peptide Sequence Number=SeqID_152285
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaggtggcatcacagagaggaatgccaacacctcaggagaggatgtgggtgtcttgtgaagagagcccgagtcagaactcctggaaacactaacactggtgggacaagcagaagcagaatcagtgaccaggagcaggcaagtgcaccaggtgcagaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 35508 - DNA, 805 bp, Glycine max
  Peptide Sequence Number=SeqID_152286
atgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggtggagcaactttaggacgaattttcaacgtgcttggagagcccattgataatttaggtcctgtagatactcgcacaacatctcccattcatagatctgcgcctgcctttatacaattagatacaaaattagccatttttgaaacaggaataaaagtagtagatcttttagctcccactcgtcgtggcggaaaaataggacttttcggcggagctggagtggaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaag

SEQ ID NO: 35509 - DNA, 311 bp, Glycine max
  Peptide Sequence Number=SeqID_152287
ggatcgcgcctgcaagacacccagtggacccgaagaagtccaacagggtcttggagttgtcaagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatagacacaccgccatcaccactaaagttcacctcagctcatccataaaaaggttagagcgttgcctacgacacatggccgaccaatag

SEQ ID NO: 35510 - DNA, 177 bp, Glycine max
  Peptide Sequence Number=SeqID_152288
atgccacagaacttcacgaattgcccaatgatgggtgccaagtacctcaaagtagtcaaacgagggtcgcatcccaacaatggaagctccccggatgaaattagggcatgcctagtggctgttttggggatggcctttgtggatgactgggtggtagagatgatattggttgagtaa

SEQ ID NO: 35511 - DNA, 216 bp, Glycine max
  Peptide Sequence Number=SeqID_152289
atgtcattgcctaacgctgttcatgtgtctccattatcaagtgcgaagcttctggtgactgggaagcacgttattctgttgttttccagatcggttccttcgccaaaagaaaaaaagaaggaatggagacgagagtcgtcatcacagaaaagggcaggacggacgaaatcagtgtcctatctttgcttcctcttatctccgatgagaggtaagtaa

SEQ ID NO: 35512 - DNA, 351 bp, Glycine max
  Peptide Sequence Number=SeqID_152290
atgttaggatttacatgcgattctcctcaaatttcagccagcctgcatcagttagaccttgcaccttacgcttcagggccctaccatgctcaatggaacgccccggggcttctccatgacaagcacacgttgcgttcgagtcgtattctcagagaaatggaggttgatgaaccttggctggggttatggctaacattgaattatcaagtagatatgggagcaaggattgcctttgtggataactgggcggtgggtaaggacaaggaatggcagtcacagcatgggcttctccttcatcctcaccctcttcatttgccccagttttctcattcgtccaagcaggatgactaa

SEQ ID NO: 35513 - DNA, 387 bp, Glycine max
  Peptide Sequence Number=SeqID_152291
atgtatggatattggtgtgaggtagaaaattgctatgcaaagggggtgtttggactgatttggggatgtaccggaagtagtgctcttgctattggtattggtggggttctaggtagtgaagggagggttgttgctatagatttaagccttctagttgttgttgcagtttacaatgataagatgacacaagatatgagtcaaagtgacaactttatagaaatttcagctaatgatggtgtgggactaggaggtcttcacagtgttgcatttcagtccaccacaagctttagtggttcagggtctagtttttcaaattctaattcagctgagtactgtagattgaaagaggaggttacttgtttaagggacaaattgacaacttcttaa

SEQ ID NO: 35514 - DNA, 258 bp, Glycine max
  Peptide Sequence Number=SeqID_152292
atgcttagcaaccatgtcaactttagtgcaactcctttatgtgcaatttcgggaaggacttcccctggtaactcatcgcataattcatctcaatgtaagaagctaggtctaaccacaacacgaccattgactctaatgttgagatgcagtgcatcatcttcgagtgtgatggtgcactcaccctatggtaggctaaaagaagataaggttcaagtagctgatgtctcactaagcgaggcatatgtgcttaacaagtga

SEQ ID NO: 35515 - DNA, 1116 bp, Glycine max
  Peptide Sequence Number=SeqID_152293
actacatgtcctcaccttcagtgggctacaggccctcgccttcaaaggactacacgtcctcgccttaagaggactacacatcctccgcttctgaggactacacgtcttacccttcagagggccacacgccctcgccttcataggaatacatgtcctccttttcagagggttacacaccttcaccttcagaaggctacacaccctcgccttcagagagctacacgccctcaccttcagagcagtacgcgtcctcgccttcagaggactacacatcttaaccttcagaggactacacgtcctccccatcagaggactacacatcctcactttcagtggactacatgccctagccttcaaatgactacacgttgtcgccttgagaggactacacgtcctccacctcttagagggcaacacaccctcgccttcagacgactacacgtcctcctcttcagagggctacacaccctcaccttcataggtctacacgtgctcacctttagtggactacatgtcctcgccgtcaaagggctacacgttcttcccgtcagagggctacacgtcctcgccttccgagggcagcacgccctcgccttcagagggctatatgccctcgccttccgaggatggctacgcgtcctcgccttcagaggactacacgtcctcaccttcagagggctagacgccctcgccttcagagcactacacgtcctcgccttcagaggactacacgtcctccccttcagaggtctgcatgccctcaccttcagaagactacacgtcctcactttcagagggctacacgccctcaccttcagaggactacacgtcctcgctttcagagggctacaggccctccccttaagaagactacacgtactcacctttagagggctacacgtcctcaccttcagagggttacacgccctcgccttgagagaactacacgtactcgccattagaggactatacgcactcccctttagaggtccgcacaccctgacctttagaggactaaacgccctcgccatcagagggcaacatgccctcaccattagaggactacacgtccttgccttcagaggattacacgtcctcaacttcagaggactacac

SEQ ID NO: 35516 - DNA, 363 bp, Glycine max
  misc_feature (333)..(333): n is a, c, g, or t
  Peptide Sequence Number=SeqID_152294
atggaggacttggctgagatgctagagaagcaattggcttcagagttatccaagatgacgctggaagaagctttgccccttgctcgtgcctttagccatcatcttactttgatgggtatagctgaaacccaccataggaggttgaaattgttctcactgctcatcccactcaaattaaccatcgtaccttgcaatataaacaccttaaaattgctcatcttttggattataatgattgacctgatcttagccctgaagatcgagatatgtggattgaagatctggtgggagagaaaacttcaatatggcagacagatgaacttaggcgttcanaacccactccagttgatgaagctagggcag

SEQ ID NO: 35517 - DNA, 162 bp, Glycine max
  Peptide Sequence Number=SeqID_152295
atgagtaaacaaaacccacaacttcgtcttcaacctccagcagtgagaagtgggtttggtgatacaaaactgagagcaccccatcctatttatagagtttgtccatcacagagctctctcaacttgttatcagagcgtgagataggaagttatcagacgtga

SEQ ID NO: 35518 - DNA, 909 bp, Glycine max
  Peptide Sequence Number=SeqID_152296
atgccctcgccttcagaggactacacgccctcgccttcagaggacgacacgtcctcgcctttagaggactgcaagccctcgcctttagaggactatcgtccttgccttcagaggactacacgtcctcaccttaagagggcgacacgtccttgccttcagaggatagcacgtcctggccttcagaggactgcacgtcctcgtcttcagagggctacacatcctcaccttcagagggctacacgccctcgcctttatagggctacatgtcgtccattcagaggactacacgccctcgcctttggagggctacacgccctcgccttcagagcactacacgccctcgccttcatagggctacacgtcctcgcctacagaggacgggacgccctcgtcttcagagggctacacgtcctcgccttcatgggactacacgccctcgcctttagagggctacacgccctcgccttcagaggactacacaccctcgccttgagagggcttcatgtcttcgccatcataggagggtacgtccttgccttcaaaggactacacatcctcatcttcagagggctacacgttgtcaccttcagagggctacatgccctcgccttcagaggactacatgacctcgccttcagaggacgactcgtccttgcctttagaggactgcacgccctcgcctttagaggactacacgtccttgccttcagaggactacacgtcctcatcttcagagggctacacgtcctcaccttcagatggctacaccccctcgcctttacagggttacatgtcgtcgccttcagaggactacatgccctcgcctttagagggctgcacaccctcgccttcagagcacttcacgccctcgccttcatagggctagacgtcctcaccgtcaaacgatag

SEQ ID NO: 35519 - DNA, 522 bp, Glycine max
  Peptide Sequence Number=SeqID_152297
atgtccaaatttaattttggaaactatatttttgatcaaactgttaagcattcagaatcatttgctgtcaaattacccattgccttcccaactgtattgtgtggcattttgttgagtcaacaccccaatattttaaactacactgactctgtgatgaagagagaatctcctctatccctgcattacaaattgtttgaggggacacatgtcccagacattgtctcgacatcagggaaagatgcttcaggtgctgtgtccaaggatgccttgattgctgaactcaaggacacatgcaaggtgctggaagcaaccatcaaagccaccacagagaagaagatggagctagaacggctgatcaaaaggctctcagaaagtggcattgatgatggtgaagcagccgaggaagaagaagcagctgagcaagaagaagaagaagctgaggaagaagaagaagaagccgatgacgaagatgcagcagaggatacagaatccgatgatgatgattctgaagccaccccatga

SEQ ID NO: 35520 - DNA, 204 bp, Glycine max
  Peptide Sequence Number=SeqID_152298
atgaagacagtacaagcggaggcttcaatctcttctccgtctctcttacgttcgagaattctatcggagcagtcggagaaaaaacttgaggaatctaagggaaccgctgtagatgccgctatcgttgtcggaagacacgtgagtccgctcagagttgatgtcccaatgagaaattgctatgaaattgatgtgtttttgtgttga

SEQ ID NO: 35521 - DNA, 510 bp, Glycine max
  Peptide Sequence Number=SeqID_152299
atggcggtgccgagccagcaggagaaggtggcgcgccaaaattggctgcgcccctctttggttgccaggcgttcatcggccgccagcgcggcgtcggcggtctgtggagtggcaagcgttgtttcgctcatgacggtgctatcctcttttgttctgcgcctggaggggcgcggcgatcacagaatcgtcatcgtgccggggaacgaagatagagaatacggatggcaaaaagatgacagaaccccggtttttccggccgataggcctgccgttttcgccacgaatcagcctgccgctttcgcatttctgcgctacaatgggggcctgttaacagtttgtatcgtctggcgcgccgtaccggctgcggttcaggcgaggagtaaagcaatgtctggcatcagggattccatcctgccgccgctggagtggatgtccgaacaggatcctccggcgcccgccgccgtcagcgactggctgatggagttaggctccatgaccccgccgatttga

SEQ ID NO: 35522 - DNA, 480 bp, Glycine max
  Peptide Sequence Number=SeqID_152300
atggtgttcggcgatgtgttcttccccgaggccacgccgctggtcgctctgctggccagcttcgctacctactcagtcggtttcgtcgcgcggccgatcggcgcgctggtgttcggctggatcggcgatcgcaaaggccgccgcgtggtgctgatcaccaccgtggcgctgatgggcatttctaccacgctgatcggcctgatcccgtcctatgcgcaaatcggcgtctgggcgcccacctgcctggtgatcctgcgcttcgcgcagggattcggcgccggcgcggagctgtccggcggcgcggtgatgctggcggaatacgcgccggccaagcggcgcgggctggtggcctcgatcatcgccatcggctccaacagcggcaccctgctggcgtcgctggtatggctgctggtgctgcaactcgaccaggaagatctgatgagctggggctggcgcattccgttcctcgccagcttctga

SEQ ID NO: 35523 - DNA, 198 bp, Glycine max
  Peptide Sequence Number=SeqID_152301
atggagggaaggctgaggtccattgaaggaggcggatatcattcttttgttgacatggcagagttgtgccttgtgcctgacgtcatcatcccttcgaagttcaaggaggttagtttagttattagaggggtgtgggtagttaagactctagcttctcaaagaagcctctcaaggaagcttctcaaagaagcctcatga

SEQ ID NO: 35524 - DNA, 237 bp, Glycine max
  Peptide Sequence Number=SeqID_152302
atgggtaggccacccctttatgaatcattttttaagggaacctttcggatgcctggttgtttctcatcctttcatcgtgttctcggcaaaggcttagtttctgatgtggtgttgtcgatgaattggcgtggagcggttgtggtgctcgtttatgccaccgcattgtggtacttcttcgagcgtgtcggttacaatttcttgtccttcgtcaccaaagtttttgccaacaagctttga

SEQ ID NO: 35525 - DNA, 339 bp, Glycine max
  Peptide Sequence Number=SeqID_152303
gtctatggacattggacttatagttgtttacctttcagagatatgatacaaaagactattgatgaagaaatgttgaagtttgaagaaaagcctatgcaagtggatactaatcctttccaagttcaagccaattatgttgaacctgtcaagattctgatggtaagggctttgattggtacttcaaagcttgaaactcttttttctgaagatgaagttaatcaagctttggaaaaattcaagaaagaagaagaatatgtattcccatatactggggatatgttgctggagtttctaacaaagaagcataaagctgggaaagaagtgatgatttgcccttga

SEQ ID NO: 35526 - DNA, 270 bp, Glycine max
  Peptide Sequence Number=SeqID_152304
atggaatcacaagatcccttagaagaaatcaatctggggactgaagaagatcgaaggcctcttatattagagtttaaggactgctttgcatgggattatgatgaaatggatggactcaacagagatatggtggagcatagattacccattcaagaagggaggaaacttgttaaacaagcaccaagaagattggctcctaatgtcgtggaagctatcaaggaagaaattgaaaggttgttgaatgctaaattcattcaaacaatgaggtaa

SEQ ID NO: 35527 - DNA, 642 bp, Glycine max
  Peptide Sequence Number=SeqID_152305
atgacgcccaatgagttagagaataaaattcagaaagaattgttcagctgcgtagatggtttcaatagcttttattttagtgcaggtgccggcgcgggtaaaacacatgcgttgattgagcaagtagcatgcatcacttataccaatattgccgtgtcagaaataactaaaaggcttggtaattcagatgcggtgatggtttctaccattcatgatagattgtgggacataatcaaacgataccagccagagctgattatctgccataaagaaaaaatcactaaagtcattcaagcatgccaacatgaccttgctaatgaaaagagagctcaattttataaagaactaaacggctcagaaaaagaggagttcaaaaaatatgtcattgagacaaaggggattttttatcgaaagaattttttgagtagcagggattttaaagaattatataataattacgaagaaataaagaagcctgatttttttgatagatgtattaaaaatctagagaattttagttttgttgttaaaagaatacacaaaatagattctcttgaggtagcaattacacgaattaatgacggaaaaatcaaacgcgttaattatgatagtaatattaacactgacatgctcatcgaatga

SEQ ID NO: 35528 - DNA, 252 bp, Glycine max
  Peptide Sequence Number=SeqID_152306
atgaggacgcgtagccctctaaaggcaagggcgtgcaaccctctgcaggtgaggacatatagtcctctaaaggtgataggtactagtacccaagggtccacctttatgagaaagcaagagatcgactcatcgagagggcagattgactgtccttttgaaaaaggtgataattcatgcaaccttatcctatcttttgcaaatctctccgggaactccctcagagtgtatgttctgtttgatttagtcacttga

SEQ ID NO: 35529 - DNA, 891 bp, Glycine max
  Peptide Sequence Number=SeqID_152307
atgggttcattggctgtgagaacattggggagttcactattttcaaagtttgaggcaaatgagtgggaatatgattatcaatttcttagtgaggaggtagctatacattggggggcacttggtctccttgcatcacctagaaagaatgagacaccggaaaatgttgtgaaacagtatctggatgaattactgtcaagatctttccttcaagattttgtcaattttggcactatttatcgatttaaaatgcacgatttggtgcatgatcttgctctgtttgttgcaaaagatgagtgcctagttataaattcccacattcaaaatattcctgtgaatattcggcatctgtcttttgctgaatacaattttattggaaattcattcacctcaaaatcggtagctgtgagaaccataatgtttcgaaatggtgcacaaggagccaacgttgaagctttgctaaatacttgtgtgtcaaagttcaaattattgcgagttttggatttaagggattcgacatgcaagactttgccacgttccattggtaagttgaaacacttgagatatttcagcattgagaataatcgcaacatcaagagactcaccaattctatttgcaagctccaaaatttgcaattgttgaatgtttcgggatgcaaggagctggaagcattgcccaaaggattaagaaaattgattagtcttcggcatttggagataactacaaagcaacctgttttgccttacagtgagattaccaacttgatcaagcttgcacatctgtatattgcatcaagccataatatggagcctatctttggaggggtgaagttacctactcttaaaacattgaatgttgctgactgtcatagtctgaagtctttgccactggat

SEQ ID NO: 35530 - DNA, 267 bp, Glycine max
  Peptide Sequence Number=SeqID_152308
atggttcaagaactgatgacgagtaccctctcgtttgatcgaacagttcggactgctgaatctccaacctatggtgcttggcatgctgttgtggtgggacgggatgacttacctaaggcggtggaagcattgagcaatgtcaatgcttatcatgttgtagcaggagattacacaacctttgtagtgtttgatgatggtgatgtgtattcatttggttgtggacaatctgctagtcttgggcataatgctgttggaaatgatgagtag

SEQ ID NO: 35531 - DNA, 720 bp, Glycine max
  Peptide Sequence Number=SeqID_152309
atgaaaaattcaagaggacgcagcatgaaacatgcacatttatttcattgtgaagatcaaagaagtcaagaacacaagaaaattgtaagggacagactggagggtaattctaataatacttttaggacaagggagattccaataaagaggttgttcaatgtagggcattttactaatgcttcaggggacttgtcagggtatagcaaaggaaagaacttttctgcaggaatgaatgtcatggactatgatataccagagcttgttgtttttattcaagaggaccatcagcagtttgtcaaggacaattgcattggtaagggagtgtcaccagaaggcaagtgtatgtcagaagattgcgcattagatcatgatataatgtcacgtcactttgagaatgacatgacaagcagaagagattcaaatctaagaactatggaagcaatgtcaatcaattcaaatgggccagagtatgcctctaaacctcttacccttaaggatgcaatggaattttatgattcaagaggtttagtgatggatggtgaagtggattcaggatacaagatttcaattgaccacctcacaaagaagacaacaccagagacccttagagagaaacgtgtgtggtttactggctactcaagcctatactctatattttgtcatggtcagtttgaaattttggagaataatagagaaggactcatgaaaaagcatttttag

SEQ ID NO: 35532 - DNA, 111 bp, Glycine max
  Peptide Sequence Number=SeqID_152310
atggcgctaagcttgacatcgaggggctttagcattgaaagatgtattgtctccttagaacttgatagagcaggattaggttaccgtatgtctggacacggagtgcgataa

SEQ ID NO: 35533 - DNA, 300 bp, Glycine max
  Peptide Sequence Number=SeqID_152311
atggttcgttattccaaccgttgttttttctccgccgtggaagaatggcctaggttcaacttcgtggatttcaacgtgaatacgaattcaacagaaggaatctatgggtattggttgctatccaaaacgttgagtgatgcagtgggtgaggctgtgaaagctggcaccaagaagtttgcaacgaaaaacgctaccgtttttgggtctcaaagagtgcatactcttgttcagtgcacgccagatctatcaagcgaagattgcagagaggtggaatggttctatttccaagctgcactttga

SEQ ID NO: 35534 - DNA, 785 bp, Glycine max
  Peptide Sequence Number=SeqID_152312
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacaggagagcaaattagctgtttctctgtttctcaacctcctatctctgctctcatcagggaagaagatcaaggtgttattcaaacaggcacctgatgtggtcagaagtagagctgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 35535 - DNA, 741 bp, Glycine max
  Peptide Sequence Number=SeqID_152313
atgatcggcaaggtgggcatttcgctgcaggcctatcagacgcgtaccggctttagccagacggcgatggccgacggcgcttcggtgctgcgccatcgtccgcacggcgtgctggcggtgttcgggccttataacttccccggccatctgccgaacggccatatcgtgccggcgctgttggccggcaactgcgtggtattcaaaccgagcgagctgacgccgctgaccgccgaggagaccctgaagctgtggctgcaggccggcctgccggacggggtgatcaacctggtgcaaggcggccgcgagaccggcgaagcgctggcggccagtgcggatatcgacggcctgctgttcaccggcagcgccggcaccggctatcacctgcatcgccaattggcggggcagccggagaagatcctggcgttggagatgggcggcaacaacgcgctgatcgtcgacgggggcggaaggcgacgcctttatcgaacgtttggtccaggtggcgggcgaactgcgcgtcggccgctgggatgccgaaccgcagccgttcatgggcggggtggtgtcggcagccgcggcggaaaacatgctgaacgcgcagcagcgcttgctggcgctgggcggcaaatcgctgctgagcatgcgcctgctggaaccgggcagttcgctgctcagcccgggcatcgtcgatctgaccggcgtggcccggcgtaccggacgaagagtatttcggccccttga

SEQ ID NO: 35536 - DNA, 491 bp, Glycine max
  Peptide Sequence Number=SeqID_152314
tcaccggtaatgcctccgccgaagatcaaggcgccaaactcaaggagcatctcaataagagcggcttgccggacaccgacaaagtcaatgtgcaggtgatcgatggtaaagccgtagtgaccggcgacgccgtcagccaggagttaaaagagaagatcctggtggctgtcggcaacgtggcgggcatcagcggcgtggaggataaggtggcggtgacgcaacccgacgccgagagccgcttctataccgtgaagaagggcgatacgctgagcgccatctctaaagagatgtacggcaacgccaatcagtacaacaagattttcgaagccaacaagccgatgctgtcgagcccggacaagatttatcctgggcagcgtcatcccccggttgagccggaacgaccaaggcgacaacgttggcgccttattctgaggggatgttttgccccatcaaacagcaatgcagcagttgaacgagtgaaaccgatttag

SEQ ID NO: 35537 - DNA, 780 bp, Glycine max
  Peptide Sequence Number=SeqID_152315
atgagtcagtcacgtcctacgctctcttcacctgcacgcgaatgccctgtcgttgacggcgtgcgccagatacaacgtattgccgtgcgtaacgcagaagtggggggcatcccgatcaaccgtgcgttaccaacccgggagcggcgcaccgtcggcgcctggtgttttctcgatcacgccgggccgacggtcttcaacggcacctcgcccggcatggatgtggggccgcatccgcacatcgggctgcaaacgttcacctggatgatagagggggaggtgctgcaccgagacagcctcggcagtgagcaggtgattcgcccgggccaggttaatctgatgaccgcagggcgcggcattgcgcataccgaacagtcggtgggtgagcaacggcgattgcatgccgcacaattatggatcgcgttgccggccgaacatgccgacatggcgccacgcttcgatcattatcctgacttgccgcaatggcagaataacggcgtgaatcaccgtttgctggttggggaatttggcgcttaccgttcaccggtgtttacgctttcgccattaatcgccattgatctggaatggcaggaagcggcgaggatcgaattgccgctgcgcgatgattatgaaatcggctttttgccccttattggtgcgtttgaacttaatggtgaaactttttcacctgatgagttcgcctatttgggcatgaagaataactctattgggttaaatgcgcaaaagggcagccggggattattaatcggtggggcgccataa

SEQ ID NO: 35538 - DNA, 477 bp, Glycine max
  Peptide Sequence Number=SeqID_152316
atggcagaaaacctgttgttgaaagattgcacttccatcttccaggccaacatagtgttgtctacgaagaccatgatgatattgatgatgtattgtctaagcaaaaagaaaagatgttggcaccttaggaagaaaggctacaccattggcagattactatgggtcccaccaattataggaaaattattttacttgaggatgatgcttactgtttgtaaaggacctacctcatttgaggatttaagaacagttgataatgttcagtatcctacatatagagaagcatgttttgctatggggtttttgcaagatgataaagaattcattgaggcaatcaaagaagcaaaagattggggctcagcacattatataagaaagctatttgtgttgttacttttaactgcaacaatgaacaaacctgaacaagtttgggaccaaacttggcattggatggctgatgacattgtctataattag

SEQ ID NO: 35539 - DNA, 786 bp, Glycine max
  Peptide Sequence Number=SeqID_152317
atgttcagcgagaacaggtcgctggcgttgttgacgtacaggttgccgcccgattgcgtagtcagctggcgcgtgtcggtctgcaccgcgttgccggcgccaccgatggactgcgcggcggtcagtgtcagcgccggggtgacgaagcggccggcgccctgcgtgatcgaaccgttggtcacgttgacctgggccgagctggtggcgctgttgtccagcagcgtcaggctcttgttgttcgacacccacaggctgccgcggatgttcgaggacagtgcccgtcaccgagctggcgttgagcgtcagcgcgccagtggtgatattcggcgcgctggcgccgttgccgtagatggtgccgttgctggccagagtgaccgagccgccggcggcggtggtgaccttgttgacggtcagcgcgcggtccgacgagatcgacagtgccaggttgtcggtattgatgatgttgctgagtgtcaggcccgagacgtcggtcgaatcattcagcgagaactccgtcatgccggtggcgctgatggccgaatcgagctgcttgtcgttagccacgttcacattgccagcggaggcgatcgacaggttggacgtgctggtcttggcaaaaacgctgccgttggtgcccagggcgctcaggctgacgctgttgccggtgatcaggcccgagccgccgatgctgggggccaggtcgctgttgacgtagcgcgtggtcagcgacaccgagccgctgccggcgttgatggtgttcgaggtggatcgcggtgtcggtgttga

SEQ ID NO: 35540 - DNA, 918 bp, Glycine max
  Peptide Sequence Number=SeqID_152318
atggaaccaaaatattgggacaaaaatcccttcaaagcaaccgccaaagtctttccccaaggattccattataggccaatagccctcaataaaactagaaagttctatgaatttattctagtagatacaaattcagtatccatcaagcatttcaaagactcaaaagatccaagcttaaatacccattccacaatccaaattctgaaagtaatgcagccacgacattacgggactaatcttaaccagcccaaaaagttttctgcaccttttgacccagcaggatacatttattgggactatattgatgcctggaccaatgtgttttggcatcagaacaataaattcaagcattcgtggttgatttatttaaaaaataacactgtatacaattttccaaactggtttctccaatggtggacttattttggtccaatcccacaaatctttccagaagaagtccaacaaggatttcaacagttcaatagattgttcaacaaccaggaatcaagaattccagccgatctaatgtatgggaaaactgaaaacaacaagcaatatccacctttgcagagacatgcttttgtaaaatggtggacacaatttgatacctcaaaggccgctccagacaaagtcaagaactggttccaaagtcaccccgaatttctcaaacctgctaatccagaaacatcattatttctgaatcagaaatctcagcttgcggcgttcttggccagttcaaaatccaaagaaagccttgcccagaaccttaaggaagttctccagctacttcaacaagaagaagaggaggaatcttcaaagaaggatgccggatcttcagaagacattgatgacctagatgatgatcctgtctaccaaaatgaggatgattgttttggcatctcattagaagatgattaa

SEQ ID NO: 35541 - DNA, 477 bp, Glycine max
  Peptide Sequence Number=SeqID_152319
atggctactagtgatggtggtggttgtttgctccccggtgatagctatccagattggttaaccttcaacaccgaaggttcatccgtgacttttgaaatccctcaagtgaaagggcgtaacttgaagaaaatgatgtgccatgtccattattcttccccggaaaatataacttcagatggtttgaaaaatttgttggtgataaatcacacaaaggccatcattcaactttataagagaaatgcattagtctcctttgaagatgaggagtggcagggggtactatcaaaaatagagcctggaaacaaagtgcaaattgttgttgtcttctggagcaaattaactgtttgcaagacaacaatttatctcatatatgaaccaatgaatgaaaaaatagagcattcacatgcgccaaataagaatgtcatggattctagtggtgatgaccatgaatgtgttgttgggaccatctctcttcaa

SEQ ID NO: 35542 - DNA, 483 bp, Glycine max
  Peptide Sequence Number=SeqID_152320
atgttgcaggtgaatgcagaccttgacatggaactaaatccccaagcacaaccatggccatatcaagcgaagagccttaatagaatgtttggaaatggactaatgtcatcaaggcctgaaattggaaacaagagtaacacacagaacaatgcagaaaatgaagggtttgctgaaagccagggcaatgaatttatccctgcaggtttccccgttggtccgtgggatgattctgcaatcatgtctgacaatatgacaggtctgaagagatttagagatgaagatgtgaaaccattttctggtttaaatgcacctgaaagtcaggtagagtaccactggaccaagggattttcctatggctttatggagtttgaagtggcaagtgttgcgcaaagtgcacttgaggctctaataccatcactagaaaaaccagatttaacatcggtttttgacaaaaccgatgttaacgtaaacgcggtggcataa

SEQ ID NO: 35543 - DNA, 210 bp, Glycine max
  Peptide Sequence Number=SeqID_152321
atggcgaagagcaaccgttccgatactctcggaagaagtttatttgaccaaaagaaatacatgttcttcatgatttacagatcatggttagaacacgagaggcgtaggcctactgcatcatcccgtaggcgacgagtacatattacggttgatgagggtgttcctcaggtgactgaggatgttcctcatatggaggaggatgttcctcag

SEQ ID NO: 35544 - DNA, 744 bp, Glycine max
  Peptide Sequence Number=SeqID_152322
atggttggtactaattggaagtctccgaatgtgaagcacctcaaaggattcagcaattctgctcaaagatgcgaaaagagtagcgcacggatcatctgttgtttgcccgccctctgtgtttggttggtttcgcacttgttccaacaagacacaagacatccatgtccgctcctgagccatcgctcgtgtactgaaaagaggagaatagattgggaccagcttttggccggaataggaggtagaacaatcagttggttcccccgatggaaggaaggaaaagaaggagtccttttctcatgtggaggatacccaaacattccgctggtaggaacgaggggttgtattaactacaatcccgcgctagctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcacgaacttagaggcattcgtaatggcatcattggtggctaccatgaatggctgaaattaaaagtcgtcagcgaagagagttttgaagcaccggaagaggacgaagaagtccaagctctcaaaagcgagttaggaaaggcgaaattagccgaggagaagttcaagttggccgcaacacacattcggaaggagtgtgccgggttacgggaagagaatgcattaccgcaagagccttga

SEQ ID NO: 35545 - DNA, 336 bp, Glycine max
  Peptide Sequence Number=SeqID_152323
atgggtgaagagtcttggtcgttggtgcgcaaccatttgcttaaagaacttgccaaattcttagatgactatatcaagctcttcggtgacatagacagattgaacgaattaaggaggtccctacttattaatgggttaaccaaggttactatggataagtggatggatataactgagatgagatatgtcattgcatcaagctatataaaatatatgatgcaatcctacctcgcaagggcattagatagaagactccaaaaagattgggccatagatgcaagagaagaccctagggttctcatgaaccttagggtagatttcgggcacatgggctaa

SEQ ID NO: 35546 - DNA, 106 bp, Glycine max
  Peptide Sequence Number=SeqID_152324
atgccaacgtcatcacgtcagctcggcggctcctcaccagaatcttacaccctgcaccctgctatcgtcattttgctcccacgaacaatgttcgcgatcatcacag

SEQ ID NO: 35547 - DNA, 375 bp, Glycine max
  Peptide Sequence Number=SeqID_152325
atggatgagatacaactacctaaaggaaaaatcatagctctcaagtgcaacaaagttggccacatcaaaactgactgccctttccttaagaaagatatcaagagaagtgatctaaagaaaaaggcaatgatgaatacatgggatgatatagactcaacatcctcagagaaagatgaggagcatgcaaccaacctatgcctcatggcagacttagccaaatatgagaaatatgctcatttgaaagagcagctttctgatgctcagaaagaaaatgcgaagctcaaaatggataatgagaaaaaccattgtttgcaggaatctcatctcaagctttttgaacagttaacactaagaagagagacaactacaaaatga

SEQ ID NO: 35548 - DNA, 573 bp, Glycine max
  Peptide Sequence Number=SeqID_152326
atggcataccatgctagctctaaagccaatcaaaactcaatgcaaaatcaggaaattcatgttggtaagagctactccatggaaaattatcagtgggagcaaaagttacaaccctacaatcaatatgtagaagaaagaagttctaatatggataatttgttgatgcaattcaaggaaacaactgaatctactcaacgagcatttaaaagtctaaaaattcaagttagtaagctagctaaagaagtggctaaatttgtggccacaagggaagaaaactttgtagaggttgaagctcatgaggaaagccttgtagaagagcatgattcaagagaaaaagatgaagaaaaaaaaagtattctccaagtcaatacccctcctcatcaactgattgtcaaggaagaaaggcatggagaacatgataaatcattaagtgtcattatctccttgaccaccaacacttcccttgcaacaatatggaaggtgtttccaggatacatgaatttcatggagtctctagctaagaggcaaaaatgcaaggaagatgtgttctatgtgaccttcatgccaccttga

SEQ ID NO: 35549 - DNA, 402 bp, Glycine max
  Peptide Sequence Number=SeqID_152327
atggttccccgcatgtcatcgggcccgccgcctccggatgacaaaagtgtgggaccaaatggttcccgcatgtcatcgggcccgccgcctctggatgacaaaagtgcagatgaccataattgtctctgcgtgccatcggacacgactgtgtctgaatggcaaaaagtgagccgaatgaccataatttgtctctgcgtgtcatcgggcccgccacctctggatgacaaaagggcgcagaatgaccataatttgcctctgcgcgccatcggacacgactgtgtctggatggcaaaaggtgagcggaatgaccataatttgtctccgcatgtcacaggacctcagggtcagtatgacaaagattgtggggcggccgacaaaagcgaggctcttgctcttacgtaa

SEQ ID NO: 35550 - DNA, 1077 bp, Glycine max
  Peptide Sequence Number=SeqID_152328
atgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacagaagaaacatctt

SEQ ID NO: 35551 - DNA, 552 bp, Glycine max
  Peptide Sequence Number=SeqID_152329
atggcctccaagaaacatcaagcctccaccaacagacctcaggttgcagagtcaacctggtattccactagattcacctctgagaggaacatccagctggcctacaccgactatgacgagctcttggaggagctcgagaggagacattgggacaggaagctcaccaagcttccagagaagaacataaatgtggctctagtgaaggaattttatgccaacgtctatggttttgaggacggctcaccaaaacagtgcaacatccgattcaatgctcagacgttgaacacctttctagagacaccggaggctcctcctacaccacaacctgtcgtcattcctctagcccctactacagagcatcaatcagtgctagcttcttctactgttgagcccccaacatattggcctcttgctccagcaatcgatcatcctattgctactaccgagcccactgatgtcaccaccaagacaaagcatgttgctgttgttgagccagatactacagagcagggacttgacgtggattacattgttgatgtctcaacggattag

SEQ ID NO: 35552 - DNA, 252 bp, Glycine max
  Peptide Sequence Number=SeqID_152330
atggggtgtagcaagcaaatgctcacctcccctttaggatggattgcatcacaagcttctagcaccaaagaggaaatgagcatgatggtgaggtatatgaatggttctctaaaaggtggttcgaggtacaagacaactcaaagtgaagatgctattgaggggtatgtcactgcaaactacgtggagaatatggatactaggaaatcattgttccaatatgtgctcattttgtttgggatcgctacttgttga

SEQ ID NO: 35553 - DNA, 1443 bp, Glycine max
  Peptide Sequence Number=SeqID_152331
atgtttgttcatcggctgcttaaacatgccaagttatctgtcctccctctaatcactttctctgccataatttttcatatctatgcagatggtattgtctaccatgattccctacactctgctgctaataccgaagctccagagaagttagaagttcacaatcacagaacaaaaggaatagggtcaacccttgttcacatacctttacattccattcaagagaaggatgaagccaacagtcgaaaccagaaggctctagttgccccattcaatgccacagaagaagaaagaatagcatggcttcaaggacagctgcataacttcaagatcttcaagtcgaacaacttgacccgacaatttaatgctcgagttttgggatttttaggccgcaaatgcgaggttcagtttttcatgacttggatttcacctgcaagtttatttggagggagagaattgctgtctgtggaaagcattttcaagaaccatcccaaggcatgtctgataattctatcaagaactttggacagcagacatggctacaggatcctgaaaccactgcttgatcgtgggttcaaagtgcaggcaacagccccggacttgtcatttttggtcaaggggactccagttgaagcttggtttcgtgagctaaggaagggtagaaaggaccccggtgagattcctttgtctcagaatctatcaaatctgataagacttgcagttctctacaaatatggtggtatctacatagatacagattttatagttctgaaaccattaacagggttaagaaattctattggtgcgcagagcatgaatttggattctaagcactggaccagattaaataatgcagttctgatttttgatattggacatcaacttctgcatagattcatcaatgaatttgcattaacttttgatggaaacaaatggggacataatggtccctacctggtttccagagtgattaagaggctggggaaaagacatgatttcaactttacagtcttgccacctatggccttttatccggtggactggaacaagataaatgggctttttatgaagccgaaaactcaggaagaatcaaaatgggtagaagccaaactgcttcagctcagaagaaagacttatgggattcatctatggaacaaacatagtagcagattgacaattgaagaaggaagtatcatgggaagacttgcatcagattattgtgtcatttgtaacaaatggaggctgagagagaaggaaaggaagtggagagcggtgaggaaagagtttgggagtgagagaaggaaaggtgacaggtggaattgtgcaattgaacggagagtggagaaggtgatgctagcagtagagacgccatggccgaggataactgaaagagataaggttttagaagggggtaaaaaatggaggtggcttgccatcttctactag

SEQ ID NO: 35554 - DNA, 258 bp, Glycine max
  Peptide Sequence Number=SeqID_152332
atgtataatagtataataatctatattggtctccactgcagtgcacattggcaaatggtcgtcattttgcctaaggaaaatgttgtcatttggttttgttcgttgcataataagccagacaactacctcaaaggcataattaatagggctttgaaaggactgacgatactcaacaaagtaaatccaagcctcttgctaggtggattgttgttaaaacaaaaaggaaacactgagtatgggtattacgtcatgcagtga

SEQ ID NO: 35555 - DNA, 129 bp, Glycine max
  Peptide Sequence Number=SeqID_152333
atggtatggcatcatcagggctcaaaatgggtgagctcatcctccccctctgctgctattgctattggctcctctggttcaggctcttgggctgtggaggccccaccccctccagaaggagaaggctag

SEQ ID NO: 35556 - DNA, 648 bp, Glycine max
  Peptide Sequence Number=SeqID_152334
atggcgctgcgcaagcgccaggtggcgtcggcccaggccctgtacagcgccctgggcgtggcccgcgaggaccgcgccgggcgcgacgcgcagttcggccgcaactaccgcttcttcgatgcgcccgtggccctggtggtgagcatcgacgcacgcttcggcgcaggcggctacatggacctgggcatgaccctgtacggcctgcaaatggccgcagctgcccagggcctgggcagctgcgccatcggcgccctggcctcctaccccgacaccgtgcgccgcgtgctcgacctgccgcccggcgagcacatcgtctgcggcctggccctgggctggcccgacgaggccgcccccgtcaaccgcacccagaccacccgcgcaccgctgaccgaatacttcaaactttgcgagctcgcgcccactagtacgggtcatggcgatggcaccaccaaggcccaacccggggacaccgaggaagggcctacgccggccgcgccgccccgcaccgagggtgtcgtccccctcccccgagaagcgggtagagagggggaaggcgcgtcagctcttccgggggtgagttcttcagaacgcaggaatcaccgaccccttgaactccacatcgatgaactggcgcacttcatcggaggg

SEQ ID NO: 35557 - DNA, 384 bp, Glycine max
  Peptide Sequence Number=SeqID_152335
atgattatgaggagccaagacatttatagtagccaagataaggctactacttcaccttcctctagtgaaagtgaagaagcaaaagaggaagaatctagtgaagaaatctacccccaagaagcaggaaaacctttaatggttaagaaggagtgtaaggagacacttgttagcattgtcacacctcttaggcttgagtttattcctcaagtaaaggagttgttggatgagggtttggttcgaaagagcttaaatccttgtgctttgttggtgcccaaaataggggttcccatgaacccaaagagaataaaggtcattcctgagtggcccgctccaccaagtgtgttgagggaaaaagcccagagtttcaagaacctcgggatttga

SEQ ID NO: 35558 - DNA, 141 bp, Glycine max
  Peptide Sequence Number=SeqID_152336
atggataccttagagccctacactggggcaatgaggggcatcgtgcataaacctcaagttcccagctacaaggtcatgtcgaaagatgacaattggtacctcaaagcctcacactggggcaatgaagggcatcgcgcatga

SEQ ID NO: 35559 - DNA, 312 bp, Glycine max
  Peptide Sequence Number=SeqID_152337
gggaaggacggcagagcaaatgggttcaacccttgtggtattgagaaatctctcaaaattagtgagaaaaattgtttccttgaaaaaaatccaagacgaggtgcttccataatgctttcaagacgtttctgtaggcgatctcgtggagattcttcaccattcttaatcgttcatcaccattcttcgttcattcttcatcgttcttcggtcttcaaccggtctgatttcctcatcacaattgaggatacgtggaagcaaaagccccgcttttgtcgaccaccccaagagatcgttaatggtccaacgccttaa

SEQ ID NO: 35560 - DNA, 234 bp, Glycine max
  Peptide Sequence Number=SeqID_152338
atgtatcccaaatctagcaatatttatatcacctgtagaataaattattttggaagcaaggagtgcataaagtattcttcaggttgcccagttagaaaagacatgcaatcattgctaatgtttggaagagaaggtatgactgcagatgtagtaattgagaatgatgatgatgaagcaaaatctaagaaggatagaactccaaagaagcaggggaaagatgagtctaagaaatga

SEQ ID NO: 35561 - DNA, 385 bp, Glycine max
  Peptide Sequence Number=SeqID_152339
atgagggcaaagatattagagaatgttttaatcatgtctagattattgcgatcgttttcccgtatttcttttcgctcgaattcctcctcttcatcttcttcaagaaacaccaatctcttaagtgatcaagataaccagacccaagaggtcgccccaaaacacaatctcttcgatgaggaagtccgattcgaagatattaatcaaaacatggatgactggaacattccagaaatccctcaggatcaactatacgttcctgaaacaattaaagacaaacacaactttgattacataatcaaaacagtagaaaacaatattcctctaggacaagatataggggaagaatttcatctactttcaaaaagttcaatttatgagcatagcc

SEQ ID NO: 35562 - DNA, 1422 bp, Glycine max
  Peptide Sequence Number=SeqID_152340
atggaactctctcgtctcttcgtttccgacacgtgcttcttctcccctccgattcgctgctccccttcgccggcgctgtccacgtttttcgccgtcaagaaccgccggagcaggaggaggagcagcttctgttccgcctccaatcccgacaccttggtcgccggcggtgccgccgtcgtcgctggggccggcgagaagcacgaggaggacttgaagtcttggatgcacaaacacggcctccctccctgcaaggttgtgctgaaggataaaccttgccccaatgattctcataaacctatacattacgtcgcagcaagtcaagatcttcaggttggcgatgttgcattctccgttcctaattccttggtggttacgctggagagggtgctgggaaacgagactgttgctgagctattgactacaaataaattgtccgaattggcgtgcttggcattgtatctgatgtatgagaaaaagcaggggaagaaatctttctggtatccgtacatcagggagcttgatcgccaacgaggtaggggccaactgtctgtggaatcacctcttctatggttaaaatctgagctggattacctgtcaggaagtccaattaaggatgaagttattcaaagggaagaagcaataagaaaagagtataatgaacttgacacagtctggtttatggcaggttctctatttcagcaatatccatatgacattcctactgaggccttttcatttgagattttcaaacaagcctttgctgctattcagtcttgtgtggtgcatttacagaaagttagtttagctcggagatttgctttagttcccctgggacctcctttactgtcctaccaaagcaactgcaaggcaatgctaactgctgttgatggcgctgttgagcttgcagttgatcgcccgtataaagccggggacccaattgttgtgtggtgtggccctcaacctaactcaaagttgcttataaactatggttttgttgatgaaaataattccaatgatcgtcttatagttgaggtatatgctgggaaggaaagggaagctgtcttagatatgcttcgttatatgcgtttgggctatgtttcagatccttctgagatggaatctgtcatctcctctcaaggtccagtttgtcctgtaagcccttgtatggaacgggctgcgttggatcagttggctgattatttcaaggcacggctggctggctaccctacaacattggctgaagatgaatctatgctgacagatgataatctgaatccaaagaagcgagttgctacccaatatgttaggctggaaaagaaaatgctccatgcctgtttgcaggcaaccaccgacttcattaaccagcttccagaccacactatatctccatgccccgctccctatgcacctttattgaaatga

SEQ ID NO: 35563 - DNA, 264 bp, Glycine max
  Peptide Sequence Number=SeqID_152341
atgttcatcttggtgtggggtttggcggtaagcaacaatagctcgtggtggccaccggtggttatgggtggtggagaagaagaaagtctttataatctacaaacctcgcttagcgagttcatcttgctaagagggagtccacttttcgcgcttagcacaacaatttgcactgagtgcaactctctttgcgctaagtgcaacaattctcgctcagcgcaatttcctctcaagttggaattgcgcttagcgcgcttcttgcactaa

SEQ ID NO: 35564 - DNA, 324 bp, Glycine max
  Peptide Sequence Number=SeqID_152342
atggaggattggggaaattttctccaccgaatccttgaggaggattctgaggattccgctctgattaaaatcaacggtggctcgtggcggccaccagtggttgtgggtggtggagaaggaggtgttaggatttgggtggcgtttggagagaaggagagagtgaaaatcatatttttcacgctgaagaaccgcaacttcctctgcactaggtctcactcagcgggccaactctcgctcagcgcaattccctctcaggttggaattgcgcccagtgtgcccctgctcgctcagcgtaattccttctcgggttggaattgcgcttag

SEQ ID NO: 35565 - DNA, 1062 bp, Glycine max
  Peptide Sequence Number=SeqID_152343
atgaggaacaaacttccacaccctctctgtcttttccttttgatttccctggccttgtttgcgaaatcagatgcaggaagccttgtggtatattggggccaaaatgcaggtgaaggccaattgacaaaaacatgcaaaacaggactcttccacattgtcaacatagcattcctctcaacttttggcaatggtagtcaacctcaaatcaatcttgcaggccattgttcccctgcatcaaagggttgcaaaaggttaggcaaagatatcaagaactgccaaaggagaggcattaaggttatgctttccattgggggtggcaccaacacctactccttgtcatccccagatgatgctagacaagttgcagactacatttgggccaacttcttgggagggaaatcaaactctaggccttttgggaatgccatattggatggagtggattttaacattgaaagtggtgaactacactatgcagcacttgcttataggttgcatgaccattatgctggttctaaaaaaaaattctacttaactgcttcaccacaatgttcattccaaaacaacttacttcatggagcactcaccgcaggcctttttgaccatgtttggattcaattctacaacaatcctcaatgtgaatttacctctaaggaccccactgggtttaagagtgcatggaatcagtggaccacatcaattaatgctggcaagttctttgttggacttccttcctcacatgcagcagctagaacaggttttgtgtcatcacatgctctcataaatcatttgctgcctatagttaggtcacctaaatatggtggtgttatgctttgggatagcttgcaagttgtaaatattaatacatctttggccctcaacaacttaaatggcaccatgcttcactttttcttaataattaagaaaggggcagagcaaattaaggggagagttgatcttagaaagcaacaagttaggatactcgctctccctccctcctccgccttcatcactatcactgttgtaacgattcgcctcgttgctacgatatcatcattctaa

SEQ ID NO: 35566 - DNA, 147 bp, Glycine max
  Peptide Sequence Number=SeqID_152344
atgataggcttaattgggcgctggcttgacaatgaagaaagagtaaaaacactaatctctggtacacctgtctgtgatggagcttctcaggaacagttatcagaacaactgtttcgagatgtatttacaagctttttctcatggtga

SEQ ID NO: 35567 - DNA, 171 bp, Glycine max
  Peptide Sequence Number=SeqID_152345
atgggtggtgttatatggttcccgggatcgggaggctatggctttcctcttcctggagattgggcgcttagcgagactggctcgcttagcgtgccttataaaaataacagtactcccttagtgcgcaaggtgcgtttagcgcaacaacgcaaaaacatagactctggctaa

SEQ ID NO: 35568 - DNA, 487 bp, Glycine max
  Peptide Sequence Number=SeqID_152346
gctctgcttctcttactcaagcattacaccaaacaaattgtctacattgttattccactctttatcgccatccccgttttcctcaatgtgtattggtttgtggcctgcacccttggcgcgtcttgcagcaacgtgttccccctcgcataccgggttctggttttggtgttcttgtttttggtgattgggatcatttgtgtggatcttggtggtgaattggcatcgcatggagctcacggtgagcataattggggtcacttcccatgcacttttgaggacatggctttgttcggggtgcggccttgtttgtctgttgggttagtaatgtattttgttccaatcgtggttttcatggtgtttgcgaggtttaatgggaagattattgcgaagaatttgaagagtggatatgattgtgaatggaaggaggattcttgggttccagcttattatgctttggctgttctcaccatgttatggtctggggcca

SEQ ID NO: 35569 - DNA, 604 bp, Glycine max
  Peptide Sequence Number=SeqID_152347
gttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 35570 - DNA, 144 bp, Glycine max
  Peptide Sequence Number=SeqID_152348
atgatgaatcctgaagagttagcttctccaagaactggtgattccaaggattattcaaatgacaagaatttcagggaaacatggccaccagaaaagttgttagggctgatagatgtgtacatggagccgttaatggttttgtaa

SEQ ID NO: 35571 - DNA, 742 bp, Glycine max
  Peptide Sequence Number=SeqID_152349
atgggctacgtgggagtacgtgagctcagttggaggtgggctacaggggatggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaaaacaagaccacaaagcaaggaggcttgtggtggctggccagctgtgcattttgtgtaatatgtggattgtggctctggtaatcgattaccaagggcttgaaaacgaagtcaggaaacttagggagcctctgatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacggtggagtggatattacccacacctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttctcgaggtggattctcccgaggaatcatgtcggcatctgaggcagactctacgcgaggata

SEQ ID NO: 35572 - DNA, 276 bp, Glycine max
  Peptide Sequence Number=SeqID_152350
atggagaacgtgctgaaggatgaacaggcaaaggtgtcggccttgcaagttgaaagggaggcaagggaagaggtgatagagtcattgcatgaagaaggcataaagtggatggacaaattttttgtcactctaaatggaagtcaagagcttccaaggcttctagccaaagccaagacggtggtcggcacatcctctgcccctgatgaagttcatagtcttttcaactactgccaacacatggtcgagctaatgacccacataattaggaaccactaa

SEQ ID NO: 35573 - DNA, 198 bp, Glycine max
  Peptide Sequence Number=SeqID_152351
atgaacgaggcagtgctactgtcacgagcgggtgcgtcaccagcaagtggtggctttgaagcaatggctgtgacaatagattttgttcctcgccacgcaaaaataaagaattttatactgattgaaaggatggatgagaacgacaacgttttaggtggctttaagctttttgaccctgttaaagtaactcgagcgtga

SEQ ID NO: 35574 - DNA, 188 bp, Glycine max
  Peptide Sequence Number=SeqID_152352
atgttcatgacccctaggctatgcatttcagctattttgggagaaaaaatgtgtttccatgaagaaaatccaagccgaggtgctgccgtaacgcttccgagacgtttccatgagcatttccgtgaagattttccgccgttcttcaccgttctttgtcctttcttcgttcattcttcggtcttcaatcg

SEQ ID NO: 35575 - DNA, 417 bp, Glycine max
  Peptide Sequence Number=SeqID_152353
atgtcgccacacgggggcgacatggatgggggtgaaaaaaagaaagagagggatggggtttctcttgcttttggcatagcgggccccggcgggaggcccgcacgacgggctattagctcagtggtagagcgcgcccctgataattgcgtcgttgtgcctggactgaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 35576 - DNA, 919 bp, Glycine max
  Peptide Sequence Number=SeqID_152354
agtagattgggaccaatacttggctgggataggaggcagcacaatcaactggtttcctcgatggaaggaaggaaaggagggagttctcttctcatctggggactacccaaacgttccgttgatagggacgaggggttgtattaactataatcccacacttgctataagacagttagggtaccccatgaggggagcaccaacggaagagagcctctcgcctttccttgtgagagatttcggcgcacaaagtttcaagatcgtacacagagtccacaaggcgtgggaaagcccgttaaggaaagataaagaacttaggggcatccgtaatggcatcatcagtggttatcatgaatgcttaagagttcatacacgagggttagattggctctccaagttgaaaattatcaacgaggagaacttcgaagcttcggaagaggatgaagaagtccaagctctaaaattagagctaggaaaggcaagactcgctaaagaaaaattcaaggctcgcaaggaagagcatggccgagataaattccgaggagctttatggggcagcaacaatgagctcaagctccggagagaggaaagagaccagtcacgagtacatggcatggtcttaaaggaggagttagctgcttgctcaagatccaagaggagtttggcccaacacttggaagccacagagcaaagcatgctagctataatagggcagtacaaagaagagttaaaccagtctttgacccatgaacaaaagctagtagaggacttcacacaagcgtacgccgagaaggaagcaagagggagagtgattgatgcattgcatcaagaagcgaccatgtggatggataggttcgccttgaccttaaatggaagtcaagacctcccgcgactactagccaaagcaaaggccatcgctgaa

SEQ ID NO: 35577 - DNA, 468 bp, Glycine max
  Peptide Sequence Number=SeqID_152355
atgaagcagaaagaggaaacaactgaatcaactcaacgggcaattaaaagtgcaaaaattcaagttggtaagctggcagaagaagtaactcaatttgtggccagaagggaagaagactttgtagaggttgaagctcaagaggaaagccctgcaaaagagcatgattcaagaggaaaacatgaggagaaaggcgaggaaaaagtacaacaatgggagaagtacccaacaatagaaaatcaacaagaaagtattctccaagtcaatacttttcctcatcaactaattatcaaggaagaaaggcaaggagagcatgagaaagccttaagtgtcattctttcattgatcactaacacctcttctgcaatgagttggaaagtgcttccaaaatacatgaagttcatggaatttctagctaaaaggcaaaactacaaggaagatgtgttatatgtgaccttcatgccaccttga

SEQ ID NO: 35578 - DNA, 372 bp, Glycine max
  Peptide Sequence Number=SeqID_152356
atggtgtatatacctccaaatgagttgtggccttgcgtaagaatggaagaagaacacttaggtgcacaaagatgtattgttgacattggtatatggaaggtgcacagacatatgagtaggcacattggacaattcaatgatataactagacgatttgtccttgcccatgattttgatgattacaaaggtaatgttagaaagaaaggaatgaaccctcttgggttgattttgcaagaagagacaaatgcaactatatatgccttgttcgcaattgtctccaaccaaagtgtgtcatgttactctatgcctagatgtgagacaatggtcatatcaagaaagcgagaacagatccctcaacgaataattcactaa

SEQ ID NO: 35579 - DNA, 264 bp, Glycine max
  Peptide Sequence Number=SeqID_152357
atggctcacaaattctgttttgaggcacttgatcacagccttagagatatcatcaaacacaactcaaaggacaataaaatatttggaggtaaaatcttgagactgacaaaaaacatgcgcttacaaaacaacatgcaagcaacagatcaagaagaaactgcggcttttgcacaatggattatagatattggtgatggtattattggacatgaaaatgatggctacgctactattgaaattccacaggaactattaatcacataa

SEQ ID NO: 35580 - DNA, 1446 bp, Glycine max
  Peptide Sequence Number=SeqID_152358
gggatgattagtttgaccctatcagcagtgcttccacagtttaggccacctccctgcaaaggtgaagaggtgtgccggcaagcaagtgcaggacagctggcagtgctctacatctcactccttcttggggcactcgggtcgggtgggatccgaccctgcatagttgccttcggggcagaccagttccatgagtcggatcccaagcagaatacaaagacttggtcttacttcaactggtactactttgtcatgggagtagcaatgcttgtggctgtgactgttttggtgtacattcaggacaacattggatggggaataggccttggaatccccaccattgcaatgttcttctcaattgctgcattcattgtcgggtacccactttaccgcaacttgaacccggatgggagcccgtatactcggttggtgcaagtgattgtggctgcatttcacaagagaaatgttccgtatttgtcaaaccctagtttgctctaccaaaatgatgaactagatgcctctatttctttggaagggaagcttcttcatactgaacagatgaaatttttggataaggctgcaattgtgacagaagaagatgacaacaaaatatctaacttgtggagattaaacactgttcatagagtggaggaattgaagaccataataaggatgggcccaataggggcctcaggcatttttctcatcacagctgttgcccaacaacacacattctttctccaacaagccaagaccatggatagacacctaaccaaaacctttcaaatcccagcaggatccatgtttgtcttcaacatcctcaccatgctcataaccactgccttctacgaccgagtcttcatcaaagtggctcgtaggttcactgggttggaccgtggcataagcttactccaaagaatgggtattgggtttgtgatctcaaccttggccacattggttgctgggtttgttgaaatgatgagaaagaaggcagcttcggcccatgggcttcttgaccatccacatgccataatcccaatatcagtgttttggcttttgccacaatatagccttaatggaatggccgaggcctttatgtcaattgggcacttggagtttttttatgaccaggctcctgagagtatgaggagcactgccatggcactattttgggcttcaatttctgctgggaattatgtgagtacccttttggttactttggtccacaagtttagtgctaggcctaacgggtcaaattggctccctgacaacaacctcaacaaggggaagttggagtacttttattggctcatcacaatactgcaaattttcaatcttatttactacttgatttgtgccaaattgtatacttacaagccaattgaattccaagacaaaggggatagtagctcaaaagggaatcaaattgagctctctagcacagtttaa

SEQ ID NO: 35581 - DNA, 603 bp, Glycine max
  Peptide Sequence Number=SeqID_152359
atggacatgactaggatggctggagaggaggctaaggagaagaagagtagaggcttagtactaaaatcctctaaaccatatctaatgatgagagtgataaagaaaatgcagaagaatgaagttgtggagagaaaaaatagatctcttgaggaattagcaagaacaatgctaaatgaaaaccatctacctaaatatttttggacagatgcggtaagtacaacttgctatgttctcaatagagtgattataagaccacttttgaaattgacaccatatgagatctacaaaggtagaaagccaaatatatcacatctcaaggttagtggttgtaagagctttgtgttaaacaatggtaaagaatcacttggcaagtttgatgcaaaagccgatgaagatttatttctaggatactcatctactagcaaggcatatagagttttcagtaagaactcattaaagattgaagaatttttccatgttgtgtttgatgagtctaatccccaaaaggagggaaaggtgtctattttttatgatgatgtagggagtccaagagaagcttatctaaggagtgaagaggtggtgagcaataaacctcaagaatga

SEQ ID NO: 35582 - DNA, 228 bp, Glycine max
  Peptide Sequence Number=SeqID_152360
atgaaaaaggaatttggaagaacacctgaatcgaagcagcgtgctaagcgcgagatcagcttgctaagcgagtcatccgtctcttgccatgctcagcgcagcattgggaaagaagaagaggaacaacaagaacgaaactataacgcttttgcacaacatttgcacacactcagaggacgaagcaacaacaaggagccattcgagagtgatttgagagtgtttgagtga

SEQ ID NO: 35583 - DNA, 195 bp, Glycine max
  Peptide Sequence Number=SeqID_152361
atggccctacacagtaacactagggatggcaaaacaagttggcccgacccaccaaaaatagggcagggcggactggcctgctcagacttgaaaggttggacatgttggcctaccccgcctgaaggctggcgggccaacccgcctcgtcctgtctctagcccagaaggctggcaggttaggcggggcaggccatga

SEQ ID NO: 35584 - DNA, 576 bp, Glycine max
  Peptide Sequence Number=SeqID_152362
atggatgggctagtggatctagcggcgatcaatgcttttcttgcttatcaccacggcaaggaaagtccggtcgttgctgttttggctgatgcttatgacacattcgaccggagatgcgagaagagcagcatgagaattgtctgttgtacacccgctctttatgtatggctggtctctaacatttttctccatgaaaggttcccaaatgtccccttgatgggaacaagaggttgtattaattataatcccatattggccataagaaagctaggctaccctatgagaggggtgccattggaagagattatcacacctttcatcgcacgaggtttctatgaaggcaattcaaatgtgcttcaaagagttcaaaaagcgtggaatgctgtggaaaggaaagataaagagcttagagtaagcaacaacgatgttattggtggctatcataaatggttgaaggctcggatgcaagggataacttggctcccgaagctaaagatttcaagtggtgaagaagccgaagtcccggaggagagcgaaaaagtgcaagccttgaaggcagaacttgaaagaacgtga

SEQ ID NO: 35585 - DNA, 201 bp, Glycine max
  Peptide Sequence Number=SeqID_152363
atgaagctcactctccttgatctgccaaagctcttgctttctcttccaattgcttccttgcctagctcttgtgccaagatcttgaccattttgactattcatgccatggaagggtataacccagaaaatagatacaagttccttcctcctagcaagcatcccaatatcccttcaaactcttctacggttggtaccaactga

SEQ ID NO: 35586 - DNA, 410 bp, Glycine max
  Peptide Sequence Number=SeqID_152364
ggctatctaaagctgcaaaggaggaacatgctagggacctaccaatcatgaatggcatcaaagaaattattaaatccgttgaggttttagactcacgcagcctcaattacaaagagactttgtacaacctttctaataggctcaaatcattacagggactttgcaagcaacacttcatggaagaggattcagaattacttccaataatggaagcagtggggttgagcaaagaggaggaggaggatgcattagagcattgttttgttgtgatgcaaggaacacatggccggttgttaaagttccttcttgaggggctcccacctaatgattctatgaagtacttggacttgatcagcatgtgcagggacaaagagaggatggaatccatgcttagggtggtagtggagtga

SEQ ID NO: 35587 - DNA, 951 bp, Glycine max
  misc_feature (833)..(833): n is a, c, g, or t
  Peptide Sequence Number=SeqID_152365
atgggttttttgcaagatgataaagaattcattaaggcaatcaaagaagcaaaagactggggttcagcacattatataagaaaactatttgtgttgttacttttgactgcaacaatgaacaaacctgaacaagtttgggaccaaacttggcattggatggctgatgacattgtctataattataaaaaatcatcagcaagtccagcattacagcttgatgataggactcttcaaaatctgttcttgcttgaaattgaacaactgttgcaagcaaatcaaagatcgcttagagactatccttcaatgtcatatctagaagatgcgaattgcccaacctatctagacaatagttttatattagctgaactcaatgacaacaatcaagaacttagatcagagtttaaacatctattttctcaaatgacagatgaaggtggtatgtgttttctctatggatatggaggtacaggaaaaacatacatttggaaaacacttgcaagttcactaagagttgacaataaaattgtaattatggttgcttccagcggcatagcttctctgttattgcctggaggtagaactgcacattcaaaattcaaaattctagttccagtttttgaagactcaactggcaatatccatcaaggaactcaattagctacactattaaatcagacgagtctgatcatttgggatgaagcacccatgactcacaaattctattttgaggcacttgatcacagccttagagatatcatcaaacacaacttaaaggactgtaaaatctttggaggtaaagtaatggtctttggtggagatgtctggcagatctngccagtcattccaagaggcagccgctctgatattgttaacgcaacaattaattcctcttatctatgggatcattgtcagatcttgagactgacaaaaacatgcgctacaaaactacat

SEQ ID NO: 35588 - DNA, 825 bp, Glycine max
  Peptide Sequence Number=SeqID_152366
atgtccaaatcttgtggatttgggatgaccggccctctcgatgagtcgatctcttgctttctcataagggtggacccttgggtacttgtacctatcacctttagaggactacacgtcctcgccttgagaggactacacgtcctcaccttcgtagggctacacgccctcacctttagaggaccacacgtcctcaacttcagagggctacacgccctcgccatcagaggaccacacgtcctcaccttcgtagggctacacgccctcatctttagaggaccacacgtcctcaccttcagagggctacatgccctcgccatcagaggaccacacgtcctcaccttcagagggctacacgccctcgccatcagaggactgcatgtcctcaccttcagagggctacacgccctcgccatcagaggactgcatgtcctcaccttcagagggctacacgccctcgccatcaaaggactgcatgtcctcaccttcgtagggctacacgtcctcacctttagaggactacacgtcctcgccaacagagggctacacgccctcgccatcagaggactgcatgtcctcgccatcgtagggctacacgccctcgccattagaggactacacgtcctcaccaacagagggctgcacgccctcacctttagaggactacacatcctcgccatcagagggctccacaccctcaccttgagaggactacacatcctcgccttgagaggactacatgtcctcaccatcagagggctgcacgccctcacctttagaggactacacgtcctcgccaacagagaggctgcacgccctcacctttag

SEQ ID NO: 35589 - DNA, 450 bp, Glycine max
  Peptide Sequence Number=SeqID_152367
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggttttctcttggctatatggttcatccgggggagagatcgagcttcaagaaatagtgaacggtcttatcaatacacaaatgaattgggttcaagctttccccagcccctttctcatcaatggactcctgacgtatacgaaggagtgcgatgctacatagttggttctcatccttcagagactacgagtataataggagcatccgtcaacaaaaggatcaccctaagatga

SEQ ID NO: 35590 - DNA, 624 bp, Glycine max
  Peptide Sequence Number=SeqID_152368
atggcttcactgaggtgcctccactcaacccaccctcatcttcatcgcggttcagcgcttctcgccatttcgaaccgctgcttcaaccattcctccttgctgaaccggactctctccgtaaaccctcctcgaaccgctcctccacgcgccatggccaagcccagtttctcaactgcccaagacctagtggcttctcctggcgattttgaatttgcgcagcctctgaaaattgtggagtatcccgacccgagattgagggccaggaataagcgcatagttgccttcgatgatagtctgaagaagcttgtccacgaaatgtttgatgtaatgtacaaggcgagccctggtgcagcggtaaagttgtgccttggtgacttgttggtcatgggttcgaatccggaaacagcctctttgcatatgcaaggaactgatggtattggtctctcagcaccccaattaggaattaatgttcaacttatggtgttcaatccagtaggtgagcgtggtgaaggagaggaaattgttcttgtaaacccaagagttagccaatactcaaagaaactgacactatttaatgaaggttgcctatctttcccaggcatcaatgctgatgtaaaggtctga

SEQ ID NO: 35591 - DNA, 453 bp, Glycine max
  Peptide Sequence Number=SeqID_152369
atgtcgggacttacatgtgattctcctcaaattttagccagcccgcatcaattaaaccttgcaccttacgcttcagggccctacaatgctcaatggaacgccctggggcttctccatgacaagcacacgttgcgttcgagtcgtattctcggagaaatgggggttgatgaaccttggctggggttatggctaccattgaattatcatcgtatccccaatggagtcgccaactgtcgcaaccgaccctttttgcgggcgagcgaggcgaggctcacgggtgcgtcttccaaaggaggaaaatgcgcggagtcgccaccaacgttcatttgtggaaaacatcgaaaaaaccgaaggaaaccggtcatgaagaatattccagattcgggagttgtatttacgtttgaggaaggtattagcacctctcacgtttgtcccaaaggacaacagccttaa

SEQ ID NO: 35592 - DNA, 240 bp, Glycine max
  Peptide Sequence Number=SeqID_152370
atggataaatttgatatctttgtccctcatcctctcacaaacgcatctttgcttattcaactttcaccgaaatatgggtgcaagccattggtttgtttgctcaagcgacctgcgctcctgagtttggacttccaagaccgttcaatcagaaattactcatgctacacatttgagagaaatgagttatcaagaataggatgtgggacaaatggcctcagttatcttaagaaggggggttga

SEQ ID NO: 35593 - DNA, 273 bp, Glycine max
  Peptide Sequence Number=SeqID_152371
atggttggacggaatgatcgtgcaataattgatgctctgcaagccttagctcaggctatggggaatcaaaatagaggagaagctactggagctattgagtatcaagggttggatcgcttccaacgaaacaatccacttgctttgaatggaggctataaccctaatgaggagctgaaggttgcttttggtacatatactttcatagaagaagccgggtattggtgggagaacactcgtgttagagatagggggagcaacatgaagaagctttga

SEQ ID NO: 35594 - DNA, 1371 bp, Glycine max
  Peptide Sequence Number=SeqID_152372
atggctgtgattttcaaggatagctgctacagttcctgttacatgaaagtgatctgctacaagcatcaggagcttggttacaaagaaactcaaggtgatgaagttgaagacctgtgcattttgttacgtgaagttaaaaggcagataccctcagttagtgcagtttcttctggagccattgcatctgactatcagagattgcgggtggaaagtgtttgttcaaggttaggccttgtttctctggcatacttatggaaacaagatcagtcattgcttctccaggaaatgattacaaatggaattgtagctgtaactgtgaaggtagctgccatgggtttggatcctgcaaagcacttgggtaaagaattagccttcttaaatgcttatttacataaattgaaagaattgtatggaatcaatgtttgtggtgaaggaggggaatatgaaacattaactcttgattgcccgctcttttctaatgctcgcattgtgcttgatgaatatcaagttgtgatgcactcttcagattccatagctcctgtcggaatccttcatcccctggcatttcatttggaaaataaggcagatgttcagtatttaaaatcacaagacaaaatacatgagagttttacacagaaactgggatctgtttttgaagtgcaagacagtgtagaaggatgtttgcaggaagacttgaagattgttttggggaaaattgaatcacagttattgggccttggttttggctgggagaatgtcctttatattcacctttacattgatgacatgaataatttctctgaggcaaatgagacatatgtgaagtttataacacaggagaaatgtccatttggtgttccgtctcgtagtactgttgaaatgcctcttatagaaatgggtttcagcagagcatacattgaagtactggtagcaaacaataaagataaaaaggttttgcatgtacagagtatttcctcttgggcacctagttgcattgggccatacagccaggcaaccttgcatgagggtatacttcacatggctggtcaattggggcttgatcctcctacaatgaatctttgcaagggaggccctggtgttgaactggaacaagcactaaaaaacagtgaagcggtggcaaaatgctttaattgttcaataacgacatctgcaattgcttttgttatttactgttctaaacatatttcattattggagagacttgatattcaggagaagcaagaaacaatccttagacagatgaagatctcccatttacaggaaagaaccacttacaaagcattagatcccttgttcctttatgttcttgttcctgatctacctaaaaggtactgtagggtatacccttag

SEQ ID NO: 35595 - DNA, 407 bp, Glycine max
  Peptide Sequence Number=SeqID_152373
atggaggaatccaatcgggaaaataacaaagattgcatttgccagtcaagagggttcgctcttgacggtgaagagtacaatgcagatggaggattcaatcagcaaaataacaaagataacatttcccagtcaagagggtccgctcttgacgggtccgctcttgacgatgaagaacacgttggagaatggaggaatccaatcgggatcaagcttatcgataccgtctacctcaagggggggcccgtcgggaaacctgtcgtgccagctgcattaatgaatcggccaacgcgcggggagaggcggtttgcgtattgcgcgctagaggagtgtatactgacttactatgttggcactgatgagggtgtcagtgaagtgcttcatgtgggaggagaaaaaaggctgcaccg

SEQ ID NO: 35596 - DNA, 288 bp, Glycine max
  Peptide Sequence Number=SeqID_152374
atggcgaggattcctaacaagattaggtctattgatggatcaaaagaaacgcttaagcttgctgttaggatcaccgatctttggttcgttgggactcctaacaagtctgagcaagcgaaaatggtttttgttgattttgagggtgatcaaattcatgctatttgtaaatcggaccacctcaagtcttggaaagctgatttgaaagagaattgcacttatgttatgcataatttcaaagttgttaagaatgatggtcaatttagagtgtgcgaacatgagtacaagtaa

SEQ ID NO: 35597 - DNA, 261 bp, Glycine max
  Peptide Sequence Number=SeqID_152375
atgtctaagggtactaattatgttggacccaaaaagatatggataccaaaatctcaaatagtacctactgcagatatccttggtagcaaaaggccgatcaagggaaaggtcaatgttcctggtaaaattgcctttggaggcataagtataggaaatgtttttggtatgggtaaaattggtatcccttctcaagcctccataaacaatgtcttatatgctgaaggtttgaagtataacctgcttagcataagtcaattttaa

SEQ ID NO: 35598 - DNA, 1017 bp, Glycine max
  Peptide Sequence Number=SeqID_152376
atggaagacctattggaagaccatgcaaaaattccatacccaaaattggtgccacaaagaggacttggagtggcacagcttgaaaagtttagacttgaacaagaacaaaaggagaaggcagctataatagccacaagtgcatcatcatccaattccgatatcccttatgataagcatcttcaatttctaaaatttcataactccaatcaaccttctccaaattcatttcctttaagcactgcttcaattgcaaacaatggtggatctgatgctggcaggcatgaggctctagttttggggcatgtaagtgggccccagttacgggctccccatgattttaaatttgtgaagaagaaaattgggatgaataccggaatgacttttgcatcaacattgccttgtgcgtccaacactatcatgcccttcccgaattgtgtgcagaaaacacaacagcatcaacaacaacatccttcttcatcaatggtgagtgtctcctcaaggacttcatcaacaattgtgcctcattcctcgttagagccctattcaaccgaaacctatgtttctaagagactagagaagatgatagggattaaaagaccaaacccattctccctgaagataacacctgtgtcctcttccaattttaaaccttttgagtccaaccctattaggccctcccctaattggatgcacagaacacaacaacatccttcttcatcaatgctaggtgtcaacccaaggacttcatcaacaattgtaccccaatccttattagagccaccttcaaaccaaaactatattggaagctatgtttctaagaggaaggaggagaagatgatatggactaaacaaccaaagcccttctccatggatattccacctgtgtcctcttccaattctaaacctctcactttccctaatccacctatgtcctcttccaattttaaacctctcactttccctaatccacctatgtcctcttccaattttaacctctcactttccttgctcctatga

SEQ ID NO: 35599 - DNA, 606 bp, Glycine max
  Peptide Sequence Number=SeqID_152377
atgtcgtcatcaccgttttcaactctctcgtttcgacgtcttgtcgtgagcaatgcgatggtgtctccttgcatgtcgtatgccatgaaaccattaacggcacttccgagcgtggggcggaggcagtttctattttttctaacggcgacgacagcgttcacagtgagggaagcgacgtccgtggcgcaggacattcccttatttgggatacggaagagtctaaagaaggcggaggaggaagtggaggagattgtgaaggagggatttgaggctgcagacaagggccggagtggaaatggggagcaggagggacaaggcgcccgccataaacagcaccaacgtcttcgccgcgctcgaaagcctcaagaagatgaaggactagcagggccgtccaagcccaatgacaagaaggacgtcttttgggcccccgtgcctctcacctccaagtcatgggccgatgttgacgacgaagatgacgacgactactatgccaccatcgctcctcccgaatctgtttgggccgcgccgattatcactcaaaatgacatcactgctactaagatttcatttttttatttgccctatttttttcctccctccttatag

SEQ ID NO: 35600 - DNA, 393 bp, Glycine max
  Peptide Sequence Number=SeqID_152378
atgacgctgccagacataatcattataatacaatcatcaattagagatgatgatgtttcgtctgtaattacttcactttggattcacgatgtcggatacaatgtccaggacatcctgcccgaaaatactggaattgctaaaagcattgaagctgcaggatccacgatgtcggatacaatgtccaggacatcctgcccgaaaatactggagttgctaaaagcattgaagctgcaggatccacgatgtcggatacgatgtccaggacatcttgcccgaaaatactggacacatgaatctgttatctctttaacagattattgtgcaattttcaggaagaatgatagatctcatccagcacaagaagttgcagcccagatacacacactgctataa

SEQ ID NO: 35601 - DNA, 563 bp, Glycine max
  Peptide Sequence Number=SeqID_152379
aggactgacgtcctgaccttcagaaggctacacgccctcaccttcagaggactatacgtcctctctttaagaggaccacacgtcctcgccatcagagggctacacgccctcactttcagaggactatacgtcctccctttcagagggctacacgccctcgcctttagaaggctactcgccctcatttttagaggagaacacgtcgtcagcttcagagggctacacgtcctcgccatcagagggctgcatgccctcaccattagaggactacacatcctcgccatcagaggactacacatcctcaccatcagaggcctacacgtccttgccttcagaggactacacgtcctcgccttcagaggactacaagtcttcgcctttagaggactacacgtcctcaccattagaatgctacacgccctcgccttcagaggactatacgtcctcgccttcagatggctgtacgccttcacctttagaggactagacatcctccccctcagagggctatgtgtcctcatattcagaggaccacatgttctcgccatcagggggctgctgat

SEQ ID NO: 35602 - DNA, 231 bp, Glycine max
  Peptide Sequence Number=SeqID_152380
atgggattgtgctcgcaagacacccaattggacccgaagaagtccaatagggttctggggtttctagctctgattacgagcctttgtcagttctacggagtgcccgtcacccctagcagggtcattaggcccttattaactgggctttcatcgagaagtactgctcccccaggcaggcgcagggcgaggcatcacagtagtgggcaacaggcgcactgccaccacctctag

SEQ ID NO: 35603 - DNA, 2556 bp, Glycine max
  Peptide Sequence Number=SeqID_152381
atggtactgagcttgtttctggaatcgaggaagtcgtggatatcacagattttggggaatgctggtcctggtgatgcttcctccttggtggttttggtcttgtgtgatgtgttgggtataattcaggtgttgaatgatatgccacttttttacaaggtcattctgggatcacctccagcatcacagctgtttggtgggattcccaatcctgatgaggaggttaggctttggaagtcattcagagataaactggaatcaatcatggcgatgcttgataagagttacattgctgatacttgttttgcatggttgagggagtgtgtgagcaagataagtggaagaaatttgattgatgctgttggtagtggccaggatttggcttctgctgagaaatcaataagggagacaatggaaagcaaacaagttctgcaggggagtctggaatggctcaagaatgtttttggctcggaggttgagttgccatggagtaggattcgggaacttgttttggaagatgaatcagatctttgggatgaaatttttgaggatgcttttgttggcaggatgaaagcaatcattgacttgagatttagggagctaacaggtgctgttgatgtggtgaactcaatttctgctataggtgacttgtgtaccaagctagatgatgttcaggggtatttgaacagaccttctacggctggtggtgtttggtttctagaatcaaatgccaaaaaaactggagttgcttctgggtttaaagtccagcctgaagagagcgaatttcagtattgtcttaatgcctattttggtcctgaagtaagtcgaatcagggatgcagttgatgtttcttttcagagcatccttgaggatctattaagtttcttagaatctccaaaggcttcccgaagattgaaggatctggcaccatatctgcaaagtaaatgttatgaatgtgtgtcttctatattgatgacactgaaaaaagagctggatagtttatatgccccaacagaaaatggcgaggtgccaacagcggttactgttgaaaaatctcttttcattggacgattattgtttgcattccaaaatcattctaaacatatacccttgatacttggttctcccagattttgggttaatgggaatgcatctgcagttgggaaattaccagctctggtaaaacaatctcgatttgggtctgattctgctatctgtgatagtccgggaagacaaacgagccttggctctaaaagacaaaattcatctgtcgtatccgctttgcttggcatgagagaaggtgcaagccatgaattggaagaactgaataagaccattggggatctttgcattagagcttacaacttgtggattttacggatctcaaatgaactttctgccattgtctctcaggatcttaaacaagatgatgctttatctttgagctcaccctggaggggctgggaggatatcattgtcaagcaagatcagtccgatgagaacccaccagagatgaaaatatctcttccatccatgccttctctgtatatcatctcatttctatttagagcctgtgaagaagttcatagagttggaggtcatgtacttgacaagaagattttgcataaacttgcatcaaggctactggaaaaggatctcagagtaacaaagataatcatcctatctccaaacccaccccctgtaaaaagtaattgcaatcaagttattgagaccctgaatggattattggttactggaatctttgaggactttctttccactgcagagagtggtgttcatcaagtgtcagaaaaaggagtcttgcaggttttgttagatgtcaaatttgctactgatgttctctctggtggtgattcaaacatggttggggaattatctagtaacccaaaagcaaagctacctggcagaaagaagcatgaccaaagtttgacaaactcagccattagagaacgttcaaatcaattgttaaatcgtctttctcagaaactggatcccatagactggcttacgtatgagccatatctctgggagaatgagagacagtcttacctacgacatgctgttctctttggtttctttgtgcaactcaaccgtatgtacacagatactgttcagaaactgcctactaattcagaatctaatattctgaggtgttctacagttccccgatttaaatacctccccatcagtgctccagcattgtcctctagagggacaaagaaggcatttactccatcatcaaatgaaatcgctttgagaagttcatggaattcaattacaaatggagatctttctcaaaagataaatttggatgacagttcaagtctgggggtggcagcacccttactgaagtcttttatgcaggttggaagcaggttcggggagagtacttttaaactgggatccatactaactgatggtcaagttggcatatttaaggatagatctgcagctgccatgtcctcatttggagatattctacctgctcatgcagctggtcttctttcatcttttacagctcccagatcagattcataa

SEQ ID NO: 35604 - DNA, 696 bp, Glycine max
  Peptide Sequence Number=SeqID_152382
atgaataaaccaaaatacctgcttaggctcgagctcatcgatgacggcgacggcggcgagcgcatcggagtaagcggaaatggcgaggccgcgttcgagcaagcgatcgcggctgcgctgggagatctgcgccctgaagctctcgacgatctgccactggtgctggagcattgcgaaattggaaaggaacttcttcttctggtcatcggaatcgacgaacaagtggtggtgcacgtacttggcacgcacgtagcgcgacgcggcctcgagaaacatcccttcgtcgaggcaaccccaaatgttctcgggcgtgtcgacgatgtacttgacgcggcaggccgcgccgtaggtccaggctcgggactgggaatggagcttggtttgggactgggattgggattgggagagggagcggatgcggtcgtgtacgacggcgatgttgccggagatgccgttgcaggagcccttcatgcggacgatggaatcggcggagtcgatcaggtcgcggtaccggttgccgacgagttgccggagctcctccttcttgtcctcgatctgcttccgcgtcgccgcctccgtcttccggatctcggcgatgggcttcgagcggaagagggactcggcgtcgcggctgccgatggtggagatacggtggtcatcggcgcgaggcaacggagacgccgcgtctggggatga

SEQ ID NO: 35605 - DNA, 465 bp, Glycine max
  Peptide Sequence Number=SeqID_152383
atggatcttccatcagcagatgcaaaccaaattgccaacaatctctccaacctgggccaaatctataacagagaagacccttcaacagatgtcttggcaaggggtcaagtcctaggagatggaattcgtgtacacagcatggtccttccaggcattccttctagtacaacagttcacttctctggtccaggagaggtatactctatcaagcatgatatcacagatgtgaagtgtctcatgcctggcttgctattagccattagaaaagtagtgcgcctcaagtccacctcttttatctccttgccaagaactttaacttggttgagctcaagggaccttctacttcagcatcttgacaaaattcatatagaaaggtttgcaagaacaaaagagaaacagatgctcaccaaattgctttttagtggcccaattattcaatcacatcatgcagcaccagaactgtga

SEQ ID NO: 35606 - DNA, 951 bp, Glycine max
  Peptide Sequence Number=SeqID_152384
atgcttggagtactctgcgccactcgccccaaaccttggcttctctccctcgtccacgtccacgcttccctgcctcgcctacctcattcccctctatcaccttcagcctcgccgccgccccgtcgccgccattccaccgcctgcaaactttttctctccggcggcgctgccgcctccatatggcacgctatcatgccccgaggtgatgacggattacggcgcggcgttgttgccgtccatgacttgaagggagagggatcgtggaatgtcgcttgggacgcgcggccggcacggtggctccaccgccccgactccgcgtggctcctctttggtgtctgtgcttgtctggcgccgccgccgggttgcgtggatgctgacactaattctgctggaatcgctgtggatgaaagttgcggccttctcgataaggaacgggaggaggatgaggtttctgctgattacagagtcactggggtacctgctgatggtcggtgtctgtttagagcaatagctcatggagcttgcttgagaaatggggaaaaagcacctgatgagaatcgtcagagggaattggctgatgaattaagagctaaagtttatagaaggggatttcgatacatatctgcagagaattcaacagccttatgtatggggtggagaaccagagctattgatggcttctcatgttttgaattgtcactttcatttgtcgagaggcataagatgtttgccataacatctactaagtgtgtttgggggtgcagttacaagctgtggagcagtgttgtctatatgacaccaatttctgttttcatgagagacacaggctcggttgaattggtaaacatagcaaaatatggtgaagaatacaggaacgataaggacatttccatcaatgtgctatttcatgggtatggtcactatgacatactagagaccttacgaccataa

SEQ ID NO: 35607 - DNA, 399 bp, Glycine max
  Peptide Sequence Number=SeqID_152385
atgacacagtccaagagatttttagcaccagtatccataaccaagcaagaacaaggagccaaatttcccgacaaattcccaaacttcaaacaacatttaaatgcacaaaagcttcaattcggtgcagtcaatggatgcgtgatggaatataaatactatatcttgaaaaatacacatctagtgcaagatattgagatggtagaggaggaagagccacggattggtgcttattgttctagtgcaacctctaataaatttgagatttataaggaggaagcagggaatgcagcacagaagcataaaacaaagaggtggaaagtgtcaatgctgatgcagaagcctttggtgatcactgggaaagttcatattgctctatgcattctgaagctgaagcactag

SEQ ID NO: 35608 - DNA, 303 bp, Glycine max
  Peptide Sequence Number=SeqID_152386
atgatgttgcctatggtgatatcaggcccaagacaaccaggaaatgaaattgatgtttatctcaatcccttgattgaagacttgacaaagttatgggacgagggggttgttgtgtttgatgggtatcgaactgaaacattcaagttgctattttgtaccattaatgactttctagcatacaggaatatgagtggatacaatgttaagggccattgtgcatgtctcatctatgaagaagacataagctacgtacaactgaaacatggaagaaaaatagtatacactcaagagcatgatacgtag

SEQ ID NO: 35609 - DNA, 714 bp, Glycine max
  Peptide Sequence Number=SeqID_152387
atggctatcgtcaacaagatgcggatccatggagacaaaaaagaggatatcactgtagttgagaaaattcttcggtccatgactccaaaattcaattttgttgtttgctctattgaagaagctcatgacattaaggaactctcaattgatgaatttcaaagttccttattgattcatgagaagaaaattaatcagcaggacatagaggaacaagcattgaaagtctcaatagaaaatcgctcaacatcaaaaggagaaagaggacgaggaaaagggaaaggtaaaggcatcagaggtagaggttggggaagcaatgagcatggcaatcaacaagaatatcagcaacaccatgataatcaattccacagaagaggaagaggtcgaggaggccatcattttacaactcacaaatcaaagtcagcagacaagtcagatgttgaatgctaccaatgtcacaggtatggccattatcagtcagaatgccaaactaacttgaacaaagacaatggagagaaaactaactttgttgaaaaggaagaggaggtgtctcttctgatgagtgagaaaaaggaatcgcaccaagacagtacaagtggaggcttgaatcccttctctgtctctctgacgtttggaaactctatcggagcagttagagggaaaaaaaatctggaggaatctcaggaaactgctagaaatgttgttatcgctgtctga

SEQ ID NO: 35610 - DNA, 1485 bp, Glycine max
  Peptide Sequence Number=SeqID_152388
atggtgattggacttcctcaaattacatctccctctgaagtttgtgaagaacgtgtggttagcaaacaacatcgaaatcagtttccacaaggaaaatcatggcgagcaagaaaggcattggagttggtgcattctgatatctgtgggccaataaatccatattcaaatagcggtaaaagatacttgatcacttttattgatgactttagtcacaagacatgggtgtattttttgcaaaaaaaatctgaagctttcactgcatttaaaaattttaatgtacttgttgagaaagaagccaatagcccaataaaagtacttcacaatgatcgaggtggagaatacaactcacatgaatttgtaaatttttgtgaggcccatggaatcaagaggcaacttacagctgcctacacacctcaacaaaatggtgtttgtgagaggaagaatcgcacaattatgaatgtggtgcgcagccttttgacgaggagtggtgttcccaaaactttttggtctgaagctgtaaattggagcattcatattttgaatagaagtcccacacttgctgttcaaaatatgacaccagaggaagcatggagtggacaaagaccagtagtagatcatttcagaatttttgggtgtgtcgcatatgcccacattccaaatcaaaggaggacaaagctagatgataagggagaaaaatgcatctttcttggtgagaggcaacaaccagcagaaaatcatcaacaaattccaccagaaaatgtagcagatacgtcaggttcaccaacaatagcatcagatgatgaacgacctcaatgtgttagaaaaaggccagcttggatgatcaattatgagggacacaagacaattggtgtcaagtgggtgtacaagacaaagttgaagaaaaatggagatgttgagaagtataaggcacgcttagtagctaaaggctacaagcaagaatttggtgttgactacaaagaagtgtttgctcctgttgctcgacatgatactgtcagtgatgctgccatgtttgagaaattcaagaaatccatgatgattgaattcgatatgactgatcttggcatgttgcattatttcttgggcattgaagtaatgcaatctgctgctggaacctttatttctcaaaagaagtatgtgctagaaattctggacagatttcaaatgaaaaatggtaactctgttagcacacctactgaagtgggtttgaagcttgttcgagatcccgacgaaaggaagattgacaacactctttgcaagaaaattgttgggagtctgatgtatttaacagccacaatacctgacataacttatgttttaattgtcactttgtcaacaactgaagttgaattcgttgctgcgacttcatgtgcctgcgaagctatttgggttagaaaaattcttgaagagctttgtttcaagcaacaaggaccaactccaatctattgtgagcagttcaacaattaa

SEQ ID NO: 35611 - DNA, 282 bp, Glycine max
  Peptide Sequence Number=SeqID_152389
atgaccactggtggccaccacgagccgtcgttgcttgtcgtcgaaccaccacaccaagtggaacgttttaatcgaagcagaatcctcagaatccacctcaaggattcagtggagaacaatccttcaatcctttcttgcgtagcttctctgagggatgatgcaattgctgcagcacctactgtagacaaaggatcaagccgatgttttgatgatgccaaaagatcgcatgcgtctcaaagctttattcaagacaaagcaattaaagatattcaagatggatga

SEQ ID NO: 35612 - DNA, 231 bp, Glycine max
  Peptide Sequence Number=SeqID_152390
atggatgagatgagataccagtatatggaattgtctaggctccttgacgtttcagattctgaaggtccgcttagcgagattgactcgttaagcgagacacgctgggagagcacatctctcattgattcacttctagggtttcccagcacgctatgcgagctgtatgcctcgcttagcggatgtcactcgctaagcgcatatgcctcgcttagcgagacaccagcggcttga

SEQ ID NO: 35613 - DNA, 330 bp, Glycine max
  Peptide Sequence Number=SeqID_152391
atggaaggtagccatgggctctcaatgaaagcaccaaaaatgatagttgcagtgcttttagctggcttcgagggccaacacctcctggagaagaagaaatggttacatgcctgtgagtatgctgcacgtggacatttctcgattaaattagatgtctttagttacggtgtgatactactagagattaatggcgataaattaatgccaaagccaaaggttcctggattttaccctgaaacagaggttacatctgtagcaaattgttcgttggaaaatcacagactgtgctcagttaatgaactttctatcagaatgttagatgcaagatag

SEQ ID NO: 35614 - DNA, 192 bp, Glycine max
  Peptide Sequence Number=SeqID_152392
atggggtggttcatgatgagccagaagaaccaacttggcaccaccgttgacatgggagttcggtgcgagggaacaattggtggtttgaaggagcgcaatgatgagcttgttgaaggggggagggcattggaaaaggcgagaatggagagggaagagcgatctgagagatctgcgacgagggatgtggcgaag

SEQ ID NO: 35615 - DNA, 383 bp, Glycine max
  Peptide Sequence Number=SeqID_152393
attcgctgccgaagttcacctacgccgacgacggcgaccggcgcaagtggtcggagtgcgcgatttgcctgactgagttcggcgccggcgacgaggtccgggtgctgccgcagtgcggccacgggttccacgtggcgtgcgtggacacgtggctagcgtcgcactcatcgtgcccctcgtgccgcgcgcccttcgctgtcgtcgcacgctgccagaagtgcggccactttccggcggttgcatccgcctccgccgcatcggagtccaaggccgtcggttgcgacaatgccgccgttagcgctgcgaatgctaaccgtaataatataaagattaagagctttattcgtcatagtgcttcttatctattaggaatttacgggtaa

SEQ ID NO: 35616 - DNA, 2220 bp, Glycine max
  Peptide Sequence Number=SeqID_152394
atgaatcatttccttgcaccattcttacgtcattttgcagctgtgttttttgacgatatactcgtctatagcaactcgctttcgtctcatgttcaacaccttgatctaatcttccaagccttgctgcgaagtgagttctacttaaaacgaactaagtgtctattcactcagagggaattagagtacctcggtcacgttgtttccaacaagggagttaccctcgagccatctaagatcagagctatcgaacaatggccaactccggcgacagctaaggaacttcgagcgtttctcgggttaactgggttctataggaagttcgtgcggcaatatgcagctatagcatccccactcatgagcttactatgtaaggacgcatttgaatggtcactcgagtcgcaagaagctttcgataagctcaaatccgccatgaccaacaccctagtactagctctccccaacttcagtgagccattcttagtcgaaacggatgcctcaggcaccgccatgggggccgtgctcacacagcgaggacacccactagcgcaatatctccttggaagcctattcaccattctcatcgatcataagagtcttagggagcttatgacgcaggtgattcaaaccccggagcagcactactacctctccaaattacttggctttgattacacgatacaatataaggcgggtgccaccaatgttgtcacggatgccctctcttgccggccacctgaaccaggccagttactcgtgttgtcagtgcctcagcttgatttcctgtgcgatatccagcaaacacttgtcaatgatctcgactatcaagcattaatggccaactttcaagagaacccctcagcctaccctcaatatcgcgtccataacgggtatctgttattcaatgaccgcatctggttgaataaaaccaacccttacattccatccctcttatcagaatttcacgctacaccactaggtggtcattttggagtaaccaagaccttacaccgcattgaagcaagcttcttttggcagggattgaagcatgatgtccagaagtatatccgggagtgcaaggtctgtcagcagaacaaatcaagcaccaagcgttcggcgggcctgttacaaccactaccatctccgataggggtctgggaagacatttccatggatttcgtcacccacttagccctatccaacggctttactattatcatggttgtagtcgacagatactccaagggagtgcatctcggagccttacccacaggatttttggccttcaaagtcgccatgcttttcatagaaatcacacagtggcacccaccttcggttaagcacggcgtcctcgaacaatatctccggtgcttcgtcagctctcaaccatcatcgtggttccgctacttgtcactcgcagagtggtgctacaatacctcattgcattcaagctcccgactaaccccattcgaggtcatatatgggaaacccccacccacaatacctcagtatatcccaggcttaatgaagaacgaagttgttgagtcactggtcgaatcacgacagaacatgcatacaaaactacagaagcggttgaagaaggctcaagactccatgaagaaacatactgatgcaaggcgtgacgatgttaccttcgctgtaaaccaatgggtctatgtgaagcttcgaccaactcaccagcgatcagttacagggacacatcacccaaaactatcaaaacgatacttcgggccctttaagatccttgctaaagtgggtgaagtcgcatatcggcttgatcttccaattgaggcccgtatccatcctgtctttcatttctcgctactgcgccttcatcatggacccccaccttcatcgactgagccgtggaccttagagatcgttggtcagaaacccatgcaacgccctctttgcattttggatagtaagcttgatacatccacttctcctccaacccagctagttctaacccaatgggttggccaacctcccgaagacacttcctgggaaccctggctcgagctacgtgacacctaccaccttgaggacaaggtggtttccaaggacagaggtattgctagcattcaggcctctattgatgctaacgaagaagctcacagcgccaccatgacagatgatgctcccgcaagaccagcacgtgccgtaactagacttggatacttaagagattacattagctag

SEQ ID NO: 35617 - DNA, 231 bp, Glycine max
  Peptide Sequence Number=SeqID_152395
atggcactggaatactggatgaactgtttgggtgaacaatgcaccgctggtgaagtcatacgatgtgtacagattgaaaatggaggcaagaaaacctggctttatgttagcattgaggcctttgatgatgctaacgaagaagctcactacgccaccatgacagacgatgctcccgcaagaccagcacatgccgtaactagacctggatacttacgagattacgtcagctag

SEQ ID NO: 35618 - DNA, 1203 bp, Glycine max
  Peptide Sequence Number=SeqID_152396
atgtcgagtgtaggattgacctctgttgatgttgaaggtgctgcttttgattcggcttctcaagtgaatgtccatgggtggactattaacaataagtactacactgctgatgtttctatctggatggctcatctcaatgacgatttttctgctgctaacgtgcccgtatttcgacgaatgactgcgctgccatcctccctagcagcacttcgagaatgggtatcccacactgatattcagaactttgagatattgctgtgtattggaaacaaagtggacctggttactggtcacccagcccatgctgaatacagaagacggttgctgaaacttgaagactctgctgcagatctttattcagaagagtatggaatatctgaattggagggaaccagtttattgggggatgaagaaccgtcatgggacatcagaagatcctgcttggaatggtgcactgatcacaatattgagttcattgaggcatgtggttcaaatgctgattttgacaaatgcttgtccatagatggtgatttacaaggagttgagcgtctctacggtgcactttctgctcatatgtggcctggaatggtattgaaatctggcgataggataaatcaaccatcatttcctgagaaagaaggtattttacctcttcaattttccttctttggagcatgctcttgctgcttttgtcaacatagaataagtgcaagtactgattttggtttatccttccccctctccccctcagagttatcttcagaagaatctgattatgaacaagagtatgaagtcttatcagctggctcagccgattgggatgaaagtgaacaaggatgggtttctgcatcgtccttaggtgcagggggatcagctcctcaaaacaatcctggcacagatggtcaacatgaggatgaaattaaatctgataaagagtctcatcccacaacctcaagccctacaattcaggatgagagtgacaaggatgtggtgcacaatatcatggattccaaaggcgatgggaaggaaaacgaggctaaatgtctcgaattagaggatttggaacagttaatgtctgagattgggaatatgcgtgcaggcttaagattgatgcccgattttcaaagaagggatatggctgcaaagctagccatgaaaatggcttccatatttgggggagagagtgatgaagaggaaatttag

SEQ ID NO: 35619 - DNA, 603 bp, Glycine max
  Peptide Sequence Number=SeqID_152397
atggctgaccacggaaccaggaagacaaccacaaatcgtctagaggacgctattgcacgcctcaccaacagccaggccaacctcaacgaacgatacacagatctctccggtaaggtagattccattttggatcacctccgattatgcggtacgcaccagaaccaaccctccgtgagtaacacgaactgccaccgcaacaccgttaagcttgatatcccgtggttcgacggccgtgatcccctagggtggatattcaagatgaaccaactcttccagtaccagaacacaccggaagtggagaggatcaccgtggcttccctataccttgatggtgccgccctcagctggtatcagtggatgttcaccaacgactttatcacttcatggcaaggattcctccaagcattggagtcacgattcgcaccaacgttctatgatgatcgaaaaggtgctttattcaagtcttcctccaccattcctattaagttgctttatctcgggattgaaccccgagcttcgacgagaggtgttagctatccaaccaatctccctcctttaagccactgccctcgcgaaactgcaggaggacaagttacgagatag

SEQ ID NO: 35620 - DNA, 459 bp, Glycine max
  Peptide Sequence Number=SeqID_152398
tatggaaaaggggattgggccaaaattgcagaagaatttgtatgcaacaagactcctcaacaagtccagagttatgctattatcttcttcaagaacctacagcaatcagtaaacccaccaccaccaacatactcatatggctatagtagcaagaacccaacctactttgcaccttaccccatgtcaaggaatttaaaccctatggtggatccatcagcctcaaactccatgtctatgattgttaaccaatcacaacaactcttcacacctgtcccaatgaatgttccttttcccttggttccacaatatggagaagctagcaccagcaccaacaccaacaccatagcgtatgggttccaaactcatacaagtggtgcaactgcaggcacttccatgcatgccattgctaatgataacaaagaaattgatttggagttgcgcctgggtcgaaacaactga

SEQ ID NO: 35621 - DNA, 399 bp, Glycine max
  Peptide Sequence Number=SeqID_152399
atgaggtttatggaaccattaacaaaaggagagtatcctagaaacatgagagccctggtgggaagtagattgcctaagttctccaaatggcaagccaagcttgtgaatggttcatttgattttataggcttaaactattactcctctggttatattaatggtgtgcctccaagcaacgccaaacccagtttcctaacagattctcgcaccaacactacatttgaacgcaatggaagacccctaggtcttagggctgcttcaaattggatatacttctatccaaagggacttcgagatcttctgttatataccaaggacaaatacaacaaccctttgatttacattaccgaaaatggcaaatacgccctaatacattatgtttatttttattttacttaa

SEQ ID NO: 35622 - DNA, 498 bp, Glycine max
  Peptide Sequence Number=SeqID_152400
atgggaatgaaatttgctggtgaagaggctgcttataaattctattatgcatatgcaaagttcactagttttgctattaggaaggatgaggttcgttatagctcaaatggtgaagtgaaaaggcgtcaatttgtatgcaacaaagtgaaatttaggaacataaaacattttattagggatgataggaaaaagactcatagacctttgacctgtacaggtttcctagcaaggttgtgtttgaaggtagatcccattacctcgcggttccaagttgtgtcattttgggaaggacataaacatgtattgtgtgagccaaattacgtgccattatttaaattgtactatggtttgagtgatggtgaaaaagctcaagtagattcattgcatgcatatgggattagaagttgtcaaataatgggttacatgatgggccaaaaaggtggacctgtagggatgggattcaataagaaggatttgttcaactacattgagcagtga

SEQ ID NO: 35623 - DNA, 447 bp, Glycine max
  Peptide Sequence Number=SeqID_152401
atggctacagccaggtgggcactcaagcatcccgtttatggaattgtgatactacggttgggaatttacacaaacagatccaacgtttccaagttatgttcttccatcagttcaatgaattcatccattcttatctcagttattcccgaaactaaactcttagcgacgactttcctaaatgaaaaaaaaattctacgcgattccggactttctacaaacactattgacaacaatgaaacaagtactgacgtaacgactcaaacgatatataaaagaggaaacataaaaagagaatatggatctagggatctcccaatcatgtggctccgcatgccaccggactcttgggtcacggtaacaaaaagtggggtggtcgacaaaagcagggcttttgctcctacgtatcctcaatttgtgatgaggaactcagacctacgtagttcttaa

SEQ ID NO: 35624 - DNA, 325 bp, Glycine max
  Peptide Sequence Number=SeqID_152402
gatcatggccacagatccgacgtctcctccgcagtccgatggtcaatcagaggcgacttccaagaggagtagaacaacgacacggctgagaacattgacattaagaaccgtggatcagcccagaccggctgtttatgtggatcccgctaccgggagagcatccggaccgatgcgtgaaaagttccacagctacctaggcgtagtggcgcgagaaaaggttcccattatccacaataattggaaagacgtacctgaaacgctaaaggagattgtgtggaatgacattctagtaagtccttcataccaattacaatatttgaattaa

SEQ ID NO: 35625 - DNA, 390 bp, Glycine max
  Peptide Sequence Number=SeqID_152403
atggccaactacaaagttgcaggtattactccaagtgacttcaattggaatcaacaaaagaagttcctccatgatgctcgtttctatgtctgggatgatccccatttattcaagattagagcggataatctattaaaaatatgtgtcactatggaagaaaccagaagcatattatggcactgtcataattctccttgtggtggacattacagtggggataggacagctgctaagagaacagaggaaatttcttggagaaatgagataccattgcagaacatcatggaagttgaaatctttgactgttgggggattgattttgtgggccctctaccatcctcttatgggaatcaatacatcttggttgcaattgattacgtgtctaagtag

SEQ ID NO: 35626 - DNA, 138 bp, Glycine max
  Peptide Sequence Number=SeqID_152404
atggtggcgtctctggtgctctctagagctcctcctctggggttggacttgaatcaggagggagaggccttgatgaactcttcagagtgtaggccttgggggtcaccgggtttgagtgctcctttaagcttatgttga

SEQ ID NO: 35627 - DNA, 168 bp, Glycine max
  Peptide Sequence Number=SeqID_152405
atgtggtaccattttccagtgaaaaacctcgtcgggcgcctaggagtacatgacaagacatgcctcacaatgggcttacaggagcattcaaaccggatgacccccaaggcctacactccgaagagtccgttagggcctctccctcctgattcagtgcgcctcaagtga

SEQ ID NO: 35628 - DNA, 198 bp, Glycine max
  Peptide Sequence Number=SeqID_152406
atggctaggacatttggactagatcaagatgaagcaaacacaaatagagtgatgggaacgtgtgcttatatgcctcctcaatatgctgtacatggatctttttcagtcaaatccgatgtgtttagctttggtgtgattgtgttggagataatcagtgggaggaagaacaggggattttgtgaccccacaatcacctaa

SEQ ID NO: 35629 - DNA, 627 bp, Glycine max
  Peptide Sequence Number=SeqID_152407
atgaaattgtcagacacatcttcatcttggtatgataagactattagtcttcaggaatgtgagaaatataccttgagcaactgctcttgtactgcatatgctcaattgaatatcagtggcaatggaagtggctgcttgcattggttttatgacattgttgacatcaggacactcccaatgggtggacaagatttttatttgcgaatggctatagtttcaaatttagatttacaattacaagatcaccacttcaactggaagaaattagcaggaattgtggttggctgtactatattcatcattggaattacaatattcggatttttttgtatcaggaggaagaaactcaagcagtcagacaagagtaagaaggatgacattgatttaccaatatttcactttttaaccatctccaatgccacaaatcacttttcaaagagtaacaatttgggacaaggtggctttggacctatgtacaagggcatattaccagatgggcaagaaattgtagttaagagactttctaaaacttatggacaaggtttggacgagttcaaaaatgaagtcatgctggttgcaaaacttcaacaccgcaatcttgtaaaacttcttggttgttccatttag

SEQ ID NO: 35630 - DNA, 156 bp, Glycine max
  Peptide Sequence Number=SeqID_152408
atgactaactacttcctttttcctgcttttgagggaggatgcaaggattgggggacaggaattgatgtgcgcagtaaatcaagaacaatgtcaaagcctgttgaagatccctctgagctccctaaatggaactatgatgaatctaggactggatag

SEQ ID NO: 35631 - DNA, 462 bp, Glycine max
  Peptide Sequence Number=SeqID_152409
atgtcctccacattggacatggttactccaactcatcccatcagagatggattcttcaaccttgcaaactccaacaaccgataccttggagtttggtacaaaaacatatttccaagaacaactgtttgggtagcaaacaaagaaacaccacttaaagacaacactggcatcttagaagtaggcactaatcaaggaattcttagcatcaaggatggtggaggagccaaaatatggtcctcaagtgcatcacacacaccaaacaaatcgattgtggtgaagttgttggaatcaggaaacatggttatgaaagatggacataacaaccttttatggcaaagttttgattatcctagtgacactttacttccaggaatgaaaattggagtgaacttcaaaaccggtcaacatcgagctctaagatcatggaaatctttatcggatcttactctaggtaatttttga

SEQ ID NO: 35632 - DNA, 420 bp, Glycine max
  Peptide Sequence Number=SeqID_152410
atgaatgtatatacctgtagccggaggagcaggtctccaccaaaggtcgctagggtctccgtgtctttcaaccctgccgctgcctctggaactcgatgccatacctttctaaacaccataattcaggttccacgaaaatgccattgccgttggtctcgattgcctccgttcagcaactcctcttcggcgatacgattggtaggttttgaaagaggagcactaggcctcgatcactgccattcaggttgcagaaccacatccgactcggttccggttgggtgtcgtcattctggtcacagattcagtccctcaatgcaacgtgtggttgtgtgttccttagtaggcacagcagagacgaggattggggctggactggatgcggagcctctgcttctgatccttcatgggattggggcttag

SEQ ID NO: 35633 - DNA, 168 bp, Glycine max
  Peptide Sequence Number=SeqID_152411
gtcacttgtgctgttctcatcgccgccgcctccgtgagcgctgtggtggctgccactgaggttccagcccctgcccccggcccaagcagtggagcttcagctagcttgccccttattggctccttggttggtgcctcagtcttgtctttctttgccttgttccactaa

SEQ ID NO: 35634 - DNA, 877 bp, Glycine max
  Peptide Sequence Number=SeqID_152412
aggactacacgtcttcgccatcagaggaatacacgtcctcacaatcagaaggctatacgccttcaccttaagagggctacacgccctcacctttagaggactacaagtcctcgccatcagagggtcgcatgccctcatcttcagaggactacacatcctcaccatcagagggtcgcacggcctcatcttcagaggactacatgtcctcacctttagagagctgcagttcttcaccatcagagggttgcacgtcctcccattcagagggctgcacgtcctcaccatcagagggctacacgccctcacctgcagaggactgcacgcccttcctatcagagggctacacgccctcacctttagaggactacacgtccttaccatcagagggcttcacgccctaacctgcagaggactgcacgtcctcaccatcagagggctgcacgccctcacctttagaggactacacgtcctcgccatcaaagggctgcaggccctcatcttcagaggactacatgtccttgccatcagaggagagctgcagttcttcaccatcagagggttgcacgtcctcgccatcagagggctgcacgccctaaccttcagagggctccacgtcctcaccatcagagggctgcacgccctcacctgcagagggatgcacgtcctaactatcagagggctgcacgctctcaccttcagaggaccatacgtcctcgacatcagagggctggacgccctcacctttagaggactacacgtcctcgccatcagagggctgcacgccctaacctgcagaggattgcacgtcctcaccatcagagggctgcacgccctcgccatcagagggctgcacgccctatcctttggaggactacat

SEQ ID NO: 35635 - DNA, 264 bp, Glycine max
  Peptide Sequence Number=SeqID_152413
atgactgaatatccaaagtacattccattgcttgccaagattttggaaggtttagtttctaggagtagtatcaaagacaaattccatcatgatgaagagaaaatcaagaaaaagatggaatcaacccatgaccagttggtagaggcactttaccaaaaggggcttgcactagcagaaattgaatctttaaagttacaatatccattcatgcaaaacagggaaattaaacaccatgtagatgatattgaaaaggcccaaacatag

SEQ ID NO: 35636 - DNA, 399 bp, Glycine max
  Peptide Sequence Number=SeqID_152414
atgcctacgggggatgtctttgttttccgtggttgtttcttcacgtttcaatgcagcctctgcttctctcctgaaattgttaataatctttttctaaattggccttttgtgaaatttttgtggagatggttggctagtaatctgcactgcagtttcaaccttggctcattcacatccttcttggctgcttgtgatcatttctctggcaaacaacttcttgatgttgctttggctagttgggatagcaaatgttatttggagaatttggatgttagaaatcaaggagctattttggtcattgaaactacttggcaaaaaggttggattagattttggcttaacacagactcatcagcaatggttgttcaatcttcctctaaaccttctcttctcccctaa

SEQ ID NO: 35637 - DNA, 690 bp, Glycine max
  Peptide Sequence Number=SeqID_152415
atggttaagcttgccccacttgaagagccccttttgaatggtgactctaatgtaagcaacaattatgttcccattaaggctagaggaaatgaaactttaacccggtattcaaatgctggattttccagcattcttactttctcatggatgagtcctttagtaactctaaggaatgagaagactttagagcgtgaggatctcccacatcttgctactaatgacagtgtggatgggattttgccaactcttacaaacaaacttgagtcagagtgtggtagtgtgataacaaccctacgaaaatatgaggttactgcacagatgaacaacactatgctaggtgagcctcacagcaacgacgacaacctaagggtggctatgcgagactcagcatcgagggtcaaggacaatgacagtgatgacgacggcctgagggctaagaaagttttcaatcaagacctttattttagaaggacagtcaagtatgttggagatgccatgactcacttggaatatattgcatcctcagcggcaagacaatcacttattgtgagaggtctccttcctatgcttgcagatcctcaacatcctaatatgtatgctcagttgttgcctcttgctttgcctacaccaccaatgggtggattggggatgcctctaatgccacctttttggtatgccacccatgggtag

SEQ ID NO: 35638 - DNA, 222 bp, Glycine max
  Peptide Sequence Number=SeqID_152416
atgtatgctctagaaaattggtttagacatttcaacaaacaccttatcggcaacaaaaacatttttaaccctagcacacaagagtggcgtgcacgacgttttgataatgaaggttgggtcaccgacgtttgggctgatgattgtggaggaccggacggtacaatcaatttgaattatggtttggtgtttggaggtgtgggtggtggccgtttgaggcattga

SEQ ID NO: 35639 - DNA, 558 bp, Glycine max
  Peptide Sequence Number=SeqID_152417
ggtacctttgagatattgtctttatctggagcatgtacctacactagtagcccttctggtctagttcgtaaaactggctcgttgagtgtttcattggctagaactgatgggagagtttttggaggtgttcttgagagtgcattggtagcagcttgccctattcaacttgttatggcctctttcaagcaaaacatcagcagccaacaaattaagagaaaacagttgtctgaatcttctaatgcaccccttatgctgtgcaattcagattcagaaagggaccaactgaaacttccaaagttgacaggaggtgagaagagttgtccttcaccaccaccaacaacacttgagccaacagcaacagctaatggtgtagcagataatgtctttgttgcaacatccaatggaatggtagataatgctattactccagatcacaacgtgcactctccctctgttaatggtgttgttgatttagacagccaggccccgcagcccgcatcagacgattcagaccaaaggacttatgcagatgtgagtgcaagtgtcatggtgttatga

SEQ ID NO: 35640 - DNA, 819 bp, Glycine max
  Peptide Sequence Number=SeqID_152418
atgacggagaagcaacctttgaattctatgggaatagttaatatgggggttgatattgatgcggttacaaatgctaatatcatgaggaataatgacacgatctcgcaacaaatcaccgaagaatcaacggataagaggcaaacatggtgtccaacacaaacaacactggccgcaagtgggaccgtgaatgccaagagtggacctactactagtggagccattatctatgatgttgggtttgggaaaaattctacaatcccaatgaagactattgtctcacataatagattcactattttgcatgagaatgacaatgaagctcatactatggatgtgggtaataaggaatttcacgttgaggttgatgacatgattttagagactcctttggaacttcaaatcgccacggattgtttggaaggccaagaatgcaattatttttcaagacagccttggaacctatggaagaagttggacaaaccaacaggctatgttggttggaaaccccctatagctccctctattaagctcaatattgatgagagctcttttggtgaccccggaatctctggttttggtggtgttttgcgtgatcaaacaagcaaatgtctctctagtttttctgggaactatggaaatacaacatgcttgaaggcggccttgtttgcagtttatcatggtttgaagacagcatggcaacgtggttttaggcatgtggtgtgcgaatcggactctaaaattgctctgggtttaattcaagatcacgtggatccttttcacccatatttctctctggcattgttcatccgggaccgctag

SEQ ID NO: 35641 - DNA, 435 bp, Glycine max
  Peptide Sequence Number=SeqID_152419
atgagtgggggcagtgaacaaacacctagcatggacaatttcttatacctccatccgaacgagaatccagcagttactcttgtctccctggttttagattccaccaactatcattcatggagcagatccatagaatttgtagatggaagtgcccctgaaccaccaaagacagatcgaatgcatggggatcttcttcaaatcttgaatcttcagcaagaagcatcatcaatgaagcaaggtgatctatctgtcacagagtactttacaaaattacgcattatatgggatgaaatagaaaatttcataccaaaccctatctgttcttgcactgtgaggtgttcttgttctgttctcgttaccattgcacaacacaaactcgaggatcgggctatgcagtttctaagtggcttgaacgagcaatatagcaatgtttga

SEQ ID NO: 35642 - DNA, 295 bp, Glycine max
  Peptide Sequence Number=SeqID_152420
gaaacatgaatttcctcttggccacaaattttataatgcaaagaccattgcgaatagcatagtgacagttgatagcaaagtcactgatgaccaaacacagcaccataagtctcaagaggttcgtctctcacctgagcagtataaagcattgctcgctttaatccaacaaccatttcctggaaactcagcatctactccatctcatgtcaaccaaattgcttctgtttcttcatgttccactaatccaacaccaacctcaggatatgaacactcaagcaaggattggtacagttga

SEQ ID NO: 35643 - DNA, 675 bp, Glycine max
  Peptide Sequence Number=SeqID_152421
atgtctatttctgcctctactgaatccacttcttatgttgaggcttctcatcatgattgttggattaaagcaacgcaagctgaattacatgctttccaaatgaatcacacttggactctcactaccttaccacctcataaaattgccatcgggtgtcgcggggtgtataaaattaaatataatgttgatggttctattgagcggcataaagcgcgcctagttgcgaaaggttatacacaaatggagggattggattttttggatactttttcaccggtggccaagctcaccactgttcgcttattgctagccttagcagctcttaatgattggcatttgaaacaactagatgtaaacaatgcttttcttcataatgagcttaatgaggagcggaaatacacattagatatcctctctgattctggtatgcttggttctcaccccacttcaacccctatggattattctacctgtctgaatgccacctcgggcactctactatctgcttcatattcatcttcttatcgtcgtttagttggatatctcatctacctaacaaatacgcgaccagacataactcatgttgttcagcaactaagccaatacatggccaatcccactactgctcattctcaagctacatatgtgttctccgttatcttaagggcaccctag

SEQ ID NO: 35644 - DNA, 123 bp, Glycine max
  Peptide Sequence Number=SeqID_152422
atggcttccatcattgtggccatttgctctttcaaggcctccgtgtcagccttcattttctcttgcacctcctctacttcacccattactctagctctaacaagggtttggacatggggttga

SEQ ID NO: 35645 - DNA, 720 bp, Glycine max
  Peptide Sequence Number=SeqID_152423
atgcaatatggggcactattaggcggtaagcgcctgcgcccgtttctggtgtatgccactggcgagatgctgcgcgccgaggcggccagcctggatgcccccgccgcagcggtggagtgcattcacgcttactcattgattcatgatgacctgccggcgatggacgacgatgcgttacgtcgcgggcagccaacctgccatatcaaatatggcgaagacacggcgattctggccggcgatgccctgcaaaccctggcgtttaccattcttgcggaccagccgatgcccggcgtaagcccgcaggatcgcattgccatgatttccgaactggcgcaggccagcggcgtggccggcatgtgcggtggccaggcgctggatttagccgccgaaggccaatccgtggacctgaaccagctggagcagatccatcgccataaaaccggcgcgctgatccgcgccgccgtgcgtctcggcgccctcacagcaggtgcagcgggccgcgaagcgctgccgcagttggatatctacgccaacgccatcggactggcgtttcaggtgcaggatgacatccttgatgtggtcggcgataccgccgttctgggcaaaacccagggcgccgatcaggcgctggggaaaagcacttacccggcgctgctgggactggataacgcgcgggccaaagcgcaggatctctatcgcgaagcactgggcgcgctggag

SEQ ID NO: 35646 - DNA, 162 bp, Glycine max
  Peptide Sequence Number=SeqID_152424
atgtataagcaggagaaagtgacgagggggttgatattgaccttggtttcatggtcttcaaccggttttcttgtaaactttgattctcttccatggaatgtgagtgttaagatgttgttgttggagtttacgcgagtgttcgggatagagctattagaatga

SEQ ID NO: 35647 - DNA, 390 bp, Glycine max
  Peptide Sequence Number=SeqID_152425
atgaatctttcattcgggctccatcaaagcatccagtccacctatgtcaataaccgcaccgaagctctcatccttgaactgcatggcagtcatgtccatgatgtgccatcgcatgaggggacggtcacggatgttgcggcagagcatgttggagatgacgatcttggagaagtcgatgttggtgatggcagtgtggccggcgtcgtggaggtgctcagagaggcgagagttgccacagccggggacgaggagctgaagcgggagaggaacggttttggggagggagaggagtgggcccctgaggttgggccattcaacataccactcgaaggaatcgccgcgaagggtgaagaacttgtcccagttctctttgcttgtgaagtctcctag

SEQ ID NO: 35648 - DNA, 444 bp, Glycine max
  Peptide Sequence Number=SeqID_152426
atgagtggtcactattgcgttgttgttggagttctgccgcgtcgtgccatgaatacagatctggttcttaccccttcagtgacatcaagccaatgggatggccatttttggattgtggcttccatttcatgtgctggaaaatcatgtgcaaataaagaaaggggatggggacaagggaaggcgtgtgtggaaatcaggcaccggagatctgggacacgcgactgtggcagcagaagcccatggtggtggcggagtgagggcccaccatggattgacactggtggagacatagagcatgcgggagtggttgaaggcgacaacaaggatgaggaggtggtcgctgaagacgagagagaaggagaggactttctctttaaaaagattgagatgtgtttcatttctttaaaaaaagaaatgagatctgttttgaaagatgaaggttaa

SEQ ID NO: 35649 - DNA, 237 bp, Glycine max
  Peptide Sequence Number=SeqID_152427
atgttgcaaaaaagcaatattcttgttttagtgcaacaatctcaagaagtagcagaagaagcaagtatccttctgtcacctttacaacaagattcttcatcaaagtctactcaaagtcgagtaagatctttggtggatatatatgaatcttgcaacacagctatggttgagcctaaatgctatgaaaaatcctcaaagaagcaaaggcaactaattaagcaaatcaagcttgagtaa

SEQ ID NO: 35650 - DNA, 360 bp, Glycine max
  Peptide Sequence Number=SeqID_152428
atgagacttgggacccaaactggctatgtaaaggaaatgcataatgtttctcaaaatcctggtacaaatgatggtagggcatatgttacaaaaggaaaagtagcaggagctatgcataaaaagcaaccaaagccttcatatgatgcaaagtcagaggctgcccaagtggtgaatggttgcaatggatacagtgtatactcaggaccggcaccagtctctggatatagtgaaatgcaaaggtatcatgctggcagctgcactagtgcagttaataacagtgcggttactgtagtacatgtgattaagcttgtgcttcagtccctgatagctagtagctttttttcttacaacaacgattga

SEQ ID NO: 35651 - DNA, 324 bp, Glycine max
  Peptide Sequence Number=SeqID_152429
atgcatgtcatcacgctacatagacattggcatgctcatccgcatctgatagagcgtctgaaggtcctcgtcgcggcgtacttggggaacctagtggtggatttgatgatgcctttgaatctgatgctccactccaccactggtaactcgagtgctgagttgacgagttgggcgagtttctcgttgagggtaagtcccgagacaaggtcttgggttcgctgggcgatagggagcttggtgttaagcagaataggtaaggtgagttggaggacaagttgtaggaataaggagactgagttaactcgacgtggtggtggagaatga

SEQ ID NO: 35652 - DNA, 189 bp, Glycine max
  Peptide Sequence Number=SeqID_152430
atgggggaacaagaaattgaaggagaaaaagagggagagaagttgaactgtgaagtgtgtctcataagactctcattcatcaaagttgtgacaagtgttacacatgtttctatttatagcctaggaatattccaaggatatgccaaaggcatcttagaatatttcaagaatatgccaaaggaatcttag

SEQ ID NO: 35653 - DNA, 258 bp, Glycine max
  Peptide Sequence Number=SeqID_152431
atgacgtcgtttttcccaacggagttggatgagaacaaagacgatttcatggtgttggagaatccaatttttccgaccctttctagtggaataagactttattgttatcggagaatccatgttttcaaagtccggatgcttgttgacaagagaagacaccgactttgtttaagagtgtgggtgccattagggagaaaaaacatggactggccttccatcagggtcccaatgctgaggtatctggcaaaagttttgtga

SEQ ID NO: 35654 - DNA, 498 bp, Glycine max
  Peptide Sequence Number=SeqID_152432
atggctctggagggaattagtgaagaagatgctcctcctggtgcttccatacctgatgatgcttctaatcttgattactctatagctatacaatatgttggtccaccagtttcatatgaagtaccaagagttgagccttttgatgcaaactcaagagcaattcccactgctcaaccactctctagatcacaaagatcaaatactcacggggggcatatggtgattgaaccaatccctctactggtgtctcatattgctagcgtaacaagctctcctaatcaaagtccaagggtgtcaggaagttcagattctatggtttctgtcttacacaacccagatctttattctgcatcaccttcggcttcgccttcttcaattcataatcttctaagcaatcctcataagccaggtaatgaagtgaagagggcctcggttgccacttttaatactattgatagacctcagaggaaggaggtggaggttgtgaagccagtttga

SEQ ID NO: 35655 - DNA, 418 bp, Glycine max
  Peptide Sequence Number=SeqID_152433
agaaggacgcagaggaagattggagttcttttcggagaaagaaaaccaagaaacacaacaaccacaccctggaaaagggaacgctccagagaagaaccctcattgtgttgccgtggtgttgccagagaaaaagcacacaggggggcgtcaatttcttttgtcgttgtgtgagctttatattaaagcatcttcaaaaggacgaccctctacaatcagggaggttaatgtagaagcaaagcttcatggtgaatcaaagaacaactcaagtgaatcaagaacaattcaagagttcaagataagaatcaagaagaattcaagactcaagaagaaagttaagagtcaagaatcaagattcaaggttcaagatctcaaaaatcaagatcaagactcaagattcaagaatcaagagaaggcttaa

SEQ ID NO: 35656 - DNA, 555 bp, Glycine max
  Peptide Sequence Number=SeqID_152434
atggggaaaaggggttgcattagttacaatctcattcttactataagacaacttggctaccctatgagaggggcaccactagaggaagagctcgcacctgtcatttcacgagggttcagtgagaccaacgtggagacatatcggaaggcccgcaaagcatgggaagtggtacaaaagaaggacaaagagctcagaggcagcaacaatgggcccattggtggctaccgtaagtggttgaaagcccacgtgcaaggtttggattggctcccaagtctgaggaccgctaaaagggaagaagttgaggcaccagaggaagacgaagaggtgcaggcccttaggacaggactcaagcaggctcaaacagtgaaagaaagcaagtaccaagaggaactaagtctagccatgacccacgagcatagagtggcggacaagtatgcccaagtgtacgcggaaaaggaggctagaggaagagtgatcgactcattacaccaagtggcaacgatgtggatggaccgatttgctcttaccttgaacgggagtcaagaacttccctga

SEQ ID NO: 35657 - DNA, 804 bp, Glycine max
  Peptide Sequence Number=SeqID_152435
atggatgactggaacattccagaaatccctcaggatcaactatatgttcctgaaacaattaaggacaaacacaactttgattacataatcaaaatagtagaaaacaatattcctctaggacaagatataggggaagaatttcatttactttcaaaaaattcaatttatgaacatagtcgtaagtataaatatctacacatcggttatgtacaagtagccatcaagcccttaattgacatgggcatagatgcaacagttttaatgtgtctaagagatattaggcataataaatttgaggactccttaattggaacagtcgaaaccagtttaggacaagctccagtatatttcaattgttatccgaataagacagtgagtttaatggacaagaatattcttgactctctgttcttaaatatcaactttcatggccttgacatgaaagaaggatcaatcccagcagctttgatctataggatccagtacaaggtcatgaatacttgtgcatctagagtcctattgcaaccacaaaagggagaaacgaccttatttatcactgatataacaaaagccaatgtttctttaaaaagaataataaaacaggatgatgtaactctccccgaaaaatgggacatggagaaggccacaccgtctgatccccgacccactccaattattgaaaaaatcaaacaagacaattcaggaaaggtagaaataaccttcaatagaagaaattcacatgaatggaacatagatgcacaaatggagtataacatcgtgaatgcacaccaacatatgatcatg

SEQ ID NO: 35658 - DNA, 585 bp, Glycine max
  Peptide Sequence Number=SeqID_152436
atgttaaaccctagcaacattgggacatatatatgtggactgttcactgaaaaccacagaaacatgcgatcagagaagaaatcatgttcgccactcctctatgacgaactcatcaaggaaatcttgtctcgtcttcccgtgaaaactttgatccaattcaagtgtgtgtacaagggatggaactccctgatgtcagatccctatttcatcaaattgcaccttaacaaatctgctacgaaggacgatttggaacaccttcaactgatgaaaaatttcattattccattccctacaattaaaacgtccttgttcaatttcgcaaatataccaagttaccatctggtcggttcatgtaatgggttgcactgtggggttagcgaaataccagaaggataccgtgtttgtttctggaacaaggagacaagggtgatatccagacaattgccaacgctgtctttttccccgggcattggtcgtagaacaatgcttgggtttggctatgatccgtcaagtgacaaatacaaggttgtagcaattgcattgactatgctttcacttgacgtatctcaaaagaccgagatgaaa

SEQ ID NO: 35659 - DNA, 396 bp, Glycine max
  Peptide Sequence Number=SeqID_152437
atgtctttcgtattgaattcaactttgggtatgggtggaaacgattttgagggctccattcaacaacccctggttgagtcagtggttattccgatcggtgattcctcgatagaggaaccacaccatgaggcttctgacaataggtcttcctctttcgagaggttgctggacctgcgccatatcagagagggtagctctcgggcctgtgagagggtcccaccctctgcttcttttttggaggaggagcccatccctgtcatcacaatccttcccttttctcctccgacagttagaggaatgggtgacggtggcatcattagggtttcgcctcagagtaggcatagtcatagtgctgggacattctcacctcctccattcgttgttggctatgaatga

SEQ ID NO: 35660 - DNA, 237 bp, Glycine max
  Peptide Sequence Number=SeqID_152438
atgacccaagagctggtagcccgcagagacaccttatggttatccgcacctcgtcattcagtgaccccaagtgtgattgatgagcagaggccaatgtggtcatatgccccctttccggagatgtcagcattttccggtggagactttttcaagtctcacaagatacgtaggagcaagagcctcgcttttgttggccaccctcacaagttctgtcatgctggcactggagtcacgtga

SEQ ID NO: 35661 - DNA, 1927 bp, Glycine max
  Peptide Sequence Number=SeqID_152439
ctcgaatccgagcggcgggtgggccaggaagccctccagcagcgcggccggttccagcgcggtgctggatgcgcgtgacgtcatctccatcggcacgggaaccggcagcgcatcgacctcagcccttggccttggtcagcgcctggtcgagcaggatgatcgccaggtcgatttcttcgtagctgatgtccagagacggcgcaaaggtgatcacgttcttgtaccagccacccacgtcgagcacgaggcccatgcgcttgccgtcgtgcagcaggtcaccggccaggccgatgtcgaccatgcggtccagcagttccttgttcggggtgtagccgtcggcctggcagatttccgcgcgcagggccaggcccaggccgtcgacgtcgccgatttccgggtggcgcttctgcaggccacgcaggccgtcgaggaagtacgcgcccttctccggcacggtgcgctcgtagtccatttccttgcccagcttcagcacttccaggcccaggcgggtgcccagcgggttggagttgaaggtggaatgggtggagcccggcgggaacacggtcgggttgatcagctcttcgcgagcccacaggcccgacagcgggttcaggccgttggtcagcgccttgccgaacaccagcacgtccggtgtgacaccgaagtgctcgatcgaccacagcttgccggtgcgccagaagcccatctggatttcatcgacgaccatcaggatgccgtacttgtccagcacgcgcttgaggccggtgaagaagttgcgcggcggaatgacgtagccgccggtgccctggatcggctcaacgtagaacgcggcgtactcggcctggccgaccttgggatcccacacgccgttgtactcgctttcgaacaggcgctcgaactgccacacgcagtggtcggaatactcgtccggggtcatgcccttcgggcgacggaaggggtacgggaacgggatgaacatcgcacgctcgccgaagtggccgtagcggcggcggtagcggtagctggaggtgatcgaagacgcacccagggtgcggccgtggtagccgccttcgaaggcgaacatcaggctcttgccgccgcgcgcgttgcgcacgatcttcagcgagtcttcaatggcctgcgcgccgccgacgttgaagtgcacgcggccgtcgaggtcgaacttctcgtgcatgtccacggcaatggtcttggccagctgcacgcgggtcgggtgcaggtactggctggcgacctgcggcagggtgtcgatctggtccttcagcgcgtcgttcaggcgcttgttgctgtagccgaagttgcaggccgagtaccacatctgcaggtcgaggtagggcacgcccgcaccgtcgaacatgtagctgccttcgccgcgctggaagatcttcggcgggtcgacgtagtggacggtgtcgccgaaggagctgtagcgggcttcgtcggccagcagctgcgcgtcggaggcagcggcgtcggcgttcttgtcaaaaatgttcatgcagttcggttccgtgaaggacgttcgaaagaggtggcgggggcgtgctcaggcggtggccagcagcaggggcagtgcggtgggctgcgggctggcgtcgatgcggcgtggctgcagcaggctgccatcgagcagacgcggcaacagcgcgattgcatcgtggaaggtagcgatggcggcatgcccgatgccggcattggcgcaatgggtgatcaggcggcgcttggcgaacacgaagtcggcatcttcggatacgcagaaatccgagctgccgtcaccgatcatcagcacgcgcggtgcttcgttggcgcgcgcctgcgcggcgcaggtgcatttgcaggtgccactgcggcagccttcggcctggtagggcgattccagttcccagtggtccccgcaccagcgcag

SEQ ID NO: 35662 - DNA, 221 bp, Glycine max
  Peptide Sequence Number=SeqID_152440
atgggggtgtggccactgaagtccatttgctctgctcctttcatctcattctcactcaggattcactcttttgatttccgctggctggacaggggcagccggggatggatggttatcacactggcggataacgaaagggcagatgttagcatttttgcgcagcccgcttcatccgccagccgatgtttctggctggcgaccatatcaaattgcgacaggcg

SEQ ID NO: 35663 - DNA, 338 bp, Glycine max
  Peptide Sequence Number=SeqID_152441
atcttctcctttgtaaaaagacacttgttagcactgtcacacctcttgggcttgaggttattcctcaagtaaagaagttgttggatgagggggttcccacggaccctaagagaataaaggtcattcctgattggtccattctaccaacaccactcactgagttggtgaggaaccatgttccctcatgggaagatgcccaggaaagaggtgtcaaaggaaggagcccagagtatcaagaaccttgggattttaggtcaaattctttccaaggaggaagagatgattcaatcctacccccaaagggtattggattgaagactcctataggattgggctag

SEQ ID NO: 35664 - DNA, 396 bp, Glycine max
  Peptide Sequence Number=SeqID_152442
atgaccgacagattacttgttgggtcactaacttttgattgttgcatcatgcattatatcattgttcgtattttgcttcctcggtcttcaaaccttgcccaagcctctgaagaggatttgattctgatgtgggcttttcaaactagtcgtcagatcgactgggcccatttagttcggtaccgaatgcataaggcattacgggccaatgcacctctgccttatcttcaccttgttactctttttcttcatcatttcaattttcctttggattatgaaccatttgtcaaggacttgccaccgcctattctcgacgaacgtaccctatctactccaccacaaagggctgattccacttctcttctgactgaagtactcacaaagctttgcgacctttga

SEQ ID NO: 35665 - DNA, 1839 bp, Glycine max
  Peptide Sequence Number=SeqID_152443
atggcttctccacctgcctcccctcctcctcctcctcctcctccttctcatcctcttcctccttctgctccttcggacgcatcggcttcgccgtctgccgtgaagcggacacgcaaagcctcacgtggacgccacctacgagaactggaaggaggtccctactgcttagaaggacctaatttgggaggatattcagccgatcaggacggtgtggaggacactatctgtgagaaatacgacattagcaaggaaaaatgggcccagttttgccaaactcgtagagacccttcttgggaggatgtgcgcaaaaaggcacaggtcatccagaagcagaacactgccccccacgtgctgtctcgtgggggttatgactatttggagcagaagctcctggatgagaagaccaagaagaagctggaggaagctacacagtcaggaagtgctgatggcgtcatcgaccctccatccccgatcagacgccacgtgaagtggaagatggcccgcacgaagaaaacaggggagatggcgactgaggccgcaaaggaaatcgctgagaagatcgattcctttgaggagcaggcgacacagggatccttcgtcccccatggacgtcaagatgttctcaccactgctattggacgtccagagcaccctggatgtgtccgtgttgttggagccggtgtcaccatcaagcaatactttggatcggctccacggacgtcccacagctcttcgtccctgcctcctgaagaattgcagcagctgacccagcaaatcagggaccaactagaggagtccatcacagaaaaagtgacgcggcagctcatggcatccttcagtcagatgcaatcccaaattcagtcacagatgcaatctcagggacttgcactacctcctgagcctctggttggttcctccggtcctcgagtaagcacaaaggggagatgtgttgatccctcaggaaacgatcctgagacgggtgactcagataggtgcggcttgtacatcaacgcatatcctgcccggctggttgccctagggagagtttatgagggatccactgttgttcataacactcctttgttgcctggccaagtaaaggtgagtgtagaggaggttacagatgcagatgctccagttcctgtacccactgatgaggtttccttagtggggcaagcacttcacaccttccttgcttggccgacacatctggtagttgtgtctccggtaaaaccacctccaaagcctgatccggaggttgatgatccactttatttgatgacattgaccatcctagagcttttcttgaggccttatcaggtttcttgggatgacaccatgttcggggtctttaatccagatttcccgctctacataaagcacgaagacctctctgaaatcgcacacggtggtcaatgtctcagcatatcagtgttacagttgtggattctgcatctcactgatacaagtatgcgagcggggaattctgatatctatggattccttgagccacagtccattcagaggtctgggcaatcgcagtttgagtctgaaagccagaaaactaccataaggggattattaacaggtcttgatgatgctccacagcctaaatcaaaggctcctgctaggtggattgtcgtcaagtgtaataaacaaaaaggaagtactgagtgcggctactatgtcatgcactggatgtccaccatcattttaggaacttttcggaataactgggaagcgtattttaatgatcctagaccattggagccagagagattaaaggcgttgcagatccagtgggcacaacattatctccgagttagagatcagacctag

SEQ ID NO: 35666 - DNA, 153 bp, Glycine max
  Peptide Sequence Number=SeqID_152444
atggtggttgcaggaaagatgcagaatgtattcaacgagttgttaacagctaataccttgttcactgggctacaaaacgggtcagttctgtcttatatgaatgaatgcaaggtatctgggaaatggcctaaaagggaaaaagcctcacactaa

SEQ ID NO: 35667 - DNA, 402 bp, Glycine max
  Peptide Sequence Number=SeqID_152445
atgcaacctgatctggttgtatccggaagggtatgcatctttggggcacgtcatgttcagatcagtataatcgatgcatattcaccatttggcgttggccttttttaccatgacgatgttggcgagctaggtaaaatatttgacttctccgatgaagttggcattgaggagtttgtccacttcttctctgatagctttgcagttgtcgcaacctaccctttggtgcgagggcgacgtggggatcacgggtgcgtcttccaagaaaggaaaatgggcggagtcgccaccaacgtttattcgaggaaaacgtcggaaaaactggaaaggtgtggtctacgaactttaatcgtgaaaggttcgggagttgtttttatgcacggagaaggtgagaaaatggcttaa

SEQ ID NO: 35668 - DNA, 339 bp, Glycine max
  Peptide Sequence Number=SeqID_152446
tctctacgggctatcaggctttttgtcttacagacagcaaaaaagaatgtttatacggataaccactcgggtatctccgcccgtcagcgtgtctcaaatgtcagtatgacagatcttgtgagcgcggaagatgacacagcaaaaaagaatgtttatacggataaccactcgggtatctccgcccgtcagcgtgtctcaaatgtcagtatgacagatcttgtgagcgcggaagatgacacagcaaaaaagaatgtttatacggataaccactcgggtatctacgcccgtcagcgtgactcaaatgtcagtatgacagatcttgtgagcgcggaagatgac

SEQ ID NO: 35669 - DNA, 267 bp, Glycine max
  Peptide Sequence Number=SeqID_152447
atggtacaacaaagtagttgctacaccaaaccaaatactttctatataacatgttcaaaactaaagtactcaaatcaaaagtggagaaatactgttgggcttggttggaaaaggatgaaagagaggctgagggacaggaaaatgcaaagggtacagagacaaacaaagcatgaacaggtgtttggttgctggaaacttgagagagcaaagtgcaaagtgagaaacaagcatatacgacttcatgatgcaaaaacaagggtgaagtag

SEQ ID NO: 35670 - DNA, 315 bp, Glycine max
  Peptide Sequence Number=SeqID_152448
atggggatcgcacccacaaagacacccagtggacctgaagaagtccaacagggccctggggtttccagctctgggagtgtctgtcgcccccagcaaggtcatcaggtcccccctaccaatcgagctttcatcaagaagttctgcgtctccaggcaggcacagggcgaaacaccacagcagcctggcgatggctggcagcgggcaacagacgcaccgccatcacctctagagttcacctctgctcatccacaaaaaggtttgagtattgcctacaccacatggccgaccaataggcgaccaagtccaaagccaaag

SEQ ID NO: 35671 - DNA, 192 bp, Glycine max
  Peptide Sequence Number=SeqID_152449
atgaagtatgtggtttttcatgcaaacattgatgctgaggggccagaagcatatcaggaatactacatcaagcatatagatgggtcccctgtgaaatcagatgcaaaaagacaaagagtgatacaatgtcttgcagctacaattaagagaagaggtttgaagctagaactctgcaccaccgacaaactttga

SEQ ID NO: 35672 - DNA, 279 bp, Glycine max
  Peptide Sequence Number=SeqID_152450
atggctgaaaaagttcatacacgagggttagattggctctccaagttgaaaattatcaacaaggagaacttcgaagccccggaagaggatgaagaagtccgagctctaaaaacagagctaggaaagacaagactcgccaaagaaaaattcaagttagtcactacagaaatccggaaagagtgtgccgagttacgagaagaaaatgcagctaccgcaagagctcttgaacaagaaaccaagagggctcacaaggaagagcatggccgagataaattctga

SEQ ID NO: 35673 - DNA, 923 bp, Glycine max
  Peptide Sequence Number=SeqID_152451
gtacgctggacaccctcaccttaagaggactacacgtcctcgccttcagagggctacacgtccccacctttagaggactacacgtcctccccttcagaggtctccacgccctcgcctttagaggagtacacgtcctcgccttcagaggactacatgtccacaccttcagaggagtacacgtcctcgccttgagatggctacacgccctcgccttcagaggacaacacgtcctcaccttcagacttctacatgtcctcgccttcagaggactatataccctcctctttatagggctacatgccctccccttcaaagggctacacgtcctcgccttcagaggactacacatcctcctcttcagaggactacacgccctcaccttcagaggcctacacgccctcgccttcagaggactacacatcctcgtctttagagggctgcactccatcaccttcagaggactacatgtcgtcgccttcagagggctgcacgccctctcctttagaggcctacacgccctttccttccgaggactacacgtcctcgcctttagaggactacatgtccatgccttgagagggctgcacgcccttgccttcaaagaactacacggctacacgccatcgccttcagagggttgcacgccctcgctttcagatgactacacatcctcaccatcagaggactacacgttctcgccatcagaggactacacgtgctcaccatcagaggactacacgtccaagcctttcgagggctacaccccctcgccttcaaagggctacaggtcctcaccttcagagggctgcacaccctcacctttaaaggactacatgtcctcgccttcagagggctacacgtccccacctttagaggactacacgtcctcccctttagagggctatacgctctcgccttcgtag

SEQ ID NO: 35674 - DNA, 1725 bp, Glycine max
  Peptide Sequence Number=SeqID_152452
atgccgtctctgcaaaagaaattgctagatgaagaaagccttgctgaatcagtgccacaggcacactcgaggaagcctggatggaaagccatgccttatattttagggaatgacacaattgagaggctggcaacatttggaatgcaagcaaattttgtggtgtatttgatgaaagtgtataacatggatcaggttctttctgcaaacattttgaacgcttggctagctgtctcgaatattactcctctcattggggcctttattgctgatgcctacttgggaaagtttctaacaattacccttgcatcctttgctagtcttgtgggtatggcgatagtcatgttaacggcttgggtgccgaaatttcatcctgcaccatgctcaattcagcagcagcagtttggtgaatgcacaggccaaacaaatttccaaatgggagtcttaatgtttggtcttttctggctatctattggcactggtggaattaggccttgcagtgttccctttgctgttgatcaatttgatttgaccactgctgaaggaaggcatggaagtagcatcttctacactctatactacaccacacagactctgatcatgttgatcaaccaaaccctattggtttatatccaggattctgttagttggacccttggttttgcactgcccactgtgtttatattgatttcaattattttgttgtttgctggtactaaagtttatgcctatgttaagcctgagggaagcaacttttctagcatgtttgaagtgctagttgcagcacaacacaaacgccattttcatgtgcctgctgctgaggacacagaaggagccttttatgatcctccactccatgatgattcagaaacaaagctgcctcttacaaatgaatttagatgcttaaacaaagctgctattgtagaggagaatgaattgaacaatgatgggtcaagcaaagacccatggagactttgtagcgtccaacaaattgaagagctgaagtgtttgctcaagatcatgccaatattcataaccagcattatagtcaacattccaataggacaacaagcaatatttggagtgtcacaagcattgaaaatggacaggaacctggggcacaattttgagatacatgctgggtcagtaaatgtgataatgatgctgtcaataggcgtgttcctcccaatctatgaccaaataattgccccagcactagagaaaatcaccaagcaagagggggggctcacaaccctccaaaggattggacttggacatgcatttggtgttctctcaatggtggtttcagggttggtggagatcaagagaagggaattggccatttcgaagggtgcttctgatggggttgcaccaatgtcagtgatgtggctggctcctcaattcatgctcttagcatgttgccatgtgtttggaactgttggacacactgagttcttcaacaaggagttccctgatggcatgaaaagcattggaaattccttgctgtgcctcaatgtctcagctgctagcaacttgagcagcttcatagtgaacattgtgcattcctacactaggaagctagggcaaccagattggcttgatggcgacattaacaagggaagattagagtatttctacttcttcattgcggctttgggagtgttgaatatgtgttatttcatattttgttctcgtcgctatcattacaagattacaagactcctatga

SEQ ID NO: 35675 - DNA, 195 bp, Glycine max
  Peptide Sequence Number=SeqID_152453
atggcttatgggatgagcgggaaaagtgagatcagtgaaggaggtgcaaatgattcagtggctagtgtgggagatgtgatatttgtcaagcttcgcgatagctcatggtggcctgcacaggttgttgatgaaaatagtgttaataagagtgttaaaccaagcaaactgaccaaacaattgccaagagacatcctt

SEQ ID NO: 35676 - DNA, 174 bp, Glycine max
  Peptide Sequence Number=SeqID_152454
atgtcaccctctgctatgaggtctgccacccaccctcgtgctcgaaacgactatgtagcagtgcaacttgctcccaacttccttaaaggactatgtcgtaacaggcttaccataactggtgttgtcttgtcgtcagagtcaatagcttgtcgtcataagagaggggtattgtag

SEQ ID NO: 35677 - DNA, 309 bp, Glycine max
  Peptide Sequence Number=SeqID_152455
atgaatgtggaagcagtagcgaagaaaagtaaaaaccctagaaaagggatagagggaatacttgcgaagagcgggagccatcttgttggtgagagtgctgacgacgatcagactgacgaagcggtcaagatcgtagtgggcggcaccgatgtgcatcatttcgatggcgcaggatgcgagaccgaaggtcatgggccagatggagccatgacgagcccagttcatcagatcgtcaaccttcaacatcacaaactttgccgccttcgacacgtcggcaggagaggaagcacgagggaaagggaaatgtga

SEQ ID NO: 35678 - DNA, 267 bp, Glycine max
  Peptide Sequence Number=SeqID_152456
atggagtacacaccactggtacactcttggcattttcctttcccttcactgagtgttccaccaaaaggtgacccgacggaggatattgctgccccaaatggtatcgtcattgtggaagacgaagaagcgccaaacgacatcgttgcggcaccaaaaattgaagaatcagtggcgccaaatgcgagtgcaggagaggaagaggaggccagggagaagaagggtatagaggaagaagaaaaaagggagaaagagagaggggatggataa

SEQ ID NO: 35679 - DNA, 321 bp, Glycine max
  Peptide Sequence Number=SeqID_152457
atggagtcatatgacaccataatgttggaaaagtatggagaagactcttcaaagcatccattggttgattcaacaacatgggtagagttgttaggttccaagaagagacgagtttttggaactatggcgacttcatcttcaaaggtcataggacatccctcccacacttcaatatctacacaagaagttattaaggaagttgtaaatgttgcaatgacttcttttgttgatgatagtttgatgcctatgttggagcccattatatgtttctttggtggctcccaagctaaagcagctgaggaggatcatgaggactcataa

SEQ ID NO: 35680 - DNA, 207 bp, Glycine max
  Peptide Sequence Number=SeqID_152458
atgtgcaaatcataccaactggataaggctcctctaaagtatgtttgtcatcaaagcaagcaatggttcctatatcaatatccttttgggttgagtaggtggctaccttaccctctggttgacttgatactggaaggacttcttgaactactagagaataaagaatgtgctcattggaaagctaagtatgtatctggctggatctaa

SEQ ID NO: 35681 - DNA, 267 bp, Glycine max
  Peptide Sequence Number=SeqID_152459
atggaacaagcttggggtagggtgagacttgtgagaatgcatggccctaaattctcaaccgttacagtaaccgcctcactgaagggtcaatatcctggggaaatgagattcagtttttcatgcaagcactactataaaaaagcatttccacgacatcagaataacatcggtgctatgccaacgttgttgaatatgtaccggtggcatttttgtaaataccctgacattaacgacaacgtttttggtgctgcccgatgtcgtatttga

SEQ ID NO: 35682 - DNA, 919 bp, Glycine max
  Peptide Sequence Number=SeqID_152460
atgcagatgttccagaaaggctcgccagtggccagagacgtgtcaaaagctatattacatctctcagaaaaagcagagctgaagagattggaagagaagtggttgattacctcaccggcatcatgctccaacgtgacctccgatgatacggacagtttgaagctgagaagtttatggattctatatgtcatctcaggtgccacttccaccatttgtgtgctactatcagccatccagtctctagtaaaatcctgtcaccaatgtcaagcagtggcaccagaaggcaatgacacaccaagtgatcataaagtgtgggaaaaggaacaggttgtgactgattgttcttcgagatgggatcgcgtgaacatgactgtttcccctgagcatcagcaggaaatggcttctccgctacccggaattttaatgctaccttctccacccccagaggatttaccaggcttcatggaatcccttgtgaagcaaatgtctgtaaatcttaaacgccttcacagcttagggataaaaaaggtagcagttgggttattacagccaattgggtgtttccctgggttaaatgtgatattttgccgtacgaactgcattggccttttgaacgtgatctccaaagatcacaacaaaatgttgctcaaagccgtgcaagaactcaacaaggaagcagcagtcaaatcagttttcataacactggacctctacaactccttcctctctgcaattgaaactatgcagaaaaagcgtgcagaaaagtctacactgatgaatccgttgcaaccatgctgtgagggaaacaagttggaagattcatgtggaagtgtggatgacgaaggatcaaagaaatacagtttatgtgagaacccgaaactttctttcttttgggacacacttcacccttctcaaaatg

SEQ ID NO: 35683 - DNA, 342 bp, Glycine max
  Peptide Sequence Number=SeqID_152461
atggtggtaatgtgcgaaaatgagttccgaagatggtgtccaaatttcaggataatcaaatggtttaggtgtatgctggaaaaagttagggttttgggaaaggaatcagggggaacaaatctgagaggaaggaagaatgtagagacttatggacctacatatgagttattagaaggacctacaaaagaattatttgaaggacatacaaaagaaagccataaggccgatttgaacttgagccacctctgtagccatggtaatttccttggaagttctgttgaggtctaccttgattctgtaaatatggacctcttcttcttgttgtcaatcactaggtgctga

SEQ ID NO: 35684 - DNA, 114 bp, Glycine max
  Peptide Sequence Number=SeqID_152462
atgtggttgtactccccagagtttgaaggaatcatatgtgctggagagtatgggaagtctacaatctttaagcaggcaagaaattgcatcttctcaactgcttgtgaattatga

SEQ ID NO: 35685 - DNA, 1020 bp, Glycine max
  Peptide Sequence Number=SeqID_152463
atgaaaaacattgtccgggattggtatgtggattctttccgtgatctcagagccttccccaacatcaagaatgtgaatgatgaacaagatttcactgaaatgatcaaggccatcaaagtgaggcacaacaatgtggtacccacaatggccttgggtgttcagcaattgaagaaacgtatggatccaaagattgtttatgaagatcttgttgagattcatcagtttctagaccgcttctacatgtcaaggattggaatccgtatgcttatcgggcagcatgttgagttgcacaatcccaatcctcctccccatgttgtgggctatatacatacaaaaatgtctcctgtggaggtagcaaggaatgccagtgaggatgcacgtgctatatgttgtcgcgaatatggaagtgcccctgatgtgcatatttatggagatcctgattttacttttccgtatgttccagctcacttgcatcttatggtatttgagttggttaagaactcactgcgtgccgtacaagagcgttttatggattctgataaagttgcacctcccattagaataatagttgctgatggaatagaggatgttaccataaaggtctcagatgagggaggtggaattgcaagaagtgggttgcctaaaatttttacatatctatatagtactgcgagaaacccattggatgagcattcggatcttggaataggtgataatgtgacaatggctggatatggatatggtcttcctattagtcgtctatatgctcggtattttggaggtgatcttcaaataatctctatggaaggatatgtgttcaaccgaatggacacaaattcctatgcaagctttgtgagaagggagagtttggagtttttggttcaacatccgtttgggggcctcccaacagaaaaacaaatatgcactaagttagacattactcattacacattagaactttgcactgatgcatatctccatttgtctcgtttgggagattcacaagaacctttgccctga

SEQ ID NO: 35686 - DNA, 975 bp, Glycine max
  Peptide Sequence Number=SeqID_152464
atggctggtcagaagcttcatgggggttcaagcatgacacttttgctccaaaaagaaagacttccatgctcccctgaacttattcaatctttttgttttcaaaactctgaaccttctttccaaggttcaaaatccatggctaatgttgtgaacgtcacgcataggcccttctttcaagggccagagaaagaagagaacggcaatgatgcggattttgaggtgtgcctccatcaacccggtaagacaaggaggctcacaagtgaacaagtgcagtttcttcaaagtaacttcgaggtggaaaacaagcttgaacctgaaaggaaggtccaacttgcaaaggaacttggcatgcaaccacggcaagtggccatatggttccaaaaccgtagggcaaggttcaagaccaaacagcttgagacagactatggcatgttaaaagctagctatcacgtactcaaacgggactatgacaatctccttcaagagaatgacaagttaaaggaagaggttaactctctcaacagactgattcccagagagcaagaggaacagaattctgatgatacctcttgtgatactgtcaactcacggcataaagagcataaagagcataaagatttaatcataaacacaggttctgagaatggatccgaagtgccacttcctgttaaggtaataaacaaacatgaagatgctaattcagctaaaagtgatgttcttgattcggagagccgacatttcactgatggaaaccaatcctcatatatggagcctgcagattcctcccatgctttggaaccagaccactcagatttctcgcaagatgaagaagacatcctcagccaaaacatcttgaccatgccgttcttaccaaaggttgaagatgtctgctatgaatatgatgaaccaaatgaaaattcttgcagtttccggttcccacttgaagatcaagccttctgcttttggtcatattga

SEQ ID NO: 35687 - DNA, 270 bp, Glycine max
  Peptide Sequence Number=SeqID_152465
atggcatatgggaaaaccaccgcaagagatctacacaaaaactataatataggggtgaacgaaggtatggatgaaaagggcaaaggtctagacgaaaaggacatggggcttcagttgatccatatggattttggggtagaagaagaggaacatgaaaattttggaaattcaaggatctatattaagatatttcactcttattattgcaatgcttatttcaataaatttgaggtcggtatcacaaatggaaggaaatggagggttttatag

SEQ ID NO: 35688 - DNA, 1263 bp, Glycine max
  Peptide Sequence Number=SeqID_152466
atggggcagtgggttttcatgtatgctgaattgggttgttcagttcaaatgcccatactacatgcttgtgctaactgtggcaacattgactttgctaggaagatggtatgcacaatatgggaggtcaagggaggtgttggatatgttccatttgatgtagatggaggatgggttcatgcttatgtggagaggtacaagattaggatgatggtgacactgggagttgcacttggtgacatgtatgtagaagcaaagcttcatgatgaatcaaaattgattcaaagatgttttgatgatagcaaagatgatgacaaaggtgatgacaaaaagctcaaaggtcaatcaaagaatgagttcaagatgttcaagatagaatcaataacacttcaagattcaagaggaaagttgatttcaagaatcaagattcaaggatcaagctttcaagaatcaagatcaaaattcaagactcaagattcaagaatcaagagaaggcttaatcaagataaagggtacatctacttgggtttgactgagaacaagatagggtacatctcttgtggatcagttctagtggagggtacatccactaggttcaaagagaacaagggaggatacatccctcgtggatctttgcttgtaaaaggatttttacaaggaaagaaatgtttatacttggagagtgccattggtggtttggccatgaatggttttggtcaagagagtttggatcttttttatgatataaaacgagagggtgttcagccaaatggggtcaccttcatttctgtcttgaaagggtgcaatgtggtggggttgatggagaaaggtcgaaagcattttgactcgatgatgaacgtttatgggattgaccctcgacttaagcattatggcttaatggttgatatgtatagtagagcagggcatcttgaggaagctttgaacttcatcaatagcatgcctatgaagcctatgttggtgcatggagtgctttgcttcatgcttgtagaatgtattaaaacaaagaactcgggtgagctttcaaagagaaacatagtggaactagaagacaagaacgattgtgcttatgtccttaaatcgatgctccctggttgtagtgtcatagaagttgatggtgaagttcatgagttcattgttggggacaagtctcacccaagatatggtgaaattgaattgaagctggaagagatatccaagtgtcttagactagacgggaatgtggttaacactaacactgctttttga

SEQ ID NO: 35689 - DNA, 1002 bp, Glycine max
  Peptide Sequence Number=SeqID_152467
atggataacatgggggtggtaagaaatgaagggaaactgaaaaggaagggaaaggggtggggtgggaagagggaagggcaattctgtcctttcacttatattcaaaagggagtgatcgctcctactctactaaatctgcttatggctagctcaccagaactcatctcccccatggtaccactgcaagttacggatcctggttgtggaaactccagttacccgaaaatattaaatttttcttgtggctcattagccataagtccctgccaactaatcttgttttactttaccgcgccatttgtctttagattcttcttgtcacaggtgtggatcggagctcaagaggagtccatccttcaactggacatcatcaaacagatcgacgcaaatgatgatagttctacctggatccgtcactatgctgggagcactcatggaggtctcttcgtggtaacctgcttgattttgtggaaacatcgtaatgctcggatattcaataatgttgtatgggaaaattggttcatcatcagtcaaatatggaatctccaatccatcattagaaagtttttcgtcccaaaaccaagtcatgttcatgacatcagtgctcgctggattccgcctacatcaaacttcatcaagttgaacaccgatggaagctcccttgggaaccccgacaatgttgtctttggttgtcttctatgtgactccttaggccaatggatttcaagttatttgggttcttgtgaaattgctacctgtctctttgccgagctcatcgctatctaccatggtattaacattgcatggaacaaaggtattagaaacctctactgtgaatctgattctaaaaactttattcaaggattaaaagtgaaaactcaaaaaataacccattttattcaatttgcacgaccccaattcgtgacacacacacatgtacaaaagaaaagtctttcgcaagggatttttgtggaacgattgccactgtgcatagcaaaataa

SEQ ID NO: 35690 - DNA, 408 bp, Glycine max
  Peptide Sequence Number=SeqID_152468
atggtgaccaattatgagaagctcagagagaatactaaacctcttaatgagcttgtgaccacaaccttcaagagaccagatgaagccagtagcagcaactcgtcagaggtttttcattctttaatgataaaacctaaagtcaaagaagacaacaagatgcctatatttgcagtcaaggcagatggaagagtgatatattcatataacgtaaatgaacactttatttgggatgttgctcctgaaatgtgtgattcgaactgttcctggatgaccgtgatggagacagaggatgaaacagatgatgaagatgaatgtgaaggcagatggaagccggaacccagaccttgtaaaccacctccaccaccacaagaagaagtgacccagaaaatggaccatggacgggaataa

SEQ ID NO: 35691 - DNA, 279 bp, Glycine max
  Peptide Sequence Number=SeqID_152469
atggccagaacagcaagagtagtcttatcctttcttttttatttcttttgcagaaggattatatgttcctattcagtggagaataacgaccagagaagaaagggggcacgggataatgtgtacggatcgataagcaaggctgctaaagatatgtcaccaattccagtcttcgaagatgccttgcattttctttttttgccactgaataagaatttgtgtgtggcagttgcagtttttcaggcttttgagtacttcctcaccttaatgtgttttcactga

SEQ ID NO: 35692 - DNA, 177 bp, Glycine max
  Peptide Sequence Number=SeqID_152470
atggaggcatttggtttgcttgcgggaaatgtgaaagaaaaagaagaaggcaatgtgtctgcatctggatactgggttgcgtccaatcgctcgtgtccagcggcccaaccatgtccggcgatggcggatgaacccgacacagtgttgcatgcaagtcatgtccacttacgtgtctga

SEQ ID NO: 35693 - DNA, 156 bp, Glycine max
  Peptide Sequence Number=SeqID_152471
atggtgaagagtcacaaagttaagaaagactcttggcaaggcaaacagacacaagatggtgctcctccaaaagtctcaggtcctttagaaaaagatttcaatttgcaaggcggagatggtcttgatgccaagattgtaaggatgtttttctcttaa

SEQ ID NO: 35694 - DNA, 234 bp, Glycine max
  Peptide Sequence Number=SeqID_152472
atggcaaagacgaagcgatgtcgacggctgatccgcgacaaaggcgatggatctatgagagagatggatctacaacggtggcggttctgtgatagagatagatctacaatggttgaacgatcaaaggtggaaatggtggaggtgaaagcgctattggtcattggaggcgtcggaggaggtgttgtcggtcatcagaggcagcatgtgaggatatgggagagggagggacgataa

SEQ ID NO: 35695 - DNA, 429 bp, Glycine max
  Peptide Sequence Number=SeqID_152473
atggttattagtcttgaatggtctacttacgaggatgatgatgttagaaaggcaaaaaaagtgaaagaaactttgttgaatgatatttggtgggacaagacaaatcaatttggagtttgcaatttttttggtaaaagagaaggatttcatgatgttgactctttaagagatagaattgaattggatgcaaaattttggtggcttgttcatggtgcttatgcaccaacacttcaaaagattgtccttaagttacttgggcaaccatcttcttcttgttgttgcaaaaggaattggagcacctacgatttcatacatagttcgaaaagaaataagatgacacctaaaagagtggaggatcttgtatatgttcatagcaatcttcatctcatttcaagaaattcctcaaactacaatgaagaggaaacttga

SEQ ID NO: 35696 - DNA, 621 bp, Glycine max
  Peptide Sequence Number=SeqID_152474
gtactcagttatgatgagagctccaaaattatcccactcagacatgagttatccccaaccggtttctgcgagcaggtgagaccctcaagtaaaaatcattattcattcctatgcatctattaccctagtcattgctcagagttaaaacctgacttcaacattggagaatcttttgcaagtacccttgctttggaaaaatcacattcaaagctttggaggacaaataggagcaaggaacccttaagctggaagaagaagtgtttgaccactatttggcaagaacattttggcgcctacaatgcggtcatgaatgtatatgacaacaacagttcagccaggacaacaatatcatcctcaagaagaagtacaagtagaagatctaaccaacttgtcattcgtggtaggacaactgcaagaagtctccgacatgcatcgacaccacgcccaacacatgaagaagtgactatttttgctaaagggcagaagaagaagaaaggaaaaggtggaaagaagagaaaatttgatcctaaggacatatgcaattactctaaagaactgggtcattggaagcaagactgtccaaagaaagcaaagaaatattttgttgttactcttgtttag

SEQ ID NO: 35697 - DNA, 144 bp, Glycine max
  Peptide Sequence Number=SeqID_152475
atgggggaggaggagaaaggaaagtggttaaacccttttctttctacctttaaggtggggttgtctactgcacgtcacaattttctcaagtccaagattggagtcactgaatctggctccatcttgcaagagcattttaagtaa

SEQ ID NO: 35698 - DNA, 342 bp, Glycine max
  Peptide Sequence Number=SeqID_152476
atggaattagaacaaaaccagagatgggaaggctatgtgaactggaggaacaagcctgctctcagtggctgcaatggtggcatgcttgctgcctcctttgttttagtggttgagatattggagaatctggcatttctagccaatgcaagcaatttggtgctgtatctgaggcagtacatgcacatgtccccttcaaaatctgccaacaatgtcacaaatttcatgggaacggccttcctccttgcccttcttggaggtttcttatctgatgcttttttcaccacttatcaaatctacctgataagtgcagtcattgaattcctgaaagaatcaaacttgtga

SEQ ID NO: 35699 - DNA, 567 bp, Glycine max
  Peptide Sequence Number=SeqID_152477
atgggtgtggctaatttgattacaaatataaatcaaacacaaataaatgggtttggcatgattttaggaaaaattagcaacattacaaatataaatcaagttgtaacattagtagaacagtcacaagagttcccacaaaagcaaggtggcagagaaaattatgatcaatatggaagaacaatatggaagttgcattgctgtgcaagttcagcaggtgacctcaaacgtatttgtgagactgatctaggacttgcttcacaatgttgcttaactaagcatgtcttcaaaatgagcaagcagtaccttgcaaatgttgctttgaaaattaatgtcaaagttggagggagaaacactgtactggttgatgcgctctctcgacgcattcccttggttgtggcttcgcaagactatcctgaaattacaaagcaggaactcatccaggatcttttcaaacaatggcaagatccagttagaggaagagtgactggtggaatgatcaagtactctccttccctttttctcatatgtgagatggttaatgcacattgggacattggggttgcttga

SEQ ID NO: 35700 - DNA, 1527 bp, Glycine max
  Peptide Sequence Number=SeqID_152478
atgtacaacattcttattgtacatacatatcatgttgcacaactactgttcatgactaagggaataggaacttgtgtgtgctctatgctgcagggattgattgttctcactgtgcaagctcgtgtgccatcactgaagccaccagcatgtgacgcatccactccatgcaatgaagttagtggtggaaaagcagcaatgctgtttgctgggctctatttggtggcacttggagttggaggaattaaggggtcattgccttcacatggtgctgagcaatttgatgacaacaccccatctggaaggaagaaaagatcaaccttcttcaactactttgtcttctgcttgtcatttggtgcccttattgcagtcacatttgtggtgtgggttgaagacaacaaagggtgggaatggggctttggaatctctactataaccatatttgtatctatcccagtgttcttggcaggctcaactacttataggagcaagatcccttctagaagtccacttacaaccattttgaaggtactagttgctgcttcacttaacagctgcttcaacagtagaaattctagcagtgcagtggtgaacatgacttcaagcccttccaatctaaactcaggcagaaaacaagtagggaaagaagcttccaatattgcaaacaaggaaccagaagccccaataacaaacacactcaaattcctcaataaagcagttgagaacaaccctatctattcatcaataaaatgcacagtggagcaagtagaagatgtgaagatagtgctgaaagtgctccccatattcgcatgcaccatcatgctgaactgttgcctggctcagctctccactttctcagtcgagcaagccgcaacaatggacaccaaacttggtaccctaaaggtgccaccagcctctttgccaatcttcccagtgctcttcatcatggtcctggcaccaatctacgaccacatcatcaccccatttgcaagaagagttaccaagacagaaatgggaatcacacacctccaaaggattggaattggactagtcctctctgtagtagcgatggcagtggcggcggttgttgaagtgaaaagaaaacgtgtggcaataatggcaacacactcaaatagccttctagatgatgcaaccaagccactccccatcacattcttttggattgcttttcagtacttgttccttggttctgctgatcttttcaccctagcggggttattggagtttttcttcacagaagcaccttctagcatgaggtctttggccacatcactctcttgggcctctttggctgtagggtattaccttagttcagcaattgtgtcaattgtaaatagtgtcactggcaacacctcacatagaccatggctctctgggacaaaccttaaccactaccacctagagaggttttactggctcatgtgtgtgctgagtgcgttgaatttcttgcattacttgttttgggctatcagatacaagtatagagggacaggaactacaaacaactga

SEQ ID NO: 35701 - DNA, 381 bp, Glycine max
  Peptide Sequence Number=SeqID_152479
atggaaggctatcgtgcactaggtttgttggttgttatcctctttggcgtcccgactctgcgagggcttcgacaagccattgatgagatcaagaagaggaggacagcggcggcacgaacaattctcacggcgattgcgttcttcaagccctcggaaggttcttgttccaacctctccttgagacgtgcatttttttgtgtgttttgtgcagaggtgaaaattgggatgtttaagtcaagaattgaagagttgtttgatgaggtatcattgaatggagaactgtatgcgattatgagtgttgctgatatgttattgtggaggaacaagaaaatttctgctggtgcacttggcagagccactgctgtttgggttcttttttag

SEQ ID NO: 35702 - DNA, 138 bp, Glycine max
  Peptide Sequence Number=SeqID_152480
atgactataaaggtctctgtgtgtcaacgggctcgcttgcctttggatgacaagactcgcttgcctctggttgacgaaaggtggcagatgaccatgatttgtcttcgcgtgtcatcggacttgcttatcttcggatga

SEQ ID NO: 35703 - DNA, 279 bp, Glycine max
  Peptide Sequence Number=SeqID_152481
atgttggaatacagggtacaagccgtcctgctcactagtattgttattcaacatttagcatcggtgcttacgtcaccactgatgttaaatgcacattttttacctcgttttttaaataacactgacttagaatgtctaatttctacatcggtggtcaggatagtaccgatgtggaaaacgttgtctttctacaacgatggtttagggaccgacgctgaaatttttaactttcaacatcggttgaccaccgatgtagaatgtggttttccactgatgtag

SEQ ID NO: 35704 - DNA, 429 bp, Glycine max
  Peptide Sequence Number=SeqID_152482
atgggcaccagcatgaccacccatacccagatatggatgacgttgctagtcagcaacattctgcccagcgaccataactctgaccttcctctaccaaagtgtcagttggtttatgccatcctgacacaggtgagtgtccatgtggctcagttgatttctgacgccatttatcagtttgtaggaacggggcctacgagacaccctatggacccggagaggtacaacagggccctgggatttcctgcactgattacgggcctctgtcagttctacggagtgcctattgcccctagcaaggctagcgtagggcgaggcaccacagcagcctggagacggtcagccgcaggcaggcgatgcaccaccgtcacccctggagtccacctcggcctacttgcggaggttagagtgctgcatacaacatgtggctga

SEQ ID NO: 35705 - DNA, 1638 bp, Glycine max
  Peptide Sequence Number=SeqID_152483
atgggatcaaatcaaacacctctgctcaagaaaaggttctatcaagtcaaaatcaagagcttagaggtcaccagtttacgagagttgggtcaattgatgggtcaacttcaacggaaagccttccacaaagcctatggtaagatttgggacctagctatggtagaagtctctatggaagcgattgcatcccttacccagtattatgaccaacccctgaggtgcttcacatttgaggatttccagctagtgctgactatggaagagtttgaagaaatcctgggatgcccactaggaggaaggaagcgatatcttttctctgggttctatccctccatggctagagttgccaaggcaaaggccatggcaaatcaaagcgaatgggcttcttttattgacatcttggcacttttgatctttggggttatcctttttccaaatgtggaagggttagtggacctagcagcaattgacgctttcctcgcctttcaccatagcaaggaaatcccggtcgtcaccattttggccgacatgtatgacatgcccgtctgtccgctacaaggtcactgctcgtgcaccgggaaaggaaaggcaaattgggacaaactcttggctagcatggagggggcatccgttaattggttccctcactggaaggaaggaagaaccaggattctatcctcgtgtgaaggatttccgaatgttcccatgatgggaacaaggggttgtattaattataatctcgttctcgccgtaagacagcttggctaccccatgagaggagcgccatcagaggaaagcatcacgcctttcattgcacggggtttcagtgaccccaacacgagggtacttcaaggagttcacaaggcatgggatgcagtgcgaaggaaggacaaagagcttaggggaagtagtaatgggatcattgacggctatcgtaaatggctgagagtccggatacaaggattggattggctccaaaagctaagggctgtgagagacaaagaggctgaagctccggaagaaaatgaggaggtacgaaccctaaaggtggagcttgaaggagccagggcaaccaaagagaagttcaagtcaatggccatcaaagtccaaagagagtatgatgaactaagggacgtcaatatggccaccaccgaagccttggaacgagaaaccaagagggctggaaaggaagaacatggccaaaacaagttccaagggactttatggggcagcaacagtgagctcaagcttcgaagagacgaaaaggatcagtcgcgggtcgaaggcatgatcatgaaggacgacgagactgaagggcatatgtgggccatcatcgatgagtacaaagagaagctaaacctagcggcgactcacgagcaaaggctagaagatgagtacaccaagatatcagcggaaagggaagcaagggaaagggtaatcgactcattgcacagagaggcaatgatgtggaaggacagattcgcctttactttgaatggaagtcaagagcttccccgattattagctaaggccaaaggaatggcagacgtgtactcggcccccaaagaaattcacgggctccttaactattgccagcacatgattgatctaatggctcacatagttagaagccgttaa

SEQ ID NO: 35706 - DNA, 480 bp, Glycine max
  Peptide Sequence Number=SeqID_152484
atggcgctagaggacatggaaaagactacgtttgtcaccttatggggaacattatgttataaggtgatgtcctttgggctcaagaacgccagggcaacctatcagcaggccatggtggcattattccatgacatgatgcataaggaaattgaagtctacgtggatgacatgattgcaaaatctagaacagaggaggaacacctcatcaacttattaggaaagctactcggtttcgttgtgagtcaaaaagggatagaagtggatcccgacaaggtgaaagccatccttgacatgcctgagccacgaatggagaagatcaagcaatgccttatgaatcctcctatgcttatgcctcttatcctgtacatgacagtgttggatgagtcaatgagatgcatgctggggcagcacgacgattccggaaaaagagaacgggttgtctattacttgagcaaaaagttcacggcctggaataattct

SEQ ID NO: 35707 - DNA, 258 bp, Glycine max
  Peptide Sequence Number=SeqID_152485
atggtggggtacgcaccttcaagctttgcggatttggtcttcgccgacaaaaggatggaaacgggtctaaaaataggcaaatttgatcatcctgctttgatgaatgagaaaactagggcaaatgaaaaggatgagaatgaggaaggaacccgtgttgtggctgtcattcctacatggccaaacttcccaccagcccaacaatgtcatcgctcagccaatatcggcccttctccttacccaccacccaatcatccataa

SEQ ID NO: 35708 - DNA, 618 bp, Glycine max
  Peptide Sequence Number=SeqID_152486
atgcatctccatggtggaaaatcaccattaaaggacctcattgaagctcaaagatccagccttcatagaagctccacaagcaagcttccatcaaaagggggaaaatctagtgaagaaatatacccccaagaagaaggacaacctttaatggttaaggaggagtgtaaggaggtaagtgtctcctcgaagaggttagctaagaaggaaagacattttgaaataaagaaaaatattaaagaaatttcccctcttagacaacctccacattttctcctttgtaaaaatacacttgttagcattgtcacacctcttgggcttaagtatattcctcaagtaaaggagttgttggatgagggtttggttcgcaagagcttaaatccttgtgctttgttggtggccaaaataggggttcccatgaaccctaagagaataaagctcattcctgagtggcccactccaccaagtataaagaaaatttggggcttccatgacttaacaaacttttacaaaagtgttgaggaaaaaagcccagagtttcaagaacctcaggatttgaggtcaaatccttttcaaggaggagggaatgatgcaatcctatcccgcaagggcattggatag

SEQ ID NO: 35709 - DNA, 955 bp, Glycine max
  Peptide Sequence Number=SeqID_152487
gctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaaagcgcgatgaccaattgtgcgaatcaacgggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 35710 - DNA, 946 bp, Glycine max
  Peptide Sequence Number=SeqID_152488
gcgagatcacgaacggggtgaagaccagctcggcgccggtcgagacgatcacgggacggatcaccaccaccgggagcgacccccacagcgtgaacacgatagacgcgatgaggacgaccgcgagcaagacctcgcacaggaggagctgccggagcgtggaggcccggtcctccgccagcgtcgtctcgcggccccggaccgtgatgcgctcggtccaccgggcgccgtcccaccagcgcagagtgccgcgccgccgggtcttgaaccagcaggctgcaatcccgcgttccctcacgccctcattatgacggctttcgccatgcacgaatccgcagaactgcgcaccggcgtcgtgaccgcggcgctcgaactcttcagcgcccaggggttcgaccagacgtcggtggagcagatcgccaaggccgccggcgtctcccgatcgaccttcttccggcagttcggcggcaaggaggatgtggtcttcgaggatcacgaggtcctcctcgaacagctgcgggagttcctagacgaagggcacgaagacccgtggggtgcggtgtgcgcggcgtccgagtcggtcttcgtccacttcgcccacgacccggaactcgcccgccggcggtatcagatcgtccgacaggtgcctgtgctccgcgagcgcgagatcattacggtcttccggtacgagcggttgttcgatgaatacctgcgcggcgcgcttccgggtgtcgacccgttggatgccgtcggcttcgccgccctcgtgaccgcggtgcacaaccatgtcctgcgccagctgttgcgcgggcgcaagaagatcccgctgtcgacgctgcagacggcactggcggacgtccggcgccggtacggtgtcgccggcgaggccgccacggagccggacgacgtggtcgtggcggtgttcccccgctccaagccgatcgccgag

SEQ ID NO: 35711 - DNA, 790 bp, Glycine max
  Peptide Sequence Number=SeqID_152489
atggagcagaggatacgtgaggccatagaagatgccggatttgaggccaaagtcatggaagaggactcgaaagacacctccactcaaatatgccgaatacacgtacgaggcatgacttgcacttcttgctcctccaccattgaatctgctctgcaatcccttcatggggtgcataaggcacgagtggccttaacaactgaagaagctgaagtctgctacgaccctaagattgtcacccacaaccacttcatgagtgccattgaagaaaccgggtttgaagccgtactaataagcacaggggaacacataaccaagattgaacttcaaattgatggcattaaaaatgagcaatccctgaatgtcattgaacgctctctccatgaacttccaggtgttgaaaccatagacatatatccagacatcaacaaaatttccatcacttataagccgtacatgacaggaccaagaaccttcatagaagtcatagaatccacaggctctgggtgttttaaagcgattatattcccaaatgatggaggaagagaagcacaaagacaggaggaaattaatcggttcttcaagttattcatatggagtttggctttcaccattcctgttttcttgacatccatggttctcatgtatatacctggagttaaacgtgttttggatatcaaagttgtcaatatgttgaatattggacttctcttgaggtgtgaatttgctaccccggtgcagttcatcatagggagaaggttctatgttggggcatataaagcgttgcgcaaag

SEQ ID NO: 35712 - DNA, 2058 bp, Glycine max
  Peptide Sequence Number=SeqID_152490
atgaacaacttcaagttaggggtagatgtggttagtgctcacaatctattacctaaagatggacaaggttcatccaatgcctttgtggaactttactttgatggccaaaagtaccgtacggccatcaaagaaagggatcttaacccagtttggaatgagagcttctacttcaatatatctgacccttctaatcttcactatctcacacttgatgcctatgtccactgccataccaaagctactaactccacttcatttcttggcaaggttagtcttaccgggacttcttttgtcccttactctgatgcaattgtcttgcactatccattggagaaacgtggtattttctctcgtgtaagaggagagattggccttaaagtttacatcactaatgatccaaacataaaatcatccattccaactcctgctgttgagtccatgccaacaaataattcaagctcaacacatgcagaagttcgagcacctgcaagcacaatgacaaacaattttccaaatgaaaaggttgattcaagacacacatttcatcatctccctaacacaagccatcaccagcaccaacagcattcctctggctttgcagatactcattatgtaacaaagtatgaagccgatgcaatgaaatctgaaccacaacctatgaagctagtacgcactgctacatcagtacaaccagttgattttgcacttaaagaaacaagtccctatcttggtgggggaagagttgttggcggccgtgttgttcataaagacaagactgctagtacatatgatcttgtggaaaggatgtactttctgtatgtcagggtagtcaaggctcgtgagcttcctgctatggatgttactggtagccttgatccatttgttgaggtgagaattggcaattacaaaggtatcactagacactttgataagaatcagagtcctgaatggaatcaggtgtttgcattttcaaaggaccggatgcaagcatctgtacttgatgttgtgatcaaggacaaggatctcatcaaagatgattttgtaggcattgtgagatttgacatcaatgaggttcctctgagagtaccaccagacagccctttggcaccagagtggtatcgccttgaggacaagaaaggggagaagattaaaggtgagttgatgcttgctgtttggattggcactcaagcagatgaggctttttctgatgcatggcattcagatgcagccacacctgttgacagcacacatgctatctctgcagtgatgcgttcaaaggtctatcatgcaccgaggctatggtatgtgcgtgtcaatgttgtggaggcacaagacttggttcctacagagaaaaaccgtttcccagatgtgtatgccaaggtgcagataggaaaccaagtgctgaaaacaaagacagttccagcccgaacactaagcgctctctggaatgaagatcttttgtttgttgctgctgaaccttttgaagatcatttaactatttcagttgaagatcgggttagtcctggaaaagatgaggtcattgggaggatcatcataccactgaactccgtggaaaggcgtgcagatgatagaatcattcattctagatggttcaacctggaaaagctagttgctatagatgttgatcagttgaagaaagagaagttctcaagcagaattcagctccggttatgtctagatggaggatatcatgttcttgatgagtcaactcattacagcagcgatctccgccccacggcaaagcagctatggaagccaccaattggggttctagaacttggagtgctgaatgctgtaggactccacccaatgaaaacaagggatggtaggggcacatctgacacatactgtgtagcaaaatatggtcacaaatgggtcagaacaaggaccattgctgataatctgtgtccaaaatacaacgagcaatacacttgggaggtttttgatcatgccacggttcttactgttggtgtctttgacaacagccagctcggggaaaagggtaatggttcttcaaaggacttgaaaattgggaag

SEQ ID NO: 35713 - DNA, 1692 bp, Glycine max
  Peptide Sequence Number=SeqID_152491
atgaacttgacacccgagacagcaaccttattaacacaagatgatgagggaaatgtggttagtgaaagacaaattgatagccggttgatacaaaaggaggatgtgatcaaggttgttcctggtgcaaaagtagcatcggatggttttgtcatatggggacaaagtcatgtaaatgagagcatgataactggagaggcaaagcctgtggcgaagaggaagggtgatatggttattggaggcactctgaatgagaatggggttttgcacgttaaggtgacaagggttggatcagagagtgctctctcgcagattgttcgacttgttgagtctgcccaaatggctaaagctcctgtccaaaaaattgctgatcatatttctaaatattttgttcctatggtcattgcgctttctctttcaacatggctttcctggtttctggctggaaagttccatgcatacccaaaatcttggataccatcttccacaaacagctttgagcttgcacttcagtttgggatttcagtcatggtcattgcctgcccttgtgctctaggcctagccactcctacggctgttatggtcggtactggagttggtgcaacacaaggtgtgttgatcaaaggggggcaagcattagaaaatgcacacaaggtgaattgcattgtgtttgataagacagggaccctcacagttgggaagccagtggttgttactacaaaactcttaaaaaagacgtcacttagtaatttctatgaatttgctgctgcagcagaggcaagccttctcccatttactgtgaacagcgaacatccaatagccaaggccattgttgagcacgccaaaaagattatagaagaagaacaaaatcatccctggccagaagcacgcgactttgcttctgtttcaggccacggagtgaaggccattgttctaaacaaggaaataatggttgggaataaaaagatgatgttggatcataacatagccatttcagcagaagctgaagaaacactagcagaagctgaaagcttggctcaaaccgggattctagtatccttggatggagaagttgctggagttttggctgtatctgatccactaaaacctggtgccaaagaagttatttccattcttaatttgatgaagatcaagagcatcatggtgacaggtgataactggggaactgccaactccatagcaagacaagctggcattgaaactgtcatggcagaggctctacctgagactaaagcgaccaaaataaaagaattgaagagttctgggtacacggtggcaatggtgggagatggaataaacgattcaccagcactagtggctgctgatgtaggaatggcaattggtgctggcacagacatagctatagaggcagctgacattgttctgatgaagagcaacttggaggatacaataattgccattgatcttgcaaaaaaaactttctctcgtatacgtctcaattacatttgggctttgggttacaatttgctagccatcccaattgccgcgggtgtcctttactcctccactagattccgattaccaccatggattgctggggctgcaatggctgcctcttctctcagtgttgtctgctcatccctcttgttaaaaaattacaggagacccagcctgctaaacaacttggacatgaatgctatcaagattgaataa

SEQ ID NO: 35714 - DNA, 219 bp, Glycine max
  Peptide Sequence Number=SeqID_152492
atgacaaggaggaagcaacaaaaaaataaaagggtgggtttatgtttgagtgggggaggagtagggaaaagaagtgggtggtgctcactgctcagtgctcaggtgaacgccaacaacacagacagacactgtctccaatgcaaggtgcaaaagacaaaggctacccgtgcttcagcttctgactctgactccgtaactttcatttcccttatctggtaa

SEQ ID NO: 35715 - DNA, 321 bp, Glycine max
  Peptide Sequence Number=SeqID_152493
atgacgttgctacttagcaacatttcgtctagtgaccgcaataccgatctccccttgcggaagtatcagggtcgcgcccataagacacccagtggacccagagaagtccaacagggccctggggttttcagctctggttacgggcctctgggtcgcgtccacaagacacccagtggacccaaagaagtccaacagggtcttggggcttccggctctgattacgggcctctgtcagttctacggagtgcccgtcacccccaacaaggtcatcaggcccctattaacaggggtttcatcgagaagtactgcgcccccaggtag

SEQ ID NO: 35716 - DNA, 255 bp, Glycine max
  Peptide Sequence Number=SeqID_152494
ttgctacgtgcacccagcaaaattgctggggcacccgaaaaaagggaatgggcaatttatgcccatctgggaaaggctatttttcgaaagacacttttttcggaagtctttcggaagacccttttttcggaaaacttccggaagaagaaggtggacttccggaagaactccagaaaacgttccggaagaagtgtcttccgaaagttttccgaaaaaagggtcttccggaatacttccttcttcttccggaagaag

SEQ ID NO: 35717 - DNA, 322 bp, Glycine max
  Peptide Sequence Number=SeqID_152495
atggtggaaccatcgaaaaagtgcaaaggaacttcgagtcggagtcagcggcattctgggtcacaagaagctccaattcctccctccattccctatgggtcattattctcatcagaggaacaacgtatatggtacacaaacctcttttcctctcgttccattgtagacccaaaattcatagatatggagttcttctcaaatgagaattttgaatgcttccaagcattcgaaaactccaatcttattccattcatgtctctaaaattacctgtctattctgagttagtcaaagctttttattcaaatttagaaattcatgaag

SEQ ID NO: 35718 - DNA, 174 bp, Glycine max
  Peptide Sequence Number=SeqID_152496
atgaagaacgatgaagaacggtggaaaatcttcacgaaatcacccatggaaacgtctcagaagcgggaaaagagggaggtggttgctgcccagcttgcccaggcgagctgggttgcttccaccagaaggcaccgccttctgttggaacattctggaaggcccaggtgggcctga

SEQ ID NO: 35719 - DNA, 1734 bp, Glycine max
  Peptide Sequence Number=SeqID_152497
ctagacatgctgcgtcaccaagcaatgaacatagtggcggctagactcggccgagcagagccaccacttcgcaaggaagtggtggaatacatgtcagatgtggactctcacctttggagcatgcggcgaagcaaggcgaatttcttccgagtgatgagcgtcttctctggtgtgtttgctgttggaaaatggtttggtgatatctgcatgtggaggaatcctatcacaacagcgctggttcatgtgttgtttctcatgcttgtttgcttcccggaattgatcttgcccactgtttttctctacatgttcttgataggggtatggaactttagatatagaccaaggtaccctcctcacatgaacacaagaatctcacaggctgaggcagtgcacccggatgagttagatgaagagtttgacactttccctactaaccggagcccggacctagtgagaatgaggtatgatcgtttgaggagtgtggctggaaggattcaaacagtggttggtgatttggccagccagggagagaggattcaggcactgttaagctggagagacccgcgtgctacatccatatttattacattgtgtctcctatctgcgttggtgctctatgttactccttttcaagcagtggctggcactcacccctcctttgaaatgccaacttccgcaaacaataatagttctactattactcctggaattgatgaaggtaatgcaactactgaacccgtagatatcaatgatagagatgagaaagttgcaaatgctgttaaggtcgttgaggaacaattgcagctccatcgatcctggaggtcaaagtcaagcaaaaactatgcaacttgtgatggtcaaggaatatatgtatatgatttgccatccaagtttaacaaggactcggggttgggtgagcctatagccaagcttgggaaagggtggtataagactcatcagtactcacttgaactcgtatttcattcgagggtctcgaagcatccatgcagggtttatgatgaaaatgttgcaaagctcttttatgttccattctatggtggtttggatatcttgcgatggcatttcaagaacgtgtcaaatgatgtgaaggaaagtttggctctggaattggttagcagtgactctccttggggtactagattgttagagcttgacaaaatgcaaaaacccattaagcttttgatcgaacgacaaccttggcatgtgaatgacaatggaatccctcatccaactaatttccacccgcattctgacaatgatataatctcttggcaactgaaaatcattagatcaaaccgcaaaaacctcgtcagttttgctggagcagcacgggctgattcagaggacaacataaggtcaacattgattgaccaatgcacttcattgggtaatggttgcattccggttctctttgatcccttcacagcttattaccaatatccctggcacttgtctcatgatcatgacaagtattctgtgttaatggacaaaaaagaggtggtacaaaagaatgtgaatgtggttgagaggctaaccaatatttcctctagagagagggaaaacatgagaaggtttattacgtatgaactgttgcctggattggtgtatggggattacaactctgagcttgacaggtttcaggatgcatttgccattacaatgaataatctgtttgagagggttagcagattagatgaagcacataaggattga

SEQ ID NO: 35720 - DNA, 222 bp, Glycine max
  Peptide Sequence Number=SeqID_152498
atgaccaccaaggttccaaaatccgtatacgactttgttgtcaaggcctggagattctggcatttccatgtaaccaatttgtggaacttttccaagttcgtggttgataagaatggacaagtagtgggtcgctattatcccaccacttctcctctcagccttgagcgagacatccatagcttctgggaatttcctgaaggcaaaaagataatttcttcctga

SEQ ID NO: 35721 - DNA, 291 bp, Glycine max
  Peptide Sequence Number=SeqID_152499
atggttttggacaagagaaaacaaattcacgtacaagaattttcatgggttattataagttgttatcgccaaactttacgtgagggtaagcctatgatcaattcagagagcacacctgaacagaagaaacttttggctaagggggagaggtctaatagtttgagtttgattgctatcaggaggaccatctttgaacatcttctttgtggtctaccagagaaaccaatagctaagaagttccttgatgctctagaaaagaggtaccaagtatttgataatgcagagccttga

SEQ ID NO: 35722 - DNA, 279 bp, Glycine max
  Peptide Sequence Number=SeqID_152500
atgggcaagaaaggaggggccaaaaaattggagtctgcgtctcacactccaatatcattgagagaagaagccaccggaaaaatacaaaccaaggcagcctctaacaccaagtccaaattgagatttgaacacttgaaaaacctagcagtgtgggccaccaccataccatctttgggtgccttctatggtcaccaattcgctacctttggagaggccaccggaataccacctgatccttctttaataacttgccaaagaagcttcaatatgattccgtag

SEQ ID NO: 35723 - DNA, 789 bp, Glycine max
  Peptide Sequence Number=SeqID_152501
atgatgaatcatcgccgtcgtactcaagtggtaacgagtgatgatgaagaggaaacaccaaacccacaatacacacagaaaaggacgaggctttcagagcaagataacagtaatgagaataaagaagaacaaaaaaaagaagcagtatcgaaactgcctcgtcctgtggaggacgctaagcctattggcgagcctattaagtcttcgggaaaagggaaaaaagagaagaggcactatgaatccttcgagtttaatgggatcaaatatactcttgaggatcatgttcttttcaaaccagaggaaaagggccaaaagccatatgctggaattattaaggacattacacaaggaaataatggcaacgtggtagtgacagggcagtggttttatcgtcccgaagaagctgagaaaaaaagtggtggcaattggaaatcgtgtgatacgagggagttgttttatagtttccaccgtgatgatgttcatgctgaggctgttatgcataagtgtgtggtgcattatgttccccaacacaaacaacttccaaaacgtaaggatcacccagggtttattgtacaaaaggtgtatgacaatgtggaaaaaaagctttggaggttgggtgataagggctttgaggatattaagcagcaagagattgatgtgcttcttgagaagactctacaacgtattggtgaattatttgacatcgaggctgatgaaacccttaacgatggggaagaccaaatgaaaataaaaaaaaagctcaaggagaaaaagtgtttcacctcttga

SEQ ID NO: 35724 - DNA, 510 bp, Glycine max
  Peptide Sequence Number=SeqID_152502
atgtgtcacctaactgcatatgtttgtgtttattacgatgaccaaatttgcaatactaatgaaggcaccaccttcgttagtaacaacacaaaaactttcatggtcgacaaggtcataacttttacacaattgcttgaacttgttcaccaaaaactaagcattgacccagaacaacatatccaacatctccactttcggtgccctatatttgagtcaggacaacgttatatgtacacatcttttattctgcgagatgatgctgatgttcgacaaatgttcaacaatttttacaacaacccatcactaccatttgtggagttatttgccataatctgtcacaataataacccaccacgcaaccaacatggctcaacctctaattttgaggacttatcagatgaatacgagacttgttgggtcaaaaaccatgatagtgatattgactcctcttccgggcccgaaggaagtaacctgtctccatcccacgaacctatattcaaacgggattag

SEQ ID NO: 35725 - DNA, 1974 bp, Glycine max
  Peptide Sequence Number=SeqID_152503
atgagacaaggttccgtgtatcagagttcagaacaagtcataaatataaagaaaattggcaccattaggggaaggaaaaaaatagaaatttcatctaggagtagtgatgcctctttttcaggtagtgttgttgattctctgtgtggttcagatgatgaaagtctggatgagagaccttcagtaatatctcaggactcaaatttaggttcaacatctccatctgtttctgtttcctgggttagtatggagaacagcacttcaaatggctatattgaattttgcttaaattcagatgtttgggatgaaaaatatggtgcagcagaaggggttggttctataaatacagaaatcagaagtgacaaggttgctggttcaccaattgatggtaattttcatcttcaaaaagagacagttcgtggattacaaaagccactctctgctatggttgaaatctctctcatgccatctccatcagagagtgactgctcaccaagatcaagttcaaaaatctcactcacctctatcaggaacaggttaaattcatatacaaagtcaaaatctttgaaaagcccagtgagttgtgttctggaaactactgaggtcaaattaagcggcacaagaaacagggcttatcagagatctttgctgaatgacttctctaacacagcaaagcattctgacattatttctgagtttatcaatagagatatccagttttcaggtctatcatgttctcctgttcatcttcatggcaatctcaagttgaaaaacaaacaaggactgccattttttgagtttaaggtaaagtgccccgaagatgtctttgtggtgaagacatggaaatcaggcaatgctttcaattgggcgtatacctttcattcaatggataatagaaaaaaaagtactgccactgacttgggatcccattgttgtgacaaagactcatcaatggtagcacagatgctggtttcctctaattcatgctcgaaattagaaggtggaatgtttgacaactctatggtatcagaatttgtgctgtatgatcttacacactcaagcaaaagtgtttctcctgaaaaaaagcgttacagcgaccaacactgttctaaaactctaaaagcttctcgtgtaggaatgaagggcgaaactttcaggccagatgaagagactttgttcactaaaaacaagcttctatcaggcaatgcagattttgataaatcaaattcctatcctttgtcatccacagaattgcattcaaaccctgaaatggctgccattgttttgcaaattccatttcgcaagagagaaagcttgaaatacaaaagaagggatagaataaatgctgaagagcattcaaaattaagtgatctctctttagctgtagatcagagtagaaaaagccttcatgataggaaagtcctagaacaggtgaaggtggtgctaccaaccggaagccatggtttgccaagtgctgaaagccagggtccctcatcattacttgatagatggaaacatggtggaggttgtgattgtggcggctgggacatggcctgtccccttattcttttaggtaatcctactattcaatttgctgaaggtcgaactcatatggagggatatcaaacactggaacttttcactcagggagccaaagagagaactcctacatttggcatgacaatggttgaagaggggcaatatgcagttgatttccatgcaaacctatcaccgttacaagctttctccatttgtgttgctattttgcatggcaactcctccttcagtggcacggggaaggcaaaaaaccaacagatatctagatgcaattcattgaaaatgcttcttgaggaggaggtagagttatttatcaactcagtcaccaaagaagagaataagaatgtgtccaagattcagaagggaatttctcgaccctacgtgctaaacccacctttgtctcccattgcacgagtataa

SEQ ID NO: 35726 - DNA, 372 bp, Glycine max
  Peptide Sequence Number=SeqID_152504
aaaaatgcagtgttagcacgccgtctattaagtggagagttggagccttcaaaaatattaaatatgacacccaatgaattaaaggaatcgagtctacttactaaaggcataggggtggagggtttggttgctgaggaaaaaaccaaggaggagcctgacaagatccagcacttgcaaatgacagatgctcgctgctcaaaatgcatggattgtaaggtggccttgagagagattatccaagctggaaataatgaacgttatcagctggaatgtgtttcctgtggtcattcctggtatgcctcccgggatgaggtgtctatgctgaccatagatgcatcagattctaagggaaacataggcacagcgctatag

SEQ ID NO: 35727 - DNA, 567 bp, Glycine max
  Peptide Sequence Number=SeqID_152505
atggcttcggagaagatttgctcgattctcttgttttgtgctgtaattttgcttctccgtgatgctccttctgccatagctggggacatagttcacgacgacgattcaactcccaagaagccgggttgcgagaaccagttcgttctggtaaaagtgcaaacatgggtcaatggtgtagaggatgttgaatttgttggtgtgggtgccagatttggcagagccattgtgtccaaagagaaaaatgcaaagcacacgcgccttattctttcagatcctcgtgattgttgcattccgccaaagaataagattgtgggagatgtcatcatggtggatcgaggcaactgcacgttcacaaaaaaggcaaatattgcacagaatgctaatgcttcagccatcctcatcataaataaccaaaaagaactgtacaagatggtttgcgaacctgatgaaactgatttgaacatacacatacctgctgtcatgcttccactagatgcagctaacttagtgatggtcgcaatatctttaatgcttatgacttatcagcagattctaattgcaatgtaa

SEQ ID NO: 35728 - DNA, 165 bp, Glycine max
  Peptide Sequence Number=SeqID_152506
atgcgtcatccactagggaataagccatggaagaagaagcttcaccaccaagagagtgtcttggataagaagcttagagatgaagctaagctcacccccatgccaaaatacatgaaggaagaaagcttccttggggagcaagtgtcacacccctccaatagctaa

SEQ ID NO: 35729 - DNA, 492 bp, Glycine max
  Peptide Sequence Number=SeqID_152507
atggcggagagtggcggcggacaccgccgcagggaaccgcctccggtgtctccggaggaagagggtgcaaatgcttcgtggagacttaatgtggaggagttttgtttgtctaaccaaacgcatgatcatcgtcaacatcaccgtttctacactttccgtagccttctccgaaagctcagtaagcaacttaaagtagcagaatattccaagaaacaggagagtctccttgaaggattgaatgagatggagaccatgactgaaacgtgtggtttaccaggaactcttactgaggatgaaatgaagcaactagctaagagtgagaggatggctgtttatgcatcagttgggagcagatcattggcagtcattgcctcaaccatggattctctcttggatctcttgtcaggtttcatattgtggtttactgcacatgccatgaaaaaccgaaaccaatatcactatccaattggaaagaaactcatgcaaccagtg

SEQ ID NO: 35730 - DNA, 1128 bp, Glycine max
  Peptide Sequence Number=SeqID_152508
atggcggagagtggcggaggaaatcgccggagagaaccgcttctggtgtcgccggaggaagaggctgcaaaagcatcgtggaggcttaacgtcaaagagtttcgtttgccaagccaaacgaatgatcatcaaaatcaacgatccttcactttccatggccttcttcgtaaacccaggaagcaacgcaaagtggcagaatattacaagaatcaggagagactccttgaaggatttaatgagatggagactatgactgaagagggtggtttcccaggatctctaactgaggatgaaatgaagcaactagccaagagtgagaggatggctgttcatgtgtcaaatatgtgtaacttggtgctgtttgcagcaaaggtttatgcctcagttgcaagcagatcattagcagtcattgcctcaaccatggattctctcttggatctcttgtcaggattcatattgtggtttacttctaatgccatgaaaaacccaaatcaatatcactatccaattggaaagaaacgcatgcaaccagtgggtatcattgtttttgcatcagtgatggcaaccttggggttgcagattttgattgaatctgcccgagaacttatttccaaggcaatgaagttcattcttatggtctactgtcgaagattcaaaaatgaaattgttagagcatatgcacaagatcacttttttgatgtcattactaattctgttggattagctgctgctgtgctagctgtcaagttctgctggtggattgatccaacaggagctattattatagcattgtatacaattaatacatgggccaagacagtcattgagaatgtttggtcacttattggaaggacagcaccacctgattttctagccaagttaacgttcctcatatggaatcaccatgaacagatcaagcacatagatactgttagagcttacacctttggtgcacattactttgtggaagttgacattgtgttgccggaagacatgcttctccaccaagcacacaacattggtgagacactccaagagaagctggagcagcttccagaagtcgaaagggcttttgtgcacgtagattttgagtccactcacaggccagagcacaagaccatggtgtga

SEQ ID NO: 35731 - DNA, 318 bp, Glycine max
  Peptide Sequence Number=SeqID_152509
atgaccttggagaagaaaaagaaggaggaggtggtgctggtgggtcaccgaatgtgtcgtggcggcgttggcttgcagcgatgggggtggaggatgatcattttctcttctttgaaggtttttccatttgagcttgtttctgcaaattctgatcagtggggtgttttgatgataacaatgatgataacaaaagatgatgacaaaggtgatgacaaaaagctcaaagatcaatcaaagaacaactcaagtgaatcaagaacaattcaagagttcaagataagaatcaagaagaattcaagactcaagaagaaagtttag

SEQ ID NO: 35732 - DNA, 819 bp, Glycine max
  Peptide Sequence Number=SeqID_152510
atggcttttcttctaccaaacgtccaaccttctcttttagctcaatccaaatccaagaaagacaaagcaaaccttcaccaaactctctcacctcaaaaacccacttctcagtttcctatatcatccaccacatgctcttcttctctacaaacttccactgcacaagttgcaaaagtcagcacaccacatgataagcagcaacaacagccaaaggatgaattctacctcaaccttggtcttgatgtcaggacaatccgtgaggaccttcctttgatcttcatcaaagacctcaattatgacatttataggttttcattggagtttggttatttcagggatgacataacattcatggaccccttgaacacatttactgggattgagaagtacaagctgatcttctgggcattgaggtttcatggcaaaatcttgttccgagagattgcacttgatgtgtacagggtgtggcagccttcagagaatgtgatattggtcaggtggaaccttaggggtgtgccgcgggttccctgggaggctaaaggagagtttcagggcacttcaaggtacaaattggacagaaatggcaaaatttatgaacacaaagttgataacttggcattcaatttcccacagaatattaaaccagtttcagttttggatttggttactgcatgccctgcaagtccaaaccctacctttttgtggggtcctgttgatgcatactcttcttcatggataaccttttacaaggcaattagggagacattggatcaagaaaggagtttgctaccacaagatggtctagctacatgttcatag

SEQ ID NO: 35733 - DNA, 720 bp, Glycine max
  Peptide Sequence Number=SeqID_152511
atggtagaacaatcgaagaagcgaaagggggttgcgacttcatccacaaccattggaactcgaagccatggaacatccaaagcgcagacatctcaaattcctccctccatatcatctcctacgttgttttcctcggaagaacaacgtatccggtacaattctcttttcacttctcattccattatcgaccctaagttcgtagacttagctttctttgatgatgaagtatttgattactttcaagcatttcaaaattctggtttaattcaatttatctctatgaaacttcctttttaccctgaattggttaaagctttttattctaacttggaaattcaagaagattccttgatttccgaagtttatgggattaagatggtcatagaccagtcccttttctttgaactcactcaattatccagtgatggtgtaccatttaagggtacacttgatgatgagtggaagtttgacttttctgtgtctgatgcccgtcagatggtttgcaccaaccaagcggatatgattggaaggcttcttgccggttcattggcatttgaatgccgcatcatgcactacttgattgtgcgtatcctactccctagatcttccaaccttgcacaggtttctgaggaagatttgataattatgtgggttttcttaaccggtcgtcaaatcgactgggcccatcttgtgagatatcgcatgcataagggattgtga

SEQ ID NO: 35734 - DNA, 309 bp, Glycine max
  Peptide Sequence Number=SeqID_152512
atgggcataacaacaaagacggtcatcaaaaccgtcttaaaaataatgaccaaacttggtctctgcttgtcatcgggcccgccgcctctggatgacaaaagggtgcgaataaccataagaatgaccaaacttggtctctgcttgtcatcgggcccgccgcctttggatgacaaaagggtgcgaataaccataaggtatctccgcgtatcatgggtgcagaatgaccaaacttggtctctgcgtgccatcggacacgactgtcatgaccaaacttggtctctgcgtgccatcggacacgactgtgtctga

SEQ ID NO: 35735 - DNA, 648 bp, Glycine max
  Peptide Sequence Number=SeqID_152513
atggcctcgatcacctcaccaacttggctgatgggactattgatgtttctttgctctgaggatccttcaccaaagcaagccagagttagaggccacttggtgaaaatagacgccgatagcctcaacacatttctagagactcctatagtcctagaggagggggagacattacctacctactctaggcactgtaggttatccatagaccacagagagattgaggctgctctttgcataccagagagggggttcattttgaatgctgagggccatccgaggaggattctcaggaaggatctgactaccttggcccaggtgtggagtgttctctcttactccaacttggaccctacatctcatgcatcagatcttactatggacagagccagattactgccttatgccgagctcgaaggggttgtctctgacaacctcacatttgagcgcctgagtccggccattaacttggcctacatcaggaagaactgttggaacattgatgatctaacagttgctttccggagagctaggagggcgagggcgaggccagctgatattccatctacttctacagctccagcatctacttctgcagctctttcagttccagctcatgttgactcgcagagctttgaagccatgctttaa

SEQ ID NO: 35736 - DNA, 1008 bp, Glycine max
  Peptide Sequence Number=SeqID_152514
atgccacactccattctaattgccctacaccagcgtgctgtgaatacaactgaacaccgaacagagcttggtggcttcgcgccgtgtgaaaaaagacaaactgaaaatgacagctttcaaaagtccaatttccttgcgctttcgccaaggatacagctagctagggctgagattaatataaggccttgggaacatgtgttgaaggagatggaaaagggcaatagaaggattaaatggaatgacagagaaccatatgcctattggaagggaaacccttttgttgccgaaaccagacaagatctcctcaaatgtaatgtttcaaccacccaagactggaatgctcgtttatatgtgcaggattggattcaagaatctcaacaaggattcaataactcaaacttggcaagtcaatgcacacatagatacaagatatatattgaaggatatgcgtggtctgtgagtgagaaatacatcctagcctgtgattccgtaacgctaatggtgaagcctcgtttctatgatttcttcataagaagcctgcagccaatgcagcattattggcctataagggacaagggcaagtgcaaatccatcaaacatgcagttgattggggtaataatcataaggaagaggcacaaaaaattggtaaagcagcaagcaagtttattcaagaagagctaaagatggattacgtgtatgactacatgttccatttgctaaatgaatatgcaaagcttctaaagtttgagccaagagtgccagaaggagctgaggagctgtgtgtggaggccatggcatgcacaagaagtgggttagagaggaagtttatgactgaatcaatggttagggagccttcaacaaaagccccgtgctcattgcctcctccgttggagccaacgtcgcggagggtgttttatgccaacaaactaaattcaattaggagagttgagaggtgggaagataactattggaaaaacagcactcaacagttgcatacacgcatttga

SEQ ID NO: 35737 - DNA, 948 bp, Glycine max
  Peptide Sequence Number=SeqID_152515
atggctggagtcggtattctgtctacaccttatacattgaaagaagctgggtggatgagcatggtgttgatggttctttttgcagtcatttgttgttatacagccacccttatgagatattgctttgaaagcagagaaggaatcactagctatccagatataggagaagctgcatttggaaaatatggtcgtattattgtctcaatcatattgtacactgaattatattcatgttgtgtggaattcatcaccttggaaggagacaacctcactgggctattcccaggaacatccttagatttgggtagttttcggttagactctgtgcacttgtttggaattttggcggcacttatcattatccccactgtttggttgaaggatcttcgtataatctctattttgtcagctggaggagtttttgcaacactgttgattgttgtatgtgtgttttgtgttgggacaataaatggtgttggattccatcacactggtcaattggtcaattggagtggcattccattagctattggtatccatgggttttgctttgcaggacattcagtttttccaaatatttatcaatctatggcagacaaaagacaatttactaaagcactaataatatgttttgtattgtctatcacaatatatggaggtgttgcaatcatgggatttctcatgtttggtggtgagactttgtctcaaataacattaaatatgccacgagatgcatttgcttccaaggttgcattgtggaccacggtaattaacccattcactaaatatcctttttaccacaaactagttttttatgaatgccatcaaaatgaacatgacttgatcaagttcaggaataattttagtctgcttttccttaactatacgcaaatatgctttgttgatgaacccattggcgagaagtctcgaagagttgctaccagatag

SEQ ID NO: 35738 - DNA, 249 bp, Glycine max
  Peptide Sequence Number=SeqID_152516
atggctagtaacacaaacaccaacaacagcaacaagaaggagaaagaccttgagtttttctttgaggaagatatcaacgaattgggtgcacaacaaatggatgctgaaactgccaagttagagagtgagagtagcagcagcgatgacgagggaaatgatacaacacgccgtcactctttcacttctcagcaatggcctcaaagttacaagtacactctccaccatttgtttaacttctttgcaatttaa

SEQ ID NO: 35739 - DNA, 1153 bp, Glycine max
  Peptide Sequence Number=SeqID_152517
atgaagccttgcactttgttgttgtttctcagttttatctccacgctctcttttgtggtttctgacacagtgccctcaaacgaagtttgggcgcttaggagcttcaaagaagctgtctatgaagacccatatcaagttttatccaattgggatacggtggaatcagatccttgtaactggtttggcgtcttatgcactatggttcgagatcatgtcatcaagctaaacatatcaggatcatcattaaaggggtttcttgcaccagagctggggcaaatcacctacttgcaggcactaattttgcatggcaacaatttcattggaacaatacctagagagttgggtgtgttggaatctctcaaggtgttggatttgggaatgaaccaattaacgggaccaattcctccagagattggaaatctaacccaagctgtgaaaataaacttgcagtccaatgggttgactggtaggctacctccggagcttggaaacttgagataccttcaagaacttcggctggataggaataggcttcaaggacctattcctgctggtggtagctcaaattttgcttcaaatatgcatgggatgtatgcatcaaaggagaatgtaactggcttctgtcgttcgtctcagttgaaagtagcagacttctcatttaattttttagttggtaggatacccaaatgcttggagtatcttccaaggttaagctttcaagggaattgcctccagggtcaggagttaaagcagcggtcttctatacagtgtgcgggtgcctcacctgccagtgccaagagccagccagtggtgaatccaaatcaccaacctgctgaatatgtgtccaagcatcacagagcatcgaagcctgtttggcttttggctctagaaatagtaactggaactatggtgggctctctctttctggttgctgttcttgctgcttttcagagatgtaacaaaaaatcatctatcattattccttggaaaaaatctggaagccaaaaagatcatacagcagtatatatagaccctgagtttttgaaggatgtgagaaggtatagcagacaggagcttgaagttgcctgtgaagacttcagcaacataattgggtcctcaccagatagtgtggtgtacaagggaacaatgaaag

SEQ ID NO: 35740 - DNA, 1674 bp, Glycine max
  Peptide Sequence Number=SeqID_152518
atggcgaagctgttagcgttgagttgctggcgaagcctctcgccgcgacctcactacccctccatgcccaaatatcccaagggcgagagtgtcgccaccgtccaagagctctctgagtccaccgctgttctctccgtcgtcggaatgagctgcgctgcctgcgccggatccgtggagaaggccgtcaaacgcctccccgggatccgtgaagccatcgtcgacgtcctcaacaaccgcgcccacgtcatcttctacccctccttcgttaacgtggagactattcgcgaggcaattgaggacgctggtttcgaagccgcgttactcacagacgacaaaaaatccgttcaagtatgccgcatccagatcaaaggaatgagctgcacctcctgctcctccactctggaatccgttctgcaagcccttgacggggtccttgaagcccgcgtgggccttgccaccgaagaggcccaagtccactacaacccaattctcctcaccaccaaccacatccttcaagccatacaagattccggtttcgaagcccagcttatcagttcaagccaagacttaagcaagatagacctcctcgtggaaggtgacataaccatgaaactaatcgaagattctcttcagacactcccaggagtccttgccgtggacataacaacggaactaaacaaaatatcggtttcttacaaaccggacgtcacaggacccagaaatttcattaacgttattcacgaaacagggaatgggaatttcaaggcaaagatatatcccacagaagaaggacagagagattctcacagacgccaggaaacaaaacagtattatagatctttcttatggagcttggtgttcactattcctgtgtttctaacctccatggtgcttatgtatgttcctggtgttaaggactcgcttgatgccaaaattgtgaacatgcttaccgtgggggaggttgcacggtgggtgctttccacgccggttcagtttgtgttggggtggcggttttactatggttcttacaaggcattgcgtcgtggctctgccaacatggatgtgctcattgcgctgggaacaaacgcagcgtatttttactctgtttactctgttttgagagctgccacctctccgcatttcgaggggaatgatttctttgagacgagtgcgatgcttatttcgttcattctgcttgggaagtatcttgagattctggccaaggggaagacttctgatgcgattgccaagctcatgaacttgacaccggacacggcggttctgttgactctggacggtgatgggagcgttgttggggaggaggagattgatagcaggttggttcagaagaacgatgtgattaaggttgttcctggggcgaaggtggcttcggatggatttgttgtgtgggggcagagtcacgtgaacgagagcatgataacgggggaggcgcgacccgtggcgaagaggaaaggagacactgttattggagggactgtgaatgagaatggagtcttgcatgttaaggcaacaagggtgggatcggagagtgctctttcgcagattgttcgtcttgtggagtcagctcagatggctaaagcgcctgttcagaagtttgctgatcgcatttccaaatactttgtgcctctggtaattatgaattgtgtgatgtaa

SEQ ID NO: 35741 - DNA, 684 bp, Glycine max
  Peptide Sequence Number=SeqID_152519
atgactgcagatgaagaaggatgtcaattctcttggacacggcgtatgaagattgccataggtattgcacgtggactcaagtatttgcatacagaagtggagcctccattcactatctcagagctgaattctagtgctgtataccttacagaagaattttcccctaagacaatccttgaaagatcagaaaagaattctggttccattggcagccaaggtgctatctgtgttcttccaaattcccttgaagcacgccatcttgataccaaaggaaacatatttgcttttggggtacttctgctagagataatcagcgggagacctccatactgtaaggacaaagggtacttggtggactgggccaaggactatcttgaaatgccagatgaaatgtcatgtgtagtggatcctgaaatgaaattttttagatatgaagacctcaaagtgatatgcgaggtaataactctttgtgtcaatcctgatacaactgtgcgcccatctatgcgagaattatgtagcatgctggagagcagaattgacacatcagtaagcgtggagctcaagtcatcatctttggcttgggctgaacttgcacttttatcggtttctgttaggcttaagcacgacaaggtctcgttgtatagcactagcggactagtggaagtccagaaattgttaaaatag

SEQ ID NO: 35742 - DNA, 420 bp, Glycine max
  Peptide Sequence Number=SeqID_152520
atggggcaggcaaatgcagcgtctggaatggctgtgcatgatgactgcaaactgaggttccaggagcttaaagcaaggcggatctaccgattcattacattcaaaattgagcatcaacaagttgtcgtcgacaaaataggggaaccgacggaaagctatgacgattttcaggccagtttgccagttgatgagtgtcgttatgccgtctatgattttgatttcacaactgatgagaattgccagaaaagcaagatcttcttcattgcatggtcaccagacacttcaaaggtgaggatgaagatggtgtatgcaagttccaaggatagattcaagagggaactggacggcattcaagtcgatatgcaagcaactgatccaagtgagatgagcttggaccttgtgaaagcgcgagccttctaa

SEQ ID NO: 35743 - DNA, 151 bp, Glycine max
  Peptide Sequence Number=SeqID_152521
atgacggagttcgacccggcggtgtccgcagtgctatcgggcgcccatgcgtcctcctcgctctcgcctgagccgtccgcgttagacgacacggctccgctagacgacgtacgcggggtcgaggcaccgcagaacgatccgaccaatcacc

SEQ ID NO: 35744 - DNA, 438 bp, Glycine max
  Peptide Sequence Number=SeqID_152522
atgggtaaaaagtttgagggttgggagtgtagtttgcagtgcagtgggaacctttcgcctcaggcacactatccgatgaggaggttggaagaagaaggaagagattcagagggcaagaaagtggttttgagcgttatgggaatgagttgcgctgcttgtgccggatccattgagaaagccatcaaacgcttacctgggattcgagaggccgttgttgatgtcttgaaccataaagctcaggttctttactacccacaaatgcttcacacaaatagtactattttgtacaaaagtttatataatggtggcagacgagaagatggaagaggagagagaaagggaaacaaaaaagagtcccctacacttgaacatgcacacacattttctaaatgtctcctaagacctcgatccattagttcgagtttaaattcctcttag

SEQ ID NO: 35745 - DNA, 531 bp, Glycine max
  Peptide Sequence Number=SeqID_152523
atgatgctgaaagaaacgacgtcgattgactacgtaatggaggctgcatctaggccccacttctccaccctgagactcgacggtcgagtcctatcctccgccaccgtcgcgtcctccactctcgattcaagcctaaccctcaattcccttcccaatcaacccattatcataagagtttctggaggtactgccttggacaaaaccaccgtctgcgatatgatcattcaacaactccacgatcattgcgttgtccttgtaaatcaggacttgttttatcgcgggttgaatcctgaagagttggaatgtgctcacgagtacaatttcgaccaccctgatgcttttgactcgaagcaattgttagagtgcacgaggaagctcattagtggtcaaggcgtgcatgtgaatgcctctgatttgattatattggaggggattattgtgttccatgatcagcacatgcaggatctgatgaacacgaagatctttgttgacgcaggtttgatatctcaattaacccttcaaatcacctaa

SEQ ID NO: 35746 - DNA, 231 bp, Glycine max
  Peptide Sequence Number=SeqID_152524
atgcaatgcatgaatatgataaatgcaagaatgctacgcccgttacgatgccatgaagagatgtatgatgcaatcaaggaacatgccagtggactatcagtgacaatgcatcaccaaaagaggaaaactctagatgaggcttcattgttatcaagcgagtcggagacccagcatgaccacagatcgacctccactccttatggctcacatagacccgggtatagggcctaa

SEQ ID NO: 35747 - DNA, 1359 bp, Glycine max
  Peptide Sequence Number=SeqID_152525
atgggttggtttactaagttgcttaagggatccaatcgtaaatcctcaggaggaagatatcatgggaaatatgaagatgacagaatatcggacaatcttgattgttcagcgtttggtacttggatccctaaccaaggtctgggatttgattcccggcttggacatggagtgacaagaggaggtatcactttaccccaaaaatgggccaatccggtaggaggaggattacacctcctgaaagaagaaattggtcgggcaatagcactctctctttcagaggcagataagaaagggaaaaaagttattggccttaagtttttgcctcacaaaacccaagaggacgactctgaatctgaagatgatgaactgtgtccacttagcgacgaggaagctgaatctgttggtgaagttcagcaagatgaagatgaccatcatgctacaattcaacaggatgaagacaaacatcttgatgaagttcaacttgaggaagatgaacaacttgccagggcaattcaagaaagtttgagcattagttctcctcctcgatctgagactgattctttatttcaacctttagcacacttatttccacctgtatacagaatctgtgctggctgtaatgctgagattagccatggaagatttttgagttgcatgggaggttattggcatccggaatgcttttgttgccatgcttgcaaacttccaatcactgattatgagttttctatgtctggaaatcgtcgttatcataaatcctgctataaggagttgcgtcatccaagatgtgatgtttgcaagaactttattccaccaaattcagctggtctcattgagtatagagcacatcctttctggctacaaaaatattgtccatcgcatgagcgtgatggtactcctcgctgttgtagctgtcaaagattggagtcagtggataccaaatatctgttgcttgacgatggtcgaaagctgtgcctggagtgtcttgacttagctatcatggatactcatgaatgccaacctctctatgtcgaaatacaagagttttatgagggtttacatatgaagatggagcagcaagttctgatgcttttggttgagagacaagcactgaacgaggctatggagggagagaagaatggtcatcatcacttacctgaaaccagaggactttgcttgtccgaagagcaaaatgttcccactattttaaggagaccaaggataggagcaggataccagctcatagatatgataactgagccttttaggctggtccgtcgttgtgaagtgacagccatacttgttttgtatggccttcctaggtatccttctgatatcatctattttcaaaatctatag

SEQ ID NO: 35748 - DNA, 483 bp, Glycine max
  Peptide Sequence Number=SeqID_152526
atggccagcgttgaggttgcacaacaaacaccaacaaccaaggtaagcaagacccaggaaacaaccccagtcactaaggctcctgcaacagaacaaccagcagctgagattcctgcaacagaacaaccacccgctgaggctcctgccccagaattaaccacccaagcaccaaaggaagaaaccatcgaggcaccaacagaaacagtagagaaaacaactacagaagtagccccagaggagcctaaagaagttccagttgagaccgaggaggtggtggcaaaggagacagaggaagagaagccagcagaagagaaatcagaggagaaaactgaagaagtgaaagaagaagcagaggagcctaaggaaactactgaaacagaatcagcagcagtagcaccaccagcaaccacagaggaagagaacaaaccagctaagtcagttgaaaccccagtagaggttcgtgttgagaagactgaagcttag

SEQ ID NO: 35749 - DNA, 1221 bp, Glycine max
  Peptide Sequence Number=SeqID_152527
atgaagcagctttccaaccagagtgatctatattgtctttggataagaactcctcctagaaagagaaaaacaagctactatgtctcaaagatggaactaaactatccattgattagagtctatttgcctatattattccttgtcttggatgaagcagatcgtgtcctggatgttggttttcaggaggaattgagatttatctttcagtgcttaccagaaaatcgacaaaacctgttcttttctgcaacaactacaagtaatctgcaaaagttgcgtgaacgttaccaagataagatgtatgtctatgaggcttatgaaggttttaaaacagttgaaacacttaagcaacaggctatattcatccctaaaaaggtgaaggatgtatatttgatgcatattttggctaaaatggaagatatgggaattcggtctgccattgtatttatctcaacatgcagagattgtcatcgtttaagtttaatgctggaagtgcttgatcaagaagcagcagctctgtattcattcaaatcacaagctcagaggcttgaagcacttcaccaatttaaatcaggaaaggtttcaatactgctagcaactgatgttgctagccgcggtttggatattcctacagttgatcttgtcatcaattatgatgttccaaggtttccacgagattatattcatcgtgtaggtcgtacagcaagagcaggtagagggggactggctttgagtcttgtcacccagaatgatgttgatcttattcatgaaatagaagcacttattgagaagcaacttgaaatgattgaatacaaagaaaatgaggtgctttctctcatgaaaaaggttttcagtgctaagaacgtagcagaaatgaagatgatagatgatggctttgaagagaaagctaaagagcggaaaaaacagaagctgaaaatgctagcagataaaggattgttaaataaaagaagtaaaaagagaaaacgaaataaagaatttgcagaggaaggggaagaacaaaaaaatgaggttttcactgttaggaatgtgacggaaatgaagaggatggatgaggatggcattgaggagaaagcagaagaggggggaatacaaaaacttaaaatgcgaacacagaaagatgaagggaaaaaacagaaaaaagagaaagtagaagcattagcagatatagaaactccaaagaaaaggagtaagaagagacagtaa

SEQ ID NO: 35750 - DNA, 228 bp, Glycine max
  Peptide Sequence Number=SeqID_152528
atggacggtggagaaaaccctaagaaagagaaactgagaaagcgagagagaaagagagagagtgcatttctgagagcatctttctcgggtcgacgcgtggtggatgacgaaagttctgacattcaaagggcattttcagggccacgtggtgagaagatagtggttgctgcagcgtttgtatggacgactgcgacgtttcttggtgtcgacagcagcgcatgcgcgtga

SEQ ID NO: 35751 - DNA, 3828 bp, Glycine max
  Peptide Sequence Number=SeqID_152529
atggaacaatcaagattccaaaacacggttctatacaataacatggaacctagacatgatgaataccaccaccctgggtcacagtcagtgatgcaggaccatatggatggcacacatgccggtagaagaccagctgacctcaatacatcagaagttaaacctgtacttaattactccatacagacaggtgaagaatttgctcttgaatttatgagagatagggtgaatatcaggaagcctgtattatcaaatgtcagtgattccaattataccccaggttatatggaattgaaaggcattttaggcatcagtcatgcaggatctgaaagtggatctgatatttctatgctctcaatggttgacaaatatccaaaagaatttgatagaatgaatacatcattacctggagacagaagcaactatgggtcgattcgatcaatgccaagaacttcattgaatcaggacaatagacaatttgtgcctggctatggctcttttggagtttatgatagatcaatgatgatgaagtttctttgcagctttggtggtagaatattgccacgaccatgtgatggaaagctaaggtatgttggaggccaaacacgcattcttcgaataagaaaggacatatcttggcaggagctcatgcagaaagcattacaaatatataatcaggttcatgcaatcaagtatcagcttcctggggaagatcttgatgctttggtttctgtgtcctctgatgaggatttgcagaatatgatggaggaatgtaatcatcttctagatagagaaggatcacaaaagcttaggatgtttttgttctccatgagtgatttggaggatgctcagtttggtctcagcagcattggtgatgattctgagatccagtatgttgttgctgttaatggcatggacttggaatcaagaaaaaacacaaccatgtttggtgtcagtttttctgcaaatgatataaatgaattggacaggcaaattagtattgacagggagactagtagagttggtgtagaatctattgcacaaggtgctcccctgactaacaattttaactcatcattggctactcagtcttcaccaccagtgctaccaacttcctcaaattcttatgatgcgtatccacagttttatggtgatcaaatgatacgccgtggggaacctagtgatcaatatattattaatcatggccttattccttctcataaacctgttattggagagactcctatcattatgcctcctcatatgcttgttaatcaacaagggattttgagtgaaggccttccacctcatggaatacaagtacaaaattcagaaatagcaggaacatttgcaagcaatctggttgatagttcaattcaacaaggaagtgaccctgggaaaatttttgcctcagaattaccatcaacagctcctgcacaactgcttaataatggttacatgaaaaataattttcctgaagcatcagttgttgttactgcaccagaggggcattcgttgcatccaacaaagatggacaagctcccagattatgaagagacttcttctacatctagcagtgcatttggtcctgcttatgttgattcccactacaatgcagctgacttgagttctcttcatcctcctcctcttcctaaaagagtttactattcggagagaatttcacgggaacaattagagttgttgaatcggtcctcaaaatcagatgatacaaacagttctcagtttcatgtttcagatttactttctgatgtcaacccaccagattcagttacagaatctggtgacaagttgcatggtggaaatctgcctaatctatctgaggaattaggcatcacagggaagcccttgcatgcagatggctatgccattgataatggggctgtcaatcatcaaatatacaaacagctgcctgatgcaagcagtcagatgaaatcaaagctaactgagcatgtgagtcctgagttgaagcaggtatcattggacaatggaggacgcaaagatttgttaaataaggataatgttgttgggttggaaacagaaatttatagtataaataactataacaaacccctgattgatgagacaaaaaccagcaaaccagacttgcctattttgcaccaggtctcttctgataagcaccttgatgatccagcatccattcttccagaagttgattggggtgatacctctgtgaaggagtctaatgaggatattaatgttcaagccttacctgtttccataaatgggaatacaactacagatgaagattctgaagaatttccttcaaatgttgtttccaaacaagcgcaaggtgacatccttattgatattaatgatcggttcccacgtgaatttttcactgatatgttctctaaagcagtacttgaagaagatccctctagtctgcatccattaacttcagatggagtgggcttaagtgtaaacatggaaaatcgtgaacctaaacgatggtcatattttcaaaaattggctcaagaagggattgataatgtgtctcttatggaccaggatcatcttgatttttcaccaggaaaagtggttggagaaaatagggctcaacatgttaaacctttaacaactgatgaagtttctctgaaccatgcagagtcccaccttgattttgttgaagaaaatataagagacttgcatggaaggattggagcagaaaccactgttctaaagtcaaattatgatcattcccaagtgaacgacaccgaaagtatgcaatttgatgttatgatggaaaacataagagcacaagagtcagaatatgaggttgggaagtttgaaaaaaggaatagcaatctacctcctcctgatccttctttagtaggagagtttgatccaagtaccttccaggtcataatgaatgatgatcttgaagagctgaaggaactgggttctggtacctttgggactgtgtatcatgggaaatggcgaggaacagatgttgccattaaaagaataaagaaaatctgcttcactggtcgatcatctgagcaagagagactgactgtagaattctggcgggaggcagaaattctttccaagcttcatcatccaaatgtggtggcattttatggtgtagtgcaggatggaccaggaggaacaatggctactgttgcagagtacatggtggatggttctcttaggcatgtattacttcgcaaggataggtgtagtgtgaggaactgcaagttcctgaagaagagtttgaatccagaggatatcaggaaagtcatgtatcttgatcgtcgcaagagactgataattgcaatggatgcagcttttggaatggaatatttgcactcaaaaaatattgtacactttgacttaaaatgtgacaatttgttggtgaacttgaaagatcctatgcggcctatatgcaaggttggggattttggcttgtcaaaaattaaacgaaataccttggtttctggtggtgtgcgagggacacttccttggatggcaccagagctgctgaatggtagcagcaacaaggtctcagaaaaggttgatgtgttctcctttggcatagtattatgggagattctaactggtgaggagccatatgccaatatgcactatggtgcaatcataggtgggattgtgaataacacattaaggccaacaatcccagatcattgtgattctgaatggagaacactgatggagcagtgttgggcacctaatcctgcagctaggccatccttcacagaaatagccagtcgattgcgcataatgactgcagcagctagccaaaccaaaacacagaaggcatctaaatga

SEQ ID NO: 35752 - DNA, 3771 bp, Glycine max
  Peptide Sequence Number=SeqID_152530
atgcagaaacatcaatacaattccatggaacctcgaaatgaggaattccattctgcaccacagttggtcccgcaagaccttcgtgatggcatgcatatcaatgcacgacctccgccatttaatatgtcagaaaataaacctgtacttaattactccatacagactggtgaggaatttgctctcgagtttatgagagatagggtgaatctcaggaagcctgcctttccaaatgttgtgggtgatcccaattattcaacaggctatatggaattgaaaggcattttgggccaccctggatcagagagtggatcagatatttctgtgctcacaaaggttgaaaagggtccaaaagagtttgacagaaggaactcttctcaacaccaggacagaagtaattatggttcagctcaatccattcctagatcttcatctaatcaagacagttaccgagttcttcatggtacttcctcttctagtgtttctgaaagcgcatcaatgaagatgaaggttctatgcagctttggcggtaaaatattgccacggcctagtgatggaaagcttagatatgttgggggtgaaacgcgtattattagtataagacgggacatacgttttcatgagcttatgcttaaaacatcatccatctataatgaaactcatgtgataaagtatcagctccctggagaagatcttgatgcattggtttcagtatcttctgatgaggatctgcggaatatgatggaggaatgtcatgatctacaaggcggccgagaatcaaataagcttaggatttttctgttatctatgaatgatttggatgatactcagttcggtataggtagcatggatggtgattctgaaattcagtatgtcgttgctgttaatggtatgggcatgggttcaagaaacaactcaatccttcgtggtgaaagtggctctactaataacttacatgaattgaatggacacaataatgagagggagaccaacagagttctcatggacacatttggtgttagcagttcatccttgactgacaatgttaaaccatcactggctattcaatcttcacaaccagtgcttccaatctcctctaatgcttatgaaacccatccattgttttatgatgagcagattattcaccacggggaagctagtcattatccactacagcatggccttggtccttctaacaactccgctcacaatcttgaagagattccagtttctatgccaactcatggccttgtcaaccaaggaatcatgaatgatggacaagcatccagtcagttgcaggtacaaatttcagctatgccagaaacgctggtgaaaagaaagggtgataatttcattcatacaggcaatgacccaggaaaagttttccccttggaagcaccatatcctattcctttgcagccatttgagggcaatttgcatgctaatatatcagatgcttcagctacagctgctatatcagaagggcttcatcctgcattaccatcaaagaacaagggtaagcaccagcagtctgaagatgcctcttcattaattagtagtatgaatcccacacagactcccaagtctgttgaagatgacttctttactacagccactgatgcattcagccatgctcatgttgatgccgagtccaatgtaattgatttcagttaccttgaaccacctccacttcccaacagagtctattattcagagagaattccaagggagcaggcagatttgctgaaccgatctacaaagtcagatgatgctcatggttctcacttactcatgtcagatttgctttctgacttcagccagaaaaattcaattacagaatccactgacatgttgcacaatgggaatacatcaaatctgaacatgatgtccagctcagcaggaaagcctttgcaagcagatggccataccattgatgatggatttgccccgccacagacatacaaacagttgcctgatacaacaattaaggtgaatccaaagttatcacagcatgtgaattctgagtcgaagcaagtgctagaagataataaagtttctagaaatgaggatcaggttcttagttctgaaaacgaaaccaaaggcaccgaacatcttgcatttcatcaagttccttctgttgaacaaaatcagaatctagcatctaaacttccagacctcaatttggctgaggtttctaccagggagtctgataatgatactaaggtccaatcccagacttttcctttaactggaaacacaggccaagatgtttctcaagattttcccccagaagctaaatccagacctactcagggtgacattctgattgatatcgaggacaggtttccccgtgatttcctttatgacatgttctccaaagcaataatttctgaagattcctcaagcattggtccattaccaacagatagagcaggtttgagcttaaatatggacaatcatgagcctaaacgttggtcatattttcagaacttggctctagaggggtttgataatgtatctctaattgatcaggataatcttggtttttcgtctgctgtgagaaaagtacaagagggggatagtaaatctcagccatctgctcctcaaccagctggtggtgttttggcaggacgcacagattcccacctaaatattggtgaagaaaatcagaaaaatgtacctgtagcaactaaaacagaagcaagtatctttcaccaaaaatatgagcattcccaactaaagggcaatgaaaataagaacatggatgccataatggaaaacatacgaccacaggagtctgaataccaggatgacaagaatgaaccgaggaatgtggttgtagcaggggaatttgacaccagtactgtgcagttcataaagaatgaagatcttgaagagttgcgagagctgggttctggtacatttgggactgtgtaccatggaaaatggagaggatcagatgttgcaattaaaagaataaagaaaagctgcttcgctggtcgatcttcagaacaagaaagattgaccatagagttctggcgggaagctgacatactttccaagcttcaccatccaaatgtggtggcattttatggtgtagttcaggatggaccaggagcaacattagcgactgttaccgagttcatggtggatggttctcttaggaatgttttgcttcgtaaggataggtatcttgatcgccgcaagaggctgataattgccatggatgctgctttcggaatggaatatttacactcaaaaaatattgtgcattttgacttgaaatgtgacaatttgctcgtgaacttgaaggatcctatacggccaatatgcaagtgtgacaaagctacgaaacttgcttttcaccaggttggcgattttggcctatcaaagattaagcgaaataccttggtgtctggtggtgttcgtggaactctaccttggatggcaccagagctgctaaatggtagtagcaataaggtctcagaaaaggttgatgtgttctcttttggcattgtcttatgggagattcttactggtgatgagccatatgctaatatgcactatggcgcaatcataggaggcattgtgaataacacattaagacctacaatccctagttattgtgatcttgagtggaaaacactaatggagcagtgttgggcacctaatccagcagtaaggccatcctttgccgaaattgctcgccgcttgcgtgtgatgtctgcagccgctagtcagatcaaaggacagggccacaaggcatctaaatga

SEQ ID NO: 35753 - DNA, 270 bp, Glycine max
  Peptide Sequence Number=SeqID_152531
atgagtgagagaaattgcagccaaagtgaggtagaggaggagtatcccaacattctttctcactccgcttgtttccatgaccatgatccccctcttgcaattttggttactgcaatattgccacaagatataaagaaaaagaggcttcttctgattattatggctccactgttgcactccaatgccagtgcattgaaagactcaaaggtagaacaatatgtgagcatgaaggaatgccaaaagtgcagaaaaaagtgtccacaaatgtga

SEQ ID NO: 35754 - DNA, 468 bp, Glycine max
  Peptide Sequence Number=SeqID_152532
atgggcccaccctactttgagcccaccccaccattcataatcccttcccccacgggtggcatcaccccaggcccaccaagcactgttccatcccccactgaaggcactgtcccaagcccaagtgtgtttcagccacctgtggtgtaccctccaccgagtgtgccaccaccacccaactatgcccctaggaccaccttgtggtgtgtggctaagccctcagtcccagacccaatcatccaagaggccatgaactatgcttgctggtcaggagcagactgcacttcaattcagcccaatgggccgtgctatgagcccaacactgtgtatgcacatgcttcatacgctttcaatagttattggcaaaggaccaaaggtgctggtggcaattgtgaatttggaggcacagcgatgctggttgcagttgatcctagtgagtctcacaatcataaaatgggtttggattcttaa

SEQ ID NO: 35755 - DNA, 450 bp, Glycine max
  Peptide Sequence Number=SeqID_152533
atgacgaaggaagtgattcacagtcacaactctacagcctcggctccacttttcctcttctacttcttcttctacattttctctttgttttttagaaaacaaccattgagtgcaaggaaattctcccaggcgagctgcaacttgcctaagcgagttgcttgcttaatggtgcagagaaaggcagttttgacatcgagttgttctaactccatgtccagaattgccactagggctagcaaaacacgtatgaaggttgctttggatggtttcgactcatctagtcaatctcttcaactggtgctaaattttgatgttgagggcctaggatcctcttcatcaatggatttctttgcttcttggaagatgaatcgcagcggaatggagaagcaagggagagaggagatgccacttcaaggagaagatgagtctagaagaagctcaccaccatag

SEQ ID NO: 35756 - DNA, 288 bp, Glycine max
  Peptide Sequence Number=SeqID_152534
atgtcttgtgctctcactcgttcctcagattcttactatgctatagatttggatgaaaagactatcattttctacaatattctgagtgcaatctgtttagccaaggatcaagtctatcatgaaaggactaagcacattgacatcggataccacttcatctgtactaagaagagggacgaagtccaaatagtttatataaagaaaaatgttattgaaccaaggtggagattgttggacgatagagataaggcggacaacaacattgttcgtatggtccagtacttttga

SEQ ID NO: 35757 - DNA, 201 bp, Glycine max
  Peptide Sequence Number=SeqID_152535
atgaacctcttagataacaagacattggcaaaagtgttgtttgtcttgcattttctcttagcagttctcttgttccctctttacatgcaaccagagccccctgctgaggtagctctatgtttaggtgtcatcccttgctttgtctttgtttacgccaccattgcttggcgagccacattgttctacatgcaagtaggatga

SEQ ID NO: 35758 - DNA, 830 bp, Glycine max
  Peptide Sequence Number=SeqID_152536
atgttagttcgtagatggtctgagtccatttcggggttcaacttggtatcgtattgcctacataagaggaaactacgtttggtggataataaggtgatcgagtacattggattcaaagagccgttagaacaatggttatgtgagaagaagcagccattgctccaaaagctttggatttttatatttaccgagctggaaagaaaatcttcggacgcagatgatgttgaaactattcaaagaatatgctcttcaagaggtgagtgggttctccaagaaggcgagttaccgcgaaaggatctaaacaagttgatgtcttatgtggagcgcaacgaagttacctttgatcagtgtcttattctttggcacattgccactgacctcttgttctatgcagataaagatgaagaggatgagagaaaaaagaaacaacatgatgacgccaaaaaaaatgatgctctggatctcaagaaaggacctataagtggtgatgggcaaaaccataatgaaaatgatgatgctcaagatctggagaaaggaattattgataagaggcagaaaaataatgaaattgctccggatgatcatgtgaagaaagaaagttctgaagggcaaaaaaagaatgaaattgctccagatgatgtgaacaaaggaagtgctgaagggaaaaaaaagaatgaaaatgctggacataaagatgaccttgttaaaaatgattttggagatgttgatgagctcagggattttagtaagctactgtcggattacttgttgtaccttgtaatcatgcaacctaacatgatgtctgctgttaggggaattgcacagataag

SEQ ID NO: 35759 - DNA, 216 bp, Glycine max
  Peptide Sequence Number=SeqID_152537
atgagagagtttgaaatgagagggggtcatgatcagcggaggcgtggttgtgcgacgacggggcacaatcgagggagactgagaggcagaggcatcgcgaaggagggcgagggagagaaggatggtgacaacatagagcaacgttgtttaggcatggtcggggcaccaagtgatggagacaatctcgtcaagggcacacgcggagttgggggatag

SEQ ID NO: 35760 - DNA, 1383 bp, Glycine max
  Peptide Sequence Number=SeqID_152538
atgacatcgaataatcgcaaaagcaaaactgtttctgaagacataacttcaaaatctgaagctactaagggaagtgttggtgacaattcatacaagctagaacatgctgtagaagagaatagatctattcctgaaggagaattgagatgcccaaactgctctcacaatgaagatatttcaaactcaacagagaatttaaagatacatcagaagccgaagtccacctcagctgatgaggaaagggaaacacaacaaccgatgatgaagaagaaagaagtatggagacgacaatgggaagtagaggtagcgaagaaacaaggaaaagaaagagtttttcaccaagattgtacaaaacatgctttttcggtcaaacaggatgcaaccatgcagcaaacagaagaaatatatgctgatcaagaagaccaagccaaaataacgagacctgataaacttccaataagaggtggaaaaaaagtggcttggaagaacacacagaaggagctcatagaatgtttaggacgagctgcacctatgaaaactactgaagggacagaaaaagaagctttcaagaacacaacccttgaatgttcaggatctgatgccctaaagcatctctttgatcttgagaaaagaatgcaaaatcaacttgcttcactgaatgctttcataaaaggtcaaaatgctcaatcttcacctcacatggaatgtaataatcttcaggctagttccacttcaaacccttcatcaaatttacagatggttttagcttctggttctacatccagaccagaaagtattggtacagaaggcccaaggaaacctatccctagacttggcattcctccattccatgttggtgtggggaatgaagaaggcctcaacttgggaaggttcatcccctcctcaagttgtgcatttcgtccttaccatcaaggatcttcctcaagaggttttaattcagttcaaccctcggctattgctcatagggaagtaataaacgccaactcgaacacaatggctccacaacttcatggtctatatttcaatgagaggcctaatctgctggctcaaaactttatgcccatgagtgtgcagacactacaaactccaccattttctctcagtgctacaagaatttctcctctagctaatgttgagactgaagctcgacctcagttgctgttgggtggtcgattcctgctctcgaatgataatgttatactgaaaaataatatacatggttattatgagaactttcctgacttcagcaacaattatccaagtgttgtcttagtacttgaacatcaccccaacaatttgaaaggcggaacagtgctatggtacaaattagcaatgatttctctcggtcaaactcatagttaa

SEQ ID NO: 35761 - DNA, 1281 bp, Glycine max
  Peptide Sequence Number=SeqID_152539
atggctatcagtttcagctattgggatgattgtgttgaccctcagaattttgaggcaatgtggaatgtacctgaagtgagtgctgaatggataaaggctggagaacaaagatgccaaaaggttcacctatcacgtgatcccgatgggcagccatatttaacacaaactgaaatgagggctgtagctgacatcattattaccaagcactttcattcagagatagatcctgacatgatatgtgctattgctgaacttgaaagtgatagacaactacttgttatgaattccagacacaaatctaaagagcctaccgtggggcttatgcaactcctgccaaaaactacagagtggttgatgaggttgactacagcttgcagtgaattaggttattgttcatatgaagcagatgagaatcgagaattcttattcaaaccctttgtaaatgtatattttggtgctgcttatattaaatggctgtcaaactttgagaacaagaaggcgagccctggtgcagcggtaaagttgtgccttggtgacttgttggtcatgggttcgaatccggaaacagcctctttgcatatgcaaggaaaaagaagtgaagaatttattgtaagggcatataaaggtggtacaaagaaggcaactcataaatccactttgcgctattggaattgctatctctcagttaaagaaagttttcgatccagaaaatctgttgatgacaatgtttcacctcctgctcactctcatcccttaccttcattagaaaactcaaaagatgcaagtgttgacacatattgggattccagagtagccccagaagatatggaagctatgtggaatcatcttgaggttcgaaaagagtggaataaatccaaacaaaaacaaggaaaggtgcggtttgcacatgatgaaaagaagagaccatatctatcccgagtagaaatgaaggcaattgcagatataattctatacaaatacctcagcacagtgaaaattaaatccacagtaatttgtgccattggggaggttctaagcaagcgttttctacatggagttggagaacaacctggaataatggggattgactactccactgcttactggctttacttggaattgggctatagggcttatagacttgaatctgttgatgatcttaacaatccatttgtgtccatgtactttggtgctgcttatgtagcatggttatcagaatatgaaggaagtttggattttggaataggagactttgtagtgaaaaatttggaaggaaactaa

SEQ ID NO: 35762 - DNA, 138 bp, Glycine max
  Peptide Sequence Number=SeqID_152540
atgaccttgcacgttgcacctagtgaacgtaggcatgccatattttcttttcgctcacaaaaggactttgtcttctcggcgagtgcaataggcgatgacaattccgacaaagagccaccaaatggcgatggtggttga

SEQ ID NO: 35763 - DNA, 168 bp, Glycine max
  Peptide Sequence Number=SeqID_152541
atgtcaaacgtattcgtgacggcagggcatctgcatcaatcgaaacttcttgaaatattagtatggatcagttattggcacagatcctcgatcacaattgcaccagtaggggcagtttctactctcctctttgtgaatgccacacctcttacggtgagttgtgaatga

SEQ ID NO: 35764 - DNA, 1146 bp, Glycine max
  Peptide Sequence Number=SeqID_152542
atggcttcaaccactgctggaaaggtcatacgctgcaaagctgcggtagcatgggaagctggaaagccattggtgatagaagaagttgaggtagctccaccacaggcaaatgaggttcgtatcaagatcttgttcacctcactctgccacactgatgtctacttctgggaagccaagggacagacacctttatttccacggatatttggtcacgaagcaggaggaattgtggaaagtgttggtgagggtgtgacggatctcaagcccggtgatcatgtgcttccagtcttcactggggagtgcaaggagtgtgatcattgcaaatcagaagaaagtaacatgtgtgacctcctaaggattaacaccgaccgtggagtgatgctgaatgatggcaaggcaaggttttcaatcaatggacaaccaatataccactttgtgggaacctccactttcagtgagtacactgtagtccatgttggttgtgttgccaagatcaaccctgctgccccacttgacaaagtttgtgttctgagctgtggaatctcaacaggtcttggtgctacattgaatgttgcaaaaccaaacaaaggttcatcagtggctgtatttggattgggagccgtggggcttgctgctgccgagggagctagacttgctggtgcttccaggataattggggttgacttgaattctaagagatttactgaagctaagaagtttggagttaccgagtttgtgaatccaaaagattatgacaagccagttcaagaggtgattgctgaaatgactggtgggggagttgaccgaagtgttgagtgcactggaagtatcaatgctatgatctctgcattcgaatgtgtgcatgatggatggggtgttgctgtacttgttggtgtgccaaataaagatgatgctttcaaaactcatccaattaatgtcttgaacgaaaagactctcaagggtactttctttggcaactataaaccacgttctgaccttccatcagtggtggagatgtatatgaacaaggaacttgaactggagaaatttatcacccatgaagtacctttcgaagaaatcaacaaagcttttgaatacatgcttaaaggggagagcctgcgttgcataatccgcatgactgaatag

SEQ ID NO: 35765 - DNA, 1182 bp, Glycine max
  Peptide Sequence Number=SeqID_152543
atggaggaagtatcagtgataatcgtaggtgcaggtccttctggacttgcaatttctgcatgcctatcacaaaactttatctctcacataatactcgagaaagaggattgcagtgcctctctttggaggaaaaacgcttatgatagattaaagctccatcttgctagcgagttttgtgttttgcctctcatgcctcacccaccctcagccccaacttacctatccaaagatgaatttgttcaatacattgactcgtacattgcatgtttcaacataaaccctctctattgtcgtatggttgagtttgctgcgtatgatgaagttgaaaacaagtggagggtcgaagcgaagaagactcttgagggcacaagtgaaacttatgtggctaagtttcttgtgattgccacgggtgaaaatagtgaagggtatattcctgatgtgcctggactagaaagctttgaaggagagatagtgcactccaaatactacaaatcgggttcaaaatatgaaaccaaagaagttttggtagttgggtgtggtaactctgggatggagattgcttatgatctcaatgactggggtgcaaacacttctattctcatccgaaatccgctattggaggagacatgcagacatgttttcaattgggttcatgtcttcaccaaagaattgatcaatgaaggcatgcgaatgctgaagcatttacccgttcatgttgtggacaatatcattacctctttggcaaacatggaatatggtgatctatctaagtacggaatttatcagcccaaaaaaggaccctttcatcttaagtttataactggaagggctccagttatcgatgttggaaccattgaaaagattaaggagggagcaattaaggtaattccttctcatatagtgagaattgaaaacaagaaggtcatatttgaaaacgatgctgaaaaggagtttgatgtaatcgtgtttgctactggctacagaagtgtagctaataagtggcttaaggattacaaatatgttctaaatgatgaggggatgccgaacaatgattttccaaaccattggaagggtgatcgtggattatattgtgcaggactatcaaacagaggcttatttggagtcaaaatggatgttgaggctattgctgatgacatcaaccaaactctcaagttacattaa

SEQ ID NO: 35766 - DNA, 3222 bp, Glycine max
  Peptide Sequence Number=SeqID_152544
atgacggttacaaaacagaggttggtggatcggctgagatcacacggaggaagatatattgctctccatctgagatatgagaaagatatgctttcttttactggttgtgcatatggtctgacagatgcagaatctgaagagcttagaattttgagggagaatacaaattattggaaagtaaaaaagataaattcaacagaacagagagttggaggattttgtccactgactccaaaggaggtgggcatttttcttcatgctcttgggtatcccccatctacaccaatatacattgcagcaggagagatctatggtggtaatactcatctttcggagctctcatcccgctaccctaatctaatctttaaggaatcccttgcaactcctgaagagctgaaagattttgccaatcacgcttcccaaactgctgcacttgattacataatctgtgtagagagtgatgtatttgttccatcatattcaggaaatatggcaagagcagttgaggggcaccgcagattcttaggtcaccgcaagacaatcaacccagacaggaaaggacttgttggaattttttatatgctggaaactggagagctagaagaaggaagggaactatcaaatatggtgcagcggatgcacaagaacaggcaaggagctccaaggaaaaggcacggttctctaccgggaattaaaggccgagcacgatttaggactgaagagcccttttatgaaaatccatatcctgagtgctccaactcccaaaacccttcttccctcgcaaaatccctttccccctatttcctcactcttcacctcgctttctcaccaccacattcccctctcgcaacttctcaaatcgatgcaaactcagaatcaccgcttccaattctctttccgactcaaccaatcccaaccaagagcaagacgccgaatccgctcaactattcgagttgtgagttgttgagagaagtgaactgtgtgcagaaactgaaggaggcggagaggaaacggatgaatgagttggaggaatttgacaagaaggcgaatgtgcagttagagaggcagcttgtgatggcttcttcatggagcagagctttgttgactttgcgtggaaaactgaagggaacggaatgggatcctgagaactcacacaggatagactacagtgattttttgagacttcttgactctaataatgtccagtttatggagtattctaattacggtcaaacaatatcagttattctaccatattacaaaaatgggaaaccgacgggaactgaaggaaatactcagggtattatttttcggcgtcatccagtcaatataatgccaattgatagttggaatgatgtttggagaaagctacatcagcaaattgtaaatgttgatgtcattaatgtggatgccgtgcctgctgaaatatactcaactattgcagttgcagtcatatggtctatgcgtcttgctctggctgttggattttatgtgtggattgataatttgatgagaccaatatatgcgaagttgataccttgtgatttgggaactcctagccaaaaaactacacagccactaagaagtcgtgcacttggatctctaggccagagtcgggctaaatttatatctgcagaagaaagaactggtgttacatttgatgattttgctggccaggaatatataaagaatgaactacaagagattgtccgaattttaaagaatgatgaggagtttcaagacaaaggaatttattgtccaaaaggtgtacttcttcatgggcctcctggaactggtaaaactctactggctaaagccatagcaggggttgctgcatcccgtgttaaagacctttttgcaaatgcaagagcattttcaccttctataatctttattgatgagatagatgctattggtagcaagcgtggaggacctgatattggcggaggaggtgctgaaagggaacaaggtttacttcagatactgactgagatggatggattcaaagtttccacagcacaggttctcgtgattggtgccacaaatagattggatattcttgatcctgctctattgaggaaaggtcgttttgacaagatcattagagttggtttgccatcggaggatggaagatttgccattttgaaggtgcatgctaggaataaattttttcgctctgaggaggaaaaggaaactctacttaaggaaattgctgaactgacagaagattttactggggcagagctacaaaatatactgaatgaagctggaattttgacagccaggaaggatttggactacattgggcgagatgagctgcttgaggcattgaagaggcaaaagggaacatttgaaacagggcaagaggatagtactgaaattcctgaagaattaaaattgagattggcatacagagaagcagctgttgctgttcttgcatgttttttcccggagccccaccgtccttttgttgagactgatataaattctatccgcagccagccaaatatgcattatgctgaaatttctggccaggtttttgcaaggaaatcagattacataaactctatagtgcgtgcttgtgctccaagagtaattgaggaggagatgtttgggattgacaacttgtgttggatctctgcaaaggcaacattagaagcttcaaagcatgcagagtttttaattctgcagacaggcatgactgcttttgggaaagcatattacaaaaactatagtgaccttgtgcccaatcttgcaatgaagcttgaagcacttcgagatgagtatatgcgttatgccacagagaagtgctcatctgtgctaaaagagtaccatttggctgttgagacaatcacagatattttgcttgaaaaggggcaaatcaaagctgaggagatttgggacatttataagagtgctcctcatgtagctcagcctcctgtcagtccagttgatgaatttggagcactgatttatgctggacgatggggaatccatgggatcagtcttcccggaagggttacatttgcaccaggcaatgttggatttgcgacctttggtgcacctcgccctacagagacacaaattgttagtgatgaaacttggaaattagtagatgatatctgggataaaaaggttcaaaacattaaagatgaagcttcaatggtgattgaagaagagaaggaaaagccacagcttttgatggcgagccattttctttga

SEQ ID NO: 35767 - DNA, 1077 bp, Glycine max
  Peptide Sequence Number=SeqID_152545
atggataagtacgaggctgttaaggatttgggagctggcaattttggggtggctaggctcatgaggaacaaggtcaccaaggagcttgtagccatgaaatacatcgagcgtggccccaaggtggttttgactcccacacatttagcaatagtgatggagtatgcagcaggaggagagctctttgagaggatatgcagtgctggcaggttcagtgaagatgaggctagatatttctttcagcagctgatttccggtgttcatttctgtcataccatgcaaatatgccacagagatttgaagctagaaaatacccttctagatggaagtcctgcacctcggttgaaaatttgtgacttcggttattccaagtcatctttgctgcactcacgacccaaatcaacagttggaacaccagcttacatagcaccggaagttctttctaggcgagagtatgacggaaagttggctgatgtatggtcatgtgcggtgactctttatgtcatgctggttggagcatatccctttgaggaccaggatgaccctaggaattttaggaaaacaattcagcgtataatggctgttcaatacaaaatccctgattatgttcacatatctcaagattgtaggcacctcctctctcgtatatttgttgcaaatccattgaggtgtcaggacatcataaggtttgagaattgggacacttatggtactcgtcttctgaaatttaggtgccatgtacagaatgtacttaattcttcctggctgctgagaattactattaaggaaattaagaatcacccatggtttttgaggaatcttccaagggagctaactgaatctgctcaagctatctattaccagagagacagcccaaactttcaccttcaaagtgtggatgagataatgaaaattgtaggagaggcaagaaatccacctccagtatctaggcctgtcaaaggttttggctgggaaggtgaagaagatttggatgaagaagtggaggaagaagaggatgaagatgagtatgataagagggtcaaagaggttcatgcaagtggcgaatttcaaattagttaa

SEQ ID NO: 35768 - DNA, 408 bp, Glycine max
  Peptide Sequence Number=SeqID_152546
atgcaaatctatgaggaacttcctgagggaatctcttactacacaaagcttagaagcagcaagttttgcctctgcccaagtggttatgaagtagctagtcccagagtagtgaaagcaatatttgcagaatgtgtgccagttctgatttctgacggctatgttccaccctttagtgatgttttgaattggaattcattttcagttcaagtggatgtgaaggacattccaaatatcaaaaagatactcatgggaatttcagaaaggcagtacttgaggatgtacaagagggtgaaacaagtgcaaagacattttgtgcctaatgagcccccaaagaggtatgatatgttccatatgactgtccattccatttggctcaggaggttgaatatccatattcaagaccagtaa

SEQ ID NO: 35769 - DNA, 1536 bp, Glycine max
  Peptide Sequence Number=SeqID_152547
atggaccctcaccgccgccaccgccaccgccgccgcacgtggtgctgctcctttgccgtccctccctccagccccgacaaccttactaactcctccaaacctctccctcgcaactccgagcctcactccaaacctgcattctccctcccaaactcccccaaatcccgcatcccagtcaagatcgaccctcgccggatcctttccccgggaagagtctcccccatcgactccgatcccgtcgccggagaacctcttccctttccccctccctcgccggagccgccgcggccgccatctccggcggcggctaccggcgagagggacgtgaggatgagcctgagaggaaagaacggcgggtgcatggttctggaagtgaactcaggagttctctgcgcgaattcggaagtgttcgcggggttgatagaggattacaagaaagggtcttcgagtggtagcaacaaaatgtgtagaatagaggttccggaagttgacaacttgggagtgttcagagaaaccattgagctcatgttcgagaacgatgatggcgtcaccaagaggcttcttaacattggcgtttttcgatccattgacgttttggaggtttcagcaggcatcatgttcactaagggtgttttgtcgtgtttacaataccttgaagccatgccttggactgaagaagaagaagaaaaactgagaagcctattcacaagattcgagtttgatgaagcaacaacaagagacatcctaggaaggctttacttgcacgattcagtagattcttcttcccagccaaatgtggcgcgacagctagtttggtcaattaccacttgtgtggatgccaatgcaagaaatgaaatgaagtcactagtgaagggtcttctttgcaaaagctcagtgtatgagaagaatcaccttgacctcagcaaggaggatctgtattctgtttgccacttgtgtctggactcattgataagcctctttgaggaggcatctgacactgaaaggttggcaaagaaagataagaataggccattgattgaacgtgtcgcaagacaggttgataacatcaactggttgttggaaatcttgcttgatgggcaaatagcagaggactttgtgaacatatgggcagatcaacaccaacttattaaaatgcatgaaaatgcatctcctatggttagatatgaactaagtcgtgtgtcagcgatgctttttgttgccatggctaccagaaaattgcaatgtcggtcagaagctcgattgggacttcttcaggcatggttcaggcctatgttgttagactttggttggcttcagagatgcagaagagggcttgatataaagttattgcaagaggctatgggtcaaacacttcttactctacctctaaatcaacaatacatgctcttcatggaatggttcaggcacttctcaagccatggaactgaatgtccaaatctaagcaaggcattccaaatttggtggcgcagatctttcttaagaggctttgaaactgatgccattgagtcaaggtaa

SEQ ID NO: 35770 - DNA, 1416 bp, Glycine max
  Peptide Sequence Number=SeqID_152548
atgccagggtttcggtttcaacccactgacgttgagctgattgagtattttctgaagaggaaggttcggggtaagaaattcccttccgaaataattgctgaacttgacttgtacaagtttgctccgtgggacctcccagatatgtctttgctcaagaatggggatttgaattggtacttcttttgccctcggggaaagaagtattcgactggtgggaggttgaatcgggccacggaggctgggtattggaagactactgggaaggatagagcaattgaacacaataatagagttgtggggatgataaaaacactggtttttcacactggtagagcccctaagggagatcgaactgattgggttatgcatgaatttagacttgatgacaaggtgctggctgatgaaggcgtattgcagaaaggcattttgcaggcaagcaactttgtggaagtatatgtgagtgttgtagggtttgtgactgtgaggatggtgtaccaaaaggagggtcctggtcctaggaatggtgcacaatatggtaaaccatatgaggagaaagagtgggaaacagatgaggaaattgattctgtacaatctgcccctgttgctgctgtttgtgcacctgttcctatacaacctagtgaaagccatatttcagttgctaattacatccatccctctacaagtggatgtgctggattgacctctgtatcatgtgtatcagaattgatgccatcttgctcgacacatccttcagcacctagcaatccagttggcactgtatcatgtgtatcagaattgattccctcttgctcggaaccacatcatttgccatcaaacaatcaagttggctctgtttcatgtgtttcagaattcatgccctcttgctcggcacatccttcagcaccaaacagtcaagttggctctgtttcacgtgtttcagaattcatgccctcatgctcagaccatccttcagcaccaagcaatcaagttggctctgtatcttgtgtaccagaattgatgacctcttgctcagcacatccttcagctccaaataatcaagttgacaatgacattctatctttgcttgattgtttctttgaagatgatgacacattggctgtgaaagaaaacaacagaattgagaacattgatgatcctgatcaggcaaacaatgccgatggtgcactgtgttcagatccaaatgctatttttgaggagttaggagaccttaacagcttggttggattgggtgaaggcagtttttcctgtggccagaaaaatgaatatactacaagcgaaatgctttatactgttgatatattcgggtcttgtgaccatgacttcttggagttgcttgacctagagacaccgcagctctggctgaataaacatggaagtggtagccaagataagtaa

SEQ ID NO: 35771 - DNA, 3240 bp, Glycine max
  Peptide Sequence Number=SeqID_152549
atggatcttttgatggttccatactcatcagatcctagcttgaaaataattcagtggccaccgtttctgcttgcaagcaagattcccatagcactggatatggcagctcaatttcgaggaaaggactctgatctttggaggcgcatatgtgcagatgaatatatgaagtgtgctgtgattgaatgctatgaatcttttaaaaatgtcctgaatgctttggtagtaggagaagctgaaaaaaggacaatctctgtcatcattaaggaagttgaaaacagcatctctaagaatacacttgttgcaaattttcgaatggggtttttgccttccctttgtaagaagtttgtggagcttgtggaaatcttgaaagatgcagattcatccaagcaaggtacagtggtggtcttgttgcaagacatgttagaagtgtttacgcgtgatatggtggtaaatgagataagtgagttggcagaacttaatcatagtagtaaggacactggaaggcaactttttgctggtacagatgcaaaacccgcagtattattccctcctctggttacagcacaatgggaggaacagattagacgtcttcatttacttttgacggtgaaggaatctgccattgaggttccaacaaaccttgaagcacgcagaaggattgcattctttaccaattcattgttcatggacatgccacgtgctccacgagttcgtaaaatgctgtcattcagtgttctaactccatactacagtgaagagactgtctattccaagaatgaccttgaggttgaaaatgaagatgtaattttaccagatgagtggactaacttcatggaacggcttgaatgtaagaaagatagtgagatatgggagaaagatgaacacatattgcagctacgacactgggcctcattacgaggacaaactcttagcaggacagtaaggggaatgatgtactaccggcgggctattaagcttcaggcttttcttgatatggcaaatgaacaggagatacttgatggctataaagctgttactgttccatctgaggaagataaaaagagccatagatccttatatgccagtttagaggctgttgctgacatgaagtttacatacgtcgccacctgtcagaactatgggaatcagaagcgtagtggagaccgtcgtgcaacagacatcctgaatttgatggttaacaatccctcacttcgtgtggcttatattgatgaaattgaagaaagagaaggaggaaaagtacagaaagtttattactctgtactggtcaaagctgtggacaatcttgaccaagaaatatttcgaataaaattgcctggtccagcaaagataggagaagggaagcctgaaaatcaaaatcatgccatcatttttactagaggcgaagctcttcagactattgacatgaatcaggataattacttggaagaagcttttaaaatgcgcaatcttttggaagaatttaatgaagatcatggggtgcgacgacctacaatattaggtgttcgtgagcacatctttactggcagtgtctcttccctggcttggtttatgtcaaatcaagaaacaagctttgtcacaattggtcaaagagttcttgcaagaccactgaaggtgcgattccactatggtcatccagatgtttttgatagaatttttcacataactcgaggaggaatcagcaaggcatcttgtggcatcaatctgagcgaggatatttttgctggattcaactcaacactaagacgcggaaatattactcatcatgaatatatccaatgcggaaagggtagagatgttgggctcaatcaaatctcactttttgaagcaaaagtggcttgtggtaacggagagcagacattaagcagagatatctacaggctgggacatcgttttgactttttccgcatgctatcatgttatttcacgaccattggattttatataagctcagtgattgtggtcctcacatgttatgcattcctatatggcaaactgtacctgtctttgagtggatttgaggctgcaatagtaaagttggctaggagaaagggagatgatgcactaaaggcagcattaacttctcaatcccttgttcaactaggacttataatgactttgcccatgttcatggaaattggactagagagagggttcagaactgctatcggtgagctcataataatgcagttgcagctagcacctgttttctttactttctccctagggacaaagctgcactattttgggcgcactcttctgcatggaggggcaaagtacagagcaactgggcgtggttttgttgttcgccatgagaagtttgctgaaaattacaggatgtactctaggagtcactttgtaaaagggattgagctcacaattttgctcttatgttataagatttatggatcagcaacacctgattcaacgtcatatggctttctctcatggtcaatgtggtttatggtctgctcttttctgttttctcctttccttttcaatccatcagggtttgaatggcagaagatagttgaggactgggatgattggcaaaagtggataagtattcgaggtggtattggtgttccttcaaacaagagttgggagtcatggtggaatgaggaacaggagcatctgcagcacactggatttctggggcggatatgtgagattatacttgacctgcgtttctttgtctatcagtatggtattgtgtatcatctcaatgtagccagaggtgacaagagcatcttggtttatgctctgtcctggatagtgatagtagctgtcatggttatccttaagattgtatccatgggtagaaagcaattcagtgcagatttccagttgatgtttcgtcttctcaaattgtttctgttcattggagccattgttgctctaggcttaatgtttactctgctgagtctcacagttggagacatctttgcgagcctcctagcctttttgccaacagcttgggcagttattcagataggacaagcatgcaggccattcgtgaagggcattggaatgtggggttctgtcaaagctttagcaaggggctacgaatacttgatgggagtggttatttttgcaccagtagccatattagcttggttcccatttgtttcagaattccaaactaggctgctgttcaaccaagcattcagccgaggacttcaaatccagcgcattctggctggtggcaagaagaataagtag

SEQ ID NO: 35772 - DNA, 579 bp, Glycine max
  Peptide Sequence Number=SeqID_152550
atggacaatgagtcgccaagaatctatgtcggaagaggaatgcatgagaatcaatttgctctcctaaaatacactcttttttgggtgattctcttggctgctaaattttcattcagcttttttgtgcagatcaaacctctagttcagccaactaaagacataatgagcattaggcatgttgattttggttggcatgagtttttccccaaagctcgacataactatggtgcagttgttgcactttgggcccctgtacttatggtttatttcatggacactcaaatctggtattccatcttctcaactatttgtggtggtgttattggagccttcgatcgtcttggagagatacgcactctgaccatgttaagatcacggttccagtcattgcctggtgcattcaacacatacttggttcctactgacaagaagcgggaaaagagattcactttctcgaagcgatttgccgagatttctgcaagcagaaggagtgaagctgctaaatttgctcaattatggaatgaagttatttgcagtttccgtgaggaagatatcataagtgataggaaaggcttctga

SEQ ID NO: 35773 - DNA, 276 bp, Glycine max
  Peptide Sequence Number=SeqID_152551
atgttgtcttcatccctaaatgtgatcatccatcctgttctggccaatctcctcaagaaggttattggggagcgcatctcaggagcaatcagcttcattgaaggaagatctatcttgcacaatgccctcatagctaatgagattgttcatcacatgaagtgtaagggaggtaagcatggtgaagtagccttaaaaattgatatttctaaggcctacgatcgggttgattggcatgagtgtatcttatgttgtgtgattaggcatgagtgtatctaa

SEQ ID NO: 35774 - DNA, 264 bp, Glycine max
  Peptide Sequence Number=SeqID_152552
atggagaggagggataattttcatggtattaaggtagctcgtggagcaccgattatctcccatttactttttgctgatgattgttttatgttttttagagcatcttcacaggaagctgatcacatgaagttcattcttaacatgtacgagactacctctggccagaccttaaatcttcaaaaatctgaggcgtactttagtgggaatgtggaccaatcaactcgccaggatattctgtcccacattagagttcgggagggctag

SEQ ID NO: 35775 - DNA, 657 bp, Glycine max
  Peptide Sequence Number=SeqID_152553
atggctcttttcttcataacttcactagttcttgtttcttgtcggagtcttctcgctccaaatttctcttcttcaccttggaggggagaaccaacttcctctttggatacagaaaacaaaagtgcttcaatattacatgatgatcatgagggagaagctccatctccaactgcatttgactcggatcatcatggtcctcatcgagaaatattcaataagggtgatgaaaatgactccaagtttaagcataaaggtacggataaagggtaccttacagatcacaagtacaccaagttaggaagaattgaagcaagattggctaaagcaaggtattccatcagagaagctagcaaaattcgaaatttgacatcaaacctccaagatccagactatgttcctcaaggttcaatttacagaaacgtcaatgcctttcagaggagttacctagagatggaaaaggttttcaagatttttgtgtatgaagaaggggagccaccgttgttccacaatggtctaagcaaagacatatatgccactgaggggagattcatacatgaaatggaaaaggggaggtactatcgtacttatgatccagatgaagcttttgtgtattatctgccctttagtggggtttatgttggtcgaatatgtgtatga

SEQ ID NO: 35776 - DNA, 363 bp, Glycine max
  Peptide Sequence Number=SeqID_152554
atgtccggcttagagaaaaccgtgttgactgttcctcgctgccagtcaacaaaagaagctatctttgagcttattgcctctcttcagcagcctaagaaagcgttattcgctgcaggggctattttgactgcttggggaagcagccgaaaagatgattcgggggcttttgctatagctcgaactgggtgggagactccctgcatgaacatcattgagggagaagcgatgggagtgcttaaagctctcacttggttgactgagcttagccttactcatgttattgtggaatctgattgcaaagtagttttagataaaattaacaactttgatactgatgttacagaaataggatgtcattgctga

SEQ ID NO: 35777 - DNA, 478 bp, Glycine max
  Peptide Sequence Number=SeqID_152555
gttgttaccacaggcaatttgtacctctcaaaagaagtactggtgcttcagagctcatgtggaggcttcttttaacactaatcccttgaaaaattacacatcagtcagttgctctacatggtggtctgaagcacaatccttagtttcttacaaaacacacaacaaacagttgttcactgtaggatctttagcaacttcaacagctcaagatgtttctgatacaactcttattggtggtgataagattggcgtgttactgttaaaccttggaggtccagagactctagaagatgtgcagccttttttgtttaacctttttgccgacccggatataatacgtttgccaaggatatttagttttcttcaaaagccattggctcaatttgtatctgtcgcaagagccccaaagagcaaagaaggctatgcttcaattggtggtggctctcctctcagacgcatgactgatgaacaggcatga

SEQ ID NO: 35778 - DNA, 1686 bp, Glycine max
  Peptide Sequence Number=SeqID_152556
atggcagaagcacttagagattcctttccaccttcagataaatcattaagtaaattgcttggtgaatctccttatttaccaaaatcagttctgaaaattttagaaaatatgtgttctcctggaaatggggataaaggtgaaaaggagttgcactcactgaatgcggatagagttactcaaggtctaagtactgtatggagtttgattcttctaaggcctcccattcgagatacttgcttacaaattgctctacagagtgcagtgcatcacctggaagaagtgcgtatgaaggcgatacgtctggtggcaaataagctttatcctctgtcatccatttctaagcaaatagaagatttttcaaaggaaatgcttttctccgtgatgagtggcgatgcaactgaagctactgatgttgaaggttcctttgctgattcacaaaagggacctgatgttgaaaaggttccaaacgaacaatcatcattgagtggcagtactaaagatgtcccctcagataatcgtcaatcatgcacatctgagagtgtttctccagattcagtttctgaggctcagaggtgcatgtcattgtattttgctttgtgtacaaagaaacattctctctttcgccaaatatttgtcatctatagaagcacatcaaaggcagtgaagcaggcagtacgttgccaaattccaatactagtacgtactatgggctcatcttcagatctacttgaaattatttcagatcccccaaatggaagcgagaatcttctaatgcaggtattgcaaacacttacagatggtacggtcccttctaaggatttaatatgtaccgtgaaaaggttgcatgattcaaaactcaaggatgcagaggttcttattccgatattaccattcctatcgcatgatgaggtaatgcccatttttcctcacattgtgaatcttcctttggagaagttccaagcagcacttgggcgcatattacagggatcatcacaatctggtccagtgcttactccggctgaagttttaattgcaattcatggaattgatcctgaaaaggatggaattcccttgaaaaaggtcacagacgcatgcaatgcttgctttgagcagtggcaaacttttactcaagaagttcttgctagagtattgaatcagttggttgagcagattcctcctcctttactgttcatgcgtacagtattacaagcaattggtgcttttccgacactggtggactttataatggggattctttctcgccttgtgatgaagcagatatggaaatacccaaagttatgggtgggattcttgaagtgtgtgcagttgacaaaaccacagtcatttggcattttgcttcagctgcctccagcacaattggaaaatacattaaatagaattgcagccttgaaggcaccattgattgcgcatgcaagccagccagatatacaatctaaacttccaagggctatgctggttgttctgggacttgcttccgattctcaggttttaagtcaagcacaaactactcagacacaaactagtcagacacagactagtcaaacacagactactcagacacaaactagtcagacacaaactagtcagacacagactggtgagacaagcaattcagacaaggacacagcgacagaaaaatctaaagaatcatctacagcgagctaa

SEQ ID NO: 35779 - DNA, 726 bp, Glycine max
  Peptide Sequence Number=SeqID_152557
atggtactaacgtcaccgctttggtcaaagttttttgatgtatatgatgagataatagatttcaccaaagcgtctagtgagatcaccgaaaggcatctcaagaagcttgggatgaggtttgttaaccatgagtggattatggctagagagccagcagcaataggaaacgtggatcagatggaagaagaagctaaagctgaagctttgcattggaagcactttcttcttggccttcactttaagaagcttctccataatttccacaagctcactcacatgtacaagggaagtgaaatcccttgccaaagttcccccatcaggagacttgaatatcgtaatatgcttccccttgagaatgtccttcgtggatgctggcacaatcgaggaggcattggcgggttcatagtagcggttgaagttgtcgaggtcgaggacatcatcgccataatgcttgagggagagggagacataggggtcgacaaagccagtggcactggtgatgaggacgaagaggccagagggggaaatttgggtgatgaaggcaggggacaacgcgtcattgggcgacaacgacggggtgttgaggtttgggttaggcacgagaagaagatgacggaacgagaagagatgagtaggtcaggcttagagagttttgttaaaatcgatgttgtcaagcattacacaacattgattttcataaaaccgatgttaacaagcattaaataa

SEQ ID NO: 35780 - DNA, 741 bp, Glycine max
  Peptide Sequence Number=SeqID_152558
atgataacaaaaatcaggaatgctgaaaataagagcttgaaaattaaaagggatggaattacaaagcttgttattcttccactctatccacaattttcaatatcaacgagtggctcaagcctacgtctactggagagtatattccgagaggatgagtatctagtcaacatgcagcacacagtaataccctcatggtataaacgtgaaggatacataaaggccatggcaaatttaattgaaaaagagctgaagagttttgactgccccgaggaggtcatgatattctttagtgcacatggggtgcctcttgcttatgtggaagaggctggtgatccatacaaggctgagatggaagaatgtgtggatttgatcatggaagaacttgagacacgaaagataactaatgcttgcacccttgcttatcagagtagagttggaccagtggaatggttaagaccctatacagacgagacaatagttgaacttggaaaaaagggagtgaaaagtctgctcgctgttccaattagcttcgtcagtgagcatattgaaactctagaagaaattgatgttgaatacaaagagttggctctagaatctggtatagaaaagtggggccgtgttcctgctctaggatgcgaacctaccttcatttctgatttggcagatgccgttattgagagtctcccatatgttggtgccatgacagcttcagaccttgaagctcaacaagtactcttttga

SEQ ID NO: 35781 - DNA, 1248 bp, Glycine max
  Peptide Sequence Number=SeqID_152559
atgaaaagaaaagcattgagtgtaatcttcatatataatgaaactgtccagctgcaggaagaggaagaggaacctgcaacaaattctggcgattcagtgcagaatactttggcaagaaaacgatcaggatcacaaattggaggtgatttatctgaagatgaagaaactcctggaaaacgtgtcaggacaacaattgttgctttggaagaacctaagaaggagttagatgtatgtaccactgcctactctcaggatgaggctccttcaaaaggagttgtggataatgggcctgtacggcaacttgttgccacatttggtgctttgattgctcaaggtgaaaaagctgttggacatttggaaattctcatctcaagtatttctgctgacttgttagctgaggtggtgatggcaaatatgcaaaacctacctacgtattaccctaatgctgaaggaaatgatgaacagctgcaagacattagtatgattggttctgatgacaaggctaaatatccagcatcatttgttgctgctgttatgtcactttctagtactttcccgccaatagcttcccttcttgatgcacatcaatcagtgtccaaagaggtagtgaagtcacaagtggaggaagaaattgctgaaactgctacaaatattggtcctgtgcattctggcatgaatattgagtctgaaaatataccatcgcctcctgattttccatcttctgatgccagtatacctggagtagagaatggctgcacaactgtgcctcctgatcctgacatccatgatgttggaaactcagagagtggaatccctggcctggattcttttggtcgtagtgatgctgtgtcacaaacttttgctccttccttattggtttccactgaaatatgccaagaagatggcagtcaagagcaagatacaagtttggatcagaggtcacctctgaacttagctccatcaatatcaacagatagatctgaggagctgagcccaaaagcggctgttagagatgccaatagcttggtgtcctcaacagctacttcagttgtgcctccccgattagtcttgccaaagatgattgctcctgttgttgaccttgaagatgaacaaaaggatcgtttgcaacagtcatgttttatgcgtattattgatgcatataagcaaatagctgtagctggaggctccaacgttcgtttttcgatacttgcttatttaggagttgaggtgaaaattccagcttcttga

SEQ ID NO: 35782 - DNA, 228 bp, Glycine max
  Peptide Sequence Number=SeqID_152560
atggttggaagtggcaaagtcagcacatttggtggatttgggaagtgggtttgtagccggagagtgatcggagatcggaggagatctgggtcggagaaatgggaaatggttttgatgagagtgtgtgtggatgtgtgtgagaaagaagcggaggagaagaagaagaaaaggaaaagagtgaggaggaggaggcacttgattagccaaatttgcggatcaaattcatga

SEQ ID NO: 35783 - DNA, 765 bp, Glycine max
  Peptide Sequence Number=SeqID_152561
atgggatgcaagcctttagagcgcatggacatagttggtggatcatcagcagcaagcccttgttcatcttaccatccaagtccatgtgcttcctacaatccaagccctggctcatcatccttcccaagtccatcttcatccccttatactcaaattcctaatgctgatggcaactccctcattccatggctcaaaaacctctccactgcttcatcttcagcatcttctcccaagcttccccacctctacctccacagtggctccatcagtgctcctgtcacacctcctctgagctctccaacctccagaacgccacgaatcaatgtcgagtgggacgagcagtctgcgcggccggggtggaccagacagcagcactactcattccttccatcttctagtcctcccagccccggtcgccaggttgttgaccctgaatggtttgctgggatcaaacttccccatgttagtccaacctcaccaacattcagcttggtctcctcaaacccttttgccttcaaggaagatggcttgcccggaagcggttcgcgaatgtggactcctgctcagagtggaacatgctctcctgctattccacctggctctgatcaaaatgctgacattcctatgtctgaagctgtttcagatgaatttgcatttggaagcaacacgttggggcttgtcaagccttgggaaggagaaaggatccatgaggaatttggatcagatgatcttgaactcacacttggtaactcaaagaccagatga

SEQ ID NO: 35784 - DNA, 252 bp, Glycine max
  Peptide Sequence Number=SeqID_152562
atgtcagaaatgtccctgcaatgtttcgttgtgcggatcaacttgatccgcgaaaaactcctacggatcaagttaatccgtgtaacacaggcggaccaaaagcggatcaagttgatatcaccaccgccatggatcaacttgatccgcagctttaaaatctacatgcggatcaagttgatccgtaaagcaccaccaccacatcgccaaacaccagtcgaggagaatgtgcgaggaagaagcagagcagcataa

SEQ ID NO: 35785 - DNA, 501 bp, Glycine max
  Peptide Sequence Number=SeqID_152563
atgtcagttgggtgcacgacaatcgttttaaatgctcacagggtgggggtggaattgccactggatgaggaacctccccattctgtttcggccgtggaggtggagatcgggtatggcgggatcacaactggtagagaacgagtatcaacttctcgagatggtgactctattgagagtggtcgtattagtggacggttttgtctctctccaagaaaacccaagcgagggatgtcggtttccgtaatcggcaaggaattagacatacagagattaaagacagggaaggcaccttcggaccaactgttcaggctcctcttcctcctctgcttcttcatggtcaaatcgagtggtggtcattgtagctctgccagcaagaaggtcatcatgtcttgcaagaactttctgaagttgctcattcaattcaattgctggagaaattatcctttcatctctaccgaagaccaatgcataaccaatttaaggaataaattaaccatataa

SEQ ID NO: 35786 - DNA, 138 bp, Glycine max
  Peptide Sequence Number=SeqID_152564
atgtcacgagtgcttgacaagaagcaggaaggtggaagggaagaatatgcaggattgtttttacatataatcacaaggttgaggcctaacaaggagcagcagaagtcagcagcaagcttctttggctatagaacatag

SEQ ID NO: 35787 - DNA, 993 bp, Glycine max
  Peptide Sequence Number=SeqID_152565
atgtgcatggcggcgacttcccgtgaaaagctcacgagtctcgtgaacgccgccaagctggccatcgacatcccctccaagctcgaatcgctgcgccaactccgccacgaacttccccccgaagaccccgtcctcctcaccgagttcctcccatcgctcttcctcttccactccgatcgcttcggccccgttcgcaaattcctcaccgagatgcttggggagattggattgaagaacacagagttcttgtccgacattgtgcctgtgctgattgatttattggatgatgacacgccggcggttgttcgtcaagctctactgtgcggaattgacttgtttcgtgccacacttgagaaaattgcggttcagggtctatattctagtgatttagacggcgcacttgaatccgcttgggcatggatgcttaaattcaaagacaaagtatactcaatagcttttcaacatggaagtggtggtgcaaagctgctggctctgaagtttgttgaggcagttatttgtctttacacgcatgatcccaatggttcctcagagcccacttctcatcaaggaaggcctgtggaatttaatatatcatggctcgggcggggtcatcctgtacttaacattggagatttgtcaattgaagccagccatcgtttgggtctcttgcttgatctactcagatttccaactgtgaagtctcttggtaactcagtaatcattgtgctgattaaaagtctttcagccattgcaattgacaggcctgcattctatggccgcatcttgccagttttgctgagtttggaaccttccagctctgttgttaatggggtctctgtatcagctacacattttgctttgaagaatgcctttcttacttgctcgaaatgtacacatccaagtgctgctccgctgagaacaacaaacacgagtgatacatgtttggtgtatccacaaatgttacgtcgactggtttggtctagcttattttag

SEQ ID NO: 35788 - DNA, 1512 bp, Glycine max
  Peptide Sequence Number=SeqID_152566
atgaagttccttgtgaggtctaaaagcccgggtcctgggtcaagagggcccaccagcccaacatcacctctgcatccaaagttgcttggtttgagtcttgactcccctacaggcaggcaagaaggtgaatgtcatccattgcctcttccgccaggttctcctaccagtccttcttcttctcttcccagcatgagagcaaatggaatgacggaacacactaccagtaacctttccaagtggaagaaaggaaagcttcttggtcggggaacatttgggcatgtttacctgggattcaatagtgatagtggacaattgagtgcaattaaagaagtcagggttgtctgtgatgaccaatcatcaaaggagtgcctcaaacaacttaatcaggagatccatttgctcagtcagctttcacatccaaacatcgttcaatactatgggagtgatttgggggaagaaacactttccgtttatttggaatatgtctctggtggttctattcataaattacttcaggaatatggggccttcaaggagcctgttattcaaaattataccaggcagattgtctctggactttcctatcttcatgggagaaatacagtacatagggatatcaaaggggctaacatactagttgatcctaatggtgaaatcaagctggcagactttggaatggctaaacatagaatgagagctagaatgcatctggctcacacagaactttctgatctctgttctgtcgtttacaatttaaagataaattcttcttcctccatgctatctttcaaagggagtccatactggatggcacccgaggttgtaatgaatacaaatggctatagtcttcctgttgatatatggagcttgggatgcacaattcttgaaatggcaacatcaaagcctccttggaatcagtatgaaggggtagctgcaatatttaaaattggtaacagcagagatatgcctgaaattcctgatcatctctcaagcgaggcaaagaaattcattcagctatgcttacaaagagatccatcagcccgcccaacagcccagatgttactagagcatccctttattcgagatcagtcattaacaaaagctacaaatgtcagaataaccagggatgctttcccctgcatgtttgatggaagtcggacgcctccgccagttttagatcattccaatagaacaagtttaacttcattggatggagattatgcaacaaagccagttcctgtaacttcacgagcagaaaggagcccaagagataacacaagaatgatcacatctttaccagtatctccctgttcaagtccattgcgacagtacgagccagcgcacaagagctgtttcctttctcctcctcacccaacttacactttgatggggcagaatacactcccctcatatccagtgagatcaaatgccacgttcactcttgacccttttcaggaaacttctttttacaaagcccacacgcccggtggatccccaagaagactcatttga

SEQ ID NO: 35789 - DNA, 444 bp, Glycine max
  Peptide Sequence Number=SeqID_152567
atgtgggcgagaaggaaaacaccaaagctagatgcttccttgtttctcgacatagaggttggtcaatccttgatcatcgatgatcccgccgccggggcattcaccgtctccgctttcgacgccaatcactgccctgcttctgcgtttgttaaatttttttataacgagttttactactaccttgctgttagaataaaaacttccaaacataaatcacatcaggaaaattcggtaatattctgcacacgggagattgcaggctcattccttagtgtttgctcaacttactggacaagtatgttgggaggaaagggaaagagccttgctgctctcttgattgggatgcctggcaaacattctgctattcaacagatggaaatgcatgctttagatgcactccttggttgtagtaagttgcttgtattgtatagtctatggagataa

SEQ ID NO: 35790 - DNA, 579 bp, Glycine max
  Peptide Sequence Number=SeqID_152568
atggcattcttgggagagacaagcagtcagacagttgtgaactccacattaggttttatttttccaaatggatccattgttcacaacgacagtggtgtttcattccaagcttccactccagttcccattcgagtacctaacgggtgtgattttcaaacattaaaaaccagaatacacaatacccttaagctaactgacaagcaatttttggatgaaatttactatcggcagcctttcacgtatgcaggaaaaaatcccaaaaactttgacattcccaccggatgtaccatggatgagttgaaggatttgatcaagcaagttgcgccttgtgggattcccccttatggtgttgatgaaacacaaatggtaaggcgattgttttttcggaaaccaagtcaccataagtattcagaaaaagttataaaatttgaaataattgaactcaaaaccaacgaggacgtgatgaaggtgctcattgagtctaactactggaaaaagattggaccaatagaaattttagctgttttcagtaaacctgtaccgcaaatggaagatgagttgtccttgtcgcaaaattag

SEQ ID NO: 35791 - DNA, 279 bp, Glycine max
  Peptide Sequence Number=SeqID_152569
atggtggagatgtgtttaggctaccggttccgtttcgcaattgaagcttcggtcctattgtcttcgtcgccctcccttttcactttaccttaccccagcagaggtcacgatttagcgattgaagcagaggatgaaagaaagcctaggccagatggtcttcacgccattgccgctagtcttgctagagctggcatatttcctggaagatgctattcaattcttgctagagaaatcagaccagaagaacttattacagtaactgatttctatgtatcttga

SEQ ID NO: 35792 - DNA, 513 bp, Glycine max
  Peptide Sequence Number=SeqID_152570
atggacattgtgagtactcaaggcaaacgtgaaggtgaagctgatggtggaaaggatgcgggacatggtaaagtggatgttgcgtggaagatgttgagggtgatgaatggagttcggggtgtaatgctagatgcatctgattttgatgcagagaacgctgaaagaggcatctatgcagggaaaggagtagttgaattgggaacgggacaagcgtgctgtgatgaggctaatcttgagaatcctaaccaacagatgttaccagcatttcaaacaatttattacatgccctcaagagtgggaaagacaaatgaaatgagaaaggtcaatggggaagcctacatgctctcactgaaaatacctcctggattttggagtagatcgagattttcatttaattccaattgtgatgccctactgaatatgtctgaaacattcaacagtgtgatcgttggaccaaaagggaaacctattatcagttttgtcacagtgcttgaagaaattactttcttatag

SEQ ID NO: 35793 - DNA, 720 bp, Glycine max
  Peptide Sequence Number=SeqID_152571
atgaagccttcttctcccaatgaagaacatcatgacttggaaaatgccaagtcggacaaagataaagtaagaacaccaagaaatggaaggggagttaaagtctacaatcaggccttgttgtctggacttgcttattgtttttcctcatgtggcatgatattggtcaacaagcttgtactttcaagctatgattttaatgcggggatatccttgatgttgtaccagaatttaatttcagttgctattgtttccgtgttgagccttctgggtttagtttcaactgagccgctgacgtggagattgatcaaggtctggttgcctgtgaattttatatttgttggaatgctcgttacaagcatgtttagtttgaaatacattaatgtagccatggtgacagtcctgaagaatgttactaatgtcataaccgcccttggtgaaatgtatttgttcaagaagcaccatgatggtaaagtctgggcatctttgtttctaatggctgcgtacaacatccctctcccataccttcgcatagcgaagagcctccgggcaatggggtacgaagacgaagttttatctccttgggcatgttgttatcatggtcatagtgtatccctagtccctaggattctccatctctctgtgctaaggactggtttagacttggttgaaagacaaattgatgctccaaagggtcatggatacagcaaagcaagttactaa

SEQ ID NO: 35794 - DNA, 126 bp, Glycine max
  Peptide Sequence Number=SeqID_152572
atggctagccataaatttttaaaaaggataaacggattgcaacaagtgaccctgttgtattttgttcagtgggtgtggagccacgttctcaattactgtactggacctaatgcgcttgatcattga

SEQ ID NO: 35795 - DNA, 153 bp, Glycine max
  Peptide Sequence Number=SeqID_152573
atggagcaaagcaatgagtctggtaaaaccaattgtggtcacatatgtgatgtagaatgtgcacctttactacaaaatggtgctcatggttatgcagaatatgctggtgatcttgtggcttatgtgatgcatttttgcttgcaggagtgttag

SEQ ID NO: 35796 - DNA, 288 bp, Glycine max
  Peptide Sequence Number=SeqID_152574
atgacgtccgtcgcgaggcagccaacgtggaaggagcgggagaacaacaagaggcgagagaggaggaggagagccatcgcggcgaagatcttctccggcctgcgaatgtacggcaactacaagctccccaaacactgcgacaacaacgaagttctcaaggctctctgcaacgaagccggctggaccgtagaagccgatggcaccacctatcgcaagtggcatggcacatgctactggtggtgggaatcagaaggacgcgaaaggcgcagggagttacggaaaggatga

SEQ ID NO: 35797 - DNA, 405 bp, Glycine max
  Peptide Sequence Number=SeqID_152575
atgttagaaagaaacacagcacacagcgcgagtaagcgaattatagaggaaacgacatcctttctgctttttttatataagatttgggattgtgatctgagtagatctaggcgagggaggttgggtggtggaggcggaggagcatggtggccggaaaagccgccggaaaagagaggaagtgggtttgtgttaggtgtgaactgtgcacaatggggagaagagaaggttgaaggagcgaaagagaaagagaagtggactaaatacgttgaggagagggaattgggcttggttttgggggtatttacggatgtgccactagatttagagagagagagtgggattttggggcgtttttgtttaggacaattgaagcctgaaaaagatgaaagactctgttttaagtaa

SEQ ID NO: 35798 - DNA, 1041 bp, Glycine max
  Peptide Sequence Number=SeqID_152576
atgagtgaaaaccacaatccgccatccgccgatgagcaaaaagacaacaacacgtcagattccagtcaggataatgagcaatcaccgcgtaaacgccccggcaaaaagccgctgatcattctggcgattgtggtggtgattatgctgctggtgggattctggttctggtttagcacgcgcaatattgaaaccaccgacgatgcgttcaccgaaggcgatgccgtgaccatcgcgcccaaagcgtcgggctacgtggtgcagctgctggtaaaagataaccagcgggtgaagaaaggcgatctgctggtgctgatcgacccgcgtgataacgccgcacagcgcgatcaggccaaagcacagctcggtctggcgcaggcgcagctgcatcaggcgcaggcgcagctggcgctggcacgggtgcaatatccggcgcagcgcgatcaggcgctggccgaccaggcgcgggcgcaggccaatttactcaatgcgcaggcggattaccgtcgtcagcgcggtgttgacccgcgcgcaacctcgcagcgcaatattgataccgccgccgcgcagttacgctcggctgaagcgcagctgcaaagcgccaaagcgcaggtcgaagtggcctcgcaggtgcagttgcagattcgccagcaggaaaccaatgtcgaagcgcggcagcagcaggtcgagcaagcccgggctcagctcaacactgccgagcttaacctctcttacaccgaagtccgcgcgccgtatgacggtttcgtcaccaaacgcaacgtgcagcccggtacgctggtgcaggccggcagcgcgctgttttcgctggtatcgccggatatctggatcaccgccaacttcaaagagtcgcagctggcacgcatgaatccgggcgataaagtggagattggcgttgatgcctggccggacatgaagctggaagggcacgtcgacagcgtacagatgggctccggctcgcgcttctctaccttcccggccgagaacgccaccggtaactacgtgaagattgtgcaacgcgtgccg

SEQ ID NO: 35799 - DNA, 186 bp, Glycine max
  Peptide Sequence Number=SeqID_152577
atgactcgaacgcaacatgtgcatatcgtgggggagccctggggcattccattgagcactgattttcaagtgcaagccattggtcagtttgctcaagcgacctgtgctcctgagtttggacttccaagaccgttcaatcagagattactcgtcttgcacgttggtgggggtgccgtaaaacaatga

SEQ ID NO: 35800 - DNA, 150 bp, Glycine max
  Peptide Sequence Number=SeqID_152578
atggctaccattgcgttatcaagtagatatgggagcaagttagcatatgacaccggaatttggggtgaatcctacaggctttttgctgcaaaattcatttcttggttggtgttttttttgtgcggtagacaggctttgtggttgatttag

SEQ ID NO: 35801 - DNA, 1824 bp, Glycine max
  Peptide Sequence Number=SeqID_152579
atggcttccctatatcctccacccttttccattgcaaccaataataatacttccaccccagctgccaccggaacccatgtttctacctcttgttccatccccttaatcagaaatcacaattccaatgccccaaaagttgcgaagtctagagtgtcatgcaaagccacaaagggtggtgaccaagaaaaccaatcaataaaaaacatcaacaaagacacccaagaagaggcctttatgtttgacagaagaaatatcctcattggcctaggaggcttttatggtaccctaagcaatgattcattgtcccttgcagcacctatctcccctccagagataaccaaatgtggcccacctgaccttccctcaggagccaaacagaccaattgttgccctccaatttcctcaaacatcatagacttcacacttccaatcaccccccaagttaaggtcagacccgctgcacatttggtagatgccacatacctccaaaattacaaagaagcccttcgtcgcatgaaagccctgcctcccaacgatccacgaagcttcacacaacaagctaacattcattgtgcttattgtgatggtgcatatcaccaagttgggttcccttctcttgattttcaagttcataactcttggctcttctttcccttccaccgctggtacctctacttctatgagaaaatcttgggaagcttgatcaaagatcttgacccaaattttgcccttcccttttggaactgggatttccccaatggcatgccaatgccagccatgtacactgatcccaagtcaccactttatgactccctcagaaacgcaaatcataaaccgccaaaactcgttgacctagactacaacggcgttgaagaccaatcctcaacacaagaacaaatatcaaccaatctcaacaccatgtaccggcaactggtgtcaagttcaaagactccaacgctcttcttcggtagcccttaccgtgcaggagaagatagtgatcccggtggtggcactgtggagaacattcctcacggtccggtccatatatggaccggtgataacacacaacctaactttgaggacatggggactctctattctgctgctagagaccctattttctattctcaccacgctaatgtggatagaatgtggtccatatggaaaactcttggaggaaagagaagtgacatcaaagaccctgattggttggaatctgggtttcttttctacgatgagaacaagaatcttgttcgtgtgaaggttaaggattgtcttgatactagaaagcttggatatgtttaccaagatgttgatgttccgtggttagaagctaagccaacaccgcgttttcgaagagtggttgcaaggagctttggtgctggtgcagcactggctgctgagactactaataaaactactaataagtttcctttggttttggattcaagtgtgagtgctcttgtgaagaggccaaagaagggaaggagtgagaaggaaaaggaagaggaggaagaggttttggtgatagaagggattgagtttgagagggatttgggtgtgaagtttgatgtgtatattaacgatgaagatgatgtgccaggtgggccaagtaagactgagtttgcgggaagctttgtgagtgtgcctcataagcacaagcacaagcatgggaagatgaagactaacttgaggcttgggataacggagttgttggaggatttgggtgctgaagatgatgagcatgtggtggtgactttggtgcccaagtttgggaaggggcatgtcatcgttggtgggatcaagatagagtttcacaagtga

SEQ ID NO: 35802 - DNA, 1872 bp, Glycine max
  Peptide Sequence Number=SeqID_152580
gggtcctggaaactatgttagaacggtgatggtggtgactgggcttggtgataaggtggctcacgatggcaaggaggtcaaagaaagtgtcactgttgttaccatggccgaggaagttccaaagacaagcacaactccagaggaggtggtggtctctgacgtggcacctgctgacgagaaaccagacaccaccaccgacgttgttgttcccgtagagaaagacgcacaacaagaacaagaaacctcgccagagaaggagaaagagaacgttcccgaaacagctgaaaccgagtccgaggttgtttcaaaaccaagcggtgacgacaacgttcctgaatccggttctttcaaggaggaaagcaccattgtttccgacctacctgaaaccgagaaaaaggctctgcaagaactcaaacaactcattcaagaagcgctcaacaaccacgagttatccgaggtacctacaactaaccctcccaaagatgaaaaacccgaacacaaggaagaacagaaacccgtggaggaagaaaagaaggaacatgctgctgacgtggcagaagagacagaaaaagaagctgcagaagttacggtaaccgaaactgaggttgttgaagagaaagtggcggtttctgcttctgctgacgaggatggagcgaaaaccgttgaagccatcgaagaaagcgttgtgtctgtgacagtgactgtctccgaggaaccaaaggtggaagctgtttcactttctgcttctcccgaagaggtttgcatttggggtgtgccgcttctcgctgatgacagaagcgacgtgattctgttgaagtttcttcgtgctcgggacttcaaggtgaaggaggcattggcgatgataaagagcacgattcggtggaggaaggagttcaagatggaggagctgttggaggaggatttgggtggtgatggtttggagaaggcggtgtacatgcatgggttcgacaaggagggtcaccctgtgtgttacaacatctatggtgagtttcagaacaaggagttgtacaagaagagtttctctgatgaggagaagaggtataggtttctcaggtggaggattcagttcctggagaagagtatcaggaagctggattttaaccctggtgggatatgcaccattgttcaggttaatgacctcaggaattctcctggcccttctaagtgggagcttagacaggctaccaaacaggccctgcagctgcttcaggataactatcctgagtttgtagccaaacaggtgtttatcaatgtgccatggtggtacttggcagtgaacaggatgataagtccctttcttactcagagaaccaaaagcaagtttgtctttgctggaccttccaaatcagctgagacccttttgaggtacattgctgcagagcaacttccggtcaagtatggtggactaagcaaagatggagagttcggaatttcggatgctgttacagaaattacagtgaggtcagcagcaaaacataccgtggagtttccagttactgagaactcgctactctcttgggagctcagagtaatagggtgggacgtgagctacggtgcagagtttgtgccaacttcagagggaagctatactgtgatcatccagaaggccagaaaggttgcttcatcagaagaaccggtgctttgcaacaactacaaaattggtgaacctgggaaagtggttctcaccattgacaatcaaagctctaagaagaagaagctcttgtaccgcttgaagggagatggagaagagcagtgcctacatgggttacttgattacattcttgcattcacttctatctcccaagatgttcaaagcttcaaagatgtggactttgctgctagaagaggaaa

SEQ ID NO: 35803 - DNA, 642 bp, Glycine max
  Peptide Sequence Number=SeqID_152581
atggctaatgtgagattatgtggtttgaagccactgctctttggacggaagtcatgtgtttctgagtcaatgaaaagctctaccacacccaagaagtcttctatggctcagaatgaagggaagggggggtcaattgagtggtcatttgttggtgcggaccaattgatttcaatgatgaaggtccataaaaagatctttgtcttcagggacatcatggaccttgctcctctgaatagttctgcttccttacatgagatggttattgcaaccctggaggaagtctatagatcaggtgaaaccatgtcgggcacacttgattgtttgattaattttgctagtgaaaagtttgatatcatggaagaggaccccaaaaaagaattcagcccaccatctagctcgtttggaaaagttatgtccaactccaactccttttctgaaagcagctattctcctaccacaccactttggtctctcagaattcaaggtgtggcaaagcagaacccgattgatttaaagcgcttatcttaccatatgtcaccaccacacacggaaatccacaagatagagaagaaaccaactataaacatggaaataatagatcacaaagctgaaaatcatggaaaaagcatttcacaagagata

SEQ ID NO: 35804 - DNA, 369 bp, Glycine max
  Peptide Sequence Number=SeqID_152582
atggataagtacgagaccgttaaggatttgggagctggcaattttggggtagctaggcttatgaggaacaaggtcaccaaggagcttgtagccatgaaatacatcgagcgtggtcccaaggtggttttgactcccacacatttagcaatagtgatggagtatgcagcagggggagagctctttgagaggatatgcagtgctggcaggttcagtgaagatgaggctagatatttctttcagcagctgatctccggtgtccatttctgtcataccatgcaaatatgccacagagatttgaagctagaaaatacccttctagatggaagtcctgctcctcggttgaaaatttgtgacttcggttattccaag

SEQ ID NO: 35805 - DNA, 2442 bp, Glycine max
  Peptide Sequence Number=SeqID_152583
atgtacttgaaggagttgacaataaagaggaaaactcaaagtaactttctcttccctcttcaatggttgctgttggttgttgatgaaatggtttccctgcatcgtctgttagagtctcgaatagcactactccggaaggagcaagcaatggcttatacacgtggtcttgttgctggatttgaaattgacagcattgatgatctcatatactttgcaaatgcatttggagcagcccgtttaagcgaagcctgcatgaattttaaggaattatggaagaaaaagcatgcagatgatctttggataaaagaagtagctgctatgcagtcaagcttaccaccagcactctcattgtctggatcatcaggaattatattggcaaatgatataaccacccataatagctctagggacagcattgcttctggtgacgaaaatgtatctctggaaacattgaattctgctttaaacaaaaaagaaggaatgccatgtgcagatgtgaacctgcctacagcagatcataaactttcacatacagcaaatgttaatatgccaatgccctggccttacaatgtacctccatatatgtataatcttcaaaatccgcaaatgccttcataccaaggatatcctatgactaatatgcagtctgttcctccttaccttgtaccaaatatgcaatggtctcctgacctgggagtgaatcagaaaccatcagaaaccaaaagggataaatctcacaagaaaagagcagaagaataccaagaccagcagacagagtccagtgaccctgattctgggagtgaatctgattcagataaacagaatcactccagtcattcttcgaaggatgatctgaagaggaaaaagcacagaagaaagtcatctagaacagttgtaattcgtaatatcaactacatcactccaaaaaggagaaataatgaggggggagtctctgatgagtctttagaagatgatgatggcatcgatgaagaaaccatcaaacaaaaggttggtgttgcacttgagtctttgcaaaaggtccataaagttgaaaaacgtgctaagggaaaaaaagcagcagcctggcacaatgtaactaaatcaagtgatgcgactgaggaagatctcacttataacttgagtgatgcgtccgaaggaggaaagaaaaatgacaactgggatgcattccagaaccttttgaagatagatgaggggaccggaactgatggaccagaaaggatgcagtcaattgatatccaggatgaacattttgtgttgagaagctcagaattaagaatgccaaatggtgctagttcatctccaaacttggatttcaaagaagttctgaagaatcctaaagttccaaatgactgctttattgtgtctcagagagatggaggaaatgaaggtggctctaagctggatgagtatgtagacaactgtggtccagttacaaagagcagggataatattggtgaagaaatgctgttatcacatagatcaaaggaaccaggaagaaatgaactcggtgatccattatctacttttgctgctgattcattacaaacaaagggaagagcagcagatgattggtttattgtagataatttggaaaagatgaggagccctgacccaaccattgtgcctgcagtgtttgatggtgattacacttcatcagtgaatgatcgctcccaatctgagaaaagaagtgagcgaactcttattgatgattccttcatgattcagggtcaattagtagataatgatctttctgactcgcaatggaagacggacttaagtatggttgcagatctaactgctgccaacaagcttgaaagtgatgcagctgcttcaaatgagaagcatgcattatcaaagaaccaggagccaagtgacctctttgtagttctacaacgggattctggattggactctgttgaggcctcgcggacaatggactatgaaattgacttttccttctcagaaactaatagaagatcctccatggatgattctcacgccaaggtgaatgacaaccttcctgttagtcctgtgaaaaccaatgtgagaaaaagccaagtttctggaacaagaagttctggaaaagatgaaaagtcaaaagtgttgcgtgattactctgggaagagcaagcctgaaatcatgtcgagggccagaaagccagctctccctaaaaagcctatagttcagaagagcaaaagggaacaggaagatgagattagacagaagatggaagaattgcggaatgaacgtcagaggagaattgctgaaagaactgcatcctctggcattgctcgagctgcgacaaggaaagaccaaattgaaggtaaaacagcaaggatttctgctaagagtgacaagaataaggctcaaccggtaaaagagacaagcagaatcagttctgtcaaggtcaggggaatttag

SEQ ID NO: 35806 - DNA, 1707 bp, Glycine max
  Peptide Sequence Number=SeqID_152584
atgaactctccaattcatgccccttcttcatcggcatcttcttcctcctatatgcttcgtccttcaccatgcctcactcatgcttctcgtaacctcaagtgtcctatgttgttaccacaggcaatttgtacctctcaaaagaagtaccattgctttggagctaatgtggaggcgtcttttaacacaaatcccttgaaaaattacacatcagtcagatgttctccatggtggtctgaaacacaatccttggtttctaacaaaacactcaacaaacagttgttcacagtagaatctttagcaacttcaacagctcaagatgtttctgatacaactcttattggtgatgataagattggtgtgttactgttaaaccttggaggtccagagactctagaagatgtgcagccttttttgtttaacctttttgctgacccggatataatacgtttgccaaggatatttagtttttttcaaaagccattagctcaatttgtatctgtcgcaagagccccaaagagcaaggaaggctatgcttcaattggcggtggctctcctctcagacgcatgactgatgaacaggccgaagagttgaaaaaatctctttgggaaaagaatgtcccagctgaagtgtatgttggcatgcgttactggcatcctttcactgaagaagctattgagcagattaaaagggatggaattacaaagcttgttattcttccactttatccacaattttcaatatcaaccagtggctcaagcctacgtctactggagagtatattccgagaggatgagtatctagtcaacatgcagcacacagtaataccatcatggtatcaacgtgaaggatacataaaggccatggcaaatttaattgaaaaagagttgaagagttttgactgccctgaggaggtcatgatattctttagtgcacatggggtgcctcttgcttatgttgaagaggctggtgatccatacaaggctgagatggaggaatgtgtggagttgatcatggaagagcttgagacacgaaagataactaatgcatgcacccttgcttatcagagtagagttggaccagtggaatggttaagaccctatacagacgagacaataattgaacttggaagaaagggagtgaaaagtctgctcgccgttccaattagcttcgtcagtgagcatattgaaactctagaagaaattgatgttgaatacaaagaattggctctagaatcaggtatagaaaactggggccgtgttcctgctctaggatgcgaacctaccttcatttctgatttggcagatgccgttattgatagtctcccatatgttggtgccatggcagcttcagaccttgaagctcgacagacatcgctggaggcactagtcaggagtgtaggtcatgtaatttttagatatgtaaaaagaggtaaaggaagatcagaaagaacattggaggatattattaaaagggatctcatgtccctcgttccattgggcagtgtagaagagttattggcagcatatgattcgcaacgcagggagttgccaccaccagttatagtgtgggaatggggttggacaaaaagtgctgaaacttggaatggaagagtagctatgctggctgtgcttcttcttttgttttttgaattcactgcagacaagggtttgctgcatcagatgggaatatggccctcgcttagatga

SEQ ID NO: 35807 - DNA, 459 bp, Glycine max
  Peptide Sequence Number=SeqID_152585
atggattccaattccaaggccattttggattatgctttgtttcaactcactccaaccagaactagatgtgagttgttagtctttcgtggaggtgttcatcagaaaatagcttctgggttgtttgagcctttcgtttctcatctcaaattcctcaaagatgagatctccaaaggtggatactcaattaagcttctgcctcccaaccacggtggcttctggttcaccagagccacgtttgagaggtcattgctacttttgctcattttgaatttacctctttggcctcttaatgatttgtgcgctttgtcagcacaccggctattctggagaggtttgttagccttgaaaatgaaattcttcagatcagaagttcatttcaagctaatgctttttcaatgtccgttgcaactccagatgaaggatctgtgccaccagccaatggcatcacaaggaggttaa

SEQ ID NO: 35808 - DNA, 738 bp, Glycine max
  Peptide Sequence Number=SeqID_152586
atgattttattatgcattattcaaaaggctagcaatgcattagaagtactaaaagaggtccttgatgctgttgatgctcaaaatcctcagggagcaagtgatgaattcacccttgaccttgtagaacaatgttcttttcaaaaacaaagggttatgcatcttgtaatggcttctcgagatgaaaggataatttctcgagcaattgaattgaatgagcaacttcagaaagttcttgcaagacatgatgaccttcttgctggcagagttacaatgaccaccactcgattcgaccatgaagaagcagaggaggaagaggagcctgaacagttagtccgaagattacggaagggaaaggcttgtgcaaggcctgaagatgaggagactgaaaccaacatccctcgcttgggtttgcttggagagagactcaaccgtccactctcaatagagtcaccttctcgagaagttgatactcgttctccaccagttgtgatcccgccatctcgagaagctaatacccgatctccacctgttgtgattccacctcctcggccgaaacagaatggggaggttcctcatccagtggaaattccacccccacctgcaaagcacattgagagggagaggttttttcaggaaaacaaggatggttctaatttgtctggccacatgagaggtatcaccttacatagtcgtaatggcagcagctctcggagtggaagctttgattttagtgactga

SEQ ID NO: 35809 - DNA, 624 bp, Glycine max
  Peptide Sequence Number=SeqID_152587
atggctacacctgttactagtggtggtggtggtggtgaccccaatccaccacacagcggtgctgcgccacctgtgcatcctgctccagtgaacaccaatctaaatcacatcattactgaaaagcttgattcgacaaattatctgttttggaagtcacaggtggaacctataattcatggttataatttgcttcattttattcatgaggttcagattccgcaaaggtttgacaccattaaagatggaaatgctggcagagtcactgaagacaaaatcaataatcactttcacactcacatgaatgtggagtgtaatcacctccacactcagcttcatcaacttactcttgaaggccgcacagtctctaaatttctttcagcggtccaagatctagtggattcatttaatgctattggtgatcccatttcagtgcatgaacacattgctgtcattgttgaaggtttgcctgaaacctatgagtcgtatatttccttcattaataaccatgctgaaccccttactgttgatgaaattgaaactttactgattggtcatgaggcacgaattgagaggtatcgaaagaaggcagctttggtttttttttgcacagcaaaaatcagatag

SEQ ID NO: 35810 - DNA, 678 bp, Glycine max
  Peptide Sequence Number=SeqID_152588
atgcagcagcctcctggttttgaggcttcaagtaagtcaatggcttgtaagcttaacaaggcaatttatggccttaaacaagcacctagggcttggtttgataggctaaaggagacactcttgaagtttggtttcagctctagcaaatgtgatccctcattatttgtctattccaaaggttccacaactgtctacatgtggatctatgttgatgacataatcatcaccggtggtaatcctactttgctgcagagcttagtttgcaaactcaatagtgttttctccttgaaggatcttggttcattggattatcttcttgaatcactgtctgatccttttctgtacagatctgtggttggtgcccttcaatatgccacaataaccagacctgaaatcagtttttctgtcaacaaagggtgccaatttacgactcatccttgtgaggagcattgggtagcagtcaaacgaattttaaggtatctaaagggtactcttacttggggtctccacattcagtctgttcctaaacctttcttcatcacagcttactgtgatgcagattgggctgctaaccctgatgacagaagatccacttctgaagctggtgttttctttggttctaatctaatttcttggtggtccaagaagcaaactgttgtggctcggtccagcacttaa

SEQ ID NO: 35811 - DNA, 1149 bp, Glycine max
  Peptide Sequence Number=SeqID_152589
atggtggggttggtgtgttcggtgagggagaacaggtcagatgagaggaggttttctgtgtgtacggggacaaagaagaggctgcatttgagggcggagagcaaggaagacagagccacctgggtaaaggcaatgatggccgtcaaggacttgtttcctcgcttgtccaatgcagaggctatgtcacccgtggcctcggtgctagtttccacagagaggttgagagatcggcttttaatggagggtgtgagtgaaactgctatcagggaaagtgaggaaatcatgaagtctgagttctcacagttgcagaagcatattgtggccctcaagcagcagcagtctctacttatggacacgctgcgccatttagaggcagagaaggttgacttggagaacacacttattgaggaccgaaggcaatccaaggatgaaacagatccctatctatcaacgcaaaaaaagtatagcgagggaagtggtgatgattcttctgaagagcactataggaacaatcactcagaagatgaggacgatgcattctacgatacatgtgatgatattctatcaacaggctctgaccacccgagatcctgccatgattctgaatgtgaggagattattccaaatggtgatgaaaaatcccccaccggatctgttggatttaatcatccccacatcaagcgacgaaagaacttgcctgatcctgttgagaaagagagcagcgtcagtctttggtcaatcataaaagataacattgggaaggatcttacaaaagtttgtcttccagtttacttcaacgagcctctctcctcactgcagaaatgttttgaagatcttgagtactcttatcttctagaccaagcatatgaatggggtaaaatgggtgacaatctaaagagggtgctgcatgtggctgcatttgcagtttcagggtatgctagcaccaatggtaggagttgcaaaccgtttaatccactgttgggtgagacatatgaagcagagtatcaagacaaaggcattcgttttatctctgagaagaaagaatgtataggaaaagatcatccaccaatgcatctattgggtagcacgtcgctaaaaactccaattcgtcagttcctttttcagaaagggaactcatggagtggatga

SEQ ID NO: 35812 - DNA, 606 bp, Glycine max
  Peptide Sequence Number=SeqID_152590
atgattgtgtctgggaaggcagctttggttaatgtgacctcttcctctgttatgccatcctctgcacaatacaaaaccaacacttcagcatctgctactgccaactatgttcagcagaattccaacacttcacaaactgattctggtcagaatcagaatgctggtcataatagtggcaaatctggtggcagaggccgtggaggacgtgccggtcatagttctttgcagtgctatatctgccagaagtttggacatgtggctgctgattgttggcacaagccctcaactactgcatctccttactgcatgatggccttcatgcaacaaccagtcatgcaacaaatggttcctactcagatggctatggtctcctctcaacaaatgacaaatttcactaccaaacagaatcacagtcctcaagctatgactgttggttcaacttctgacccatccaacatttggtatcccaacttgggtgcctttcatcatgttactgccaatgttgagaacgttcagcagtgttcttcacttgagggtcccgatcaagtgattgtaggcaatggtcaaggtctgcccatcaaatctattggttcatcttccttataa

SEQ ID NO: 35813 - DNA, 1701 bp, Glycine max
  Peptide Sequence Number=SeqID_152591
atggaggaagcgcaaatttgggctaagaaggtggagctgccagcgttcatggggacagacccaattggttggattgctagggctgaaaaattcttgagccaaaacaacccagatttagattgggcgtcattttccacagctttgatcaaaaggtttagagatcgctatgagttcttgaaagagaggaccaacatttcggagctgaaacacatgttgcacaagatattgaatgaagaagttgattcccatgcctctcaacaagacaaaaatagcatggagggaagtgggttagaattcagtgaagcaaaggctagttcttgggcaagaaaggtggaactacccagctttgatagaagcatagaagggggaactgatttgaagggtaacagttttgagtgtgacagtgacccattgcagttcttcaaatcagaaaacagaagtaaagaagattcagtaatcaagaatcacaccctttgtggtggagaagaaaccaaaaatgatgaagcaaaattagcaagagaaaaaaagactgaaaagattatggaggaagaagttgatccatcgataaagagggagaagcacaaggaaaatggagtgacgaatgtgggctgcgtagacgattttcttgataacccaattacaaatttgatcaaaaaggaagtcgaagctggtgatgcaaccaagccacattgttttcaagattcagatttccataaaaagattgttatggtgaaacaaaaatcattcatgaaggtggttggaacatcaatggtgcttgaatcttggaatgccaacttgttgggtgagcctttagcattaaattttgttgtgtctatggatgacagctcgacattggagccaaggcagaagggagctactgagacagtcatgatgattcaaattatacggagtccaccctcatccccaccaccactgaagctgccggacctgagtttgcatgaagttgccagcgggttcacagttgatcccccatggagggacaccaaagaggcacaccctgttagtgtaaatgattcagttttgaaggatgagaaagaggaagggggagttttggagttctgcaaaggaggtccaactttttacatagtgggtcatgcccaaatgggctatagaaatgggattcataaaagaggagcagaaacttggaattcaaactgggtggcaggatttatactgctaaagttggatgtttgtgtacctgatgacatgttaaaagagcagaggtggaaagagattgaagcatcacacatggagctacaaggggtgcaaatgtcttctagcaatcggagaaaacttgaggagttgctggaaatgttgatgaacaatattggagagcatattcatgagcaggtgattgatactggaattattactattctcgtaaaaattgtgaagaaaaagtctgatttgcctgtcagggagcggatatttctcctactagatgccacacaaacatcccttcgtggtgcatctggaaagtttccacagtattataatgcatattatgatttggtgagggctggagtgcagtttgctcaaagggatcaagtggtccaaccaaatattcctatttcacaacctagtaggactagtaatgtaccaaacagggagcaggcctcacctagacatgaagcagttgctcagccagcagagtcccagactgtccctgaatctaggtga

SEQ ID NO: 35814 - DNA, 276 bp, Glycine max
  Peptide Sequence Number=SeqID_152592
atggcggtggctgttgatgcggcggagggactcttcgccaatgaccatggcctcggcctcgacctcgtgcatgacctcgttgcgcgtggcggtgtgctgtcgcgtgaacctcacggaggtggatcgcttcacggttgtggcggtgaaggaggaggacaagggggaggggcggaggaggaggttgaagtgggttggtcggagattcgagctggaacgggttttgtgcggtgttgggagccacaaaaggaattcatggatagggttaggttaggttag

SEQ ID NO: 35815 - DNA, 528 bp, Glycine max
  Peptide Sequence Number=SeqID_152593
atgattcatggcgtagtggaagataagaaaggtagaacagtggcaactctgtttgggacgtgggatgagagcttgcattacgtaattggagggaattctgggaaaggaaaagggtcctcctatgtgtcatcaaaaccacatgttttgtggaagcgaagcccaacaccagagtaccagacaagatataacctcacacaatttgctattacactaaatgaaatcacacctggattaaaggagaagttgccaccgacagattcaagactaagacctgatcaaaggtgtttggagaatggacagcatgaaatggccaattctgaaaagttgcggctggaacaaagtcagcggcaggcacgaaaggtgcaagagaagggttggaaaccaaggtggtttgccaaggaaaaaggcagcaactcttaccgttatgttggagggtactgggaggctagggaaaaggggaactgggaatcttgtcctgacatttttggccaagtctcaaccgatactgattttaacccaacttcataa

SEQ ID NO: 35816 - DNA, 1809 bp, Glycine max
  Peptide Sequence Number=SeqID_152594
atgcaagagacgctcctcactctctccgaacaccaacaagacgacaacaacaaagacatcgagctgctcgtggttcctccgccgccgtgccgccgccctccgcggatggcgcggcgcgtgtcccccggcgcggtggaaaaagccctccccaacggcgacatctacagcggaagcctctccggcaacgtcccgcacggcaccggaaaatacctctggtcggatgggtgcatgtacgagggcgactggaagaaaggcaaagcgtgcggcaagggccgcttctcgtggccctccggcgcgacctacgagggcgagttcgccgccgggagaatgcacggccgcggcaccttcgtcggcgtcgacggcgacacctaccgcggcgcgtggctctccgaccgcaagcacggcttcggcgagaaacgctacgccaacggcgacgtctacgaagggttctggaggtgcaacctgcaggagggggaagggaggtacacgtggcgcaacggaaacaactacgtcggagagtggaagggtggcgccatctccggcaaaggcgtgttggtgtggaagaacgggaaccgttacgaagggtgctgggagaacggggttccgaaggggagaggggtgtttacgtggcgcgatggaagcacttcctctgggaattgggggaaggagttcgtgaatgagaaacgcgtgtcggtggatgtctgtagtaatcacaacaataataagagtgtgagttttcccaggatttgtatttgggagcttgatggtgaagctggggatattacttgtgatattgtggaggcttctatgatttatggtggtggtggaggagtgtgtgagagtgatgtacagttgcagaagagtccttgtggttctgttgatggggatgttaagaaaccgggtcatactgtttctaaaggccataagaattatgatttgatgcttaatcttcaactgggtattagatactctgttgggaagcacgcttcggttttgcgagatcttaggccgggggattttgatcccaaggagaagttctggactaggtttcctccagaagggtctaagtttacacctccacatcaatctgtggatttcaggtggaaagattactgccctgtggtgttcagacatctaagggaattgtttgggatagatcctgcggattacatgcttgctatttgcggcaatgacacacttagggagatgtcttctcctggcaaaagtggaagcttcttttacctcactcaagacgactggttcattatcaaaaccttgaagaagtcggaagtcaaggtgctcatcaggatgcttccaagttactatcaacatgtgagtcagtacaagaattcgctggtgacaaaattcctgggggttcattgtgtcaaacctattggaggtcagaagactcggtttattgtgatgggcaatgtattttgttcggagtatcggatccataagcggtttgacctcaaaggttcttctcatggtcgtacaactgataaaccccgggaggaaattgacgagactaccactcttaaagaccttgatctttgttttgtcttccgcctggaacattcttggtttcaagagcttaaatggcaacttgatagagactgtgaattcctggaagcagagggaataatggattacagttttttgattggccttcattttcgtgatgatagctcagttgatgaagtaaagagtttaccagacgagttgtgttcaggcaagagagacatgcaaaatgatgacatacaggatatgaagtggatacccatagaccgaaatgattgtcctccttga

SEQ ID NO: 35817 - DNA, 231 bp, Glycine max
  Peptide Sequence Number=SeqID_152595
atgttgaaagtccatgagccctcgttgatagggatagatagaggacgcactcataatttcaaccagaaaaagaccccagggatgccggaattgtgttcgcgtaaccgtaaccgcccgagagcgaggaaaagatgcgatgcgatgcgattcgcgaggagggccaaaacggcgtcgtatggagagagggaagggacacgtgtgagggagttcggcgcacgtgttggagtgtga

SEQ ID NO: 35818 - DNA, 126 bp, Glycine max
  Peptide Sequence Number=SeqID_152596
atggacccaaaagaatggccaataattgaggcattgccatcttatggaagagggagagagagaggctatgaggaagacatattagccttatacatggaaatggcattagcaatgctgtcattacag

SEQ ID NO: 35819 - DNA, 1254 bp, Glycine max
  Peptide Sequence Number=SeqID_152597
atggccgcagaaatttgtggcgggtctctattcttatccgttaaaactcaactgcaactgcagcagcgaaaccagcaaaacgtgttcttccatgctcaacgtagcagaacgcgaagaagcactaccagattccactcatccaaacgctgctttagttcttccgcctttccaaatgcgtccgcgtttcgccgcggcgccgtgtgccaggtcgccagcatcgacttcgaatccgccgccaaagccggagaggatcgtctctctaaggtgccggtgcgtaatataaggaacttctgcatcattgcgcatattgaccacgggaaatccacgttggcggataagttgcttcaggttaccggcacggtgcaccagcgagagatgaaggatcagtttctcgataacatggatttggagagagaaagaggcatcactattaagctccaggcagctagaatgcgttatgtgtttgaaaatgaaccttattgcttgaatctaatagatactccggggcatgttgacttctcgtatgaggtttctcggtcactcgctgcatgtgagggtgctcttctagtagtggacgcttctcagggcgttgaagcacaaaccctagctaatgtttatttggctttggagaacaacctggaaattatccctgttttgaacaaaatagatctcccaggtgcagaaccagatcgagtaatcaaggagattgaagagattgtaggtctagattgtagcaatgcgattctctgctctgcaaaggaaggaataggtataattgaaattctcaatgcaattgttgcaagaattcccccacctgaagatacatctaaaaaaccattgaggactttaatatttgacagctactatgatccatatagaggtgttattgtatactttcgagttgtagatgggactataaagaaaggtgacagagtttattttatggctagtgggaaggattattttgctgatgaaattggagttttgtctcctagtcaactacaagttgaagaattgtatgctggtgaggtgggctatctatctgcatcaataagaacagtagctgatgctagagtgggtgacactgttactcactatggcagaaaggctgacaattcactccctggatatgaggaagccactcctatggtgttctgtggcttgtttcctgttgatgctgaccaattccctgatctgcgtgatgcacttgagaagctgcaactcaatgatgctgcacttaagttgtacttttga

SEQ ID NO: 35820 - DNA, 279 bp, Glycine max
  Peptide Sequence Number=SeqID_152598
atggttacccctgggacagctacaactttaaatttacaggcattggcagaggagatcaaggcaagatatgataaagcagctgtcaaagttgttgacttgattcttacacttctacaatttggaggatatacactagtgcaaaattcagttgatctgtatcgaagctttgggtttgatacacagccagtcctcattgggctcatcatatttcaggctggaatagttgctagcccagtaggtcattggtcaaagggtcatttcattgtaactcatttttaa

SEQ ID NO: 35821 - DNA, 165 bp, Glycine max
  Peptide Sequence Number=SeqID_152599
atggaaggtaaaaagctgaagcttgccatttgggatacagctggtcaagagagattcagaacattgacaagttcttactaccgaggtgctcaagggatcattatggctataacaagcattgttgaaacgagggacactaatgttctaatgtttaaggacaagtga

SEQ ID NO: 35822 - DNA, 750 bp, Glycine max
  Peptide Sequence Number=SeqID_152600
atggctcttgctgttggtagtttcatgcgcatgccactgctgcgaacgtccaagtactctagggcacaaaaacctacgacgatgaccatacgtatttcgttacttaatttggatatcagatcatgcacttgccacaacaatagtacaaaaggagcagaaaggagaaggagtgttctacaaaccaaaagaagacacgatggaggaaaaggacgtgatccacaaactaatagtttagggcaactcaaaagcacaacaacaacggaaagaggaattgttctaaaaaagaaaagaagacacaacgcagggaatggacatgatccacaaacgaatagcatgggattacttaagagaaaaacaaccgaaaggagagggattgttctacgaaagaatagaagaagacacgatggaggaagaggacgtgattcacaaacaaatagcatggggctactcaaaagcacaacaactagaaggagagggattgttctacgaaagaatagaagaagacacaatggagggagaggacgtgatccacaaacaaatagcataggactactcaaaagcacaataactagaaggagagggatagttctacgaaagaatagaagaagacacgatggagggagaggacgtgatccacaaacaaatagcaaaggactactcaaaagcacaacaactagaaggagagggattgttctacaaacaaaaagaaaacaccacggaggaaaaggaagtgatcatcaaacaaattaa

SEQ ID NO: 35823 - DNA, 789 bp, Glycine max
  Peptide Sequence Number=SeqID_152601
atgaagaaaggtgacagagtttattttatggctagtgggaaggtgggctatctatctgcatcaataagaacagtagttgatgctagagtgggtgacactgttactcactatggcagaaaggctgacaattcactccttggatatgaggaagccactcctatggtgttctgtggcttgtttcctgttgatgctgactatctgcgtgacgcacttgagaagctgcaactcaatgatgttgcacttaagtttgaacctgagacatcgagtgccaagggatttggctttatatgtgggtttctgggccttcttcatatggaaattgttcaggagagacttgagagagaatacaatttgagcctgataacaactgctccaagtgtcgtgtacagggttgaatgctcaaatccatctttacttcctgagcctggaaaaaggaaatcaattgaggagccatttgttaagattgagatgcttacaccaaaggactacattggttcacttatggaactggcacaagaaagaagagggcagttcagagaaatgaaatttattgctgaaaatagggcatcaatcacgtatgaattaccattagcagagatggttggtgatttctttgaccagttgaagtcgagaagtaagggttatgctagtatggagtatacctttgtcgggtacactgaaagtaatttaattaaacttgacatacggataaatggtgactgtgtggagccattggctacaattgtgcacaatgataaggcatttggactgaagaggaatgacccataa

SEQ ID NO: 35824 - DNA, 261 bp, Glycine max
  Peptide Sequence Number=SeqID_152602
atggccttctttcgtgagaagggactatgctataattgtgacaataagtggagctccactcattgttgcaaaggacgcgtccttctcttcatcgccgacactgaccctctcccagaccatctcgaaccttctttgcctcgcccaccctcaccagatactcaacctattttcgatgccacccctgtatcaccccccattagtctccatgccctatccaacctccccacccttgagacttttcacctcttcggttttatttga

SEQ ID NO: 35825 - DNA, 903 bp, Glycine max
  Peptide Sequence Number=SeqID_152603
atggagaaccagcttccaaatggcaaaaaggcaatggaagaagagttaatcaaagggcatggcatggcaaatcagttacttgaagtacttgttcaggataaattgaacactcaccttgaagaggagggtagctcaaagtcagtgttaccatttgttgaagatcttgttcgcaaagtgttgtgttcattcacaaatacccttttgattttgaactccaataatgatgtttccaatgaggtcgcagcgtctatcactctcagagatgtctcttcgtccattaattgcccaaagctgcagtcggtggatgaaacttgcaagagtcccaatattctcaaccctaaaagtggaagcgggtgctacaaaagaaaatcaattgcgccaacttggaaaaaggacagctcaatactgattgaagatggctatacatggagaaagtacggacaaaaaatgacgtcgcagtccaaatacctcaggagctactataggtgcactcacaaaaatgatcagggatgccaagcaatcaaacaagtacagagaattcaagataaccctccattgtaccgaacaacctattatagccaccacacttgtaaaagccctatgaatcccgagatcattgtggaacctttttctccctctgcctcttccatattacttagcttcgataacaaccttcagagcaaacaagaaaacccgttttcctcatcaatacttgcatcaaccaaacatgagccccaggaagtgattcacaatgaacatagtgctcaaaataaattgtctacatttgaaaacctcctattttacgattatgacattccttttgattattcgaggaatgccactttgctatcatcgactgaagccgttcaatttgagaatgtttatgagcagtatggattttga

SEQ ID NO: 35826 - DNA, 891 bp, Glycine max
  Peptide Sequence Number=SeqID_152604
atggagaatcagaatcagcttccaaatggcaaaaatgcaatggaagaagaactaattagagggcgtgacatggcaaatcagattcttgaagtacttgctcatgataaggatgaagggtcaacaaactcaaagtcagtgttaccatttgttgaagatcttgtgcgcaaggtcttgtgttcattcacaaatacccttttgcttttgaactccaataacgatgtctcctatgaggtggtggcatctattgctcccaaacatgtctcttcgtccacgagttccccaaagctggagtcttcggatgaaacctgcaagagtctcatgaacactaaaactagaagaagaggctacaagcgaaaatcaattgcgccagcttgggagaaggacagctcaatactgattgaagatggttatgtatggagaaagtatggacaaaaaatgacattgaacgccaaataccttaggagctactacaggtgctctcacaagaatgatcagggatgccaagcaatgaaacaggtgcaaagaattcaagataaccctccattgtaccgaacaacctattatggccatcatacttgtagaagccctttgaatcccgagattattttggaacctatttctccctctgcttcttccaccttacttagctttaataatagttttcaaagacaacaagaaagcccgtttccctcatcactacttgcatcaaccaaacaagagcccgtggaagtgattcaagattatcatagtgctcaaaatcagttgtcctcacctgaagatctcctattatacgattatgattttttttttgactattcgaagcgtgtggcctcgctatcatccactgaaaccgttgaatttgagaatgtttatgagcagtttggattttga

SEQ ID NO: 35827 - DNA, 885 bp, Glycine max
  Peptide Sequence Number=SeqID_152605
atggaaaatcagccatcaaatggaagaaaggcaatagaagaagaactaatcaaagggcgtgacatagcaaaccagttacttgaaatacttgctcctaaatccaatactactcaacataagggtgtagaagtggaagcgttagtgttaccatttgctgaagatcttgttcgcaaggttctcagatcactcacaaatacccttttgctattgaacactcatagtgatcatgtctccgatgaggttgttttgcctgtcactatcaaaggtgtctcttcgtccgtgaaatgccaaaagcctgagtataaggatgagtctttcaacgctaaaagacgaagtgggagctacaagagaaaatcaagtgcaccaacatgggagaagaacagttcaattctgatggaagatggctatgcatggagaaagtatggacaaaaaatgacaatgaatgcaaaatacctcaggaactactacagatgcactcacaagtatgatcagggttgtctagcaaccaaacaggtccaaagaattcaagaagatcctccgttgtaccatacaacttattatggccatcacaattgcaaaagctctttaatgttggaaccagcttcttcttctgactcttctatgtttcttagtttcagtaacaccttcccaaacaaagcagaatacccattttcatcatcactttattcatccatgaaacaggagcctatggaagtgattcatgaagaccatattgttcacaaccaattaccctcatcagattaccacatgttatgtgactatgatcttgattttaattattcgaggtatggtactatgctatcctccactgaatctgtacaatttgatgaagtttgtcggagtgatcaggaatttgatggctag

SEQ ID NO: 35828 - DNA, 312 bp, Glycine max
  Peptide Sequence Number=SeqID_152606
atgaaaatcaacataggcttgtattttcaggcatattcggtgggaagggctttgactctaaagttgaaggagctcataccacgacaaatgtttaaagtaccaattcaagcgtgcataggatcaaaagtgatcgctagtgaagcgatatccgcaataaggaaggatgtactagccaaatgctacggtggggatatttcgagaaaaaagaaattgcttaagaaacaggctgaaggaaagaaaaggatgaagtctattggtaaagttgatgttccccaagaagctttcatggcagttttgaaacttgaaaaggag

SEQ ID NO: 35829 - DNA, 1120 bp, Glycine max
  Peptide Sequence Number=SeqID_152607
cttggacttgttcgaagatccagtgactttgtgcacaggccaaacctatgacagatcaagcatagagaaatggttttccacaggaaatctcacatgccccgtgacaatgcagaagcttcatgatccatccattgttcccaaccacactcttcgccacttgatcgaccagtggctccaattgggtccccaatttggtaactctgccactattgattatttagctgcacttaagcacacccttgaatcaccccaattggaaaacaagctccaagcactcgagaaaattagagtcctctctgatgagtattgctccttcagaaaatcttacttccaccaactgagtttcttgccactgcttttggaactagtttttggttctcggctctcaaaaagtcacaacagggagttcactgagctagcactttcttgcattctaaagctgttgcctcttgtgagtttggagcctctaaatatgatcaaagatgagtctaagctagcaacttttttgctactatttgaaaagggaactagctcggttaagactagtctttgccatatcatagattcaatagcatcaccacaaacagaagaggtatgtcacatgcttggacactctcacaaactagtgcatgagatcgttgtacttgttcgccaaaattgtgaggtttccaaggttgcaattaaggccatgttagcattatgttccttgcaatctaacagagagaatttggtgagggaaggagcaattgatggggtcataacatacatttcaggttgtgaaacaaggcagaagaacgctgctccattggcgatggcaataataaagaagcttttggtgctagagagtgctaaagaggcgttggtgaatcaccctaatggagttgaaactctggtgaagatggttttcagggtgtgcaatcaagagtgtagtgagagtgctgttgggatacttgcaattatttgttgtgattttgggcgtgcaagagaggaagcaattgaagctggagttttgactcagttgctgtttcttctgcagagtcagtgtggcaccaaaactaaaacaaaggcaagaatgctgctcaagttgctaagatccaagtggattgaggaaccaaaacag

SEQ ID NO: 35830 - DNA, 381 bp, Glycine max
  Peptide Sequence Number=SeqID_152608
atggctctgtcgaaagtggatctaacaccacaaccactgttcaccatcaaattgttcccccaacaccaccaccatcctttgcacgtggtgatgcagattgggctagtgatagcgcgtggtggttgtcgtccgcgtgaacctttggtgttgcacaagaagaatgtcacgttgtggagtattgagtgtgttgagcatgtttacattccatttgccccaacagcccttgtggacgtcacagaaaatttcacggtggcgatggtgtctagccccattgcttttctctctctgacaatatggaagggtttgactatggcggcggtagtgaccgtgaaggacaaaggggaacttcagagttcagatccatactgtgatcgaggatag

SEQ ID NO: 35831 - DNA, 168 bp, Glycine max
  Peptide Sequence Number=SeqID_152609
atgggagacgaacagctcaattctgatggaagatggctatgtatggagaaaatatggaaaaaaaataacaatgaatgcaaaatacctcagtggttgccgactcagtgttgcggaggtggtcaccatggccgctgcccgctgactaggggagggattgtggagagttag

SEQ ID NO: 35832 - DNA, 465 bp, Glycine max
  Peptide Sequence Number=SeqID_152610
gctgcaagagaaactggagctctccaagctgccaaaaataagcttgaaaagcaagttgaagaccttacattgaggttgcagctggaaaaacggctgaggatcaacattgaagaatcaaaaacacaagaaaatgaaaaactgcaatctgctttgcaagcgatgcaacttcagtttaaagaaaccaagttgttagttcaaaaggagcgtgaggctgcaaaaagagaagctgagagagcgcctgtcatacaggaggttcctgttgttgaccatgctttgttggagaagctcactagtgaaaatgagaaactcaagaccttggtgagttcattggaaaagaaaattgatgaaacagaaaaaagatatgaagaggcaaacaaaattagtgaagaaaggttgaagcaggctttggatgctgaatcaaaaataatccagttgaagactactatgcaaaggttttgtttgtga

SEQ ID NO: 35833 - DNA, 204 bp, Glycine max
  Peptide Sequence Number=SeqID_152611
atgctcatccagcatcaacaactcaactttcacccacacttatctaccattcttcaaattcgaagcctcctagctcggaactggagtgttcggttacaacactgctatcgtgaaggcaatgccccagcggactggttagctaagcatggtgcttctaacgcactttttctctccgtccagcctcaccttgctgcttttggctga

SEQ ID NO: 35834 - DNA, 357 bp, Glycine max
  Peptide Sequence Number=SeqID_152612
atggtagagagcaatgaagaaaacgtgaaagaagaccttgagcttcctttagttgaccttgctgtaattttcaaagctactgatgggttctcaattaacaataagctgggagaaggtggatttgggactgtatacatggcagctggaaacaatacaggccacgacgaagtgaagaagaatgcgctaggtatcgagaccttgggagtgccgaaccacgacggagcttgcagcacactttcgaggtcacggagcttatggaactgcgcaggtcttgctgaaaaagcacacacgtacgttcaacaaggcgtagtactgagcttcgaaagtgaaaatacaattgaaatcaaaatcgcatga

SEQ ID NO: 35835 - DNA, 420 bp, Glycine max
  Peptide Sequence Number=SeqID_152613
atgggtagatatgggttcgttcaaaaagtggtgggtgacctttgttccctcgattcttcacccatcgcaaagttattggactcttgcgacggacgcaatgtatttgatcgtatgccgcaaaggaacattttcagttataatgcgattttaagcgttttgacgaagtttggcaagcttgacgaggctttgaacgttttaaaatccatgtcggagcctgaccagtgctcgtggaatgctatggtgtccagttttgcacaacatgatcgttttgaggaggctttgaagttctttgatgctatgcatagtgaggattttgtgcttagtgagcatttgtttgggagtgctcttagtgcttgttcagggttgacagatttgaatatggtggttcaaatccatgctttgatatcgaagtctcgttaa

SEQ ID NO: 35836 - DNA, 1896 bp, Glycine max
  Peptide Sequence Number=SeqID_152614
atgaagaaagaagggtgtgaggttgaggcaataggcatcaactacaagattcgtacaaagacaacagagcaaccttttaaaatcttcaccaaacctccacaatcgaatagggaagatgttcatgaagcaaaagaggaagaaaggccatgcagtggagttaggcatgtcctcaaggatgtgaattgcatggccaagccatgggaaatttcggcaattgttgggccaagtggagctggaaaatcatcccttcttgagatccttgctggtaaagctagtccacaaagtgggtctatcttggtgaatcaagaacctgtggataaagctaagttcagaaaattttcagggtatgttacacaaaaggataccttgtttcccttacttacagttgaagaaaccattatgtttattgcaaagttaaggctaaatcttcctcaggagcaattacgctacagggtcaagtcactgattctagagcttggtcttagccatgtcgccaggactagaattggagatgaaagggtccgaggcatttccggtggtgagagacgccgagtttccattggtgttgaagtcatacatgatccaaaagtgctgattttggatgaaccaacttcagggcttgacagtacttcagctttgcaaataattgaaatgcttaaagtcatggctgactctaggggaagaactataatcctaagtatccaccaacccgggtacagaatagtgaagttgttcaactcattactgttattggccaatggcaatgtgttgcaccatggcactgtggatttgctgggtgtgaatctaaggctaatgggtttagagcttcctcttcatgttaatgtagttgagtttgccattgattccattgagactattcagcaacaacaaaaatcagagcacgttcagctagaagtgcctcggcgattaccagggacaatgcaacaaaagaaaggtggtgatctaggcgagagtagaagtggtaagtttactttgcaacagctctttcaacaatccaagataattgacatagaaatcattagttcgggaatggatatcacacgtgattttgctaattctggattgagagaaactatgattctcactcataggttctccaaaaacatccttcgcacaacggaactctttgcttgcaggacaattcagatgctggtttctggactggttttgggctcagtattttgtaatctcaaggatggtctagtgggagcagaagaaagagtgggtctatttgctttcatattaacgtttttgttatcaagcaccaccgaagctctaccaatttttctgcaagaaagggagattctaatgaaggagacctccagtggaagctacagagtttcatcctatgctattgccaatggcctagtttacttgccatttctactcatactagccattttattcgcaatgcctctgtactggctcattggtctcaacaggaatttcacggcagttttgtactttttgatgctaatttggctagttctttgcaccgcaaattcgattgtggtatgtttcagtgctctggtgcctaatttcattgttgggaattcaatgatcgcaggtgtcatcggctcgtttctcttgttctctggctacttcatatcaaaacatgaaattccgaattactggattttcatgcattatatatccccatttaagtatccctttgaagggttcctaataaatgagttctccaactcgaacaactgcttggagtacttgtttggggaatgtgtggtgagaggagaggatgtacttaaagaagcaaagcttggaggggagactagtagatggaagaatgttggggtgatggtacagatgctcgcaaggagtcatcctaaaagtatgatggactctctctctgtctaa

SEQ ID NO: 35837 - DNA, 2484 bp, Glycine max
  Peptide Sequence Number=SeqID_152615
atggcagatgttgcaacgaataaaacggatgattatatagtatgttatgcaccttccatgataacaacaaatggggtgtggcaaggagacaaccctttggaatattctctacctcttttcatcttgcaattgactttggttgtggttgccacccgcatattcgtcttcatactcaagccttttcgccagccacgtgtaattgctgaaatcttgggtggagtaatgttgggcccttcggtgcttgggcaaaacgaagcatttgccaatgcagtgtttcctctaagaagtgtgatggtgattgaaacaatggcaaacattggtctcctttattttctcttcttggtaggggtggagatggacctaacagtgatgcgtagtgttggtagaaaagctgtggcttcagcaatagctggcatgattctaccttttatcgttggaattgccttctcctaccttttggcaaaaaaaactgactctgacataaaccaaggcacttatatactattccttggtgttgctctctctgtcactgcatttcctgttcttgctaggatccttgcagagcttaaacttgtcaacacagaattggggaggcttgctctttcagctgcactcatcaatgatgtgtgtgcttgggttatgttagctttagccattgctttagctgagactgaaatcactactttggcttctctctgggttctaatatcaagtgtagtattcgtggccatttgtgcctatggtgttagaccagcagctaaatgcctagttaagaaaaccccagaaggtgaatccttcagtgagttttacatatctcttattctagctggggtcatggtctcaggcttcatcactgatgccattgggactcatgctgtttttggagcttttgtgtttggtttgtctatcccaaatggaccactcagtttcactcttgtggagaagcttgaagactttgtttcaggacttttgcttcctctcttttttgccattagtgggcttaaaactaacctagggctcatccatggctcatacacctgggtaattcttattatagtcatttttttggcctgccttggtaaagttgttggaaccattttggttgcattgttttatgaaatgccaatacatgaaggagctgcccttggtttactcatgaacacaaaaggcctcgttgaaatggtcgtgcttaatgttgggaaggaccagaaggtttttgatgaggaatcattcgcaattatggtggttataacagtgataatgactggaattattgtacctgccatatcagtcatttacaagccatcaagaaatagcatatgttacaaaagaagaacaattgagatatcaaaattagatgccgagttcagagtcctattttgtgtccacacccctcgaaacgttccaacgatgatcaacctccttgaagcctctaatccaacaaagaactctccaatatgtgtctatgtgctccatttggtggaactcagtggccgaacatcagccatgctcattgttcacaacactgcaaaacaagatgcccctgcccttaatcgaacagaagctcaatctgaccacataatcaaagcctttgaaaactatgagcagcatgcttcattcgtctcagtccagcccttaacagcaatttccccttactccaccatgcatgaagacatttgcaatttggccttggacaaacgcgtgtccctcataatcgttcctttccacaaacaacaaacggttgacggtggaatggaagcaacaaacatggcatacagatccatcaaccagaatgtgctagcaaatgcaccttgctcggtcggaattctagtggataaaggcttaagtggctctaaccgtctggcgggaaatcaagtatctcatcatgtagcagtgttgttctttggaggaccagatgatagagaggcattgtgctatggatggagaatggtggaacatcacgggattagccttaccgtaatgcgttttgtccaaagtgatcaagtacaagtagagccattgaggcaacaacatggtggtattgatttggatgaaccaagggtgctgacagtgcaaacagatagggatattcagaagcagcatgatgagaagcttatacatgagtttaggatgaggtgtggggatgatgatgcggttgattatgttgagaaggtggtcagcaatggtgaggacacagtggcagcaataagaacaatggatgacattcatgaccttttcatagttgggagaggtcaaggggtgatatcaccactcactgcaggactcactgattggagtgagtgtcctgagataggggcaattggggatatgctagcatcttcagattttgcagccactgcttcagtgttggtgctgcaacaatatgttggggatggttcacaatatgaaggattagaaacaccatatggtgaagaatccacaccactaccaccaggacataaaatgttcggttcagaacactag

SEQ ID NO: 35838 - DNA, 564 bp, Glycine max
  Peptide Sequence Number=SeqID_152616
atggacgttgtagtgaagcttttgatgtttataaggcctagtgctccaacttttgtgagtgttatagatgcctgtgcacaggaggcccttataggaagaggtgacaaaagtggtaacttgtttaatgtgtatgtgggtaatgctttgattgacatgtatgctaagtgtggagatatgaaatcagctgaaaatttgtttgagatagctcctatgagggatgtagtaacttggaacatattgataagtgggtttgcacaaaatggtcatggggaggaatcactagctgtttttagaaggatgatagaagccaaagtagagcccaatcatgtgacatttcttgggtgctatctggttgtagccatgcagtgttgggggcttgtagagttcatgggaacttggaccttgctagaaaggctgcagagtaactgtttgagttggaaccagaaaatacgggtagatatgttatactggcaaatctatgctgcatctggcaaatggggtggtgccaaaagaattaggaaggtaatgaaggaaaggagtttggagaaagaaccagctttgtag

SEQ ID NO: 35839 - DNA, 738 bp, Glycine max
  Peptide Sequence Number=SeqID_152617
atgcaaaacttggagttgcattgccaatgtacagtattggattctaaactgggggaatcacaaattgtattttctggtatgttgaaactagttgaagaattggaatgcaaatttacttcaatgctggaagatagtgctttgaaagaaaaaaccatagatgtagacctagatgcccttcttgaggaaagcagaaagctagatgaaaggttcactatggaagagaattttttaacacacatgtatttggaaaaaacagctgaagcagccatacttgaatctgctcttcaagaagaacaggagaaagcaaggctatacgacaccgagcttgataatcttggagcagaatacgaagtcatggtgcaaaattatgctgaagagctagctgcttctagggcaaaccaagaaactctgatggttaatcatgaaaaagtagttgttttgttggaaaaagtcaaattaaatgaagatttgaagggcagagttagagggctcgagccggaactgaaagcctctgaacttaagaggctaaaagcaacagaagaaatttttgagctacaagtccaacttcagaaaatagaaatgcttcaagatgaaatctttatccttaagagatcactgtatgaagcagaatttgaattcagaagattggaagcttcatatctgatgctatccttagagtgtgatgagctgaaagctaagaatgtatcttacaatcgaagaatctcaacaactgagtaa

SEQ ID NO: 35840 - DNA, 1443 bp, Glycine max
  Peptide Sequence Number=SeqID_152618
atggcaattctatacaaatcttgtagatctaaagattatgggaggcatctcatagataactgcatggagattagatttgaattggtaggaattgcacattgggttctcaccaggaaagaaacaaatagtaaacatgataaaaaatggcagtacggatgtatgaccatgggctttggtgatacattacagactgaacctgacattgcttggggcaaacgcacgcgcgttatactagatgttggatgtggtgttgccagctttggaggttttctctttgatagagatgtacttgcaatgtcattagcaccaaaggatgaacatgaagctcaggtacaatttgcacttgaaagggggattcctgctatatctgctgtgatgggcacaaagaggcttcccttccctgggaaagtatttgatgtagtccactgtgcacgatgtagagttccgtggcatatagaaggtggtaaacttcttttggagctaaatagagtattgagacctggaggtttttttgtatggtctgctactccaatttatcagaagcttcctgaagatgttgaaatatggaaggccatgaagacactaacaaaagccatgtgctgggaagttgtgtcgatcagcaaggatcaagtaaatggagtaggtgtagctgtatacaagaagccaacttctaatgagtgttacgagcaacgttcaaagaatgagccaccgctgtgtccagactctgatgatcctaatgcagcatggaacattaaattgcaagcttgcatgcacaaagtgccagctagttcaaaggaacgaggctcaaaattgcctgagctgtggccagccagactgaccaaagtgccttattggttgttgagttcccaagttggagtttatggaaagccagcccctgaagatttcactgctgattatgaacactggaaacgtgtagtgtcccagtcttatctagatgggatgggaattaaatggtcaaatgtgcgcaatgtcatggatatgaggtctatctatggaggatttgctgcagctttgagagatttgaatgtttgggtcatgaatgtggttacaatagactcccctgatactcttcccattatttttgaacgaggtctgttcggtatatatcatgattggtgtgaatcatttagcacctatcctaggacctatgatctcctccatgctgatcatctgttttcaaagcttaagaaaaggtgcaatttggcagctgtagtggccgaggctgatcggattcttaggcctgaaggaaaacttattgttcgtgacactgtggagatcgttgaagagcttgagagcatggctaggtctatgcaatggaaggttcgcatgacttactccaaggataaggagggcttgttatgtgtggagaagtccaagtggcgacctaaggagcaggaaaagctcgagtatgctattgtttaa

SEQ ID NO: 35841 - DNA, 714 bp, Glycine max
  Peptide Sequence Number=SeqID_152619
atgagcacaatccaccaaacacacgagagtgatggagagaaagagttcagtttctggggctcatcaaacaccataccttctgaaaataattgtgatcaaccacaaggcaatgaatcaaggctcaataaggaagcatactctggagaaacacaccaaagaaaaagtcttaaatatgagtattcacgtttttgttcaacagtctcagacccttcaaggagcgaagctattttagaaggacaaagggagcttatggagatgatgcaagacatgcctgagtttggctatgaactgtctttccaagatatggtggttcatgagaagcaggcgctggaaccagaacaacaaccacaccaaaatgaaacttcgcttgagaacactctcatgcaaagtagtggccataaagctcaactcaaaagggtaagcaaaaagaagaaaaacaaaggcaatagtagacctggtcagatattgcgggttgaaagcatggacagtgaaaccttcctcctcaagttgttctttccaatttctcttgattggatgaagaaggatagagcaaagaatggctccaaggtttcttcaagaccatcattgcaggaatctataaaacaagtgggtaaagaatggagaattaaaaggcttttcctttcaggagataacagagaagatggcatatgtcaaaaaaatggtggccgcagcattagtgacataaacgagtag

SEQ ID NO: 35842 - DNA, 177 bp, Glycine max
  Peptide Sequence Number=SeqID_152620
atgacgacaactacaacagagggtaagggcaaggcacgtgagatctccaatgaactcaatactgaggttgttgacacatttctcaacacagtggtggaggagtatggttcacagatcgacgtggacagcaacacgagggtttctaacaacactacggtgatgaacggaccacgatga

SEQ ID NO: 35843 - DNA, 480 bp, Glycine max
  Peptide Sequence Number=SeqID_152621
atgatgggtttagcatcttcccaaggctacaacttctctgcttctgtctgttcatggagaggggtttcttgtgatgccgatagagaacatgttgttgacttagtcttttctggtatggacctctctgccactatacctgataacaccataggcaagctgggaaaactgcaatttttggatcttagccacaacaaaatcactgacttgcctttagatttttggagtttgagcactgtcaagagccttaacctctcctccaatcagatttctggctcattgactaacaacattggcaactttggtttgctagaaagcattgacttgtccagcaacaatttctcagaggaaattcctgaagctgttagctcattgctgagtctaagagtcctcaaacttgaccaaaacaggtttgcacacaacataccttctgggattctcaagtgccagtccatgatttgtgcaacttcatactttaactga

SEQ ID NO: 35844 - DNA, 189 bp, Glycine max
  Peptide Sequence Number=SeqID_152622
atgaaggagaagttgggaagaatgtatgacatgaaagacaccaagattgtatttgtcttcaagtttcaacctcattttggtggtggcaagtccattgggtttggtttgatctatgattcagttgagaatgctaaaaagtatgagcctaaatacaggtttatcaagtttgatgattgcctttcctcttga

SEQ ID NO: 35845 - DNA, 201 bp, Glycine max
  Peptide Sequence Number=SeqID_152623
atggttgtgaatgagtgtgtgattgatatttgtagtgatattacttgtcatgtgagacccaaacggattcttcagagtctaggccttgggggtaaagatactcggtttgagtgctcctttaagcccatgttgatcccatgtggttggggcattctcgcaaaacagagtaaccctgactggtcaccttatgatgttacttag

SEQ ID NO: 35846 - DNA, 219 bp, Glycine max
  Peptide Sequence Number=SeqID_152624
atggacgaagttgaggatattaatgtgttggagcattgcgacaaagatggagatgccgacgataacaaacttaaagatgatgtgctgaagcactacatcgaagaagagtctgtcaatgatgaggatgaagttcaagataatgtactcatattcgatgcgcaaaagcttatagaaactctattagcgatgtgtttgtctagtgaagaactgagaggatga

SEQ ID NO: 35847 - DNA, 285 bp, Glycine max
  Peptide Sequence Number=SeqID_152625
atgagtatgcacatgactgtcaacttccttttctattataattctccttcaggtaagattattcggggcatggaggagaggtatagatatttgatgctgtatagcgtgttggattctaaaactcatggtcctggacgaaatgcacgtattgtatacattgatggggcatttgatctcttccatgccgaccatgttgagcctgaagttagtaaagagattatatctgcgtctaattcactgtggtggaatatatatctactttacccaactgatcaggacgagtga

SEQ ID NO: 35848 - DNA, 1650 bp, Glycine max
  Peptide Sequence Number=SeqID_152626
atgaataagtttagagagagaaacaatgggtgggagagagataggttcaggggaaagacagtggagagaggtagagcaagcttcaggaaggtaacccaatgggactatgcaagtaacaagacacgaggccagcaactacataaggtgtctaattggagggaccacaatgatatcacaaccttctacttcacttgttttggagaagaaattacagaggagaagttatggcaacacttcaagaaatggggagatgtcaggaaggtattcatacccaatcgcagaaattactcaggaaggaggtatggatttgtcagacttaaaggggtacgcgacattccacacttggcacggcaactggataggatcgttattggagggttgaaactatatgtcaacattcctaagcatggaagggacaaaccaagaaaggcagatgcagggatcaaaatacagagacacgaggggggcacccaaacagaaactgaccacgccagacaagcacgtcaaacaaacccagcctcatacagggatcgactggcctccaacatccaaaatcacagccgccaaacctcaccttcttcaatccacatcgacatcgaacttgaagacaccaagtggttgaaggacgcgtgggtaggacgcctaagaaacccagctacgtttgaaagagtggaggatgaattatggtgggagataggattgaaaatagcccctaaatacataggagatgactcagtcttgcttcttggcctcaacgacgaggacccagaacaaatcatgaataagggacaagatagaggctcatctatgttttactcaatggagaggtggagcccaagcttacgcactgggaataggctggtctgggttcattgttggggaatcccactccaagcttgggataagaaacatatacaacagattatgtctgttatgggagatttggtggatatggatgacgaggttgaagaaaaacggaggctggacagagcaagggtgctcattaagaccccatggaggccaactatccaacacaccatccacgtccacattggtgatgaaacatttgcggtggacgttattgaggagagcgacagtgtatttcacgactaccttcgggggagaaggagtttcgtggggttgtctgacgagatcttctcggacaaaagttattacagagaccacaacagccaaacgcacaaccaaacccatttcggggccatcccgtcgacgtcggcggctaatgtggtgcgggaagacgacatgcaactatcaacagtgccggaaacacaaaatgaacaacgctacctcgcttgtagacccgacggcggagttgaagaccacggcacaactctattatccagcggtcaaccgggttgcaaatacccagtgggtaatagtagtatcccacggacgtttggcagacaacaacggtcaacagcggcacaacagctttttcaccaaaatggaaacattgaaaggagggagatagatgatatggcagagatccacaatgttttaaaagctgaaacacgcgaccacagtgtcacatgcgacccgacagaggcaaaagaccactcatgcaatcatggaaaattaaaaaatctggagggtgatgaagacagaggtgtaaaggcagctcgtgagtag

SEQ ID NO: 35849 - DNA, 378 bp, Glycine max
  Peptide Sequence Number=SeqID_152627
atgggggggaaagtgttagagggtgtgagagagagaggttttgagctttggaatgattttggaatagaaaatggatgggcttggaacgattttggaatagagaggttttgtgatgcatgcgacgtgaagaatgcacggaagagcgtagcctacaatccacaacttgagaggcatgttgggattctcgttgcgattgagaaccaagacggtggcaacaaaggcaaagttccagagaatgtccaagatgacgaagggcttggaaaaggcctaatcactctgcctctcttcgagttgctccgctgccgcctcccgcatcaccatggacgactctgtctctcttttttggctttcattgttttaaaattaaaaaaaaaataa

SEQ ID NO: 35850 - DNA, 1776 bp, Glycine max
  Peptide Sequence Number=SeqID_152628
tccaatcccgttttagaagcctttggcaatgcaaagactgttagaaacaataattcaagtcgttttggtaagtttgtggagattcaatttgaccagaggggaaggatttctggggctgctatcagaacttatctgctggaaagatcacgtgtttgtcagttgtcagatccagagaggaactatcactgtttctatatgctctgtggtgcacctccggaggatattcagaagtacaaattaggaaatcctagaacatttcattatctgaatcaaacaaattgctttgagttggaaggggttgatgagctaaaagaatatcgggatacgaggagagcaatggacgttgttggaataagttctgaggagcaggaagcaatatttcgagtggttgctgcaattttgcatcttggcaacattgaattcacaaaagggcaagaaatggactcatctgtgcccaaagatgaaaaatcttggtttcatctacgaactgctgccgaacttttcatgtgtgatgcaaaggcacttgaagattctctttgtaagcgtgtaattgttactcgagatgaaactataacaaaatggctggatccagaagctgctgcactcagccgagatgctttggctaagattgtctacacgaggctgtttgattggctggtggataaaattaataattcaattggtcaggaccctgactcaaagtccttaattggtgtgctggatatttatggttttgagagtttcaagactaacagttttgagcaattttgtatcaatttgaccaatgaaaagcttcagcaacattttaatcagcatgttttcaaaatggagcaagaagaatacaaaaaagaggagattgattggagttacattgagtttgttgataataaagatgttctggatctcattgaaaaggttctcaagcccactgtaatatgtgtggctgtagataaaagtagtagcttgcaagctgaacaccaggcacttctttatgtttccaaatgcccttttgtgtctggtttgttccccccttcacctgaggaatcgtccaaacaatcgaagttctcttcaataggttcccggtttaagcaacaattgcaagcactacttgaaactctcagtgccactgagccacactacattcgctgtgttaaacccaataatcttcttaagccagcaatttttgagaataaaaatgttttgcagcaactgcgatgtgggggagttatggaggcaattaggataagctgtgccgggtatcccactaggaaaacttttgatgaatttgcagatcgatttggacttcttgcacctgaagctttggacgggagttctgatgaggtcactacttgcaagaagattctggagaaggttggacttaagggctatcagattggtaaaacaaaagtgtttcttcgagctggtcaaatggcagatctagatactcgtagaagtgaggtcttaggaaagtcagcaagcattattcagaggaaagttcgtacttatttggcccgccgtagttttttcttgatacgtttgtctgctatacagattcaagctgcatgcagaggacaacttgctcagcaagtttatgagggattgcggcgggaggcttctagtctgatgattcagaggtatttccgcatgcatgttgctaggaaggcatataaagaattgtatagctcagctgtttctattcagactggtatgcgagggatggctgctcgtagtgagctacgcttcaggaagcaaactcgtgctgctattgtcattcag

SEQ ID NO: 35851 - DNA, 303 bp, Glycine max
  Peptide Sequence Number=SeqID_152629
atggaaaaagctttaagcgcgaatgatgaagtacctgagctgtttgaagcatttggcagaacagaaattttggtttacgttgggttgaccatgttcactgttgttgcattgcgtgttggagagtcccagtcccagtctcaggattattttggagagtgcggctactatgtgatgcactggatgtccaccatcattttaggaacttttaggaataattgggaagcgaccattggagccaaagagattaaaagcattgcggatccagtgggcacagtttatctccgagttagagatcaggcctag

SEQ ID NO: 35852 - DNA, 681 bp, Glycine max
  Peptide Sequence Number=SeqID_152630
atggagaactctttagagatttggacaagtcacaagtatccaaattcagaattggcaatgggattcaaagttttctttgagaacaagcagtgcatgatcaaggatccttatgaaaatgaggaggagcaagcagcttatacagctgctatgactaacacaaagacttggcataagaggctaggtgtgttcttcaaattcaagaactggattgagaaccaaagtggctttagaattcatgttttgagattagataacagcaaggaatacgccttaaatgaatttgataaattatgtgaggaggctggaattgagcatcaacttacagaaccatacactccacaacaaaatggggtcaataagcagaaaaatagaaccataatggagatggctagatgtctgcttcataagaaggaacttcccaaagaatattgggtggaggtagcaaatattgttgtatttttgttgaatagacttcccacaaaagcagttgatgggaagactccttttgaggcctggtatagcatgatgcaagctccattggagcttgtaggcctaggatcttcttcatcaatggattcctttgcttcttggaagataaatggcagcagaatggagaaggaagagagagaggagacgccacttcaaggagaagatgagtttagaagaagctcaccaccatag

SEQ ID NO: 35853 - DNA, 312 bp, Glycine max
  Peptide Sequence Number=SeqID_152631
atggatatgcaaaaagaggttgaatacaagcaacaacaagagaagctcgaatgtgaagagttattcaataacctccatgctcatcttggaccacaagttgatgttattgaaactctgatggttgaagtttcttctcagcccataccagacgatgcactcaccactatcaacacttccagtattccaaggaaaataaatcatttaaccattgttgcttacaatggcgtgtttaaagaaaggatccaagaaatgaatgttcgcatctacgatgacggttctcagaaagtcatcttagaaaagctacaattctaa

SEQ ID NO: 35854 - DNA, 408 bp, Glycine max
  Peptide Sequence Number=SeqID_152632
atgaatgagtcattggtaaaactcattatcatattcctgcctcaagaagcacattttccaatcattgaatctatagatctttgttggatgcaagatctgcaccatatgcatgttgtcgcaacctacccttcggcgggagggcgacgcgtgactcgcgggatacgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggagagaaacgttaaggtgttggaccattaacgatctctcggggtggtcgacaaaagcggggcttttgctcctacgtatcctcaattgcgatgaggaaatcagacctacatag

SEQ ID NO: 35855 - DNA, 1044 bp, Glycine max
  Peptide Sequence Number=SeqID_152633
atgaaaatatctgctgagctcattttgtttcaggtctcagaggtgagtttacgcttgggcaaagctggtactactggaattgctattggattagagaaagcagtagaggttttggacactcttgggagcagcatgacgaatttaaatgctagcagtgggtttgtttctggagctgcaataaaggggaatgaaatttctatcttagcatttgaggttgcaaacacaattgtcaaaggtttcaatcttctacaatctctttccgcaaaaagcattaggcatttaaaagaagaggtgcttctttcacatgccgtgcaagatttagtatcaaaggatatggatgaacttcttaggattgttgcagcagacaagaggcaggagttgaaagttttttctgatgaggtgattcgttttggaaatcgttcaaagaatcctcagtggcacaacttagagcgttactttgagaaggttagcaaagaattaaatggtcaaagattgtcaagagacgaggcagaagcaataatgcaacaattgatgactttggttcagtttacagctgaattgtaccatgaattacatgctttggatagatttgaacaagatattcagcgcaagggtgaggaggaggagggggatcaaagaggtgatggccttgcattcttgagggcagaaattaaaagtcaaaagaagcaaattaggcatttaaagaaaaaatcactctggtctagaagtttggaggaggttatggagaagcttgtagacattgtccattttttgtatttggagataagcaatgcctttggcaatgcagatgaccccaaaccattcattggacgcatgagcaatcgccaaagattgggccctgcaggccttgctttgcattatgcaaatatagtgcttcaaattgatactcttctgccattgacatcagacggtgcaatttctggtagaaaattccatgtacttaagtttctaatactaattgcctttcaggttgctataccatctgtgacctggaattggaagtggatgaacctacttgtttaa

SEQ ID NO: 35856 - DNA, 726 bp, Glycine max
  Peptide Sequence Number=SeqID_152634
atggttagtgctgtgttggcgcatttcatgttgaacgagaagctgcagaaaatgggcatgctggggtgtcttctgtgcattgtgggttccactgtgattgtgctccatgcgcctcaagagaagtctcttagttctgtagaagaaatatggcagttggcacttcaacctgcattcctgtcgtacactgcctcggcgatcgctgtagtgttctttttgattttgtattgtgctcctcgccatggccagactaatattttagtttatattggaatatgctccataattggatccttgactgtcatgagcataaaagcaattggcattgctataagacttacgatcgagggtgccgaccagtttgttcagttccagacatggatttttaccatggtcgctatttcctgcatcgttactcagttaaattatcttaatatggcattggatacttttaacacagcagttgtttctcccatctactatgccttgttcacatcttttacaatattagctagtgcaatcatgtttaaggactattatggtcaaagtataagcagtattgcatcggagctttgtggtttcgttactgttttatctggtacaactgtattacacagtacaagagagccagatcctccagtcaatacagaattttttatatccctgcaaaaaacacatggagattcaaggaaagttaaactggaaaatgtttgggttgagggaacatag

SEQ ID NO: 35857 - DNA, 426 bp, Glycine max
  Peptide Sequence Number=SeqID_152635
atgaaaatagaaaatattgttaagtctgctgctgcaactagtcaagatgagtttgtgtccaactgtcataccctaatttcgtccggggacctttgcttgatgacatgcgaccattctttggtcctcgtgaggtgcttggcacccatcattaagcgatttgtgaaattccaggacatgccgaaaaaccaaaaaaatattgatgcagaatcccacccaggcccacttgggccctccagaatattcctccagaaggcggttgcttctggaggaagcaacctggctcgcctgggcgagctgggcggcaaccacctcccctattttgctataaataggggaggaagtgaagaagaaaagggttcagcccctttggcacttctctctctttcgaatttgcttggaaaaatcgtttccgtgaagaaaatctaa

SEQ ID NO: 35858 - DNA, 1146 bp, Glycine max
  Peptide Sequence Number=SeqID_152636
atgactctagaagagctcatcagaatcctcgaagtctatgagcaagagcttgctcaagatgaaggaacaaagaaagggaaatcactagctcttatggttcaaagaccaaaattcaactcaacatccaaggagtcatcgtccaaagcctttcccgtgaacgatgctttagaagaagaatctgatgatgacgactctaacaaagaagatgatgaactaagtctgatcataagaaagattagaaagatgtggagaaacaagaacccctctaggttcaatggatcatccaaaagatctttccacaagaaagagaaaattccaatcatttgctataagtgcaagaaactgaggcactttaaaaagcatgaggatctcataaaagcccatcaagttcacttagttgattttgtcccggtaacaacctcgccttgtagtgaacaagatacctttgtttgtgaggaagttaaagcaccactgagcaaaaaggtatccagtggacgaaaaaatcttcttaaggattttcaagacttggaagaaagggaaaaatccttaactataactcttaaagattcagaagaatggtgcaaggaaatgattaaacccaaactcttacttcaaaaagaatgcacccttgctaaaaatgaacttgataagctgaaaaagaaaaactcagatctttggatggaatgtcagcattacaaaaagatgtcttctgatctgaactataagcttaaggaatgtgaggtcttgagggcattacctctagaggttgtaaagatctatgagatagaaaccttaagagataaactaggaaattttgttggtggtcatgaggcccttaataagattcttaagatctccttgatagcaagaaagaaacaccagtcatggtacctagatagtatttgctcacgacacatgacaggcgaaaagtctatgctccaatccttaagccctatatctagtggggtgatcattttcagagggaataaaaaaggactgataactggggtaggattgaagcacaatctgctaagcataagtcaattatgtgatagtggatacaatgtcaccttttacaaggatatatgtattttccataacaaggataactcttcactcttttctgctaagagacaaggagattaa

SEQ ID NO: 35859 - DNA, 502 bp, Glycine max
  Peptide Sequence Number=SeqID_152637
ggggttgttgagtgaaaatgttgatgtcaaagagtctctgtggtggagaaatttaaaaagggtttgtggaggcttggatcaatccaagaccaagtggtttgagaagggtatggagtggaagttaggagatggtgatcatattaagttttgggtagatgagtggttgggagaacattgtttagcttacttgtatcctaggttatttttaaactccttgaaaaaatccgagttggagtgtgacatggggagggaaatccctgatagctggatttggaaatcaagtttagaagattcttacaaggtgtctgagcgtgcttggaaaatcctctattcatggggcagtttctcaacgtttcttccttattctgctgatacctcatggaaagttatctacaaccagatgcaatttatggaggacaatgtggagcgcattggtatgggatcacaggactttgatcatgaataccagggcttgtttggaatgatggtgatgcttgtatag

SEQ ID NO: 35860 - DNA, 2212 bp, Glycine max
  misc_feature (431)..(431): n is a, c, g, or t
  Peptide Sequence Number=SeqID_152638
gaccaaccatgagatggatttcgctgacaggcttacggttgcgagaggggcaatggcggtggctgttgatgcgacggagcgactcctcgccgatgaccatggccccagtctcaacctcgcggttgaggacgagcttatcagggccgtggatcttgtattcacccacttgtacaggattccagacactccgttcccaacaatgttgttcagcatgacctcgttgcgtgtggtggtgtgctgtcgtgtgaaccttgcggaggcagatcgcctcacggcggatgaggaggaggacgctagggaaagacggttgtgtgcgcagctggagaaggagcggaagcggaacgcgggaggcatggaggatggtggtggtggaggaagcgggtttgcgggggattcgggctgggctggttttggtgcagtgttgggagccnacaaaaggaattcatggataggattggattgtgctgagaatggttatgatgagaatgaagttgcaaagaatggaactgaaggctttatcccaatgccgcttttgaagagaaagccttttgtgttgcctgagccacctgatgatttggagccgcacgagaattatcgccagagggtttggacatgcaaaattactggaaaatctggcttgacttatgaagaggctctggtgtcagagaagcatgctgctgagaaagttcaacagattccggaagaattagtggcacctgctctaaggattatccactacagcatgctccctttgaaggatcttgctgattctattgctgaaaagttgcaggaacagttgtttgtgggcgctcaattgtatggaaaaaagaatgacagagtacgtccatgtaaagtattgaaagtgatgcaggaagatgctgaaaatgtccgctatgtggaagagtcaatcaaatatccaattgatgatctattagtgaagcctagtccagatgatcctgttttcagtagtcgtccttctccatcaagagactttaatgttccaatttattgtgtaggggatctcttaatggtttgggatttttttatgtcttttggtaaactgttgcggttgtctccttactctctcaaagattttgaaaatgcaattagccacaaggaaagcaatgtagttcttctagtggaatctcatgcagtactcttacgagtgctcatcaaaggtgattatgaatactctgcagctgttctggaaaaaatacagaagaagattacattgattagttggaaagactatctatctgattttctagaaatgatcaatattcccaagttgcggcaacatgaagcaacaattaaacggggagattatggttatgtagatgtcaatgctaaattagaaatctttcgtgaactagtcaatagagcgcttggaactgcttttgtcagggaaaaattggatgagtttattgaacagaggacggtactgggggccgctaaaagggaagaagcaattgaagctgctgggaagagaagaaaagtaaaggagcagttgaaagctgattttgaaaggaactgtggcgagaatgggcatcatcttggcacggtactgggggccgctaaaagagaagaagcaattgaagctgctgggaagagaagaaaagtaaaggagcagttgaaagctgattttgaaaggaactgtggcgagaatgggcatcatcttggccatgatgcaagtgtgtcaacaaataataatcacagaatacagaatggtgtcgctggaaagaatagaaacggagagatagaatcatctaggcaaagagatgcattggatagtgggatcaagcattcaaacattgattcaaaaataaaggctaaaaagttcaatttggagctgaatagaacagcagaaattgtggaagtatccagaaaggaatcaaagaaacaaccagggggtgataaggatcaatcagagaaaagtgcagaacagaggagtgaatattttgatcgggagatggagaaatggcgaattcgtacaagtcccttgggtaaggacagatattataataggtattggtggtttcaccgtgatgggaggatatttgttgaaagttctgactccaaggagtggggattctacagtagcaaagaagaggatgactctatggtccgaaggtctactcgtgttcgggctccacctagggaaaatccttccaaagctttcctcaaatatgccaatgtgtggaaagaagagtaa

SEQ ID NO: 35861 - DNA, 549 bp, Glycine max
  Peptide Sequence Number=SeqID_152639
atgcaacgtttacccgccaaaacgataagcaaaatcgctcgtacagcatgcgacgtgttcataaaccaccgtgggatagacacaaagaaaaacgttgcggggttgttgtacgataatcttacgaggaatggagtgagggcattcttggacagcatgaacatgaaacctggggataggctattcgaccacattgatagggctatcctcggttgcaaggttggtgttgcggtcttctctcctcgttattgtgactcctatttctgcctccacgagctggctcttctcatggagtccaacaaaagggttgttcctattttctatgatgtcaaaccgtcgcagcttgtggtcaaggacaacggaacacgccctcataaggaccttcagaggttctgtttagcactcgaggaagctaaaaacaccgtcggtttgacgtttgattctttgaatggggattggtcggagctgctaaggaatgcttccgatgcggtgatcatgaacttgctggaggtagaggaagaaaggaagcacgcgaggaagcaacaacgttga

SEQ ID NO: 35862 - DNA, 1326 bp, Glycine max
  Peptide Sequence Number=SeqID_152640
gcagagaaggttgacttggagaacacacttattgatgaccaaaggcaatcgaaggatgaaacagaatcctatctatcaacgcaagaaaagtatagtgagggaagtggtgatgattctttcgaagagcacgatggggacgatcactcagacgatggagacgatgcattctatgatacatgtgatgatattctatcaacaacaagctctgagcacctgagatcctgccatgattctgaatatgaggagacaagtccaaatggtgatgaaaaatcagccattggatcttttgggtttaactatcctcaaatcaagcgacgaaagaagtttcctgatcctgttgagaaagagagcagcgtcagtctatggtcaatcataaaagataacgttgggaaggatcttaccaaagtttgtcttccagtttacttcaatgagcctctctcctcactgcagaaatgttttgaagatcttgagtactcttttcttctagaccaagcatatgaatggggtaaaatgggtgacagtctaaagaggatgttgcatgtggctgcatttgcagtttcggggtatgctagtaccaatggtagaagttgcaaaccttttaatccactgttgggtgagacatatgaagcagagtatcaagacaaaggcattcgctttatctctgagaagcttgatcctgttggtttattgaccgtagaatttgatgatggagaagtctttcattggagcaaggggaaccgtgagtattcatgtaagatcaaattcaaggagcagtcgatcattgatagaaaccctcaccagattcacggcatagtggaagataagaaaggtagaacagtggcaactatatttgggaagtgggatgaaagcttgcatttcataattggagggaattctgggaaaggaaaacggtcctccaatgtttcctcaaaaccacatcttttgtggaagcggaatccaacaccagagtaccagacaagatataacctcacacaatttgctattacactaaatgaaatcacacctggattaaaggagaagttgccaccgacagattcaaggctaagacctgatcaaaggtgtttggagaatggacagcatgaaatggccaattctgaaaagttgcggctagaacaaagacagcgacaggcacaaaagatgcaagagaagggttggaaaccaaggtggtttgccaaggaaaaaggcaacaactcttaccgttatgttggagggtactgggagaccagggaaaaggggaactgggaatcttgtcctgacatttttggccaattctcaaccgatactgattttaactcaactccataa

SEQ ID NO: 35863 - DNA, 543 bp, Glycine max
  Peptide Sequence Number=SeqID_152641
atgagtagaagggcgcggcggtcgctgcaaaacccagggcgcgagccgggcggaagcgtcgtcggtgcagatcttggtggtagtagcaaatattcaaatgagaactttgaaggccgaagaggggaaaagcctgcccacccctggaaacggctcagccggaaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaa

SEQ ID NO: 35864 - DNA, 780 bp, Glycine max
  Peptide Sequence Number=SeqID_152642
atggtggggtttggtctagcttatggaggtgttgtatgggactcaaagggcttaagtggccacagccaagttatatttcaagttcttaataatcttgtgagtgaagcctctaccaagtaccttcaacaagttggaatttatgatgacataactaacagcatgcgagatattagttataagaaggaaaaagatcaggggaaaataaactcagttttggtcaacatggtagaggacctagagtcaagtattgaagattcgattgccttggtgacagagatgatccataaaaaggagaaagagttgcttgaacatgccttgattgaaggacataatgatttgcccaaggctagcaatcatctccatctttcatgtctcaaagtttttcacatgttcttcaactgcagcaatcgatatgactccgaaacagcaatgcttcaggatatcagcaaagcaatctaccttgctttgagtaaaaattcaaagccatttgaggttgttcctctccaattagagccaaaggaaaaaacaccaacaccagtctcttacagcaattcatattttaagcatcacaagaggaccacttttactgcacatcaagtttcacagcccgccttaagaaaaggacatacttcctcaacaattagaacaagtggttcagatggtggggattttccaagaagaaaggaggagaagaatgccaatgagttgcttcgtttgaaacaaggcactgcatggccagctccccgaaatgtcgcaaacgtaagcccctcgtattcttga

SEQ ID NO: 35865 - DNA, 102 bp, Glycine max
  Peptide Sequence Number=SeqID_152643
atgattatggttagaactagagggttagatcgtgtcttaggcaggattataggtagaaccctggggagagaggatcatcatgattcagatgatgttccctaa

SEQ ID NO: 35866 - DNA, 328 bp, Glycine max
  misc_feature (287)..(287): n is a, c, g, or t
  Peptide Sequence Number=SeqID_152644
atggacagaaacattcttgactctctgttcttaaacatctactttcatggccttgacatgaaagaaggatcaatcccaacggctttaatctatagtatccagtacaaggtcgtgaatacttgtgcatctagagtcctattacaagcacaaaagggagaaacgaccttatttatcactgatatgacgaaaaccaatgtttctttaaaaagaataatcaaatgggacgaagttactctccctgaaaaatgggttatggaaaaggccacactgtctaatccccgaaccgntccaattattgagaaaatcaaacgagacaaacttaggaaag

SEQ ID NO: 35867 - DNA, 1349 bp, Glycine max
  Peptide Sequence Number=SeqID_152645
atggcaaaggtcatatcatcccaggcagtcaacaagagagggataaagatattgccaggttggactctcatcgatctaattcgcttttctaaaatttctacacatcctcagtcagctagtagtagtgtttcttctagagatagacaatggggtggtgtgaggagaatattgagctctggggataataataataataataatggtgatcttgtgactaacttgcctggccagcctcctgtagatttccagcactatgctggatatgtcactgtcaacgaaactaatggtcgaacactcttttactggttctatgaggccatgaccaagcctgaagataaagcattggtgctgtggcttaatggaggtcctgggtgctcttctgttggatatggagcaacacaggagattggcccatttttagtggacaccgatggcaggggcctcaagtttaataacttttcatggaacaaagaggccaacatgttattcctggaatctcctgtcggggttggcttttcctattcaaatacaaccagcgaatatgcacaattgggagatgacttcacagctaatgatgcttacacttttctgcacaattggttcctcaagtttccatcatatagaacaaggacattttacatagcaggagagagctatgcaggaaagtatgtaccggagctggccgaactcatccacgatagaaacaaggacccttcccttcacattaatctcaagggaattttgctgggtaaccctgaaacatctgatgctgaggactggtcaggtatggttgattatgcttggagccatgcagtgatatctgatgaaacttacaaaactataaaagcaagctgtgacttcaatagcagtgatccgtggagtaacaatgattgtactcaaggagtggatgaaacactcaaacagtacaatgaaattgatatctacagcctctacacctctgtctgcttcgctagtacagcgcgttcaaacgatcaatcgatgcaaatggtgatgagtcgctcatctaaaatgatgccacggatcatgggaggttacgacccatgtttggatgattatgctaaaactttttataatagaccagatgttcagaaggcactccatgtcagtgatggttacaatctgaagaattggagtatttgcaatgaaaacatattcaagggctgggcacaatcaaagccttctgttatcccaatctacaagaaactcatttcagcaggacttaggatttgggtttacagtggagacactgatggtagggtgccagtgctgtcaacaagatacagcttaagtattctaggtttgcctatcactaagagatggaggccatg

SEQ ID NO: 35868 - DNA, 975 bp, Glycine max
  Peptide Sequence Number=SeqID_152646
atggcggtgctacgtggagtggctctaccagcacaaggagctgggactctacctagatgtgagtcgggttgggttcactgcaaggataaaggagaacacgaaggttatgcctttgtggcttttaatagaaacagggttgtcaatgacatacatgggttttctactaagaagaacaaagagtaccaagagaagctaccccttgttgtgctcagggcagtggaaattatttactctaaagccaacttcgagaatgttgttgtaacaagaagaattgttgcattcaccattcaccagccaagtattgatatatttgaggcattcgatgagctcaccacttgcactttattaagagaaagggatagtggccataatccttcaataggtgtcgaatcgttgtacccatgtagtgctgatctttcattgccatctatgttgcattcagttcctcctattgttgctccgatggtttatgatcacagggctgaaagtggagctagcctaggcatgctttcttcaagcagtctttatggtggatatggatctttttcgggcgtaggacattgtcgcgcgtccgacgtctcgtcttgtctcgccaccgcgcaagccacggagtttcccttttcagagttgtcgtgccctacaacttgtcttcaagggccgtttgaatgcgatgatgaggttgctgatacattatcccagctttggcatttaagatatcctctcaatgtgaaggtgagcttggttgctgtcatggttctgcaatctagtgctattcttcagaatgtttttttgcatgatgcatttgttactgcactaaggaaagctgagcaatttctttgggctggttctaagatggattctgttcgagacatggtaaagaatttgattgaagctcagaagtgggcagaagggataagagaaaaattgagttatggttgtgtcatcgggactctaatgtcaagaaagttaatttag

SEQ ID NO: 35869 - DNA, 552 bp, Glycine max
  Peptide Sequence Number=SeqID_152647
atgctttcagacctaacaaagaatcacctactcagaaacgttgtggcatacaataaatatccaacttcagatgaaattgaccagattatatcagcagagataccttcaaaggaagattacccagaactctatacattggtgcaaaatcatatggttcatggcccatgtggaattatacgctctgaatctccatgtatgaaagaaggaaagtgtagcagattttatcctaaaatgttccaacctcgcactcttttagatgcaaatggttatccagtatatcataggagaaatgatggtcgtataatttcaaagaatagtgttatcattgataatagacacaacgtaccttataatccaaaattactaaaaaaataccaagcgcatgtcaatattgaatggtgtaatcaaagtgcttcaatcaaatatttattcaagtacataaacaaagggtatgacagagtcattgctgttatgctttatgatggcaatgatgagatccaaaatgctaccaaccagaaagatgagattaaagaatatatagacggcaagtag

SEQ ID NO: 35870 - DNA, 789 bp, Glycine max
  Peptide Sequence Number=SeqID_152648
atggaagaacattcaataagtgattgttcaaatgatgggacatttgaggatgttcatatggaggatgatggggttgctttgaggatgatgagtttggttagcaaggtaaagaacatgtgtttttggaacgaggatgggctagatgataatgaatgttttgagaataatgtttcagatgataatgagttaaaggatgaagaagattatgacaatgaggttttaaatgatgaaggttaccaattttataagtgtggtggtcataagcataagttgttgaatgagcaagattgtggtctgctttcaggtcacaggaaaattactgcatcagatgcaatgcagattgaaaattataggaaagttgtcattagaccaccccacatatatgcatcattggcccaaacttcagggggttataataaggtgggatatgttagaaaagatatatataactattttgcaagacaagggcgcaagcaatcatctgatgttaatagggctttgaactactttcaccatttgtgtccaaaagatcctatgatggttgttgcttatattgtagatgatgaaaatagattgcaacatctattttgtgttaatcatcacaataacacaatagtgtttgctactgctttggttactaatgagactgaggaaacatatgtgtggcttttagaacaatttctgaaagagatgaaagggaaacatcctagttctgttattacggatggtgaccttccaatgcgtgctattagaattgtgttccctaggacacatcatcagtttgcttga

SEQ ID NO: 35871 - DNA, 435 bp, Glycine max
  Peptide Sequence Number=SeqID_152649
atgacagcaaccaagctcaccttcactgtaacaaaacaaccaacaaagaacctgaactacccaacatgtaaacccagcccaacacacctattcagaaccatgatagcaaccaagctcacctcaacgaaacttaacccccaacctagcattatgaacaagcatctcaagccacactatgccaagaagatatacaaggaaggccaattaccattgagaggatatcttaaatgccaaagctgggataatgtatcagcaacctcatcatcgcattcaaacggccctttgtttgaactatcagagctaatgagtcaactccctatcaagagaggcttatctatgttttatcaagggaaggctcagtctttcagttctctagcaagcgtggagagcataggggatcttcctaagaatttagtgaaaaatcagaccaattga

SEQ ID NO: 35872 - DNA, 423 bp, Glycine max
  Peptide Sequence Number=SeqID_152650
atggcaacaacgacgtggaaacattcggttcttaggacgggctttaaatgcaatgacgtagtaatatataacttcaaagacggtgcttacacccggtggggtgactcgttggatgatgaccgagtcaagcgaaacgggagcattggaggggagaattgctctgtaaacactccaccactggtcttggcctctacggtggaagtagagagtgcgatcgtcgacccaggatggccagccattgaattcggcaaccttgacacggtgagttctatcgcgggtgaggaagacatagatgtgagtggggaaatcttcaacttcttcggcccaaccgttgggggtgccgtaggaagcaacagcggtccaaagacccgagggagagagggatgggctgaaatcagtgaggccgttcagcacaacagctaa

SEQ ID NO: 35873 - DNA, 195 bp, Glycine max
  Peptide Sequence Number=SeqID_152651
atgggtgttaagctcgctcaaaatgatagatatattattatagctagatctgccccttatttaatatttcaagtagaatgtggcatgactatagagcagtgcatttccacctcttgggtgcggaaactggcaattctggcaagaaaaggtgtgcatgcatgcgcaatggataaagcaagaattgaaccgaggtga

SEQ ID NO: 35874 - DNA, 204 bp, Glycine max
  Peptide Sequence Number=SeqID_152652
atgaggagaggagctaagagaaagacgaagcagggtcaagaagccatacacgatgcacccgaagataacaagcccaaagctcagcctcgagctaaaagagccaagacctccaagcctcaatccgaacctaagtacttccaagacaagcgcaacttgtgcacgctataccttcgtctcttctggtttggagctcttacacagtaa

SEQ ID NO: 35875 - DNA, 414 bp, Glycine max
  Peptide Sequence Number=SeqID_152653
atggttgactgcaatgtcataacaacaagaagcgggttagcaactaaagagctagtaaaaaaggacatggaggtagataatgaagtgaaggaagacatacaagaggaggatagtcggcttacaaaagaagctaaacaagcaattacacatgagaagttgtatctctccaaaccagcaaagcaagataaggagtggcgatatagaaggcttatagacttgattaagcaatttgatgtcaccattcctttcatcaatgtcatagacatgatgctagaatactcaaagctcttaaaagacctcataactaagaataagtgtttgaaagactatggcatagtgactcttgaagaggattgcagtgtcatcctggagaatcacaagaagcacaaccataaaggagacttaacccgatga

SEQ ID NO: 35876 - DNA, 2373 bp, Glycine max
  Peptide Sequence Number=SeqID_152654
atggtgggaagtatggggcccaaggcgcgtgacgagcagtacatattacgagttgcattgcaggatctatcccaaccgaagtcagaggttagtccaccagatggtctgctggcagttcctcttttacgacatcagagaattgctttatcatggatggttcagaaggaaacatcaagtttatactgttctgggggaattcttgcagatgatcagggtcttgggaaaacagtgtcgaccattggtttaatattaaaggaaagacctccattgctgaataagtgcaacaatgcccaaaaaagtgaattagaaactttgaatctggatgcagatgatgatcagcttcctgagaatggcatagtgaagaacgaatctaatatgtgtcaggtgtctagtagaaatccaaaccagaacatgaatttgttattgcatgcgaagggaaggccatctgcaggaacccttattgtttgtccaactagtgtcctgcggcaatgggctgaggagttgcacaataaggtaacctgcaaagcaaaactctctgtcctagtatatcatggaagcaatcgaaccaaaaatcctcatgagcttgccaagtatgatgttgttctgacgacttattcaattgtcagcatggaggttcctaagcagcctctagttgacaaagatgatgaagaaaaaggaacttatgatgatcatgcagtatcaagtaagaaaaggaaatgccctcctagttctaaaagtggaaagaagggattggacagtgcgatgcttgaggctgttgctcgtcctcttgcaaaagtggcttggtttagagttgtcctggatgaggcccagagtataaagaatcacagaactcaagttgcaagggcctgttggggtcttcgagccaagcgtagatggtgcttgtcagggactcctatccagaatgcaattgatgatctctacagttactttagatttttaagatacgatccttatgctgtgtacacatcattctgttccacaattaagatccctatcagcagaagtccatcaaaaggatacagaaagctacaagctgttttaaagacaataatgttacgtcggacaaaagccacacttcttgatggggagcctatcatttccttgccacctaaatctgtggagttgaaaaaagtggaattttcaccggaggaacgagatttctattccagactagaggctgattcgcgagcacagtttcaggaatatgctgatgctggaactgtgaagcaaaactatgttaacattttgttgatgcttttgcgccttagacaagcatgtgatcatcctctccttgtcaagcgttacaattctaactctctctggaaatcctcagttgagatggcaaagaagcttcctcaggaaaaacgattatgtcttttaaaatgtttagaggcatcattggccctctgtggtatctgtaatgaccctcctgaagatgctgttgtttcagtttgtggtcatgttttttgtaaccagtgcatttgtgaatatcttactggtgatgacaatcagtgccctgctccaaactgcaaaactcgactaagcacgccttcagtgttttccaaagtcacactgaatagttctttttctgatcagccttgtgataatttgcctgattactctggttgtgaagtggaggaatctgagttttgttctcaggctcagccatatgattcttcaaaaattaaggctgcacttgaggtgttgcagtcgttgtctaaaccacaatgctttgcttcccaaaacaattctgtgcagagcacttctggggaaagtaccgatggccttggtagctcctctagtgctgacagaatgaaatccttgaatgaaattcctgagagtcaaaatgtgcttgaggagagaagctctaataattcagttggtgtaggggagaaagctatagtgttttctcagtggacaaggatgctagatatacttgaagcatgtcttaagaattcgtcgatccagtatagaagactggatggaacaatgtcagtcactgcaagagataaagctgttaaagattttaacactctccctgaggtttcagttatgattatgtctttaaaggctgctagtcttggtctgaatatggttgctgcctgccatgttcttatgctagatctatggtggaatcctacaactgaagatcaggcaatagaccgagcacatcgaattggacaaactcgtcctgtcacagttttacggttaactgttagagatacagttgaagaccgtattttagctctgcaggtgtcagtgggttgttctttttggtggaagcagaagaaacagggtgctgaaaattttgtagcatggcctctgttgacactcgacatgaagattatatga

SEQ ID NO: 35877 - DNA, 1068 bp, Glycine max
  Peptide Sequence Number=SeqID_152655
atgtgtagttgcgcttttacagtagacccttgcctacttactagtgcctcagggaattctgtccttgaatgtgaacatgaaaaccagggaccttcatcacagactttttcatccccaaatgctcttgctggtggtttcagggactcctccatgcttgaaagtgatgaattttgcttcacagaaatgacaggagtttctaattgtgagacacctgcttacattgcagacagaaggttccctgttcctgaggcgaattcaagcagcgtagctgtctgtggagataatttgaacctgcctctgtggaagtgtgaaaatgacagccaaatcaagcatataggatatgatgcacaatctgaacatgcttcacatggttctatcattgaaaatattgacttaaattttggagattatgaaacctatatggaagacattattggactttctggtaaacaggaaaatgactcgtgtacatcttttgaaatgtcgtttgtggatgctgatagatcttcacgtgttgcaacttcaactgattcttctatttgtcaaggttccaatgttcccaatgattttagtgactattatccatctttgaattgttaccaaggtatggatgatagacctgttgttgccaacagttctggttgtttgcctaatggtgtttatcctcatgtgcggaaaaatgaagaaatggtgaggaacatgaaggttgctaaaatggagttatttgccgatacaagtagtggcatgcattccagcattaatggtggaatatcttttcaagatagtcaatttaggtttgcagatagtaaatatgcatcatcttttcctggtaatgttctatttgaagacaacgcgtcagtggaactttcaacttgtggttcatatatttcaagagaaggccaatcacttactgtcaaagccgaaagagatgaactgattatgccttaccaaaactctgttcacagtaatgatgctgagttcaatgtaggtcaagagatgaaacaactacctggtattttccctgctgttggatgtcagggtaatgatttctttaagtgcagggataag

SEQ ID NO: 35878 - DNA, 150 bp, Glycine max
  Peptide Sequence Number=SeqID_152656
atggttgaggcggaaattgttgagaaagattgcagaatagagtgttggtatggtatggtggggttgcaatgcaatgggcagagagcctcaaagtctaacaagcttggtcctttctccatcacgattcagaatgttgttgtgacagtataa

SEQ ID NO: 35879 - DNA, 444 bp, Glycine max
  Peptide Sequence Number=SeqID_152657
atggcttatccagttgggcaactggataagccatacataatcctaagtcttagactttccgacttatcaagtcactggcacctattgaagatgattctaggattgagggatttaacacgacaatcgcatttagcaatgaacataacatacagaagtgaaacagaaatactgcatccatcgaaaattaacattgcaagaaaaggcgtcggcccaaaagcaaaacctccggtggcgagtctcgaaatcgaagagcgaggaggatttcaatcccattccaaaaaggaagggagaaagaggcgtgaagcgcgggatcgtgaagaatccgcgaggtttctaagaaggttcgtgatgcgacttttcttcgtaacaccgtgctgtgttcgcaagaagcgagagaaagttggagagagaaaggacaaagccgttcctgaattgtggatgtag

SEQ ID NO: 35880 - DNA, 321 bp, Glycine max
  Peptide Sequence Number=SeqID_152658
atgggcttgttggagcggttggaatgggtgaatgcttatggcaagaagcgttgcaggagcttgttttggagggtgcgtgctgcgttgaagaaggctctcaagaatgggggcaagcagagactcaagttccaatacgatccttcgagttatgcactcaactttgatgatggttgttgcgcggccaagaaattcattggagatgcacgactcatggagctcaccgacattcacaacaacaccttggaacttgttctcttcccttgtgctagtgcatactaccttatattcttaacttctgtcctaagctacaacactcgttag

SEQ ID NO: 35881 - DNA, 192 bp, Glycine max
  Peptide Sequence Number=SeqID_152659
atgggattgaaatcctcctcgctcttcgatttcgagactcgccaccggaggttcttggcgatgatgtcaaacgaggaattcgattactcgtacctatcggacgacgacggagacgtcgccgatgacgataagctctgcatcgatctggacacagttatgagcgttctcgacgaggacgccgatccttccgag

SEQ ID NO: 35882 - DNA, 156 bp, Glycine max
  Peptide Sequence Number=SeqID_152660
atgaagaggaagcatatgcatcagcatgtaaggctaacctgtggaaccgacgaagattgtgcagcaaactcagctcagcttctgctgatggagaaagacagtgacgagataattgtgattgatgcagttttaattgggattgttttgccgtggtag

SEQ ID NO: 35883 - DNA, 165 bp, Glycine max
  Peptide Sequence Number=SeqID_152661
atggtaatgcttggtggtttggattttttgttgatgaagccatacacggagcaattgtcatatgttggcgaaggagatgatgttgccatggagagaggaagagaaggtggtgactggtggagggtaaagagccatcgcggaccagtggagaacttacaaaattaa

SEQ ID NO: 35884 - DNA, 681 bp, Glycine max
  Peptide Sequence Number=SeqID_152662
atgataccagacgaactgtcaaaatcaagtttattatctgcattggatggagcaaaatttgcttattttgatgggaggttgcctgatactgctctagttgttgcccaagaggcagttagaaagaatatacccatcttaatagatgcagaaaggccaagggaagggttagacgatctcctaaaattagctgattatgttgtatgctcagcaaagtttccagcaagtttcatttactgtgcctttctggcagcaggtccttccacggaagaagtggatgtagacagcttattggaatcattggagataaaaagggataagagtgtatccattccaacctgcatatcatcagtaatgtcagcaaaacccaaaattctttttcttttgtcagtggcaaaattgaaggcagaggggataggaacagttagtgggaagttgtatgttggaacagctgagagtattccaccatcagagcttgttgataccactggtgctggggatgcatttattggagctgttatctatgctatttgtgccaagtttacaccagagacaatgctatcctttgctgctaatgtggcaggtgccaagtgcagggatctaggagcacgaagtggtcttccttaccgtgcagatccacgcatagcatcctttgtattggagaaattgagtagttcagcttaa

SEQ ID NO: 35885 - DNA, 273 bp, Glycine max
  Peptide Sequence Number=SeqID_152663
atgctctcaaccgcactgccttctccatcgaaaccagaaaccgctttccgcttctcgagtcccaacatggaaaattctgactttggacgattgaggggtccaaagcctttctttgccagaagggttctaagagaagcgcttgttcttactgtttgtggtttaaaagctttctctaggcaattttatgggggttttgtgttgccagaaagtaaaccgccacaaagatttttaacggcagggatgaaaaaaacggaagcaaatattagggattaa

SEQ ID NO: 35886 - DNA, 453 bp, Glycine max
  Peptide Sequence Number=SeqID_152664
atgccgaacctctgcactgttagttctaatgcttcttcaaacttcatattcggcgttcaacctcacaacttctacaatgtttttgggtcaaggagaacgagacctcggtgcagggtcagcatgtcctcctccgatcctcaaaacgccgtcgttgtggggtgtggatcggtgaccatggatttcttggccacggttgcggcttaccctaagccggatgacaaaatcagaagcaccagcttgaaggttcaaggaggtggcaatgtcggcaacgccttaacctgccttgctcgcttgggcttaaacccaaggctcatttccaagattgctgatgacagtcaaggcaggagtatattagacgagctacgagatgatggtgtagatacatcctttattgtggtgtctaaggagggaacttcaccatttacatatattattgtggacaaccaaacgtaa

SEQ ID NO: 35887 - DNA, 489 bp, Glycine max
  Peptide Sequence Number=SeqID_152665
atggcaatcaaagttgaccttgtggatttgtttagcgtggagaggaaagctttgttgcagagtttgcgtttgacgatgtttgggttccattgcctccttcgtctaacaccgtcggtcgccgtcgcgagtggaagtaagcaccactgtaagctctgcgaggatcttctcttccacggcggagtggatactggcattggagggggaatactaagcgggggagcggataaaaatgacgttagattgggagtcgcgggtgaggttcacggagccaaagttgtcggtggcacggtcggtggtttgaaggagtgtggtgatgagcttgccggaggggggagggttggaggtcgaaccaagagaggaactagaggaggacatagtagcgaaggacgtcgacgagggcggacgcggagaggtggttgtaggcgacgaggtaggcgttggagacaacaagaatggaaagggaagagtagtctaagagatctgcgataa

SEQ ID NO: 35888 - DNA, 1320 bp, Glycine max
  Peptide Sequence Number=SeqID_152666
atgggaaattcggagtcaatgtatgaatctcaagataatttttaccaacatcccccttcttattataatagctatcatcaaccgtctccttatgctgagaattcagagaatactacatatcatgaaccatcttcatatgcttggaattcatcaaatactacctactatcaatcctctacttatgctgggagttcagaaaacactcgccatcaacatacgaggcaacccacatatatagctgataatttcagctcattggatcaggttgtttcttctctgagagaagctggtctggaatcttcaaatttaatacttggtatcgacttcaccaaaagcaatgagtggacaggcaagcactcattccatcgaaaaagccttcatcatattggaaacactcctaatccgtatgagcaagcaatctccatcgttggccatactctgtcttcctttgatgaagacaatctgataccatgctttggatttggtgatgcttctacacatgatcagaatgtgttctgtttttatcaagataatagattttgtcatggttttgaggaagtacttgcacgctacagagagattgttccatacataaaactgtcagttgtgttgagagagtttaagcaaaaggactacattgatttttcagttggtgcatcttctttgtccaccgtccctcctgttaggaaccctgcatttgttccatttcgtccaacatcatttgcccccgtaattgatgcagcaattgacatcgtggaaagaaacaatggtcaatatcatgttcttgtcattattgctgatggacaggtaaccagaaatccagatgtaccgtatggaaagcttagtccacaagaacaagcaaccattaattctatcattgctgccagtcattatcctctctcgattattttggttggtgttggagatggaccatgggatgagatgaagtactatgatgataacattactgagcgcttattcgacaactttcagtttgtgaacttcacaaagatcatgtccgagaacacagaagcatcgaagaaggaagcaacatttgctcttgctgccctcatggaaattccattgcagtaccgggcagcccaaaatatacaacttaacgatagagaatcagttcttcatcaacataaaaggcctctccctccacctaatgaagtaatacatcatgataatgcacgcatggcaattccgcacatgccaaatttggaatcagcagaatcgacagctccagctgctgccgaaccagtatgccccatttgcctaaccaatccgaaggacatggcttttggatgtggtcataca

SEQ ID NO: 35889 - DNA, 930 bp, Glycine max
  Peptide Sequence Number=SeqID_152667
atggtacaatttggtgtttctgctgtagaagaagctatgaacttggggagagaagctgctgaatatattagtggaactttcacaaaacccatcaaactagaatttgagaaggtttactatccatatctcttgattagcaagaagagatatgctggattgttttggacaaaaccagacaactttgacaaaatggacactaaagtccagtatgtcaagaatgcaatttcagatcttctcatgaatcgtatggacttatcacttctagttattacaaagggtttaacgaagacaggagatgattatgaagtaaaggcagctcatgttgaacttgctgaaaggatgcgcaagagagatgctgccactgctccaaatgttggagatagagtaccatatgttattattaaagctgcaaaaggtgctaaggcatacgagaaatcagaggatcctatctatgttctagagaacaacataccaatagatcctcagtactatcttgagaatcaaattagcaagccaattatgagaatttttgagccaattctgaagaatgctagcaaagaacttctccatggaagtcatacaagatctatttctatttctactccggcaaacagtggcatattgaaatttgctaagaaacagcttacctgcattggttgtaaagctttacttggcaatggtcatcacactctctgttcacattgcaaaggaagggaggctgagctttactgtaaaacagtatctcaagtgtctgagctggagatgctttttgggaggttgtggacacagtgtcaggagtgccaaggttcacttcatcaggatgttctctgcacaaggcaccaaactctcaatggacctttggagcctctagctcatgagatgaagaaaggctcaagggaattgttagtgtattcccgtagaaagaaatga

SEQ ID NO: 35890 - DNA, 1175 bp, Glycine max
  Peptide Sequence Number=SeqID_152668
atggccatcacagtttttgtgtccaaaaggatgggatacaccttgttcttgaacacttgtttcctcgtgatttgttccttcatgattgttcatttccacaccccagatgttatggttgtgaccaaaatctctgcctttgatagcagcaacgggcaagagttgtcccctacaattgctggagtcaccctcctctctcttggcaatggtgcccctgacgttttctctagccttgtctccttccaggaaagcgggacacgcgacatgggctttaacacggttctcgggggtgtttcctttgtgtcctgtgttgtggtggggagcgtgagcattgcaatacgtcaaagtggggttcaagttgccaagtctgcgtttgtgagagatgtttattttctcctttttgttgttctggccttgtttgtcattgtttatgcctcttttacccgatggaaggaaggtggtgatgatgatgaaaggggtggtattggtatttcagattgtgacaatgatttgagtttgggtgtgcctcttcttaatggtgctcaagaatatgatttaaatatcgagaaagattactgttgtatgagatactcgatttacacttcaaagagtgaggcagccgatgtgggacttggatattttttaacaatgtccctttacttgcctaggagattgacaattcctgttgtgtgcgaagagagatggtcaaagaaccttattgtttatggaattggaatcttggttggaactatacttggtgtgattgcatttttcacaaccaaaatgtcagggtcaccagagaagtgcttatttccttggcttgcaggtgggtttgtgatgagcgtgacatggagctacatcatagctcaagagttgttcctggcttgggggaactcacttggggatttgatgacaaacttaacgatggctttaaatggtggaccagagggtgctcaagtagcaatgtcttgttgctatgctggttccatcttcgataccctcactgagaaccctcaacctgttgtcatccctagagacccatatctctgggaaacaatggtgtttttggtggctggattagtttgggcacttgtggttttgagaaaaacagatatgaagcttgatggactcttgggaggagggcttttatttgtttacttcctttctctgtttataag

SEQ ID NO: 35891 - DNA, 417 bp, Glycine max
  Peptide Sequence Number=SeqID_152669
atgttgatacaacaacaacaacaacaacgccttatcccactaggtgggaaagtgctggaaaaggagactcaacttctcttggcccaaacagaattgaacaacataaagaaacagctacaatgtgctgagaacacaaaatccaaaactctttccgagcttgataaggccaaagtgacacttcaggaactgagaacgaagctcaatagtgttagggaatctaagcaatcagcaatagaagttgctaaagctatgaacaataaggccaaacaacttgaacaggcactatcccaaaaagctataggatatgaagcatggaaacaaaaactagagcatgaaagaaaggagtacacaacaacagtgaaggaagaaagtagatgcttcgaagcaacaactcaacaaaataatgcaatattttga

SEQ ID NO: 35892 - DNA, 588 bp, Glycine max
  Peptide Sequence Number=SeqID_152670
atgttgcgccgaagcttctcgaagctccacctcagtctcagagctccgggtttagggtttccgacgcgatcgttctcgcgcgacgccgggaagaggttcgcggcattgtgggggaacggtgattacgggagattgggtcttggcaacttggattcgcaatggaaacccgttgtctgccccgcgttccgcaacaaaaccctaaatgccattgcttgtggcggtgctcacaccctcttcttaacagaggatggatgcgtttatgctactggtcttaatgattttggacagcttggtgtatcagaaagtaaacactactcggtggagccactttgtgtttttggagaggagaagaaagttgtgcagatctctgctggttataatcattcttgtgcgattacagtggatggagagctatacatgtggggaaagaacacaagcgggcagcttggactaggaaaaagggctccaaacatagtgcctttgccaactaaagtggaatacttgaagggaatcaacattaaaatggcagctctgggttcagagcactcagtggctattagtggtatgcaaaagataaacaatcattaa

SEQ ID NO: 35893 - DNA, 642 bp, Glycine max
  Peptide Sequence Number=SeqID_152671
atgcttcgcagatccctcatcttcatcctacacttgttgttgttgtcgttcggatatgaggtcggcctcgttggctggcgtgatggcagtgatgaggccggcgtcagtgccagcagggcagttgatgaggatgaaggccttgccgtcgaatctgaggggaagtttggagtggggtttggagatgcagaggagttcgaagttggaccagcacttgtcacggacgggggcttagtcgaggcgacagtcgccattgaggatctcaatcacggtgtagttgatgcgattctcaaggccgaagaggaggtcgaggttgcgaaggtcaacatcagcgtcgatggcgaccacggagaagccgagacgggcgaggaagaggccaatgttggcgatggtggtggtcttgcccacgccacccttgccggaggtgatgacgacaacgcaaggggtggtgtcggagaacttgggcttgtgattccattggagagctcgtggagtcgtggcttccgcaagagaagagaaaagttcaagagaaaagagagaagaggaagtaaaagagagaatttgaaattcaatctcttgaagatagaatttaaaattctattctttcaactaactaaaattcctcttaaaattctaaaattttga

SEQ ID NO: 35894 - DNA, 765 bp, Glycine max
  Peptide Sequence Number=SeqID_152672
atggatactgaaatggttgagagcattgttgagaatctcgttgccataaggagtagtaatgctactgaagcagatttgggatcatccccttccccagcgcatgcttttgcttccgctgtggatatcaggactgttgctgcaccattattcacccccgctgagcttaaagtagccaccaacaatttctcatttgttgatcatgctaatgtttttgtcaaaattatcattttgtcagtctatatttgggatataaagtattccaacattcttactgatgtcacttggactgctaaagtatctgattttgggaaggcagcaggaactattggatacattgatcctgagtacttaactcgacgtgtattgacagaaaagagtgatgtgtataggtttagagttgtagtgctagagcttttaacgggaaaaacacctatattcgaatccatgtatggggaagatggaggcacccgattacatgtgataccttatgctgtgcctgctattttggctggagagttggtgaaaattttggatccaagggttggaccacctgatatagatgaagcagaggcagtggagttagtagcctatacaactatccactgtgtgaaaagggaagggaaagatataccaaccatggctgataatgtagtcaatttggaaagggttttgattatttgtggaatgttggtcggtcatacttgcaatgctgatccaaagaaatcaccttgcagcatagcagcggctgttacagcaatttgttag

SEQ ID NO: 35895 - DNA, 429 bp, Glycine max
  Peptide Sequence Number=SeqID_152673
atggaaacagaaaagaggaaaaggcaaaaatatgaaatcttgaaacatgttgcagtggtgtctactatatgcctaaaatacaaagagagacaagaaatcttgaaaatggaaaagacaaatagtgtagttggtcctagaggtcttgctggaaaacatggtaagcttcagaaagctatttatgacttgaaacagactcctcaggcttgtgtgaggaaggagacaattcggataaactgggctgcatatcctctttaccacgccccagaagtatttgcaccatttatattggacgggcggcatctatactacgttaatgcatttgaaaatgcagctagcaccatggagacaagtgctgtggcagctgagaatattaattgcccgactcatactgtcaagatattttggccaagtaattgtgcattcatctaa

SEQ ID NO: 35896 - DNA, 423 bp, Glycine max
  Peptide Sequence Number=SeqID_152674
atggctgagtataccccaaggcttataaaggatcttgaaggaatcaaggtaaaatacgtagctgctgggttgctaaattcagcttgtactgatgaaaacggttgtgtttttgtatttggtgaaagaggaattgaaaaattgcgtttaaaggagatgagcgatgcaacaaaaccatccttgatcagtgaacttccatcctcaaaagaagttgcttgtggtggctaccacacctgtgtcctgacaaattctggtgagctttatacttggggttcaaatgaaaatggctgccttgatgtcattcatctacctgaaaaggttcaagggccattcttgaagtcttctgttagccaggtttcttgtggttggaagcatactgcagccatttctggtagtggccaaatgttagaggtggccatgggttaa

SEQ ID NO: 35897 - DNA, 1344 bp, Glycine max
  Peptide Sequence Number=SeqID_152675
atggatactgaaaccgttgagagaattgatgtgagggataacacagatgatgcaaggagttttagcatggcagtcgacagcgacataaggagtgatactgggtccatttttggagaatctcgtgtccgtagttttgcttcattagtggacagtgccataaggagtagtagtgccagtgaagcagatttgggatcatccccttccccagtgcatgcttttgctgcaccattattcaccctcgctgaacttaaagcagccaccaataatttctcatttgacaacaagattggtaccggaggctttgttgttgagtacagaggcaaactcgttgatggtcgtgaggttgcaatcaagaggggtaaaacctggtcaaactcatttggtaagtctaagtttgccttgttctcccgcttacaccacaagaatttggttgggctggttggattttgtgaagaaaaatatgaaaggctcttggtgtatgagtacatgaagaatgggacgttgtatcatcatttgcatagcaagaagggtagcagtgtgttgaattcatggaaaatgaggatcaaaattgccgtcgctgtttctgagggaatacaatatcttcataactatgcatctattattcacaaaaatatcatgtcttccaatattcttttcgatgctacttggacagcaagagtatctggttttgatttgtggctggtgaatccagaacctgaccgggattaccgaacaatgtggacagtgggaacctttggatatattgatcctgagtactatggtctaaatgtgttgacagcaaagagtgatgtgtatgggcttggagttgtattgcttgaacttttaacgggaaagagagctaaattcaagtatgaggggaaagatttcgtatgcaccccaataaaaagtgtggtggattttgcagtgcctgttattttgaccggagagttagtgaaaattttggatccaagggttggaccacccgatgtgaatgaggctgaggcggtggaactagtggcctatacagccattcattgtgtgaatttgaaagggaaagatagaccaaccatggctgacattgtggccaatttggggagggctttggctattttcggaggagaaggtactttcactatattccacttactttgtcccattcgaacaaggaagctactaagaatttacagtgtgaacaagaagttgacttttagagcattggatgggcacgtggagaagggtggagaagtgcgagcgaggcaagccaagagaagcttcaccttaaagtcaacggtcaatctctctttagtcctagcattcacacctgtcttctttttcgttctatga

SEQ ID NO: 35898 - DNA, 915 bp, Glycine max
  Peptide Sequence Number=SeqID_152676
atggctatgtctttacctcttcgtttctattcctcctcgtctttctctctcactcattgtgtttctgcaaattattgcatcttcacagatattgttcaaccaaggagtggaaattggcacttagcaaaaagaggtggaagactcatatcgtttaagggtcgtgcgaggctggtacatacaacgtgccgaatctctgtccctgggaccttaccaagaactgatgaaaaggcctcatctaacatctcgagggataagaagacagttccagaagcagatcctccgagtatcaaagacgttcagctttttaccaagctcacggtattgactggagctggaatcagtacagagtgtggcatccccgactacagaagccccaatggagcttatagttctggtttcaaaccaataacccatcaggagtttctccgttcaagtcgagctcggaggagatattgggcaaggagctatgctggatggaggcgatttacaacagcacaaccatctgctgcccatactgcattggccacattagataaagctggccgaatcaattttatgattacccaaaatgttgataggctgcatcatcgtgctggtagcaacccattagaaatacatgggactgtatacactgtaatttgtatagattgtggatattccttttgccggagcttatttcaggaccagttgaagacccttaatcccaagaaaaatgctgatgaatgggcagaagcaatcgataacttggaccatggaaaccctggatcagataagagttttggcatgaaacaaagacctgatggtgatattgagattgatgaaagattttgggaggaggattttaccatcccaacttgtcataagtgcaatggagctctcaaacctgatgtaggccgtcttgtttctttcagttga

SEQ ID NO: 35899 - DNA, 1725 bp, Glycine max
  Peptide Sequence Number=SeqID_152677
atgagagtggccaagacattagctcgagtctcagaaaactttagctggcctggtcttcgaagggatgtaactaagtttgtggcacagtgtgttgattgtcagctcactaaatacgaaaccaagaaaagtgcagggctgctctgccccttaccggtgccacaaagaccttgggaagacctctctctagacttcataatgggtcttcctccttttcagggacattccgtaattctcgtagtagttgatcgcttctcgaaggggatacacttgggcactttaccggcttcacacacagctcacatggtggcagtgttgttcatggagattgtcgggaaaattcatggaattccccgaagtttagtctctgatagagaccccctgtttcttagcaacttctggcgtgagctcttccaattgagcggaacgcaactcaggatgagttatgcttatcaccctcagacagatgggcagactgaggtgatgaacagaatcatcgagcaatacctgagagcatttgtccataggaggccgcgaggctgggggaagcttctcttatgggtagaatggtcccataatacttcctggaacactgcaacagggaccacaccttatgagattacctttggacgaaaacccttcaactttccagattacatcacagggacatcgaaattggatgcagtcgaggagatgctcagggatagggatgagaccttccaatgcatcaggaggaaacttattaaggctcaaattaagatgaaaaagttcgcagatgtgaagaggagggagatgtcttatcagccaggagattgggttttactcaaactcagacctcgccggcaatcatcaatgaaggaaaattctgctgtacacagcaagttagcaaagaggttttatgggcctttcaaagtgcttgaacgtgttggaccagttgcatatcgacttcagttgccggaaaacgcgcgtatccattctgttttccattgttcggtgttgaagcaattccaggggacaccggggtctgacattccggtcccattgccggatcagttcattcagaatcaacctctcatctccccactatctattctggattataggaggcccaccccagcagacccatggcaggactatcaccttgaggacaaggtgattctgcaagggcccccaggtgataacactacaatacacaaggtgcaaatagcagataaagataaaggtgcagaacaagcaaagcattgtgaaggagaggtacgattagcaagtgacactaagagaaggacctcgaagcccaatgcgaagaagactcacaagaaagcccaaaagtgcactttgggtggagtccgcgctaagcgcattatcgccgctgttaccgctaagcccagaccgcgctcagtgcgtgattacaccaacatttccgctaaacccaggagtacgcgctcagtgtcaaatcgcgtggattttaaactacttaggcctatgaaaggagtaggaaacaacacggaaagataccaagtctcagaactctctattgaatatatgtttagtctcagtatttctaatcagggaaatatatcctccttctctagccattctttccttcttttttccatctatcccttcttctattcacatcagttctccctaaagtgtaaagtctctcatgacaatgagatgttaaacctcattgttgggagccttgacaaaccaacacttgtaatataa

SEQ ID NO: 35900 - DNA, 1545 bp, Glycine max
  Peptide Sequence Number=SeqID_152678
atgcagatgttggcactcatgggaaattccaagaccaaatcaattgtcctaactggccactccattggaggagccacagcctctctatgtgctctttggctactatcttacctccaccagacatattcctctatttctgtgtcagtcttgtgcatcacattcggttcccccatgctagggaatggctctttctcacgtgccattctcagagaaagatggggtggtaacttctgtcacgtggtctcaaagcatgacataatgccaaggcttctctttgctcccataacaccttacactgctcaaataaacttcctgcttcagttttggcaactgtccatgactgctccaggctttgggaagcttgcagttccaatttctgaccaacagaaagagctgttcaactttgtgatgagtcacttggatgcagccacacaagatgaagaagggtctgcacctgttttgtttcacccatttgggagctacctttttgtttcatcagatggagcagtgtgtgtggattgtgcaacttctgttataaagatgttgcatttgatgtttgcatcagtttccccagcttgtagtattgaggaccatctaaagtatggagactatgttaagaatttgtcattacaattcttgaaccagaacaattccgtgcaggggaatattcctgattcaagctatgaagcaggacttgaattgtcggttcaatcttcaggtttgggtaaccaggaatcggcaatcgaacctgccaaggagtgccttaagatgacaaggaggatgggtccttcaccaaccaagaatgctgctaacttatcaattacattatcaaagtttgtgccttataggaccgaaatagaatggtacaaagcttggtgtcaccagcaagttgatcaaatgggatactacgacttattcaagaggagaaggagcacttcaaaaatggctatgaaagtcaacatgaatcgtcacaaacttgccagattttggaacaatgtgattgaaatgtgggagagaaatgagctgcctcatgatgtggcggtgcgggctaaatgggtcaatgcttcacatttctacaaactattggttgagccactagatattgcggaatattatgggaaggggatgcacacaaccaaggggcattacatacagcatggcagagagaagaggtatgagatttttgataggtggtggaaggatgcaatgggcaacaccgaagaaaataatgagaggaggagcaagtttgcaagtttgacccaagattcatgcttttgggcaagggtggaggaagcaagggactggctgaatagtgttagaagtgagagtgacacaacaaagttggctgtgctgtgggataacattgagaaatttgagaagtatgctatggaacttattgataataaggaggtgtctgaagatgttcttgctaagaactcaagttacagtatatggatggaagatttaagaggactgagggaactcaaagcaaagcttgactctgtaatctgtaatatgcctatgaactacttgtttgcaaaataa

SEQ ID NO: 35901 - DNA, 1113 bp, Glycine max
  Peptide Sequence Number=SeqID_152679
atggcaactggaatatttggagaaatgctttactgtcctgagacagattatttgacagaattcccctcaccagaatcattgaagaaacggataattatatcaaccgtacctccaaaggaatatcgacaatctgatagtatcagtaaacctatgccaaatggaagtgaaccatctgaagaagaatcatggggccctgaattgccagattcggtggctaaactgaaaactgaggataggaattcaagtgatgaagatcaggaagatataaatacaagtgataacaaatcaaaccaacaaggcgtgcgtcaatacaaacacttgattgcaatccatggagggaaatcaaaaggttctatgaagaatcggctgaaagatgatgttaaagttagacggctaagtttgagtgagaagaaactcaaaagtgcttccgagtctcatggagccgaccttattaggttcacacagagaaatatcctcagagtttttcctaaaggagaacgtgtcaaatcgacaaatttcaggccgtatatagggtggctgtatggagttcagatggttgcattcaatatgcaggggcatggcaaatcactccggttgatgcagggtatgttcagagcaaatggaggatgtggttatgttaaaaagcctgaatttctgatccgaacacttccacatgaagaggtgtttgatccaaaaaaaccgccatcaaggaagcagatattaaaagtaaaagtatacaaaggagatggctggagattagatttcagcccaacacactttgatcgattctctccacccgacttttacacaaaggtaagtattgttggagtgccagctgattgtgccaagaacaaaacaagagtaaagacggatacatggtatcctgtttgggatgaagaatttgaattcaaattgagggttccagagcttgctttgcttcggatagaagtaaaggacaaagataagggaaaagatgactttgccggacaaacttgtttgccattatcagagctaaggcatggatttcggtcagtccctctctatgacagaaagggaaagaaatataaatctgtgacgcttctaatgcggtttaagcttgaaactttaaattaa

SEQ ID NO: 35902 - DNA, 537 bp, Glycine max
  Peptide Sequence Number=SeqID_152680
atggtggccgcaaactgtgcttcaacggtcttccacatacctcgccgcaagaaagcagaaataggttttgggaatgtgagatttggggtattcggatctgcatttggggcagttccagagggcggaggcggaggcagtggcgggggaaataggaaggcgcgtggcggcgcgggcggcggcaaggtcggaggcttggcgagcccagctctggatgcagaagaggtggaagacggcgaagcagagggaggagcaggaccaggtggggtcggagggtttgatgcgttcgaggcagatgaggcaggagagagcgccggcggaggaggaggtcaggaaggattggatcttcgagaggtcggcaccggagtggccggagagttcgaggtagggcttgaagatggagtcggagagatcagagtggcggaggggggcggaggaggaggaatcgccgccgcagtcgtcggagtcggagtcggaaagtggcggtggcggggaaggggaagggtgagagtggtgaatgtgaatcttattccacggtga

SEQ ID NO: 35903 - DNA, 1572 bp, Glycine max
  Peptide Sequence Number=SeqID_152681
atggccagtcacaactacaaagtcttcagctgcttcaacaggaagttcaccgtcaccgagccgggcccaccgcccgacgtagaaagagcgttttctgaattcgccgccggcgcctcctccctgtccggcgatcacatcctccggtttctggcggagcaccagggcgatgtggactgcaccgcagcggattcggagcggatgctccagcaatcgcggaaagaggatcgggaaagtggaatggatctccacgacttcttccgtttcctgctacatgacgatttcaatagccccatcaaatctcaggtacatcatgatatgaatgctccattgtcacattatttcatatatactgggcacaattcctatcttactgggaatcaactgagcagtgactgcagtgatgtaccaatcataaaggctttgcaaggaggtgtaagagtaattgaactagatttatggccaaattcagacaaagatgatatcgaagtagttcatggaaggactcttacgactcctgtctcactcatccaatgtttgaagtccataaaagagtatgcttttgttaaatctcactacccactcattataactttagaagatcaccttactccagatcttcaagctaaagctgcagagatggcaactcaagtatttggagaattgctttattatcctcagacagattctctgatggaattcccctcaccggaatcattgaaaggtcgaattcttatatcaacaaaaccaccaaaagaatttcttgaatccaaagaatgtgatgacaaggacaacgaaaaggaatcagccgacgagggtgatattcaggatgaattaaaagctgctggtgctgttaggcgcttaagcttgagtgaacaagcacttgaaaaggcttctgaatcttatggagctgatattgttaggtttacgcagaacaatattctcagagtatatccaaagggaacacgtctcaattcctcaaattacaagccacacatagggtggacatacggagctcagatggttgcgttcaacatgcaggggtatggaaaatcacttcggtacatgcaaggaatgtttagagcaaatggagggtgcggttatgtgaaaaagcctgaatttctaattgaaaaaggtccatataatgaggtttttgatcctaaaagaacattgcccgtgaagaaaacattaaaggtaaaagtctatatggggaccggttggagcttagatttcagccaaacagacttcgatacttactcaccacccgacttttacgttaaggtttgtattgttggagttccagctgatatggccaagaagaaaacatgtgtaatttcaaataactggtttcctgtctgggatgaacagtttgatttccctttgactgttccagagctggctttgctccgcatagaagttcgagagaatgacaagagtcaaaaggatgactttggtggacagacgtgtttgcctgtctcagagctaaaatctggattccgatcagtccctctgtatgatgaaaagggtgacaaattaaagtctgtgaagcttctaatgcggtttcagtttagatga

SEQ ID NO: 35904 - DNA, 1413 bp, Glycine max
  Peptide Sequence Number=SeqID_152682
atgtctctgcaacctggttctagtctgcttcagagaagaggaagagaagctatcatagtagaactgacccctacaaagacaccctcctcactattggaagctattcctgtgatgaagcaacgactatggtctgagtccgctgccgaacaattcgagggaactattcacttcagaaaactgttagcaaatgggcaccctccaattgatgaggtgattaaagcagacgttgtccctcgcattgtggagttcttggaaagcgatggtttacaccagttgcagtttgaggctttatgggtgttaaccaatattgctagtggaacatcccaacacaaaagagctgttattgaccacggagctgttcccaagttggtgaaacttctcagccctaccaacaactatgacgatgtcagagagcaggcagtatgggttttagggaacattgcttttgattccccatgctatagtgatcttattcttaacgaacatgctcttctaccattattatctctgttgaacccaccatctccaatattgtctatgttgaggattactacatggactttatccaacttggtccgtggaaagcctccggtaaagactttgatgcctgtccttaagacactcatccacaacagcgacgaagaagttgtatcagatgcatgctgggctctcttttacatttcagatgtctcaagtgacacaacaaagactattgttgaagcagaattttgcgtaaaacttgtggatcttctgacgaattcatcacttacagttattgtacctgtacttcggactctgggaaacattgttgctggtgatgatgctcagactcagcttacaattgataaaggattgatcccgggtctttcgaaacaacttcttatttctcgggacaaagaacagatctacaaagaaacttgttggacaatctcaaatatcacagctgggaatggagctcaaatacaggctatcatcgatgcccatattattcctgttcttgttgctattgtaatttatcgtaaagactgtgagattgacctaaagaaggaggtggcctgggccatctccaatgccactagaggatctcatgaccaaatcaggtacctggtggatcaaagttgcattcaggcactatgtgatctcttggcttatccaaactcagagattgtgtcaaactgtctcgaggggctagagaacattttggtggttggagaagttgacaaggatattgatagaggcaatagctttgctgaaagggttgataagtgtgatggatggggtatgattgaaaatttgaagagccatgacaagaaggagattaaagagagagctgcgaggattttcaagacattttgggcagaggatgatttggtggaagatacggatcttcaggatgatttgggcagaggatga

SEQ ID NO: 35905 - DNA, 447 bp, Glycine max
  Peptide Sequence Number=SeqID_152683
atgatgaaagaggaagtgcgaaaaggagtactaaagcttcttgaagctggaatgatatatgccatctctgaaagttcatgggtaagccttgtgcaagtagaccccaaaaaaggatcatggccagttggagaatgtgtattgattacctccttcttaacaatgcaacaaggaaatagcactttcctcttcccttcatggatcaaatgcttgagaggaccagtattaggacaaaagaggaatgaaagaattcatgttatctactatgccaacaaggtgctaaatagagcccaaatcaattgcgcaaccacagagaaggagatgctactagtggtttatgcccttgaaaagtgtcgatcttatctaggatcgaaagatcattgtgcacaccaaccattcaactataaaatatctactcgccaaagcggattcctagccaagattaattag

SEQ ID NO: 35906 - DNA, 360 bp, Glycine max
  Peptide Sequence Number=SeqID_152684
atggtgagagagcataacattaacagtggatggccaccaataggggccccactgaacgtgcagagagatgagtatgatcagcattggagtaacttcgatagctctgtgaatgctgtttcttttggctttgttgccactgccattcttatttctatgttcttagtcatggccatctttgagaggtttctcaaacctacctcgccggccctcttgccgtccggtggctggaaccgtcgtcggagctctcagatggacttcaatgggaagcttgctcacccatcaccgaaagtgagtgttcaaaatctcatcttttcatggggtgtgctgtgtgagtattcactgttcattgcagttccatga

SEQ ID NO: 35907 - DNA, 1122 bp, Glycine max
  Peptide Sequence Number=SeqID_152685
atgggttcactcccttcaccaccaagaccaacagccccaccatccccagaaaatcttctttccaatcatgtagtggttgctgtgttttgtcctagagaaccagccccaggtgtcagtctccctaattcaattgagctatattacccttccatgaacacatggacctatgttggctcaattcctggcctaagtgatcaccaaatcttaaaggggtttgctatagtctccctaggggactttatttacataattggtggccaaatttgtcacaaagaaatggttcatgtgtctgatgagtgtgctgactacgttgatcagggcatcaaagttgtggcaacagttctccgttacaacattagaaccaatcaatggttcgattgtgcaccactaggtgtggcacggtatgattttgcttgcaccgtttgtgaaaacaaaatctacgtggctggggggaagtccacgctggcatgtgccgggccagcgcatgggatctcatcggctgaggtgtacgacccggatcatgacaggtggacccctttgcctaatttgcgtattttaaggtacaagtgtataggtgtgacgtggcaagggaaagtttacatagtgggaggatttgctgagagagaggactcggataagacaatggcaagcatagtggaacgtagctcagctgaggtgtatgacacgcaagcaaggaagtgggacctgatagcggggatgtggcaattggatgtgccacctaatcagatagtggcagtgaatggtaccctttttagttcaggggattgcttgaatgcatggaagggacatattgaagcctatgatgggaaactttggaatgaagttgatggatcacacaagcgaaacctgtccacattagaggacaactatgagaattggcctcagaatgatcaaagactgtaccttactatggcaccaattgggactcgtttgtttttcttggcaggttacaggataggaggggaactaccaagaactatgtctgttgtgcacatgtttgacacttcagccaccagggatgcttggaggagctttgaaccaatggaattggagggtgagaaagagctttgtagccattgctgtgttgtgcaactctcttaa

SEQ ID NO: 35908 - DNA, 528 bp, Glycine max
  Peptide Sequence Number=SeqID_152686
atggagaaggagatactagcagtgctttatgcccttaaaaatggattccaagccaagttaattagatgggtccttctactacaagagtttgatctagatatccgagacaaaaaggggtgtgacaacctagtatcccatcagcaatcaaaactagtcaaagaagaagtcaccaagaaagaaaaggagattgaagaagaattcccagacaagacactcatggaagtaagcttcaaggacgaggactacccttggttcactgacactgcaaattgtaaggccataggacaaccatcaaaagttatgaaattccatgaaagaaaaaggttcttccgagaagccaccaggtatgtttgggatgaccctattctttttcgtattgatgctgacaatttgttaagacagtgtgtaacaaagggagaacaagctagcatactttggcattgtcagaacttaccatatggaggcctaaagaacatatgcaaagatccttcatgccaaattttattcggctacactcttcacatatga

SEQ ID NO: 35909 - DNA, 921 bp, Glycine max
  Peptide Sequence Number=SeqID_152687
atgttgatgcaagacaaaaaaccgatagcctattttagcaaggccttgtctacaaatttaaataaatcagcatatgagaaggaatggattacattggtattggcggttcaacattggcgaccatatttgctaggtagaaggtttgtggtgtattcagatcaacaaagtttgaggcacttgccgcagcaatgtataacaacagctgatcaacaaaattggatagccaaaccattgggctaccaattcaatgtcgtttataaaccagaacctgcaaacaaggttgttgattccttgttgcgattattcaaggaaggggaattgaagagtgtcacgtcattcccaatgtggatgcaagagcagcaggttcagcaggaggtgcatcatgatccatttcttaaaaagatgatagttagacttcaagaaaatctagcctcccatccaggattcagcatgatacagggttcattattctttaaagatcgattggtcatatctcccaaatcttcctgtattccaattttgttgaaggaatttcatgcttctcatatggggggacattcgaggtgcttgagaacttacagaagaatggtcgagagtttatattgggtgggaatgaagacaatgattcaggaatttgtgaagggatgtgatgtttgtcaaagacaaaactcgaatttgggaggacatatctctcaattttatcacgggactcccaaaatcgaaagggttcgaagcagtgtttgtggtggtggacagggcgagctatggtacaacaccacattccacatatcttctagaatgactccttttgaagcagtgtatggaaggaaacctcctacttttggtagggtggttcaaggagaaacaagagtagaagcagcggagactgagttgctggacagggatgaagctctgagatag

SEQ ID NO: 35910 - DNA, 339 bp, Glycine max
  Peptide Sequence Number=SeqID_152688
atgcatcctgtctttcatgtttcacaactcaagaaagctattggtagttactcagctaaaacaatattacatgaatggttagaagtggagttggaagaaaatgaagaacccgaggaattgttggcttcaagggagatatggaaaggagggcagcttagcagacaatggctagtcaaatggaagaagagagcagttgaggatactacttgggatgatgaaagtttattgaagagtcaatttccaacacttagccttgaggacaaggctatatctgcaggggaagtagtgatagggcaccagtaccctatgtcgatatttgaaatgttaagaacaacataa

SEQ ID NO: 35911 - DNA, 126 bp, Glycine max
  Peptide Sequence Number=SeqID_152689
atggagaaggagatactagcagtgctttatgcccttaaaaagtttcaatcatatcatacttatgccccaatgtcacatcctatcagagcattgtgtcctgacgtccttcagcacaaggtttcttaa

SEQ ID NO: 35912 - DNA, 2160 bp, Glycine max
  Peptide Sequence Number=SeqID_152690
atgggtaacatgaagttggagttgcatgttggagtttttgtcatctgcatggtgattctcatagggagtttctgtgttggagatactgacatggttgatgttgcagcaataaatagtctatatgtttctctggcgtcaccaccacttcaagggtggaaacccgtgggaggagatccatgtttggagctgtggcaaggtgtggcttgtgtcttctccaacataactgcaatacacctcggaggcatgaatttgggtggacagctgggcagcaatttgaatttcccatccattatagaattggatcttagcaacaaccacattgaagggcctattccatttacttttccccctactctgaggagcttgtctctctcagcaaatcagttaaatggaagcattccagatgccttgtccttattaactcaattgtcaaacttacacttgcaaaacaatcaactttctgggaccctttatgttttgcaagaccttcctctccaagatctgaatatagagaacaatttattctctgggccaattcctccaaaattgctgactatccctaatttcagtaaaaatgggaatccatttaatactactattattccatcacctcctgctgtggcccctgcacctgtagctataggttcatccccccaagaatcgccttggaaagtggcacatggtccttctgccctgacagcaccagtgcctgcaagtactaggaagtctgttatagctaagagcgtcatttggattgctggtgcaggtcttttagtatttattatattgggagtttttcttttaatgttgaggtgcattaagagaaggccggagaagaaaaatgcaaataaacttgatgtgggtgtgtttgtgggacctttgaataaacctacacgcagtgactctgatgttgaagcagctaatcaagaggagaaaggtaaatttgaagtaccaaatagaagtacagatttcattccaaaggttcaggaagaacaagacatatattggaaagtagtatctgcaacatcagaaggcaataatggtcgtgaatcaatcaacactggagggggttccaaactttcatccctgcagccaccaccacaacactttctcccaaccagtcctggtgagaaggtcattattaatccggctataactacacaagtaaccaaaagacaagtcatgtcaaattccatcagagtttatactgttgcgttgcttcaacaatatacaaatagcttttcccaagaaaactgtattggggaaggtacacttgggcctgtttatcgggctgagctccctggtggaaagtatccaagtccaatctatattttatttcaacaatatacaaatagcttttcccaagaaaactgtattggggaaggtacacttgggcctgtttatcgagctgagctccctggtggaaagctattggcagtgaggaaattggatgctactgcttccatgggtcagagtcatgaacaatttcttcaattggtgtccagcatctcaaaaattcagcatgcaaatattgcaaggcttgtaggctactgtgctgagcatagccaacgactacttgtatatgagtattgcagtaatgggactctacatgatacactgcatgggtatgataatcattgtatcaaactcccatggaatgcacgcattcaggtggcacttggagctgcaagagctttagagtatctgcatgagaactttcagccacctattgtgcatcgaaattttaggtctgctaatgttcttctgaacgacaatttggaagtgtgcatctctgattgtggattagggccattactctcttctggctctactggtcagttatcaggacgcctccttacagcgtatggttacagtgctccagaatttgagtctggaagttatacgcagcaaagtgatgtcttcagttttggtgtcgtaatgctagaacttctcactggacgaaaatcttatgaaaagtcactgcctcgtggagagcaagttttggtcagatgggcagtccctcaactccatgacattgatgcattgtcaaaaatggttgacccctgcttaaagggaacctatcctatgaagtccttgtcacgttttgcagatattgtttcttcatgtatacaggtgcagcaggtatggcaggatttatag

SEQ ID NO: 35913 - DNA, 525 bp, Glycine max
  Peptide Sequence Number=SeqID_152691
atgactgcagcagatgctaagctgggagataatcacacaaccgtcccacgtgaatacgcaattaacatatgcaatgagaccgacgcgtcaccaccctctccgaccactggtcggagctccggtcatcatagaaaacaacctctttttctctccaagtcaaagaccacactgctttccttgaacccaaagtactttcaagtccactccctcttctcccagaccgtcaacaaccgcacctacaccttcctcatcatcgacattgcttttgtcttcttcgccatctccaacaacaccgcatcagatcctcctccaacaacaaccaccacttcgccccactctcgtttcaatgaatcccaattccacttccacaacaacaactccaccgagggcgtcaaggccaaggagcttggattgattgtcatcttctgcaaagagctttcagtcgtattgaatgccttcattcgtggtgatagatgtttgttcaaggactacccagaactgcaggaaacattggtttggatttaa

SEQ ID NO: 35914 - DNA, 3630 bp, Glycine max
  Peptide Sequence Number=SeqID_152692
atggctcaggcggcaggattggcccgtttgcaggaagagaaactcttcgacgcgcgccgccagggacgtaataggttcggaccgacatttccctcacccatagtgaaccatacctcaccctcacccctcacaaacactaacccaaatacgttccccaaccccactccctcgagccctccgatttcccctacgaatcataacccaccactgttacccacccccttgaagttaccacccccaaaccctaaccctgttcctctaagacgactttccctagctgaattagcctcacgcagggataagggtctgtgtttcacctgcgatgagaagtatcatcgtggtcacagatgcccttctagagcattcctgttaattggggacgacgacgatccctcttatgaagacactttgcccccagacctaatacctgacccacccaaagacccgagtccgaccctggcccaaatcagcatccattcactctcgggtcacccggcccctgagacactaaggctcctgggctatatcaatgcccaccctgtggtgatattagttgatgggggaagtacccacaactttatacaagctccgttagccaagctattgggcctatcttcacgcatcaccaatccgctaggtgtcatgctctgcgtggacgtcccagtgtggattcaaaacaagcaattcacggtggacctgcaccttcttcctctgagtggtgtcaacctggtgcttggagtacaatggctcaaggccttgggacccatactcacagactacaacaccctctccatgaagttctttcacgatggcaatttggttgaattaaaaggagatgacgcttctactttgagtctcctctcccatccccaggttcatcgtcttcttcgaaaagatggcgcgaatacatacttccacatagtcatcactacctcagagcccccttcaaacccaatcacgaccacccttccccccgaattacaacccctcataaccaaattcactacaatattccaaccacctcaatccttacccccctctcgacccacagaccaccatatccacctccaacctcactctgagcctatgaatgtcaggccatataggtacccccacttccagaaacatgaaattgaaagacaaattaaagatatgttgcagcgagaccttatccgcccaagtatcagtcccttctcatccccagttctattggtaagaaagcatgatgggtcgtggcgcctttgtgtagattaccgggcccttaatgcgataaccgtcaaagaccgatatcccattcccaccattgacgaactagtagatgagttgggaggcgctaactggttctcgaaacttgaccttttgcaaggatattatcagataaggatgcatgaatccgatgtggccaagactgcgttttgcactcaccacggccactatgaattcaaagtgatgccgtttggtttgtgtaacgtaccttcgtcattccaagccaccatgaatgacattttccagccttacctccggcgattcatcatcgttttctttgacgatattttaatttatagtcgtacattgcctgagcatctcattcatcttgagcaagcattcgagaccctccttcacaaccaattcgtgctcaagttctctaaatgctcatttgcccaaccacaagttgagtacttgggtcatgtggtttcgggtcacggagttgcacccgttgcttccaaaattcaggcaattgatcaatggcccatccctaccactaccaaagctttacgaagctttcttggactcgcagggttctatcggaggttcatacgggggtatacttccattgctgctcccctgataaaagtcactaccaaggacccctttgagtggaccactgaggctgatgaagctttcaaagccctcaagactgcattaatatcagccccagtcctcgtgttgccaaacttcactcttccattcaccttagaaacagacgcttcaggagtgggcatgggagctgtgttgtctcaaaaggggcatccaattgcgttctttagtaagccattcacacccaggatgcttcaagcttcaacatatgtaagggaattatgtgcaattacaaccgcggttaagaggtggaggcaatacttgctgggtcatcaattcattattttaaccgatcaccggagtcttaaagaactcttaacccggggaaatcgtatttggcttccacagggcattccctttctgcaagtgcttttcacagagtatcactcaactccgacagggggtcacatgggagtctcgaaaacgttagccaggctcactgagaatttttattggctaggggtacgtcacgacgtgaagcaattcgtggccgcttgcgtggactgccaacagactaagtacgagaccaagagagctgctggtctcttatgtccgttactggtgccgtgctggccttgggaggacctctccctcgatttcatcacgggccttccttcatttcatggccatacaaccattttagtcgtggtggacaggttctctaaaggggtgcacctgggtatgttaccaacccaacattctgcttacgccgtcgccactattcatgaacactaccggaaaactccatggcatgccacgaagcttggtctcagaccgagaccctctctttatcagccaattttggaaggagctgtttcggttaagtggcacacagctgaggatgagctcagcttatcacccccaaacagacggccaaacggagcttttgtccacaagaaaccttcttcgtggggtaagttccttccctgggccgaatggtcctacaatacctcccgccattcaggaactggtgtctcccccttcgaggtcacctttgtccggaggccaccagatttgccatcatatgttacaggtacctcaaaagtggaagctgttgacgagtttctgactaatagggagtccatttttcaagacttaaagaagaagcttccgaaggcccaagtaattatgaaacactcagcagataaaaggcgcagggatattgaatttaaaattggagacttggtcatggttcgtctcagacctcgccagcaagcctcagtcacaggtcaccataggggctctcacaagcttagtaagaggtattatgggccttttaaggtgcttgatcgaattggaccagttgcttataagctggaattgcccgacagtagtcgtatccaccctgtgtttcatgtttccatgttgaaacaattccatcaagaaaacacgactcccactcacacccttgctttaccaccagtagctgtaggcaatgaacctgtgatctctccccttaccattctgaacaccaggtatcgtctagattccaaccaacgcatacttcaagtcctggtgcaatggaagggcttacttcccgaagatgctacttgggaagactgggaagcattgcaagcagagtaccaccttgaggacaaggtgtctttcgaaggccctgggaatgatagtcaacaagctgaataccagagtgcagagaaacagaattatgcagctaacccaaattatgcagagaacagacccaagaggaaaagctcaacacctgcatatttgaaggactacaacttaggctga

SEQ ID NO: 35915 - DNA, 221 bp, Glycine max
  Peptide Sequence Number=SeqID_152693
atgaaacaagcattggttgaaggtgatgcaaagatttctgggcctaacatgtatgagaagggtgctggaaggcaaaggatatcaagaaagaagggcaaaagggacttttccttggttttcctggaccctagcttgcctgagccaccaaatgatttcaaggttaagaatccagctcgcctgagcaagctcacgacttcaggagtaagccttagctcacctgg

SEQ ID NO: 35916 - DNA, 342 bp, Glycine max
  Peptide Sequence Number=SeqID_152694
atggctgatgtgcctgaacttctcttcggatctccggagacagtcccgagacgaaacaactcaggaggaagtgggaggggcttgcaggaaaacgggctaggacgtgaattgtccattgctcgtcatccactggaaccaggccaggtcgcagccatccatggagaacgacgccatggtcaaccgttcatgttcctgagtcgcgtgatactcgaagaactggttgatcttgaagatccaaccgagggggtctgctccgtcgaatcggggaacttcaagcttcatgcggttaacaatgagctcgtcaatcttatgggtgaggtgatgcagggtatcgttgagtga

SEQ ID NO: 35917 - DNA, 294 bp, Glycine max
  Peptide Sequence Number=SeqID_152695
atgttatgggagagggcaaggtgggatttggaaattgttgcagaagttaaagggaattttcaagaggaatttgtggctcattcagcaagcgtcaattgtttaaatattggaaagaaggcgtgccgtcttttcattacaggaggggatgatcacaagagcctatccggtcatactagtccagttgaatctgtcgcatttgactcaggagaagtgttagttcttggtggagcatcgacaggtgtgataaagctttgggatttggaagaagcaaagaattgtaaactagagaaatga

SEQ ID NO: 35918 - DNA, 873 bp, Glycine max
  Peptide Sequence Number=SeqID_152696
atgaaacatctgccttttctggcagttttgtgcacgataatgttattcattgtgtatagaaccacaaagtatcagtatcaccaagaagagattgacaaaaaatggagtttctggggacaaccaaaggtgtatccttcaacttatgggaagttgaaaggcttgccacgaggtataatacatgataattcagatttggagttaagaccattatggtcaagaagtagttcaagatcaaaggctgtttactctaactctaacttactggcagttccagttggtattaaacaaaagcagaatgttgatgctatggtgcaaaagtttcttcaagaaaacttcacaattattttattccattatgatggcaatgtggatggatggtggaatcttgactggagtagcaaggccatacacattattgctcggaatcaaacaaagtggtggtttgcaaaaaggtttctacatccagatatagtgtctatttatgattatatctttctctgggatgaggatctaggtgtggagcatttttcaccttcaagatatgttgaaattataaagagagaaggtttggagatatctcaaccagctcttgacccaaattcaacagagatacaccatagaattacaattagagctagaaccaagaaatttcataggtttgtggaaggtatggctcctgttttctctcaatctgcctggtactgcacttggcatcttatacagaatgaccttgtccatggatggggagttgatatgaagctaggatattgtgcacagggagatcgaactaaaaaggtgggagttgttgacagcgaatatgtttttcacaagggaatacaaactctgggggggagtggtcacagaatgacaaag

SEQ ID NO: 35919 - DNA, 1452 bp, Glycine max
  Peptide Sequence Number=SeqID_152697
atgggaacggaggtgatggggaggtggggcacctgggaggagctcctccttggtggggccgttctccgctacggaacccggaattggaacgtcgtcgccgccgagctccgggcacgaacagcttgtccctacaccattactcctgaggtctgtaaagccaaatatgaagacttgcaacagcggtacactgggaacaaggcttggtttgaggaacttaggaagactagagtagcagagctgaaaagagctctggagctgtctgaagattcaattggtttactaaatatcttggttcccaggtctctcgaatctaaactcgaaagcctcgaggctggaaagaatgagaaaaaagatgattgtcatgttgacaaaggatcagctggtccaaagttacatgtagcttcacagaaattggaaagagttgaatcttccactaaagagacatcaaaggatgggctatccgctgggagtttcacacatgaaaccaggacaaactggtctcctgaatgtccagttcccgcagggtttgcagaagatatggagactaagcccgaggtttcacactccactgagcaggccaaagttttgaatgtagatgagttgacacgtactatatatgaaggacaaggaggaagttttaaaaaacggagagggaagaggaagaggaaggactgtggcagaaatatgaaggaagcaagtgttggggaaagtgacttgttagattcggctgatgttgtgtcatggtgtaaagaaagttctaccagcaactgtggtgaagttgccaaatcatgtggtgtagatgatcaaaataggaacttgaaaaaggatagggtggaagacatgatggagattttggattttatttttgaaactaaaggtgcttcggctttccaacgcagacttgatagtcagaagagaggaaggtacaagaaaatgatcctgcaacacatggactttgacactataaggtcaagaattagcagccagacaattaagtcaagtgtagaactttttcgggacttgctcctacttactaacaatgccttagtcttctactccaagagcactcgcgaatacaaaactgctctactgcttagaggcattgtcaccaaaaaaatgagggaaagtttgaagggtacgagcaacaaagccaccactcaagctactaattttcctattaaattacttgtgcataatcctcatgtgaaaccaagaagtgtacggccaggcaacagaaaaatagttgcaaaggcagttggtggcaagaactctgcatctggggagtcacatggaactaagaaacctagtaaagttgattctccatcctcagtggaatccttaactatgaagaaaaaaggttttggtagaccaaaaaaggttggacgtggggctgctgcaggtcaaaggcctgcaatgccaatgaagggaaagaaaagagttaggactaagtga

SEQ ID NO: 35920 - DNA, 621 bp, Glycine max
  Peptide Sequence Number=SeqID_152698
atggctcatcgctacgatagtaatcccttcgacgaagaagaagtcaaccccttctccgaaccagctgtaaggggaaaaacatcaagccaatcaagttatagcgggggtgcattttacactacaaatcctggaagtgttgcccctgccacaaattcaaggctatctcctcttaatcctgaacccgctgattataactatggctttggtgcgacagttgatatacctcttgatccatcaacggatttgaaaaaaaaggaaaaggaactccaagccaaggaggctgaattgagaaaaagggaacaggaagtcagacggaaagaagaagctgctgcacgagctggaattgttcttgaggagaagaattggccgccatttttcccaattatccatcatgatattgctaatgaaataccaattcatcttcaaagattgcagtatgttgcatttacttcattgttaggattggcattgtgcctcacatggaatattgtagctgtcacttcagcttggattaagggagaaggagtgaaaatatggtttcttgctattatctacttcatagcaggaattcctggagcatatgtcttgtggtatcgcccattatatcgtgcttttaggtaa

SEQ ID NO: 35921 - DNA, 264 bp, Glycine max
  Peptide Sequence Number=SeqID_152699
atgtataaaataaagaggaagaagaggatgtgcagtcctagaatctctctcgactctgagcaatctctctttgaagccctacctcgtgatattctagttcaaatatcgtgtggtgtgaaccataaagatttgaagcaggtttttatgtctcaaaaacgattagagaaatgtaattatattgtttattatatgatggctaaagaacattttgatgttgcgaatacaaatgggtttaaggaaattgaagctccaaacactggttga

SEQ ID NO: 35922 - DNA, 411 bp, Glycine max
  Peptide Sequence Number=SeqID_152700
atgttggctggctcgaggcttttcaaagaggaggttctcactggcaagaactataaggcttcggaccaggcttcattcccctcaaaaattgtgtttttgtgttacgggggcttcatttcttcttggatttgtgttcatcaagtgccaaaggttgtgttgtgttgggttttcatgttggaggctacatatgcattattatgtgtgtatatgtttggttacaagtgttttttcatcttgctatcagataccactgaagaagaaggctttttaatttttaactcttacaagattggagaatttccagaagtaagatatatatactatggtttaccccttttactgtctagccttgtttccattacacctgtaagtgaccttatgaaggctgcttcttcaaagtttcctgcttga

SEQ ID NO: 35923 - DNA, 237 bp, Glycine max
  Peptide Sequence Number=SeqID_152701
atggattctctgtccgtgtatgcacaagctgatgcaaacttaacagaggaagagaaatttactaatgcttcctctatcttctctatggatatgcaaacaaagacagagctaccctgggaacgattcatcgccaagcaagccaacttggtctctgtctctttaaagaggggaaactactgccaaccctttatttctgacactttcatcatcaatttattatcaccactgcccacctag

SEQ ID NO: 35924 - DNA, 408 bp, Glycine max
  Peptide Sequence Number=SeqID_152702
atgactagaggcaatccatctgacttacaaccctttgatcctaagatagataggacatttcatagattagttagacatcatttagtacctttcgagcatcctgagcattttgttattggtgattttgagcattatagttttgaacattctgattttgaacattctaaaaacatggcacaacctccaccccgtgagaggactctatgggaaatggctgcacctaatttcacctacggaagcttgtgcatccaataccctgatgaggatgtcccatatgttcttaaaactggactgatccatttgcttccaaagtttcatggccttgcagagggagtggcaaaagactggctatattaccttgctccaaggtccatcacgagctgggatgacctcaagagagtattctaa

SEQ ID NO: 35925 - DNA, 195 bp, Glycine max
  Peptide Sequence Number=SeqID_152703
atggatttaaaattaaaaagatccaatggagttagaattgttcaaaagtgtacagtatctcagtacgtggcacacatggcactgttgcatgtcctaggcattacaaagaaaaaccattttagtttgcctcctccacctaatgcaattcttcccttggatactggaaatggttcagggtactgcattggaaattaa

SEQ ID NO: 35926 - DNA, 633 bp, Glycine max
  Peptide Sequence Number=SeqID_152704
atgacaagacagttaatgaagtccggtggaatgaggggaaggttgaatatgataccacctgtgtgcggtttgctctcagctcctcatgagaaatatgctgctgaggtgtttacaatggaatcttataaaagttttctttcagagatgtggttggagactcatttgtttgtcttaaacatagatgaaggttcaaacttccgcaaatacatgttaggcaactctgagcaccagagcctagcatgtgaagttatgttcaagcctagtagtccaagtattaaatgctcatgcttggagtttgagacaacaggatttccttgctgccatgccattcatataatcaattgtgagaggctagaaaaattccccaagacctcatacatccaagatggacaaaatcagcaaataaatgagctctctgttgcccctgatgcaagcaatagtgatgcacttggtatacctaccaatgagaaaggaggtgcaccggtctcaagtgaaagatctaaaggtgatgatgctcattccagaaatgtggaacatatcaaacatgtaattagcgtggctgacaaaagtcccataattatgcaacataccttgggtaattcatctgatcagggtaagggaccttgttactaa

SEQ ID NO: 35927 - DNA, 360 bp, Glycine max
  Peptide Sequence Number=SeqID_152705
atgataggtatgatatatgatgtgatgaaaaagatattgagagatagggagaaaaatagggtggaaatgtacgacatgcatgtagaaacaattcgtgagttcatgtacaagaaggaagcatcattaaaaaaaatgtacggaaaaagaaaaccgttaaccattactagtttgctgaagttccactccctcaaccgctgcagcaacggcactcccgtgttgagtagcgctctccatcctagatatggcatcataaaggcatttggtaatatccagcatggcaatgacttcaccattttccacgacagggaggtgtctgaatttacctatcagttaaaaagtcaaattatatctctcacttaa

SEQ ID NO: 35928 - DNA, 192 bp, Glycine max
  Peptide Sequence Number=SeqID_152706
atggagatggaaatgggaaaaatgaatcaaggcaatatattgaggggaaatacaaatggtaatcatgctgatgttgcacctaaattttctcctttgaaaattgttcactttggaaatccttctcaagacactgttgacccaagagatggagactttggaggaagactatggagatggaaatgggaaaaatga

SEQ ID NO: 35929 - DNA, 276 bp, Glycine max
  Peptide Sequence Number=SeqID_152707
atgagcagcactgaaacttcctccatcaacaaaaagaccaaacgccatcaaaagaagtccctctccctccccgcccgtaacggaatcaaccctccggatgatggcggagaaagaaccgttaagaagcttcggttgtctaaggcgctcaccatccccgacggaaccaccgtctccgaggcctgcaggcgcatggctgctcgccgcatcgacgccgttttgctaactgattccaacgctctgcttgccggaattctcactgacaaggttacgatataa

SEQ ID NO: 35930 - DNA, 564 bp, Glycine max
  Peptide Sequence Number=SeqID_152708
atgagatatgatgagagccaattggagattctcctgtttggggtccttttatcaggagcaagtatcgttgtggctctagtattctgccaatggtcaataagcaaagacaaagaagcaacttttggcggggtatttgttctatttgggacacattctgtcagaatatcattcggaggattggtggaggtagctgctagtagcactccccattatgagcttcaaaaatctgtggctgagtatattgatgcgaatggttgttggcaaattgatacaattaaggattatctttcccctaatgttgtgaagatggtaacagatatggaagcaactcagaagacaactcagaagaatcatgctctcttcatggaggtgagcaagtggaagggtcctgaatattattattcccgttattctggagcaacagaacttcatccaagtttttttccattgaattctgcgtgcgaatgggggccgatacaacaggaagtaagacaggggacggtagctacaagccgcaatttgcattgcaataaaggacaaaggcaggatcaagcagcgcagtaa

SEQ ID NO: 35931 - DNA, 1536 bp, Glycine max
  Peptide Sequence Number=SeqID_152709
atgtttttttaccatgatttaaaggtatatcccacccaaactactccgtctccagaaggtacgtgtgaggctgcaccaaatgatgaagttaatgatgtgaagactctgacagaaagattatctgctgctcttttaaactctagtgccaaagaagatttggcaaagcagcatgctaaagttgcggaagaagctgtctcaggctgggagaaggctgaaaatgaattattgattcttaaacaacaactcgacactgcaaaacagaaaaactcagttcttgaagaccaagttagtcatcttaatgaggcactcaaggagtgtatgagggatcttcaacaagctaaagaagaacaagagcaaaagattcatgaggctctaacaaataactcttacggcttggaatccaaaaaacccgatcatgagtggaaagttgttgatgctgctaaagcagatgatgctgcttcatcagttcatttggaacttcagcagaggcttggggataaggagaaagagaattcaagtcttaaaatagagctacagtctcaacttgaggaattaaagttcaggaccatagaaagggatttgagtactcaggctgctgaagcagcaagcaagcaacatttggagagtataaagaaggtggctaagctagaagctgagtgccgtagactgaaagctatggctcgcaaaacattatctgctaatgatcacaggtctgtagctgcctcttcagtttatgtagagtcttttactgacagcatgtcagatattggagagaggcaattggtagttgaaagtgatatgcaaaaattaggaggttgggatgtgagtgaaggtgagccaaaccaccatgattcatggccatcggctttaatcaaggaacttgatcaatttaacaatgaaaacaccgctggaaaaaatagtatggtcttttcaaccgagatcaatctgatggatgatttccttgagatggaaaggcttgttgcactgccagatactgaaagtgtaagcagttttcctgtggaacgtactgcatctgaccaactcaatgttggctgtggaacaaagaatgctgaagtggaagctatcgttcaaaagaatgctgcactggagaagaaactagagaaaatggaggcagagaaacttgagctagagatggatctaaccgagtgccaaaagcagcttgaagcatcactgagtaggataaaggaagtggagctggaggtagtagagctccaaactaagttggctcttgcaaacaaatcaaacgaagaagcatacgagaaactaaaagcaactcaagaaaagaaagagatagatgagtcaaaactcagagttgctcacactgaagcagaagaattggtttcaaaaatttgttcattagaggaagagattgagaaagagcgagctttgtccgctgagaatttggccaagtgtggaaagttggaggatgagctcttgaggataaagaatgaagctcaactccaaaaggacactgagattctttatggagaaggtgctaatagtgagttaaagcag

SEQ ID NO: 35932 - DNA, 597 bp, Glycine max
  Peptide Sequence Number=SeqID_152710
atggcttctcaaaaccctaatcagagaaattctctgtatccacaagtaatcgattctaaccccgatgctccctcacctctccttatcaccaatcactcgtcctcttcgcaaccctgcctctacccttccgttgactacaacgacctcgtcgagaacctattctctgaggatgccaccgccgcctgttccccctctgcgccgccggaggccaccgaggaagtcctcttccggatccccggcgcgatcctcaacctcgtcgacaaggactacagcgtcgagctcgcatgcggcgacttctccgtgatccgtctccggcagggcgacaacgccgtcgccgtgtacgcgcgcgtcgccgacgagatccaatggccgctcgcgaaggacgccgccgccgtgaaactcgacgactcgcactacttcttctccttccgcgtccccaagggtttcgatcccgatgaagaagaggatgtgctcagctacggcttaacgatcgcgtcgaaggggcaggagagattagtgaaagatctgaacgcggttttggagaactgcagttgcttctccgtgcagagcgtttcggagaatgcgaagaagaaaggg

SEQ ID NO: 35933 - DNA, 1506 bp, Glycine max
  Peptide Sequence Number=SeqID_152711
atggtggtttttattgtctggtttacgaccaccgcgatagttgtgatcccgagtagtaatagcatgacatgtgggcaagtgggaatggtcaataatagcaaagaagaattaagcactcggttgcagaacagaacaaacttctttcactctttcgcttctgaatcttcaacaatggtgctcgaggcgacgatgatctgtatcgacaattctgaatggatgcgtaacggagattactctccttctcgatttcaagctcaagcagacgctgtcaatctcatatgcggtgctaaaacgcagtctaatccggaaaatacagtgggagttctcacaatggctgggaaaggcgttcgtgttttggttacccctaccagtgatctgggcaagatcttagcctgcatgcatgcgagagttgggccctgttcacctcaatggagcagggttcatctaggtcttcttgttggcttcattgcaggcttgcaacaatgggttcctcagagctgtgttaatcactttgttgcaagactagatataggtggtgagatgaacctagctgctggcattcaggtggcacaattggctcttaagcatcggcaaaataaaaagcaacagcagaggattattgtctttgctggaagtcctgtcaagcatgaaaagaagatgctggagatgatagggagaaagttgaaaaagaatagtgttgcacttgatattgttaattttggtgaagaagatgaggggaagacagagaagctggaagcactccttgcagctgttaacaataatgataccagccacattgttcatgttccatctggtccaaatgctctttctgatgtacttataagtacgcctatttttactggtgatggggaaggtggaagtggttttgctgctgctgccgccaccgctgcagctggtggtgtatccggatttgagtttggcgtggatccaaacttggatccagaattggctcttgctctaagagtttcaatggaagaggagagagccaggcaggaagcagctgcaaaaaaggctgcagaggatgctgccaacctagagaagggagatgagcagcaagcaagctcacaacatgcaacaatgactgagcgtgccggtgcagcaacatctgaagctgagaataagacaagtgatttgatggatgatgagaatgccctactacagcaggcacttgcaatgtcaatggatgattctgcaattagccatgatgtaaaagatacagatatgtctgaagcatctgcaagtgatcctgacttggctctggcacttcaattgtcaataacagatagtgcaaaggatcaatcaagccagtcagacatgagcaaattgttagctgatcaatcctttgtatcttctatccttgcatcgcttcctggggttgacccaaatgacccttctgtcaaggatttgctggcgtccatgcaaaatcagtctgagcctcaacagaagaatgacgacaagccatcaaacgaggaggagaagaagtaa

SEQ ID NO: 35934 - DNA, 435 bp, Glycine max
  Peptide Sequence Number=SeqID_152712
atggaatacagtctgaaatatgacgagagatgttccaaccggccaggcccaccgaaaggagcaaaggttgtcaccattgatgtacgtgcagccaagagtctcatccagaccggttccatttatcttgatgttaggacggtggaggagttcaagaaagggcatgtgtatgcagataatgtccttaacattccatacatgttgaatacacccaagggcaaggtaaagaatggagactttctgaaggaggtttcatcagcttgcaacaaagaagatcatctcgttgtgggttgtcaaagtggggtgagatctctgtatgcaactgctgatcttctatctgatggttttaagaatgcgaaagacatgggaggaggttatgtggattgggttaaaaacaagtttccagtgaatataccagaggccaaagaggagctataa

SEQ ID NO: 35935 - DNA, 1209 bp, Glycine max
  Peptide Sequence Number=SeqID_152713
atgccacagtggttggacagaactaagagaaaatctctgctttctgcactggacaagatcaaagaaggtgcacatttcactgaaaactcatcacatgcttcacagggtcatgaatcattggcttcttatgaaagtcttgagcagcttcatcgctttgtgtttgttcttgggatcacccatattacctatagctttattgctgttgccctggccatgatcaagagtttattcagatatatagctggagaacatgggaaaacgaagcaaagactattgctgtacaaagcatacaagctatgtttcagccgccaattttggagttccatccacagagctgattacatggcattgcgcttaggcttcattactaatcatggtcttcccacaacatacgacttccacaactatatgcttcgaagcatggatgaggaatttcgtgacatagttggtgttagtgtgcttctctgggtatatgccatctgctgtatttttctaaattttcacggaagcaacttttacttctggctgtccttcgttccagcaattttgatccttatcattggtactaaattgcatcgagtggtagtaaagttggctgttgaaataataaatcgttgcccaaatatgaaacctcaccagtttaacttaagagatgagctcttttggtttggaaagcccaggtttctgttacggttaattcaattgatatccttcttgaatgcatttgaaatggcaacattcttatggtccctgtgggaaattaaagatccttcttgcttcatgagcaaccgaacgtttattgtgatccggttatcattcggggtcacctcccaagtctggtgcagctttataacgtttcctctctatgttatcatcacacagatggggtcaaggttcaagaagaccgtggtctctgaaaatgtgaggaaatcactctctaaatggcagagaagagtgaaggagaaacaaagttccacttgtgcagtccttactacaacatcaccatcatcattgaattctttgatgtatggaactgacaagtctaattcccgtgcctcgatcagtgaggaaggaagctcatcagggactaaagatatttgtctctcttatcttgatcatgtgtcaaagaccaaaggaaatgcaccatttccaagttatgaaaatgatcatgatgtaatccatgattcatctccccctcctttgtcttga

SEQ ID NO: 35936 - DNA, 951 bp, Glycine max
  Peptide Sequence Number=SeqID_152714
atggctctgttttcacatcaccgacactcttatgaaacgctcttgggctttctactcttcctcgtattcagagaggtttcaggggcaacatttaccttcgtgaataagtgcgatcacacagtatggccagggattttaggagcaccacagctaggaagcacaggttttgaacttgtgaagggaggttctaaaagcttccaggctccgaccggttggtccggtagattctggggcagaaccggttgccaattcgacggttcgggaaaaggaacgtgcgccaccgccgactgcggctccggcgaggtcaactgcaacggtgccggagcctctccgccggccacgctcgccgagttcacgcttggcaacggctccatggactactacgacgtcagcctcgtcgacggctacaatctgcccatgatggtggtggccagaggcggctcgggctcctgcgccgccactggctgcggcgaggatctcaaccaacggtgcccgtcggagctgagggtggagggcggcgacgcgtgccagagcgcgtgcggcgcgttcgggaaaccggagtattgctgcaacggtgcgtttagtaacccctccacgtgcaagccttccatgtactcgcaaatgttcaagtccgtatgccccaaagcctatagctacgcctacgatgatgccactagcaccttcacgtgttctggcgctgattacacaatcacattttgtccttcttctccaagtttaaaatcttcaacggattcaagtccaaagggaatggatgcagggtctgggtctgggggaggttcatcagttgagcaatctgaattagcttctacttcgtggttagccgacatggcaacagcaacaggggcctcaacacggacacggccttttgttgcttcgaaggtctctttttcggtggtggttgttttcattctctctcttttggtcgcttag

SEQ ID NO: 35937 - DNA, 818 bp, Glycine max
  Peptide Sequence Number=SeqID_152715
agtttgatgagttcaaggaggaactcgagagacgccattgggatgaggagttgactgactttggtgacgacaacatcgatgttgccattgtgaaggaattctatgccaacctctatgaccccgaggacaaatcacctaagcaggagttggctgctaagctctgtatcccagggtggggattcgagcttcatgctgatgggcaacccttgaagattttaaggaagaacatgaccaccctagctcagacatggagcgttctttctttttctaacttgattcccacctcccacacttctgatgtcactcttgacagggccagacttatctatggcattattatgaagatggatatgaatgtggggtacctcatctcccaccagatctccctcactgctcagcatgacacatccagatttggattcctggccttgattacagctctatgtaaggctaggggagttcagtctgattcgaggtccttggagagcctgagtcctaccattaatttggcttatattaagaagaactattggaatctggatgatccaacaacaactttcagaggacccaggaaggccaagggtaagagatctgaggcctcttccacatcaccatcagaggcaccagcaccttcttcttctgcactttctccttcttcatccactcagattccagtgattcctcctgcaccttcacagattccactgccagctcctctttctacaggtccagtagattttatttttactcctcagatgcttcactccatgctccagagcatccatagagggcagtccatcatcatgcagagcctttag

SEQ ID NO: 35938 - DNA, 1263 bp, Glycine max
  Peptide Sequence Number=SeqID_152716
atgtcttcattcttgtctgattctgccatcagcatgggtgacaaagaagatactctctgtagtgcttctgacagcgattcctcctctttggagaagccttccgatgctatcggggagcctgtcccggttactgtgatcctcccccctttttcttttgggggtgtgaggataggtcgtggcagtggagatgttaaggtgtctccctacatgcgatgtagccatagcattgggtcaccgtcgtccacccttgcagtcgctggctataatttggtgagggatgaaattttgaaatataagtcctgtctcaccttggcggcgagtgttgctgctcttcaatgccaagtgaagctggtgagccctaaggactcctacaagtgtctatttgaagtcttgggtctcattcttgctttggctgctttccaatgtgctcttcttgagcacttgaacgtggccccttctcaacttcacccaaatagttgggcaatgatgaagctgactggcaagattggttgggtctccttgaatagcatgtcgaagaagttgtttgagtttgacttaaatgtttttcgccactttaaggaccatttctttaagtctgaccctatcaagttcaagtcgtttgatgaggatctgttgacccttgtggagtgggtcgacaaagctattttggagcagctgccagcctcgctaaacatgcaagccattatgtctctttcttcggctagtgatcctctcgctgccttggatgggaaagtcaaacctacgggtgagaatgtgccaccgtctgctgctacttttgctggagaatggggtcaacctgttggtgaggatgatggtgttgggccgtttggtcgtaagaagtcaaaggcccttatgagccttcgcaccctgaggcagactgtagggttaatgcctggtgtgggttgcccttcgatcatgcaagatgtgcctacgactccaccggccgtcgaggcttctgctgccgctccttctattattgacgttagtgcattagctgctttggctagttttgttgtggtgccatcgtccactattgctacacctttgctgagtgttggtgtggcaaccactagtgctcctatggtactgtctccttcctattcaactccaatgatccctccctttactattatggcaacctcatcaccttctttgtcttctcaccctcctgtctcctcaggtcatttgtacacctctagtgatgctggtttactgtggggtgacacttacaagctagagtag

SEQ ID NO: 35939 - DNA, 549 bp, Glycine max
  Peptide Sequence Number=SeqID_152717
atggcgagtgccatgtatgaaagagtacatcacatgcactgcacacaagactcgtcaaacccaagctctgcacttggtgatcctcacagaatacaagcctataaaaaaccgaaggtccacccttggtacgcactccttccaaacccaaggtcaacccttggtacgcactccttcaaaactcaaggtctgcccttggtatacacttttacaaaacccaaagtacccccttttgtttgctcacttacaacaactacgatgaccaccgtcaaaggtccaaattcaaaaaaacgaactaccaccatactatttggcaataccttcaatcgggtggaagtcattcttactccttataaccatcagaggagaaacttcataggtgaagacaacccatcaccagattgcatgacaagaccttcaatcaggtacaagtcaaacatattccttataaccatcagaggagaaactcaacaagtcaagcgacctacccccaaactagttgggaagaccttcaaccaagggcaagtcaaatgtactcctcacaaggattag

SEQ ID NO: 35940 - DNA, 243 bp, Glycine max
  Peptide Sequence Number=SeqID_152718
atggatgaatttgacatccttgtctctctcatcctctcacaaacacatctttgcttattcaacttccaccggaatgtgagtctatttctcgtccttggaaaattctttttgcaagaatcaaccgcttctttcattcttccttgctaccaggttgtgaaaacaaagatggatacctcagagccctacactggggcaatgaggggcatcatgcatgaacctcaagtgaacctaggggcagattag

SEQ ID NO: 35941 - DNA, 294 bp, Glycine max
  Peptide Sequence Number=SeqID_152719
atggaacgcagatcagcaaagaagcacccaccagggatagtcccaagagagataccaagaaaccagcccactatcaagattatgtctgaatcacacagcaaacgtggaaggtctagaagtagaagaaaagaagcagatttgggtgagatgaaggatggaaaaagctttcccaggatgttctctgggcgtccaattccaaagaggggacaagtgaaggttgcagttgtattgggcttggctcattccattgctgccatcttttgttgtggtgctaatgagtacaacaactcttga

SEQ ID NO: 35942 - DNA, 387 bp, Glycine max
  Peptide Sequence Number=SeqID_152720
atgaaggcggtcgcagcggcaaagccgatgacggcgacagatccggagcttgagactctacggaggtgggcatggctactggggctgatggcaggggagtcgacgagcccgttgttgtcggacgtagggctgaaggggaggggggagtcggagggagagacggggggcggggggagagccagtgggggagttagaggagggagaggaggtggtggggccgaaggaaggggtgggggaaggcggagaagaggccagagcagttttcgaaacggggaagggagtaggtggaagaggggtggtgggtggaggagcggaagaagtagttggaggaaaggatatgggggcgaggaattgggggtggcggcaggggaatctcatggagattga

SEQ ID NO: 35943 - DNA, 822 bp, Glycine max
  Peptide Sequence Number=SeqID_152721
atgatagatataagtactctcaatgctgcacagattactgtgctgggatccgcgttttgtgttatgctttccatgcatttcacgacgcagttaatgtctcagcatctcttctattggaagaatccgaaagagcaaaaggctattatcattatcatccttatggctcctatctatgcagctgtctcctttgtgggtctcttggatatcagaggaagcaaggagtttttcacctttttagagtcagttaaagaatgttacgaagctttggtcattgccaagtttctggctttgatgtatagttacctgaacatatccattagtagaaacattgtgcccgatgaaattaaaggcagggaaattcaccactcttttccaatgacactctttcagccttgtactgttcgcctgaaccaccataatttgaagcttctaaaatattggacatggcagtttgttgttgtccgtccactactcgggctgtatccaacttggttgagctgggcattcaccattgttctcaacatatctgtgtcgttagccttgtattctctggtggtcttttaccatgtgtttgctaaagaactggcaccacacaagcctctagcgaaattcttgtgcatcaaaggaattgttttcttctgcttttggcagggaatgttgctggaccttttagcggcaattggtgtcattcaatctcgtcatttgcggttagatgtggagcacattgaggaagcaatgcagaatattttgtatgcttatcatcctgcaccatatagtggagaagttgagaaaatgcttaaacaaaacaagaaaaatgaatga

SEQ ID NO: 35944 - DNA, 264 bp, Glycine max
  Peptide Sequence Number=SeqID_152722
atggtgcatcaaaacacccaagttgttgtacttaacatggattttaagagtgtgtcagattacaagttttcagcacctgctacatcagccagggataactgtaaaattgttgatctcatcatccacagcaccgtgcattcagccaaacaaaacgataaaaatatacaccacaatcacatagagaaacaaaaagtgtcctacatcaccagggcattcattctagtactaaattttcacatacaaatgaagaatattcagcattag

SEQ ID NO: 35945 - DNA, 2775 bp, Glycine max
  Peptide Sequence Number=SeqID_152723
atggcgattgcgcaagatttgtatccctcagaagacgaccttttgtacgaagaggagttgcttcgaaaccctttcagcctcaagctatggtggcgctacctgattgcgcgttctgaagctccgttcaagaagcgcttcgtcatttacgagcgggcactgaaggcgcttcccggaagctacaagctgtggcacgcctacctccgcgagcgcctcgacctcgttcgcaacctccccgtcactcactcacagtacgacacgctcaacaacaccttcgagcgcgccctcgtaactatgcacaaaatgccgcgaatttggatcatgtatctgaaaaccctaacgaatcagaaattggtcactcgcacacgcaggacattcgatagggctctctgcgctctccctgttacccagcacgaccgcatttgggagccctatcttctgttcgtgagccagaagggtattcctattgagacctctcttcgggtttatcgcaggtatttgaagtatgacccttctcacattgaggattttattgagtttttgcttaattcgagtctctggcaagaggcttctgagaggctggcttctgtgctcaatgatgaccaattttactcgattaagggtaagaccaagcaccggctttggttggagttgtgtgatttgctcactcgccatgcgaatgaggtttctgggttgaatgtggatgctataattaggggtggaattaggaagttcactgatgaggtgggtaggctttggacttcgttggctgagtattacattaggaggggtttgcatgagaaggcaagggatgtgtttgaggagggcatgtctactgttattactgtcagggattttagtgttatatttgattcttactcgcagtttgaggagagcatgcttgcttacaagatggaggagatggggttgagtgatgaagagggtgatgaggaggagggtgaagagagtggcgttgaggaaggggatgaagaggatattcgtttcaaaggaagattggtggaggaggattttgagaggaagattttacatgggttttggttgaatgacaagaaagacatagacttgaggttggctcggtttgattaccttatggaaaggaggcctgaattggctaacagtgtgcttttgcgtcaaaatcctcataatgttgaacagtggcaccggagggtgaagctctttgaagggaaccctaccaagcagatactcacttacacggaagcggtgaggacgattgatcccatgaaggcagtgggaaagcctcatacattgtgggttgcttttgccaaactgtatgagcagcacaaagatctagccaatgcccgtgtcatatttgacaaggcagtgcaggtgaattacaaaactgtggataatctggctagtgtctggtgtgagtgggctgaaatggagttgaagtataaaaatttcaatggagcacttgagctgatgaggcgggctacagcagagccatcagttgaggtcaaacgaagagtggctgctgatggtaatgaaccagtccagatgaagctgcataaatccttgagattgtggacattttatgttgatttggaggaaagcctaggtactttggagtctacgtgtgctgtttatgagcggatcttggatttacgaatagccacaccacaaataataatcaattatgcatacttcctggaggtatggtgtgctgttatggaacataaatactttgaagatgcttttaaagtttatgaaagaggtgtaaagatatttaagtacccacatgttaaagacatatgggttacatatctctctaaatttgtgaggagatatggaaagaataagttggagagagcaagagaactatttgaaaatgcagttgaatcggccccagctgatcaagtgaaaccactttacctgcaatatgccaagctggaggaggactatggattagcgaagcgagctatgaaggtttatgatcaagcaactaaggctgttcctaataatgagaagttaagcatgtatgaaatatatattgctcgtgctgctgagatatttggtgtacccaaaacaagggagatctatgaacaggcaattgaatctggtcttccagacaaggatgtcaaaaccatgtgtttgaagtatgctgagttggaaaaaagtttgggagaaatcgaccgggcccgtggaatatttgtatttgcctctcagtttgcagatcctcgatctgatccagagttttggaataagtggcacgagtttgaggttctgcatgggaacgaagatactttcagagaaatgcttcgtattaagcgaagtgtctctgcaagctacagccagacacatttcatactgcctgaatatctgatgcagaaggatcaaactgtgaatcttgatgaggccaaagacaaattgaaacaggctggaatccccgaggacgaaatggctgctttagaaagacaattagccccagcagttgacaatacagtgacaaaagataggaaagttgggtttgtgagtgctggagtggaatctcagtgtgatagaggggtaaaaactagtgcaaatcatgaggatatcgagttaccagaagaaagtgattctgatgatgatgataagattgaaattgcacaaaaagatgttccttctgctgtgtttggtggtttgattagaaagagagatgagaatgaaaataatggagaagtagatgtcacaaaagataaggataatgaaaatcggcttggtgctcttgagagaatcaagaggctaagacaaaattaa

SEQ ID NO: 35946 - DNA, 915 bp, Glycine max
  Peptide Sequence Number=SeqID_152724
atgaacgacctattctcaagctccttcaaaaaatacagtgacctcaaagaacaggcccacatcgatgatgtggaggcggggaaggaaagtgtcaacctcgataaattcttcgacgaggtggagaatgtgaaagaagacatgagactagttgagaagctctacagaaaactgcaagagtccaatgaagaaagcaaaattgttcacaatgctaaaacaatgaaagatcttcgagccagaatggaccaagatgttcagcaggttctcaaacgtgtgaaactcataaagggcaagcttgaatctctcgaacgttccaatgcagccaacagaaacattccagggtgtggtccaggttcctcagcagatagaaccagaacctcagtggttagtggcttagggaagaaactgaaggacttgatggatgattttcaagggttgagggccagaatgcagaatgagtacaaggaaaccgtggaacgaaggtacttcaccataacaggagaaaaggctgatgaagacaccatagagaacttgatatcaagtggagaaagtgagagttttcttcagagggcgattcaggaacaagggaggggtcagataatggacaccatatcggagattcaagagagacacgatgctgttaaggagatagagaagaatttgattgagctgcatcaggtgtttttggacatggcagctcttgtagagtctcagggtcaacaacttaacaacatagagagtcatgtggcacatgcaagttcttttgtgagaagaggcactgagcaacttcaagacgctagagagtatcaaaagagttctaggaagtggacttgctatgccattcttcttggcattgtactcgttattgtactcctgtttcctctcttgacgtcacttttacctcacttgttgatttga

SEQ ID NO: 35947 - DNA, 2269 bp, Glycine max
  Peptide Sequence Number=SeqID_152725
acttagagacctatctggcaaaggttggagtcagctagctggatcaggtcctgtaccatggaagcaagcacccagtctgttcaattctgcttcttcatctgacatgatcccagaagtgccttctttagttgaactatccaatagctttgacaaaatgtattgcaatgaaaggttacctgtctcagccttggaaaagaaaaatgaggacttgtctggaatgtcagttaattggaacatcaagcttggctcgcgggagatgatgcttatgaatggaatgaggaatgaggataaatcaagttcatgtttaaatatgtgtcaacagccttcttctctgaaggaagagtcatctcctcaaccatttggtttgcctgtgcctaattcatgccaaaatgaaagaaatggtaaacttggggtaactggaagtcatccacaacaaactccacctccaggaaagcaatttaatggcactatgcatttagcacctgattcatcaggtgaggctcaggttcgcaatgggcggcctcgagcagatgcccgaggaagaaatcagttattgccacggtactggccaaggtgtacagatctggagctacagcaaatttctattgagtatccttcaaatcacatgatcgtagtgctgaaaaccttgagtgctagtgatgctgggcgaattgggcgtttagtgctacccaagaagtgtgctgagacctacttcccaccaatttctcagcctgaaggattgccacttaaaatccttgatgcaaaaggcaaggaatggatatttcaatttcgcttctggccaaacaataacagcagaatgtatgttttagagggtgtcactccatgcatacagtccatgcagttgcaggctggtgatactgtaacatttagccggttggagccagagggaaggttggttatgggatttagaaaggcttcaagtgctgtgccatccgatcaggacaatgagaccaagactggaaatggattttctgcacatggtgaagttgaattggctgatcctaattcatggtctaaagttgataagtcaggatacatagcaaaagaagcactggggagcaaatcattaatctctagaaaaagaaagagcaacatattgggctcaaagagtaaacgtctgagaattgaaaatgaggatttaatagagctgaagattacatggcaagaagctcaaggtctgctccggccccctcctagccacattccaagcattgtggtgattgaaggttttgaatttgaggaatatgaggaagctccagtgcttgggaagccaacaatttttaccagtgatagtgtgggtgaaaagatccagtgggctcaatgtgaagattgtttcaagtggcgcaaattgccagcaagtgcgcttcttccatcaaaatggacgtgttctgataattcgtgggatccagaaagatcttcttgttcagctgcgcaagagctgacagcagagcaacttgagaatttgctacctccttgtagttcagctgttcccaagaaaatgaaggctgccaaacaggatcctgataatgctgaagctttggagggacttgacacccttgcaaatctagctatcctgggagagggtgaggcactcccagcatccgcgcaggccacaactaagcatccacgtcacagacctggctgctcttgcatcgtttgcattcaacctcccagtggaaagggccccaagcataagcagacatgcacatgtaatgtatgcttaacagtgaagcgacgtttccgtacccttatgttacggcgtgagaagaaacaatcagaaaaagaagcagagacaactcgtaaaaagcaacagcaacaacatcctcaaccgttaccttcatctgaaattttgcttgatgaagattccttgccctgtagtaacacaggtgatagtagcccaaaccagaacaaagagggtaatgatggttctgatgatgatcctaaccgaataaaatcatcagctttgccattcaaaggtcaaattgacctcaatatccagccagagcgagaagaagaactatctcctggttcagattctggcggcatgatgaagttgctccatgatgctactgagcggtatctcaaacagcagactgtgaactctggtactggagattcatcaggcagtcaatcacggctggtaggagatgcaatgagggaagataaacttagcaatggtgttgcccatggcagtggtagtcataatactgataaggaacatgcccaatctttgtctatgaatgtgtga

SEQ ID NO: 35948 - DNA, 162 bp, Glycine max
  Peptide Sequence Number=SeqID_152726
atggcttcggcttcgtcttcgtcctccaagctatgcttcaattccgactgcaaagagttgaagtccgaaagacctaagaaagggtggagactccgcagcggagaactagccgagctttgtgatcgatgcgggtttgggcattcctcctgcaaatttggataa

SEQ ID NO: 35949 - DNA, 807 bp, Glycine max
  Peptide Sequence Number=SeqID_152727
atggcaaaatctcttcttgattcagttggtgatccttgtgaagtagctaatgccgttcttgccattatacgaggcagtaaacgaccgcttgatgtagctaccatcacacaaggggaaaccagatttttcagtatattgatgctcgcatggggtctggtggcagatattgacattgagtctgaaaagtaccggtggatgggaagtgctcgtctagatttttatggtctctgtcgactcctcaatttgaggcaatacattggatgtgtttcttttgtgcctgcacctgggtatgaagcttttggggagcccacaagttaccctggcaaatctactactagcaaaggaagcaacaatgatccaagtgaagcagaacgtgctaatttgcaaagactttgctatctaggacctgaaataaatttggaaaatctgaattggagagttataaatggaccctttatttctgtctggcttcacaatgtaccttggggtgccgaagacacaatggcagcgcctgatgcaaagttctccgatggttatttggacttgatcattatcaagaattgcccaacgttgccattattgtcaatgatgtcagagttgaataaaggaggacatgtgaaggctttcaacttgcaacctggtccacgcaccaaggaccaagagaaagaagggatcatagattcagatggtgaggttcttgcaagagggaaaggaacttacaagtgtgagcagaagactttgatggcctatgataaattacagataacagtggatcaaggtttagcaacactttttacccctttataa

SEQ ID NO: 35950 - DNA, 1908 bp, Glycine max
  Peptide Sequence Number=SeqID_152728
atgcagacgaggtacattgagaggtcgagcagctcggcgagggagaagcgtgccttagattcaggttccgctgacgaagatcaacctcaaagaaagcgacctgctctcgctagtgtaattgttgaagccctgaaggtggacagtctgcagaaactttgttcatcactggagcctattcttcgtagagttgttagcgaagaagtagagtgtgctttagcaaaattagtccctgccaagcttagtgggaggtcttctcccaagggcatagaaggccctgatgacagcagtctacaattacaattcaggaccaggttatcccttccgctctttactggtgggaaagtggagggagagcatggaagcgccatacacattgttttgattgatacaacaacaggccatgttgtcacatgtggcccagcttcatgtgtcaaactagatgttattgtacttgaaggagatttcaataacgaggatgatgataattggagtgaggaatatttcgatagtcacgtagttaaagagcgagaaggaaaaagacctcttctgactggtgatctgcaagtcacactgaaggagggtgtaggaacactgggtgagcttacatttacagacaactctagctggataaggagtaggaagttcaggatggggctcaaagtttccccgggttgttatgagggaatgcgtattcgtgaagccaaaacagaggccttcactgttaaggatcaccgtggagaattatacaagaagcactacccacctgccttgaatgatgaggtctggagactggagaagattggcaaggatggttcctttcacaaaaggctaaataaagcaggaatatataccgttgaagatgtcgtacaacttgtggtcagagatccacagagattgcggaatattcttgggagtggcatgtcaaacaaaatgtgggatgttctagttgagcatgcaaagacttgtgttcttagtggaaaactctatgtatactatcccgatgatgcaaggaatgttggcgttgttttcaataacatctatgagttgagtggtttaattaccaatgaccaatattactctgctgattctctctccgacggtcaaaaggtttatgtggacacattggtgaagaaggcatatgagaattggatgcatgttattgagtatgatggcgagtctctgctaaattacaatcagaataagactttgggcacctcccaacctctggctccagtgggttcccatgattattcaatttcaaactcacttgatcagcagacctccatcccaagcctaccagttccattaactacagggcagccttcaatgaatccagcagtaacagttggaggttatcataatgttacgactaccagatgctcaatgcaaccacagaatgataatcttcattcttctattcagtttgataacactgcatttccactacaaaaccagctaatgagtgcttcacaccattctcagtttccaagaaatgaaaatgggctaactcttggtacacgacaaccagccactcctggatttcagaatgtcagcatttcaaatcctaattatagaggattggaggactacttcccagaggatgagattcgaactagaagtcacgagatgctagaaaatgaagatatgcagcatctgctccgtatatttaatatgggaggagggcaatctcatgctccctttaatactcaagaagatgcatacccttattcatctgcttacatgcctgcagcctccatgagctccaacttagatgatgaacaaaaccgttcctcaggaaaagctgttgtgggctggctcaagcttaaagcagctttgagatggggcatttttattcggaagagggctgctgagagacgggcacaacttgttgagttagatgaccaatag

SEQ ID NO: 35951 - DNA, 465 bp, Glycine max
  Peptide Sequence Number=SeqID_152729
atggaaaccatatccaagcggtttgaagagattgatgtttgtggcaaagttactctaaagagtaaagttcgagaaattgtttactccgatctaaactctaggtgtgtttctccagaaaaaggtcaaaacaaaagtaattcgtcaatcaaatgtagtgcatcatcatttgaacaaccaaaaccaagaataatcataccgatgttggatcaatttcatccatgcattcatgattttattgaaaacattgtcgatatcaaacctaatggtaactgtggatatcgtgcaattgctaccttattaggtatgagtgaagattcatggtctttgatttgtaaccacttgcttaaagaacttgcaaaatggtctaatgagtatatcaatctgcttggtggcataaacagatttgaggaattaaagtggtccctacttgttaatagattatctatggttaccatggataagtga

SEQ ID NO: 35952 - DNA, 2139 bp, Glycine max
  Peptide Sequence Number=SeqID_152730
atggcttcgaacaaaaggcatttcgcggaggaagacgacgatcctcactcgttctccaagaaatcgaaggaatctgaatctgaatctgatgcatccccttcttctcttcgtgtttttctcaatcctgcggactgtgacttggatttccatattgatggcaatggacatgttggatatggccttcatgaggaagggtttgcttattgctggtccggtgcccgagctaacgtgggaataaccagaggtagatattgttttgcctgcaaagttgtttctgcacagacggttaacatgcaggacacggcccctgagcagcagcatatttgtcgcctcgggatttccagaggggacaatgcggttggaaacctaggggagtccaggcagagctttggatatggtggcacgggcaagttttcgaactgtggaagattcttagattttggtgacaagtttggtgttggtgatacaatagtttgttgcgttgacctcgaccttgaaagcagaccactggcttctattggtttctccaagaatgggaaatggttgggtgctgcaactcaatttgatgcggctcgccttggagtggtggattctcctcccgggaatttacaatggacatcggccctttttccgcatgtgctgttgaaaaatgttgtggtccagatgcagttcagtgtcaaagatggacttgttcctgaagatgggttcaaaccttgggcctcggctatggaggatggaaacatagttatgggaccttctttttctgaaccaagggattgtgaagtgataatgatggtggggttaccagcttcaggcaagactacatgggcagaaaaatgggtaaaagatcatccagagaagcgttatgtgttgcttgggacaaattcaattcttgatcagatgaaggtacctggactattgcggagaaacaactatggtgaaagatttgatcttttgatggatagggcaactcgaattttcaatatactgctatccagggcagctaatatacctcgcaattatataattgaccagacaaatgtctataaaagtgcacgtaagcgtaaacttgagccatttgctgattatcagaagattgctgttgttgtattcccaaagccagatgagctcaagatacggtctgataaaagatttacagaaatggggaaagaagtgccacctgatgctgtgaataaaatgatagctaattatgttctgcctaaaagcaaggatatgcctcgttcagatgaattttttgatcaggtaatgtttgtagaactgaaccgaggcgagtctcagaaatatttggatcagatgaagcagaatcttgcatatatatctagtaataactcatcaacattaccccctggaggttcttttgagtcttttgctggttcgaatttaccaaataaaagaagtttcacagtactactttttaatgatcttaacaacaatgctcttttggtaaaaacaacaactatgcactttggttcaggcagtggtcttcaccagcctggctcttattctcccatcgctccacccaactatgggatgcctggtcaagttagtcaggttaatgcaaatgggggtatgaattcattttctggagtatatccaggatgtcaaattccgcatgttgccagagcagcctctccttgtgaaccttattacaataatgaatcaaattgttttgctagagatattgccggttataatcaaacttacggtgctattccgactggtgatatgcggaattacaacagctctgttgtgcgtggcccatataggccaaacattgtagagaacaatatgattttccgtgatgcttttcctgatgcctacaggagtcgcatgaatgaaccctctccaatagcaagtgcaaggtcaatgtctttcgattatagcactcatactgaaccttatcctgatgcctacaggagtggcatgaatgaatcctctccaatagcaagggcaagggcaactcgtaatgaaccttatcctaaagaggattccagccattcctacagagattcactttccccatatgggacactgactccaagaccttcttatggaagttcacctaataacatgccgtattcaggaacatatgcctcccagcgtccaagatacttctaa

SEQ ID NO: 35953 - DNA, 912 bp, Glycine max
  Peptide Sequence Number=SeqID_152731
atggaggaggagagcgagtttcttttagaaatgaagctaattatcatctcgttatgcactgaaacactttctcttctctctgttcactcttcccaacctctgttttcatgcattgtcactttctgtttcttgattctcctttatttgcctcatctattttggaagatagttttctcacccgtgctgattctgtccggggttctcttgctcctcctcctccgtctcggtgcaattcagaggtctcaaaatgaagagaagaaaaactcggttgaaccagaacccattgcaaacgaagaaaacaggggaaacagagaagagaaacaggggaaccccattgaaccggtggaaaccgattctctcgatcatgtttacaggtgggtcacgagccaatctcaaaaagagatcaaatctcaaatgggttttcaatcaagttcgcgttttgacgagtctttcgtggagtggaatgtgaaagcgccgttggaggtcatatacgaaggtgaagaaacagagcaggatcagaatgagaaacgtgacgagggtattttgaggtacccgtcgttgtcacggtactaccctgaaactgactccgatagctcgtcggagagtgagtttccggcgacggagaactgggactcgccggagaacatgtgcttcaggtgggatgaagaagacagagaagggttaattgagattgctcttgacggttgcaagaagagggacgtggggtttcacttcgatgaggagaatttgattgaaattgatatttctccgacgaggcacagggaattttccggcaaggacgaccccttttccgggaaagggaaaattagagatttggagttactttgggttatggcagagtatgcctgttttggatgtggtcaccgttgtactctcttatcaaagctttaa

SEQ ID NO: 35954 - DNA, 153 bp, Glycine max
  Peptide Sequence Number=SeqID_152732
atgagagtcttgtctacttactttgacaatattgaagacgaacataggccaatagacagacttaaggcaggagaaaatcgaacatggggattcaccgagaagattagtccatctacgctctgcagatgtagccttcattatagtgttatatga

SEQ ID NO: 35955 - DNA, 870 bp, Glycine max
  Peptide Sequence Number=SeqID_152733
atgcaaagaaagaaagaaaggaaaaaaaagatgcttccactaaagctggttcgctctctggtcttaggtgaaaccatcaaccacaatcctcatcacatcctaacccaaaatcaccaccataacagtgatgatgatgatgatgatgaagcccatggcacatcacaaccccagcatcatagaagaagaagaaagtacaaaaggccaggtctgatattcctcccaactaaagagatcataagagacacatacaggcttgccaccattgcaagagacttaggtctggacttgtaccctacaccatcactctctcacatcatcttctccaacccatcatcatccaaaccctcatcactttccatctctttttcttgctctctccaaagcgacgctgttcccattcccttcccttccctctccgcaaccccactggcccacctccgctgcttcctcacgctctccccacgcgccttcaagatcgtccttttcaactccgaccaccaccccgacgacgcctccggaacctccggcaacgccaacaactgggactgcggctctttctctctccactctagggccgtcggcgttcgggttgacaccatggaggagttttgccggattctcgccggaaaaggttggagcttttacaaaaccaagaaagccccatcttccgatcagcgccacggcggcgcgttttacctcttcagaagggtggacgtgaaccgggttcgggtcggtggcgtcggagctccggaggatggggcatgtagggtgagggagttgaggttgccgcacttggattttggaaatgctccgttgaggattttgcagtatattttgttgatgactgatgatatcttctgtttggcatga

SEQ ID NO: 35956 - DNA, 866 bp, Glycine max
  Peptide Sequence Number=SeqID_152734
atgtcactgattccaagtttcttcggtggtcgaaggagcaatgttttcgaccctttcgcgctcgacgtatggggccccttcaaggatttgtctttcccttcttcgctttctgctgaaaattctgcgttcgtgaacacccgattggattggaaggagaccccagaagcccacgtgttcaaggttgatattccggggctgaagaaggaacaagtgaaggtggagattgaagatgacaaggttcttcggataagcggagagaggagcgtggagcgcagtagtgctaagttcttgaggaagttcagattgccagaaaacactaaatttgatcaagttaaggcttctatggaaaatggggttctcactgtcactcttccaaaggaagaggtcaagaagcctgatgttaaggctgtgcaaatttctgtgcggcaacctcaactccctcaccctacatgccccatcctccggagctccgacgccaccgacccgaacccggttcacgtccacccttctgaagaggtaaaacgcgccgccgtggcgctgatcggaagatggggctttcttggttttgtaaaagctccaaccttttccggcgagaatccggcaaaactcctccatggtgtcaacccgaacgccgacggccctagagtggagagagaaagagccgcagtcccagttgttggcgttgccggaggttccggaggcgtcgtcggggtggtggtcggagttgaaaaggacgatcttgaaggcgcgtggggagagcgtgaggaagcagcggagggaatgggaacagcgtcgctttggagagagcaagaaaaagagatggaaagtgatgagggtttggatgatgatgggttggagaagatgat

SEQ ID NO: 35957 - DNA, 1394 bp, Glycine max
  Peptide Sequence Number=SeqID_152735
caccaaacccagaagaaggaaaaccatcacacaacattgtagctggaaaaaataggagggatgttctcattggctttggaggactttatggtgcttcaactcttaccaacaataacaacaacaaccctttagccatagctgctcccattctccctcctgacctaaaaacctgtggtccacctgacttagcaactggtgcaaaacctgttaattgttgccctccaatatcttctaccatcatagacttcaagctcccttcttctggagcaccccttagggttagaccagctgctcatttagtcaacgatgtctacatagccaagtatagggaagcccttaagcgcatgaaagccctttcacctaatgaccctcgaaatttcacccaacaagctaatgtccattgtgcttattgtgatggtgcctatcaccaagtagggtttcctaaccttgacctccaagtccacaactgttggctattcttcccttaccaccgttggtacctttatttctatgagagaatcttgggaaacttgattggtgacccaactttcgctcttccattttggaactgggacaatcctaaaggtggcatgacaatcccttccttttacgtagataaaaactcacctttgtatgaccctcttaggaatcttaatcatcaacccccagttctcatagacctagactataacagaagggacgatgatgatcctagtgctagtgaaagtgtagatcccaatgaacaaatcgctagcaacctttctataatgtataggaatgttatctccaatgggaaactcccaaggcttttccttggaagcccttatcgtgctggagatgaacctgaacctggtgctggctctttggagaacgttccacatggtcctgttcactcttggactggtgataagagagagcctaaccgtgagaacatgggaatcttctattctgctgcgagagaccccattttcttttctcaccatgccaacgtggataggatgtggagcatatggaaaacaataccaggtgggaaaagaagggatttcactgaccctgattggttagagtccgcatttttcttctacgatgagaacaagaaccttgtgcgcgtgaaggtgaaggattctcttgacacaagaaagttggggtatgtttaccaagatgttgacattccatggctcaagaataagcctaaacctaaaagatctaaagctaagaagttggcattggcacaagattttatagttggtgcagcacaagctgttgagactacaccaaagagtgttaagttccctttaactttggattcaaaggtaagcacacttgttaaaaggccaaagctgttgagggagcaaggaggagaaggaagaagaggaggaggtgttggtgattga

SEQ ID NO: 35958 - DNA, 846 bp, Glycine max
  Peptide Sequence Number=SeqID_152736
atgtctgtgaaatcaatgctcagtgcacttgtaccctgccaacctggagacacatttgtgaattatcccacacgtccagtggatacaacaacagattttgaagggacagccaacatgcaaccttcacagccggtttcgtctggagctgcagtttctggcaacatgcctggtggtcatgtttcgaatagatctgtccctcggccaatgaatgttggtggcatgcagagaatacctcatcaggcaatgcagggttataatctctcatctcaggcagggatgggtgctggaatgaatcctggtggcatcccaatgcaacgaggtgttccacagcaacagttgagaagaaaagatcaaatgggtatgccaggataccctccacagcagaagtcaagacagacaaacttggctgttcaaaaaaccgggagaattatgttgatatgggctatcaggagtgtcactgatttttctcatgttgtgtgtgagcaattagaattcgtgagagtgctgaaataccatgtctcatggttaggttgtgctggtagagatcaagtgaagataaatttgaggtcaactctagggaacttgagctcattcaggacaattcatgaccccccaagttcagatagtttgcttccgttcttgcggacctcactattttattgcagtcaaaggatactgctggaacagcaattgagcccttggaagggaatgggtgagctattggagcctggaggcacatctgttagccaagttaaaaggttagataccttaggggtgttcgccaaaattgaacttctagatttggcttttgtgacaacctacgaagtatttggaacttacttgtga

SEQ ID NO: 35959 - DNA, 648 bp, Glycine max
  Peptide Sequence Number=SeqID_152737
atgggagacgacagtggcagcaaccggtcaaagccggagtggctgcagcagtatgatctaatagggaagattggagaaggcacctacggtctcgtcttcctcgctcgcatcaagtcttccaccaatcgcggaaaatccatcgccataaaaaaattcaagcaatccaaggatggcgatggtgtctctcccaccgccatacgtgaaatcatgttactcagggagataacgcacgagaatgttgtgaagcttgtgaatgttcacattaatcatatggacatgtctctctatctggcttttgattatgcagaacacgacctttttgaaataataagacatcatagggacaaagtcaatcaatccattaaccagtatactgttaaatcgttactctggcagttgctcaatggactaaactatctacacagtaattggataatacatcgggacttaaagccatcaaatatattggttatgggtgaaggagaggaacatggagttgttaaaattgctgactttggacttgcaaggatatatcaagcacctttgaagccattatctgaaaatggggttgttgttactatttggtatcgtgctcctgagttgcttcttggagcaaaacattataccagtgctgttggtatcctttaa

SEQ ID NO: 35960 - DNA, 2457 bp, Glycine max
  Peptide Sequence Number=SeqID_152738
atggcgaccgttggtttctgcggtttgaagccattgctctttcgtcgcaaggcaaacatttttgaggcaatgaaaggttctacacctaagaggtcttcatctgcaaaagctaagagcaaagcaaatgaagagtcattggagttgtcatttgttggggcagaccaattgattctaatggtggagatccataagaagatcttggcattcagagacatcatggacctagctccatgtaacagctctgcttccttacgtgagatggtaatgaaaaccctgaaagatctgcacgggctttacccagggatcataccaaaaaatgaagtgtcaaagattaaggacaagcctatagacaagtctatggcctacttctgcaaggctttgaagtctcttggagagtcatggatgatgaacaatgattggatgaataagctcaatattgtattaccatcatgcaaggataacaacaacatgcgtcaattgggtgagacaatgttgaccactctagattccttgatgaagttagcaagtgagaggtttgacatagaattgacagaagaagatgagcacaagaaagaattcagcccacgttcaagctcatttgggaaacatataatgagatcaacttccttttcagatagcagcttctcttgttgctcttctcctgccacacctaaatctgttctcccagagttgatgaagtactcagcaagatcaggagacagtccaaggagttcttgtgcctcaccacttcttctgtctctcagagttcaagctgtgggaaagttgaaccctattgatgtaaagcgcttgtcttttcagatgtcaccaacacaaatacacaagatagaagaggaaccatcagtacccaccacagaattggatgacaaggcctcaaatattattcatggaaaggactcatcagaagacctagtgtttcacttggacgcaactgaggaggagttagaaagcataatcaatgatcataaaactaacaaacctcaagctattagggaagtgaggctatcattgtctccaggacaatttcaacccaaatctcctcctaaaccaccacaaatacctctcgagcaacaagaacaagtacttgtatcttcacctccaattacacaacaagaccctcctaaaccatgcataccacaacctcctcctccaccacctcctctaccatccatgataatggtgaaagctactccccctccaccaccaccacctccacctccactgccaccttcacctccacctccacctactgcatcatcatccatgatcaagccaaatgtaacattaccaccaccaccgcctcctcctcctcctcctccaccatcagcaccaaaattggagcaaagtgttgctccaataattaagatggttccacctccacctccacctccaccaccaaaagggtctacaagttcaggtggttcagcaacaactgctgctgctcctccaccaccaccacccattccattgaaaggtggatcagttccagcacctccaccacccgtgcccggtggtgcaaaaggaggtgcgccaccgccaccacctcctcttggaggagggagatccttgggcgctagggcaactactaaattgaaaagatcgacacagttaggcaacctgtatcgaactctaaagggaaaagtagaagggtctagcctcaatggaaaatctttagctgggaaaaaaggtggtattggagcagcaagcactggagggaaacaaggaatggctgatgctctagcagagatgacaaaaagatcctcttacttccaacaaatagaagaagatgttcaaaagtacacaaagcaaatcttggagctgagatctaccattactaatttcaagacaaaggacatgacagaattgagcaggttccacagagatgttgaatccgttcttgagaacctaactgatgaatcacaggtgctatcacggtttgaaggtttccccacaaagaagttggaagctttaagaatggcagcagcactgtacaacaagttagactctatacttaccgagcttcaaaattggaaaatagtgcctccattgggtcagcaactggaaaagattgagcgttatttcaccaagagtaaaacagaattagatgctttggaaagaaccaaagatgaagagtccaagaagtttaagggtcacaacatcgaattcgacttccacattcttgtaaagatcaaggaagcattggtggacgtttcctccagttgcatggagttagcacttaaggagaatcgcaatgcagctgctaagaatgatgcacctaaaaaggaaggtggttcaatgctttggaaatctttccaatttgcattcaggatctacacattcgctggtggcattgatgatcgtgctgacaagctaacaagagaattggctcaggagatagaaagtgacccgaatacaaatccgaacccgaaccaaccatga

SEQ ID NO: 35961 - DNA, 135 bp, Glycine max
  Peptide Sequence Number=SeqID_152739
atgactaattggccaaagcagaggatgagattaactgcttctcaatttgctccacaagttgaacaacctaccgctaattttgaaagtactccaactccttatattgaaagtgttccaactccaactatcacttaa

SEQ ID NO: 35962 - DNA, 762 bp, Glycine max
  Peptide Sequence Number=SeqID_152740
atgggggaagttttacagaagattggtacagaggaaacaacatcaacaaacactcatccggtggtatgtgattctgctcctataaatcctaaagaagagaattcaagtaacatcaatatgtcctctgtaaccactaaggaaagagaagaaactggttttatcaaagagaagccaaccactgaggaagtagatgctgaggcttctagtttaaacaaagttcagatatttcgaaagtcatcctcagtggaatctggtcttgattctctggatgaaagcaatatttctgaaattcaacgagagtctaatgatgatagactaaggagacgaattgagtattacaagaaatgcaatgattctttacagaaggaagtggaggaagaaagaaacgcttctgctgttgctacaaatgaagcaatgtctattattacaaggttacaggaggagaaggcagcactggagatggaggctcttcaatattttagaatgatggagaagcaagcagaatatgataatgatgaattggagaaagtgaatggtctactcacagaaaaggaaaaagagatacaagatttggaagctgagctggaattttatagatcaaacatgacaagctcgaatggaagccttgaagatcatcttgcctgcaagaataacacccctccgttgtcatggcaagctcgaattcgcattgctgctgaaactgctgctgctcttgcagctgcttctatgatttttaaaaaagttgatcccacctactcttga

SEQ ID NO: 35963 - DNA, 720 bp, Glycine max
  Peptide Sequence Number=SeqID_152741
atggaatgcttggcttggaggggaaaaaccagcttgacatcacagctgaatagtcagggtttggtaagaaatgtgattgggcactgtttgagtgcacaaggaggagggtatatcttctttggagatgtgtatgattcttttagactaacttggactccaatgtcatccagagattacaaacattactcagtcgcaggggcagctgaactcctttttggagggaagaaaagtggggttggaaatcttcatgctgtttttgacactgggagttcttacacctattttaactcttatgcttaccaattgaagaaggaatcaggtggaaagcccctaaaagaagcacatgatgatcaaactctccctctttgttggcgtggtagaagacctttcagaagcatatacgaagtgagaaaatacttcaagccaattgtgcttagtttcaccagcaacgggagaagtaaagctcaatttgaaatgcttcctgaagcatatctgatagtatcagctaataaattgttctgccagaacatgggaaatgtttgcttgggcattctaaacggctctgaagtagggatgggggatctgaacctaatcggagacatatccatgctaaacaaagtgatggtatttgacaacgacaagcagttgattggttgggcaccagcagattgtgaccaggtccaaaatccagagatgtcagcatttgatcacaaaatataa

SEQ ID NO: 35964 - DNA, 1221 bp, Glycine max
  Peptide Sequence Number=SeqID_152742
atggcaagtgagaggttttactctgtatcccagaggttgcagtcagatgaagcaaagcaagatatctatttgaaagttaacaaacctcttaccctcaggtttgaagatgttgtgcataaaataaaaattagcaaagggaaaggcttgttatgctacaacaaagaggtaagttctgaggagacactggtcttgaaagggatcagtggtgttatttttccaggtgaattgttagtcattttaggcccttctggttgtggcaaaacaactctgttagctgctttgggaggccggctaaatcacagtatcactagaggaagcataacctacaatggcaaacccctctcaaaatcagtgaagcaaaacctgggatttgtttctcaacaagatgtcttctatcctcacctatcagtcagtgagacactcatcttttcggctcttcttcgcttgccaaatagcgtatctaaagaagagaaaatcttaaaagctcaggcaattatgaatgaacttgacctgactcattgtaaggacactataatgggagggccactcctaaggggagtttcgggtggagaatggaaaagggttagcataggtcaacaacttttaactaatccaagtctcttgcttgttgatgagcctacttcaggtcttgactctacaactgctagaagaattgtgctaactctatgtgagttagctaaagatggaaggactgtcataatgactattcaccagccttccagcaaacttttttacatgttccagaagattttactgctatcagatggtagaagcctgtactttgggaagggagaaaatgttatgaattacttctccagtatcggttatactccatccgtagctatgaatccaactgatttcttacttgatcttgcaaatggtatttattctgaaaatttggaagaggatacaaatgctacaaaacaggtgttactatctgcttttgagagtaaccttgcaagccaagtgaagatggaacttcaaatttccagggattcaatccatcacaattcagaagatgagatattcggtcaacattgcacaacttggtggcagcagtttactatattactaagaaggggtttcaaagaaagaaagtatgagcaattttcaccccacaaaatctgtcatgttttcgtcttgtcattctttgcaggctctctctggtggcagtctggagctgatcaaatgcatgaccag

SEQ ID NO: 35965 - DNA, 567 bp, Glycine max
  Peptide Sequence Number=SeqID_152743
atgacagagaaagtagctaatggtttcctctcaggtgtcgtgaaagtgtctggatttttcaccagttcagtgataaactcaaaagctggaaagaaaattttcagctttctaccgggggaagttctgcttgcatcgttggatggattcagtaaagtgtgcgatgctgttgaagtaactggaaaaaatgtcatgtcaacatcatcaactgtgacaactgagcttgtcgatcacagatatggagaacaagcagctgaagcaacaagtgaagggtttagtgctgctggtcatgctttgggtactgcatgggctgcttttaagattaggaaggctctcaaccctaagagtgttcttaaacctacctccctggccaaagctggtgctaaagctgctgcttctgaatttaagtctaaaaattccaagtacagacaaattttgaatgtgtgggtagacgatttgaagttttgcaaaatcagtgctggaggaaaagctgccctgataagttcagcattcgtgggaggtgggacaatgttaattgttaaacactttgttctacggactgacgactga

SEQ ID NO: 35966 - DNA, 117 bp, Glycine max
  Peptide Sequence Number=SeqID_152744
atgacgatcccagtcaagatccagatctccaaattcattgggagtacagtagcagatggagaagctacttcccatgatcaaaagcaggttcacaattatagaaaaatgggagaatag

SEQ ID NO: 35967 - DNA, 573 bp, Glycine max
  Peptide Sequence Number=SeqID_152745
atgataataaaggaaaggtccttctacatgtatagactctcatcttacatcatagcaagtaatcttgatgaccttccattgcagctagccttgccaacccttcttgtcactgttacttattggatgggagggctaaaagccaaagcttcaattttctttcgtactctagctgttgctcttctctattctttggtatcacaaggttttggccttgctattggagcattgctgataaataatcaaaaagtagctattacagttggaactgtggtcatgacattgtttcttctagttaatggcttctttgttcgaaatacgccagcatttgtgtcctggataaagtacctatctcatggctattattcctataagctcttgctaggatcacagtttaacggttatgacacttaccattgtggtcaaaatgtcacctgctcagctgtgaactatcctacaattaagcatgtgggcattgacaagcaaggtttatctgttgctgctttggtggcaatgcttgtaggctacagacttattgcctattttgcccttaggattggcactaaacttaactag

SEQ ID NO: 35968 - DNA, 168 bp, Glycine max
  Peptide Sequence Number=SeqID_152746
atggtgggttttgatgaatacatgaatttggttcttgatgatgctgaagaagtgaacgtcaagaagaaaagcagaaagacattagggaggatccttcttaaaggagacaacataaccttgatgatgaacacccatcttacgtacagggttttgagtagcatgctatag

SEQ ID NO: 35969 - DNA, 2775 bp, Glycine max
  Peptide Sequence Number=SeqID_152747
atggcggtgggccttaacacaggcgttccatgggttatgtgcaagcaaactgatgctcctgatcctgtgatcaacacatgcaacggcatgagatgcggagaaacttttactggaccaaattcccccaataaacctgccttgtggactgagaactggacatctttctatcaagtgtatggtggactgccatacataaggtctgctgaagatattgcatttcatgtcaccctattcattgcacgaaatggaagctatgtcaactattacatgtaccatggaggaaccaactttgggagaacagcctctgcttatgttataacaggctattatgatcaagccccacttgatgaatatggcaagcaacccaagtggggacatctcaagcagttacatgaagtaatcaagtcttgctctaccacattattacaaggagtgcagaggaacttctctttaggtcaactacaggaaggttatgtctttgaagaagaaaaaggagaatgtgttgcattccttaaaaacaatgatagagataataaggttactgtacaatttcgcaacagatcatacgaattactccccaggtcaataagtatcttaccagattgtcaaaatgtagctttcaacacagcaaatgtaaatacaacaagcaacagaaggatcataagtcctaaacaaaacttcagctcattggatgattggaagcaattccaagatgtcattccatactttgataacacctcactaagatcagattcattacttgagcaaatgaatacaaccaaagacaaatcggattacctttggtatactcttagaaaaccaacacttagtgttcagtctgccgctcatgttgcccatgcttttataaacaacacatacataggaggggaacatggaaatcatgatgtgaaatcattcaccttagagctcccggttacagtaaatcaagggacaaacaacctttctatactcagcgctatggttgggcttccggattcaggggcatttcttgaaagaaggttcgctggtttaatcagtgtggaacttcagtgcagcgaacaagagtctcttaatttgaccaattccacgtggggatatcagaccacatttgatacaccagagggagatgaccctgttgttttggaccttagctcaatgggaaaaggtgaggcctgggtaaatgaacaaagcatcggtcgctattggatcttgtttcatgattccaaaggcaacccttcacaatcactgtatcacgtgcctcggtctttccttaaagatactggaaacgttttggttttggtggaggaaggtggtgggaaccctcttgtggccttatctgggaatgtcagctacgacggtcgctcgcttctcattgatggccaacgcaagcttcttatctctgcttccattcattacccacgcagcgttcccgcgatgtggcctggtctcgttcaaacagccaaggaaggaggggtggatgtgattgaaacctatgttttttggaatggccatgagctttctccaggcaactattactttggaggaaggtttgatctagtcaagtttgcgaagactgttcagcaggctgggatgtacttgattcttcgaataggcccatttgttgctgcagaatggaattttggtggtgtaccggtatggctgcattatgttccaggcacggtattccggacttacaatcagccttttatgatagaaaatgaatatgggtactatgaaaatttttataaggaggatggtaagaaatatgccttgtgggctgcaaagatggctgtttctcaaaatacaggtgtcccttggataatgtgccaacaatgggatgctccagatcctgtgattgatacatgcaattcattctactgtgaccaatttacacctacttctccaaacaggcccaaaatttggactgagaactggcctggatggtttaaaacttttgggggaagagatcctcacaggccagcagaagatgttgcattttctgttgctcgtttcttccagaaaggtggaagtgtacataattactacatgtatcatggaggaacaaattttgggcgtacagcaggtggtccattcattactacaagttatgactatgatgccccagtagatgagtatgggttacctagacttccaaaatggggacatcttaaggaacttcacagagctatcaagttatgtgagcacgtattgcttaatggtaaatcagttaatatctcccttggtccttctgtggagaattttcatgactggctgtttgtagttcagttcaaggaagtaaattttagctttgtaatagtgtcaactgttggagggcgagtcctggctgcgtacaacatccctcccccataccttcgcatagcgaagagcctctggacaatggggtacgaagctgatgtctatactgactcatcaggagcatgtgcggcctttatttctaatgttgatgataaaaatgataagacagtggaatttcgaaatgcatcatatcacttgccagcttggtcagttagcattcttcctgattgcaagaatgtagtattcaacacagctaagacaaatgtagttgcaatgattcccgagagtttgcagcaatcagataaaggtgtaaattctcttaaatgggacatagtgaaggagaagccaggaatctgggggaaggcagactttgtcaaaagtggttttgttgatctcatcaatactaccaaagataccactgactacctgtggcatacaacaaggtatgtcttaggataa

SEQ ID NO: 35970 - DNA, 570 bp, Glycine max
  Peptide Sequence Number=SeqID_152748
atgaagagctcgtggttcactacctcaagagaaaagctgcttcagcaccccttcccgtcgccatcatcgccgatgttgatctatacaagttcgacccttgagagctaccaagttcttgcactcaagatccatttttgtgaagattcagcagtacagagagttaggatctccagtgtagcacaatggatcttgcataagaaccctcgagatcccaaaagtagcttaacgggtttgggagggaagcaacaagaaaaagatgcaaaggaagaaaaatacctgaacagatgcatgtcaccgtcgcaccgccgaaggtgcatcaatttggcggcaccgtcgcattgtggagaggggaagaggaagaggaaaaagagaaaggggagtggggaagaggaagcgtccgcgggagaggaagtggaacgtgccgggagattgaaagaaagagaaaaaaagaggaagggaaatgtccaaggagagagaaaggaaaaaaaaaagagaaaaactaggaaggggatggaaaaattaaaaattaaaatcaacgttacaattgaacgttggaccactcatgtttaa

SEQ ID NO: 35971 - DNA, 507 bp, Glycine max
  Peptide Sequence Number=SeqID_152749
atgggtatggagtatcagaagattcatgcttgccccaacgattgcatactatacaggcatgaattccaagaaatgtccaaatgccctatctgtgggagttcacggtacaaagtgaaggatgaagaggaaagcagttctgatgaaaactcaaagaagggccctccagcaaaggttttgtggtatcttccaatcattccaaggtttaagcgtctttttgctaatgaggatgacgcaaaagaccttacatggcatgcaaatggaaggatttctgatggaatggtctgtcatccggctgattgcttgcagtggaagaagattgatggaatgaatccatatgacaccttaagcactcaacacagttcatggtcagttctgctactaaaatacatgatgttttctaagatgatatcgagcccaagacagccaggagatgactttgatgtttatctaagtccactggttgaagacctgagaaagttgtgggacataggtggttttagtgtttga

SEQ ID NO: 35972 - DNA, 990 bp, Glycine max
  Peptide Sequence Number=SeqID_152750
atggagcatgagaagaagctggcactcctaaggaaggtggagatgaagagagcagactatgtgaagacagagaagacaaagaaagaagtggagaaattagagtcacaaatgatggtagcttctcaggccattgatagtacatcttctgaaatcatcaaattaagggaggtagagctctaccctcaactaattgagcttgtaaaaggattaatgtgcatgtggagaagcatgtatgagtgtcaccaagtccaaaagcacatagttcagcagctagagtacctcaacaccataccatcaaaaaaccctacatctgagattcacaaacaatcaactcttcagctggagcttgaagtacagcagtggcaccaatccttctgcaacctcttcaaggcccaccacgactacatccaatccctcacaggttggctaaggctcacccttttccagttcagcaaaacccctataaaccgaacccccgaggagtctaagatatacaccctttgtgaagaatggcacctcgccgtcgaccgcattccggacaaggtagcatccgaaggaataaaaatcttgttgacagttattcatgccattgcactgcaacaggcaaaggagcagaaacagaaaaagaagtcagattccacattcaaagagctcgagaagaaggtggttcagctgcgatccttggagtgcaagtatggtccatactccatgccagaatcatctggcagcttgagaaccagggacccgatcaccgagaagcgcactaaggtggatgccttgaaagcaaaggcagacgaagagaagagcaaatacaacaagtcagtgagtgtaacgagggcaatgacactgaacaacttgcaaatgggttgccctcatgtgtttcaagggattgtggggttttcaagtgtgtgcatggaggtttttgagtctgtatacaacaaagccaaagcttctgaacaggagcatgacgtgaagagaatattaccgtaa

SEQ ID NO: 35973 - DNA, 345 bp, Glycine max
  Peptide Sequence Number=SeqID_152751
atggacacgattgaaggataccaagtgaagccagaattcatccccatgttaagaaaaattctcagcaagcatggagatgtcatggagatgtttttaaggattccatggtattcacaacgttactccgaattgcaagacaaaggtctcgataagatcacagaagatgagctgcgtaacatgtttggtgttgcaaatgaaataaaaaatatgaaagtgaacactgagtggcttttcctgagactggaagagatactcgaggcaaggcaaattctcggacaatctggcattctaaaagaggaaaaagataacaacagaaaggtcattgaaactgccaaaagaaaatag

SEQ ID NO: 35974 - DNA, 867 bp, Glycine max
  Peptide Sequence Number=SeqID_152752
atgaagtttctctttcaaaatcttctttctcaattgcctatagtcattctttggtatttttccactgttatcatctctcaacaacatgttagtgctgtgagtctaccaaacaatgaaactgtcccagcagtcattgtttttggggattctatagtggattcaggtaacaacaactacatcaacaccatactcaaatgcaatttccaaccatatggtagagattttgctggaggaaatcaaccaaccgggaggttcagcaatggtttaaccccatcagacatcattgctgcaaaatttggagtcaagaagattttaccagcttatcttgatccaaaactgcaacctcaagatctcctcacaggcgtcagctttgcatccggtggctccggatatgatcctctaacttctaaaacagtatccgtgctatcattatcagatcaactagacaagttcagcgaatacaaaaacaagataaaggaaacagttggagaaaatagaatggccacaataatatcaaaaagcatatacgtcttgtgcacaggaagtaatgacattgccaatacttactctctatcaccggttaggagagcacattatgacgttccagaatacacggacttaatggcttcacaagccacaaacttcttgcagtacattttgaagctaaccgacttaaacgtgcgaaactatggtctaggtgataaattttcagacatgatggaatatgtagctgttcccaacactatgggttgcttaacagccaattctatttctaccctttcatattgggtcaaaattcaaaatccaattgcactcgaagcatctaacatgaatgtgcgtgtgaatgtgtctaaagcccacgtccat

SEQ ID NO: 35975 - DNA, 420 bp, Glycine max
  Peptide Sequence Number=SeqID_152753
atggaggcgagagtggagataaaggtgcgaatgcaatgcgaatgcacagggtgcgatagaaaggtggagaaaatgaagaaatcagtgcaaggcatggagggtgtggcgcaggtgcaagtggatcgagaggagcaaggcaactgcaagctcactgtcattggccgcgtcgatccaaaccatgttttgaaggctctgagacgcctcacgcacaagaaggttgaactgttgccagtgccccaagtccaagacgacgtcgttccgcaaccgagccaacccgaacccgtgaacgtccacaacgtgctgcgtcatgatcacgacgatcaagaagcttcgatgcttccacgtgcgaacttcttaggcgacccgaattacaccactgccttcagcgaggatagtccaaatgcttgtcctattatgtga

SEQ ID NO: 35976 - DNA, 1350 bp, Glycine max
  Peptide Sequence Number=SeqID_152754
atgcgtcgtgggttgatttccatttcacgttcaagtctccttcgaccctttcaatggcatctatccacagccacagccacagccacagccacaatcacacctcctcccgatgacgccaccgttcggcaaacgctcctctccttcaacaacgactggaagcgcgccctcgagttcttcaactgggtagaagactcccactcccagttccatcactccactgacaccttcaacctcatgctcgacatcctcggtaagttcttcgagttcaagctctgctgggacctcattcgccgcatgaacgcccacccctcctctccccccaaccacgccaccttccgtctcatgttcaagcgctacgtctccgcccactccgtcaacgacgccatcgacaccttcaatcgcctcggtgaattcaacctcaaggatcacacctccttctccaacctcctcgacgccctctgcgagtacaaacacgtcatcgaggctcaggacttgctcttcggaaacgacaaccgcgtgaccctcagcgtcgacccaatcggcaacaccaagatccacaacatggttctccgcggctggttcaaattggggtggtggagcaagtgcaacgagttctgggaggaaatggacaaaaaaggggttcacaaggacttgcactcttattcaatttacatggatattctctgcaaaggtgggaaaccttggaaggctgtaaaattgttcaaggagattaaaaaaaaaggtttcaaattagatgttgtggtttataacattgtcattcgagccattggtctatcacatggagttgatttttcaattagggttttccgtgaaatgaaggagttgggtatcaaccccactgttgtcacttacaacacattgattaggcttctgtgtgattgctatagacacaaggaggcacttgcgttactccgaaccatcatgccccgcgatggctgccaccccactgccgtttcttaccattgtttttttgcctccatggagaagcctaaacagatacttgctatgtttgatgagatggtggagagtggggttaggcccaccatggacacctatgtcatgctcctcaacaagtttgggaggtgggggtttcttcgcccggtttttatggtgtggaataagatgaagcaacttgggtgtagtcccgatgctgcggcttacaatgccttgatagatgctcttgtggacaaggccctcatagatatggctaggaagtatgatgaggagatgttagccaaaggactttcgcctaaaccaaggaaagagttggggacaaagctgttggctgctgatgaatctcaaagtaccatacagacacaacactactag

SEQ ID NO: 35977 - DNA, 1533 bp, Glycine max
  Peptide Sequence Number=SeqID_152755
atgttggtgaagcggatgtatcattcagaatcaggggaagcggatctggccagaagacccttgttttttagggagatcaatccacaaccaaggaaacatactttgtggcaggcaacatcagactttactggtggacaagccagcataaacaggcgacattttctgcagtgtccgcaaggattgctaggcaagcattttgagaagctcattcagtgtgatccacgtctcaactatctaagccagcatccggatttggtgctggattctccatattttgaacctggaacaacttcagttcacgaccacattgaatctagtgatggttttgatagaaagagcgaagagcgatctggtatttttggattgcaggatgtggaatcaggatctgcagttcaatcatcttcctcaaaaagtgaacataaccttggtaaagctgttgaaaatgttaaccaagaaattacctcacctagctcagtgatgaacatccatgcaatggaagatttcaggagtagaggagctgaaacattgaagtttctcagtaatttggatcagatcaaattgcctggacttcacccatcaatgtcaatggacgatttggtaagccacattggacattgcatttcagaacagatgggatccgacaatccgagtttggctggtgacagcctgtatagcagatctattctggaagaattttctcagtacttgttcaatgactctcaacatgcaactacctctgatgaacagcgtgtgatgtcaagggtgaactcactttactgccttctgcagaaggatccttcttcagcagaagacataaacacaatggccaaaaatggcaatagtctgagagatgcaaatgctttgtcaagggtgaactcactatactcccttctgcagcatgcagaagacacaatgaccagaaatggcaatggtctgagagatgcagatgtgatgtcaagggtgaactcgctatactgtcttctgcagaaggatccttctacagcagaagacacaaacacaatgaccagaaatgacaatggtcttgatgcggatgagggtggaaaagttggtgtcagtaactctaacaccactgaattgtcaccatgcaaaattaaagtgcctgatttggaagttcaaccggatgatgcttctggctgcaagcagggggttagtggtatgtccagaaaggaatcagctggcgatttgcttcttaatcttccaaggatcgcatctctgcctcagtttttgtttaacatgtccgaggattctgttaataaatttcacttgcgttggattgatgattctcttgtgaaacgagttggagacattttaaaacaggctaagttacccacagcccctcctgagaccgtgactgtggacatgtttaaatctgtcatggcagtggataagaaggtagcagatgggttgctaaggcttatccttctaaagggtcctctaggcaattgtgttttcacaggggattatgacagaaaggctctagacaatacgcttcgtgcattctgtaaatcctga

SEQ ID NO: 35978 - DNA, 1278 bp, Glycine max
  Peptide Sequence Number=SeqID_152756
atggcgacttctctgcaactgttccaatgcaaactagcgagaccctttcggccattccctttgcgaaggtcaactccccctctgagtctgaggtgttgcgcttcgcccccttcttcctacagcatcactctcattcccggcgatggaatcggccccgaaatcatctccgtggccaaagacgttcttgtcctcgtgggttctctcgaagggatcaaattcgagttccaagaggttcttatgggtggagctgcattggatgccaccggagtccctttacccgatgataccctttctgccgctaagcaatctcatgccgttctgcttggtgctgttggaggttataaatgggataagaacgagaaacatctcaagcctgagactggcttgcttcagatacgtaaagagcttggagtatttgcaaatcttagaccagctaccgtgtactctccgaaaaaattacatatccctgctttgcttgttgtcccttggaacggaagacagacggatcaggaaaatcttagggatgtattttatgatgtgttagtggatgcttcaactttgaagagagaggttgctgaaggggtcgatatcatgcttataagggaactcactggaggtatctattttggagaacccaggggctttggcaccaatgaaaatggtgaagagattggctttaatactgagatttacgctacacatgaggttgctcagaagcgttgtgggaaactttgctctgttgacaaagccaatgtactagaggcatcaatgttatggagaaagagatttttggcaatagcgcaagaatatcctgatgttgagctctcacatatgtatgtcgataatgcttcaatgcaactaattcgcgatccaaaacagtttgacaccatggtgacaaacaacatttttggcgatatattatcagatgaggcttcaatggtcactggaagtattgggatgcttccttctgctagcctaggggcttcgggacctggactttttgaacccatacatggttctgcacctgatattgccggacaggacaaggcaaatccatttgctactgttcttagtgctgctatgcttttgaggtatggcctaggagaagaaaaggcagctaaaagaatagagaatgcagtggtggacactttgaacaggggatttcgaactggtgacatatattctgcaggaacaaagctggtaggatgcaaacagttaggtgaagagatactgaagtcagttgaatctaacgttcatgctggtgctgctacagtgtga

SEQ ID NO: 35979 - DNA, 1554 bp, Glycine max
  Peptide Sequence Number=SeqID_152757
atggtttgcactggtgaaatgggcagcatagtagacaaaaaatcttggtacgaggaagacacaaaaagtcaaagaaaacccacaaagaagtatgattcacagtgccagcaagcataccaaacagcgaaaaagggtaaagacgcgcaggcacaggcacatcatgttattgttattgttggcttcttcactcagcaaccaccaaaccacaccgtcgcacccattccatcgctgattcccccaatggcttccactgccaccaatttctctctttctctctgcgccaaccaacaaactccaatccccaaaccctctttcttctccaataacaaccatttgcacttcaactctaataataattgggcctgggcctctgtttccacctctcgcaagtcaaggatatgcgccacctcctctcaagttatggatccctccgcagcaaaatccgaacccgctcttcccaccatcgtcgaagtcgatttgggtagccggagctatcctatttacatcggatccgggttactaaaccaacccgactatctccagaggcatgtgcatggaaagagagtcctagttgtaactaacgaaaccgttgcgccactttatctagacaaggttgttgatgctttgacaaggggaaacccgaatgtttctgtggagagtgtaattttacctgatggtgagcagtacaaggacatggatactcttatgaaagtctttgacaaggccatcgagtcgcggctcgaccggcggtgtacgtttgttgctcttggtggtggtgtgattggcgacatgtgtggctttgctgcctctgccttcctacgtggtgttaattttattcagattcctacaactgtgatggcacaggtcgattcttcagttggtggaaaaactgggataaatcaccgccttgggaagaacatgatcggtaccttttaccaacctcagtgtgtgcttatagacacagacacattaaatacgctaccggatagggaactggcatcagggctagcagaggttataaagtatgggctcattagggatgcagagttttttgagtggcaagagaaaaatatgcacttattattggcaagagatcctagtgtaatggcatatgctataaagcgatcttgtgaaaacaaggctgaggttgtgtccttagatgagaaggaaagtggactgagggcaacattgaacttgggtcatacatttggtcatgcaatagaaactggggtaggctatgggcagtggcttcatggagaggctgttgcagctggcacggtaatggctgttgacatgtcatatcgcctaggttggattgatgattctcttgtgaaacgagttggagacattttaaaacaggctaagttacccacagcccctcctgagaccgtgactgtggacatgtttaaatctgtcatggcagtggataagaaggtagcagatgggttgctaaggcttatccttctaaagggtcctctaggcaattgtgttttcacaggggattatgacagaaaggctctagacaatacgcttcgtgcattctgtaaatcctga

SEQ ID NO: 35980 - DNA, 468 bp, Glycine max
  Peptide Sequence Number=SeqID_152758
atgggtgtccagaatatcatttcggggctcgttcgatgctggcaaggttgttggcacgaggaacttgagacagtggagattggattagcgacagtggagataatgatgatgaatatgtattgtcagtgcaaagggtgcaagagaaaggtgaagagatcagtgaaaaacatggagggcgtgagggaagtggaagtggatttagagcaggggaagctcaccgtcacaggctatgtggatccaaacgaggttttggagcgtgtgaggcgccgcgcgtggaaggaatctgagttctgggccatggccgatgaaccctacgtcgttccgtacgcttatgcacctcaaccctacgtgctgcagcctaagcatgatacagaaccacccactcttgcccatgcaagcttcttccaggacctcaattatgccacacctttcaaccatgacaacccaaatgcttgctctatcatgtaa

SEQ ID NO: 35981 - DNA, 897 bp, Glycine max
  Peptide Sequence Number=SeqID_152759
atggcaggccaacttgcaagatcaagaagactagaaactcagcagcaggatcagtcaagggctaagtggacgacatcactcaccaagatacttgcagcactgatggttgaccaagtacataaagggaataaacataacaatttatttaataagaaagcatggaaatatatttgcgacgaattttacaaaaaaacaggtctgaagtgggacaaggaacaactcaaaaaccgatattcggtcttgaggaggcagtatattattgtaaagtccattcttgatcaaagtgactttagttgggatgaagccacaggatctataacagctaatgatgaaatttgggctgaatacatcaagaaacatcctgatgctgagactgtcaaaaccggtggctgctcaatctttaaggaactttgcacaatattctccgagccagcaaccaacggcaagcatgaatattttgctgcatctgagggtgaacatacttatacaactctttgtccagagcccttgaacacacaccaagaggagtcctcatcagaatcccaggacgaggaagatgctactaatgactttcaaacagttcaacctactacacctactgcaatttctacccgcaaaagagggcgtaaaggaattgatgatgctattgcagatgccatatttgagatggcgtctgcttcaaagatgagggcagctgccatagagcaacaaattgctagatttagcatggctgactgtattagggacttagatttgatgcaaggtgttgatcaacaactgtattttgctgctctagagctgttcgacaaacctaatgcaagggagatatttttgtcgctcaaaagggataaacgtttaacttggttgcgtcgcaagtgtgctgttgcatccaattaa

SEQ ID NO: 35982 - DNA, 2196 bp, Glycine max
  Peptide Sequence Number=SeqID_152760
atggcacccttcctcccacgggtaattgcatattggtttaagctaaagaagttggaggagttatatctatccagaaacgaatttgagggaccacttccctcatcttttgttaacatgacatctctacggaatttggaaatttctggaaatcacttcattggaaattttgattctaaccttgcaagccttacatcacttgaatattttgatttcacgggaaaccaatttgaagttcctgtgtctttcactccatttgccaatctttcaaagatcaagttcatctatggtgaaggaaacagagtcgtattggactcacaacatagtttgcaaacatggattccaaaatttaagttacaaaagcttattgtgtcttcgacaactgagactaaatctcttcctctcccaaattttcttctttaccaaaacaatttaacctatatagatttgagtggttggaagttggaaggagactttcctcattggttgttggaaaacaacacaaaaatgaccgatgctctatttaggaattgttctttcactggtactttccagctaccaatgagcccccttcctaacatacaaacaattgacgtgtcggacaataccgtaaatggccaaattcctagcaacaatatcagttcaatttatccaaatttgcaatatctaaacttgtctgggaacaacatccaaggatcaattcctagtgagttaggccaaatgagcttattgtatttattggatctttccgagaaccaattgtctggaaaaatacctgagaacatattagcagatggacacccactccaattcttgaaactttcaaacaatatgcttgagggacctattttgaatatccctaatggtttggagaccttgatattgagccataatagatttactggtagactcccaagcaacatttttaactcatcagtcgttttattggatgtaagcaataatcatttggtgggaaagcttccaagttatgtagaaaaattctcaaggttgcaggggctttatatgtccaataaccattttgaaggatccattccaatagaattggcagaacctgaaaatctaagtcatttagatctctcccaaaataatttgactggtcatgttccatcatttgcaaattctaacttgcaatttatccatttgaacaacaatcatttaagtggattgtcaaaaagaatgttcaatgaaaactcttctttagtgatgctagaccttagctacaatgaaatatcaagcaagattcaagatatgatacaagaccttagttatacaaggttgaattttctccttttgaaaggtaatcactttattggagatataccaaagcagttatgccaattgacagatttaagcatactagacctttctcataacaatttttctggtgcaatacccaattgcttgggtaaaatgccttttgaggttaaggaccctgccgaattgttgcaagatttttatcatttgattcctgaacctgataacagagatggaactgaaagatatgaactaccaaatgttcaagagaaatccaatttcactgcaaagaaaagaacagacacttacatggggagcatccttgtttatatgtcaggaattgacttatcccacaacaaattgaagggaaatatcccatctgagcttggaaacttgacaaaaattcgtacattgaacttatcccacaatgatttaactgggcaaattccagctacattctcccatttggtacaaacagagagtttggatctttcttttaacatgttgaacggtcgaattcctcctcaactgaccacgttaacctcacttgaagtatttagtgtggcacacaataacttatcatgtccaacacctgaatttaaagaacaattttccacatttgatgaaagcagctatgagggtaacccgttgctttgtggacttccactgccaaagagttgcaaccctccacctattgttataccaaatgactctgacactgatgaacactatgatagtttggtggacatgaattttttttgtgtgagctttgtcgtgtcatacacatcagcattgttggtgattgcaacagctttatacatcaatccttactggaggcaggcatggttttactacatggaattggtgagcatgaattgctactactttatcatggataattgtagcaaggttttcaaaatttga

SEQ ID NO: 35983 - DNA, 120 bp, Glycine max
  Peptide Sequence Number=SeqID_152761
atgaactgctcagttgatgtagctgaaatggaggaagtgatcagtcgagtcaaatggaagggcacaacggatttgaagcagaacatatccctcttgagccgtaactctagggaagagtag

SEQ ID NO: 35984 - DNA, 2415 bp, Glycine max
  Peptide Sequence Number=SeqID_152762
atggcggaacatggcaccaggcgtaccattaccgatcgtctggaagaggccattgtcgccctttcagaaagacattcagacctcgctcacaaggttgaggctatgtgtgaacgactctcgcagttcaccacccccacgccgccggcaactcaaccttcctacccctcgagaccaccagtcaaactcgacgtacctcgatttggcggccacgatccgcttgggtggatctttaaaatctcacaattctttgagtaccaaggaacactggaagaggaacgtattaccgtggtctccttctacctcgacggaccggcgttaagttggttccagtggatgttccaaaacggcttcattacgtcatggtcggcgctgcttcaggcagttgaagctcgttttgccccctccttttacgatgatccacgaggcacattattcaagcttgttcaatggagctccgtcacagagtacctcactgcatttgagaagctagctaaccgaatcatcggcctctccccttcgatcctattaagctgcttcatctccggcctaagtccagaaatccgacgagaggaagacaaaataaacgatcgaaggagataccattccagaacctcaccttccctcccaccctcacaatcatctcttcctcctacccacacgagccaaccacccaaacataaacctcccttcatccaaagaacccaggaagacatggcctaccggcgcgaaaaaggcctatgctacaattgcgatgagaaatggagctcatctcaccgctgcaagggacgcgtcttgttcctcatcgcagactctgaggaaccccttccatcagaaataaccctcgaggacccaccacgaacctacccacttgaacctcaacccgatatccacgaacctgaacccaccttcgatccttccacactccaaccccacgttagccttcacgccatggcaggtgtgccagccacaaatactttccgcctttatgggttcattaataagacacgcgtcactatcctgatagatagcgggagcacgcataattttgtccagccccgcgttgctaagttcctaaatttacctgttgaagacaccttgccccttagggtaatggtgggtaatggttcagtaatgacttgcaaccaattgtgctccgatacgaagcttctcatccaagaccatacgttcacggtgaccttgcgcatccttcctctcagtggagctgaagtggttctaagagtggaatggcttcgaaccttgggacccgtcatcaccaactacgcttccttcaccatgcaattctcatactcaggcaagtccatcaaccttcacgcggatgttcaatcggaccccaacccagcctcagcaaaccaggtaaaacgaatgctctccactagttctacctcaggtttattccatctctctctcctccctgcagactcccctacaccatcgtcaccacccctccatcatatcccagccattaacacccttcttcacaaataccaatccttattccaacagccttcgtccctacccccttcccaacaacacgaccaccacatcaacctcctccccacagcaaaccccattaacgtaagaccatacagataccctcacttccaaaagacagaaatcgaacgccaagtctctgccttactcgacgctggtttgatctggctaagccgaagtccattttcctctctgggatttcaccagatattaatggcagaagaggacactcccaagacagcgttccgcactcaccactgtcactatgagtatcgggtgatgctgtttgggctctgcaacacacccttaacgtttcaggccgccatgactcccttctctggccctttctgcgcaagtttgcggcagttttttttttacggcatcttaatctacagcgagactttcagtgatcaccttcatcatctcgagtgcgtcttcaactctctcttacaggctcgttattacttgaagcaatcaaaatacttcattggccagcaacagcttaactacttgggtcacgtcgtctctggaagtggcgtgcgaccgaatccaacaaagattcaagccatcgttgaatggatcatgcctcgttcccctaaagaccttcgcgcattcctcggtctcgccggattttatagaaagttcgtgcgggggtatgccgccattgcagccccactcacgaagcttctttgcaagaacactttccagtggtcctcggaatctcaaactgccttcgaaaaattgaagaccgtcttgactgcagctccgatattggcccttcctgacttttcaatctcgtttatactagagacggacgcatcaaacatagccatgggcgcgatcctgcaacaaaacggccaccccatagcttatttcagcaaaccgttttgtccacgcctctaa

SEQ ID NO: 35985 - DNA, 909 bp, Glycine max
  Peptide Sequence Number=SeqID_152763
atggctgcagcaacagcaactccatcagatgagcaagttcacaaagttgccctaaaagttttggtggacaaagagaaaaacaaagtattgtttgctgaggcaaggaaggatttcgttgacgctctatttgagtggtggggttcccttctcactgctgctgctagcattatccgcccctgggaaaaccaccttgtcctcaaggtggtgggcgtggcaaacgtcaatccaattttcctaggtggagtcttcgggggccaagcccttccactgcacgagtacgagacgtgtgggtggctgtggggaggagtcaacactgcgtccgggggcagtggggtcgaagcagggaggagtggaatacggggtggatcttggatccctcggggaagactggcgatggggtctaagcttgacatggacgagttggtctacctcataaaccacatcacggtgcttctgatccgcgaaatgtttcatagcctcttgcgctttgacaagcttacgttggaggattgcgtgggtctcttcgcgtgtacgaaggggaggtttgccgtagacgacttcgtatggggtcataccggtgcccgtgtgccgcgaggtattataggaccactccatgagtgcgagaagcttgtaccaagtagctggttggtgatgtacgaaggagcagaggtattgctcgagcgtccggttcatcacctccgtctgaccattcgtttgtgggtggtaggtggtactcatgcggaaaccatggtgtttgcacacggtatccatgaaaagggtagctatcttgaaggcgcgatccaccacgaccatgactgcggtgaacccatgggaggcggggagatgggttacgaagtccatggagatgttttcccaagtgcccgtgggaatcggaattggttggagtaa

SEQ ID NO: 35986 - DNA, 153 bp, Glycine max
  Peptide Sequence Number=SeqID_152764
atgtcgatcagtcatagacctccaggatttaatcctccacgaaaagtcagaaattctgcgtattttgaccaattcaagatacatgtatttgatgtcctgcccaagaaagagatcccaaccccaagagccctgtcaaatggtgattcaacatag

SEQ ID NO: 35987 - DNA, 690 bp, Glycine max
  Peptide Sequence Number=SeqID_152765
atggctgatgttaaaactgaggttaccttgaagcttgtggtaatcataggtagaaatgaagttctctttgtggaggcagggaaggactttgtggatgctctgtttagctttctaaaattacctttgagaaccgttgcaagacttgtgcttaaggagccaaatgtgcagccaattgaagttgcatcactgagttcactctatcagagaaaagaagattttgctgactttatttctagtttgctgactattcctttaggaggaatgctacacttgacagaagtaaagaataatcttgttgatcgtgttcttgctccacagttcaaattaagcaacctcatgacatcaatttataaggatgtttcaaaatatttttgttacactgagaacagctacacaaatcttagccacgctcattatatccgagctgtaatcaccatatctgagacagctaatagtaaaggatatgttaaaggaccaataatgtacatggcaacagatgatttggtagtgacactcatgtcctccatttctgtcatatctttactaagcagtgtgtgcattcatgttaatgacttggaagagaaagtggtaaacattggcatcaacgttggtgtcctcatactacaagcatctttgacatctacatcagtcctatcagttggtctcggccacttattaaccccacgttaa

SEQ ID NO: 35988 - DNA, 194 bp, Glycine max
  Peptide Sequence Number=SeqID_152766
gttttaaggtaacaaacgaaggatgctgtggcactggaattattgaagcaggcatactttgcaaccctttcaccctacaaatatgttcaaataccgcaaactacatattctgggacagtttccatcctacggaagaggcctacaatgtgctttgttctttggtgcttgataacaaaatcaaggatttcttctga

SEQ ID NO: 35989 - DNA, 123 bp, Glycine max
  Peptide Sequence Number=SeqID_152767
atggagaatggcagtgagattgattacttggtattgggtgtggcaaattgggttcatgtcttcaagtgcagaaatgtatcatgcacgtacggagggctatgcatgtcgtacctaatgatatag

SEQ ID NO: 35990 - DNA, 426 bp, Glycine max
  Peptide Sequence Number=SeqID_152768
atgggagctagtaagattgagacattgtgttgggaaatgtgtcatggctgtgcctttgttgtagctctgaatagttcccaagcagctgagggtgaactctacatagatgatggcagcagctttaattttctgcaagggggctatatccatagacgatttattttctcgaatgggaaacttacttctatagacctggcacctgcttccagtagcaaggggcgttatccatcagatgctttcattgagaggattatcctgctgggacatgctcctagctcaaaaaatgcactcattgagccatcaaatcaaaaggttgatattgaacttggccccctttgggttctaagggctcgtgcaccagctgttacaaccatacgtagacctaatgttcgtgttgcagaagattggactataacagttatataa

SEQ ID NO: 35991 - DNA, 168 bp, Glycine max
  Peptide Sequence Number=SeqID_152769
atggatagactgcttgaggtggggttcacatgcggccaagctccacactgcagaaaacagcaccgaaccgaagctgtgagcgataagagcaagagagagagagacacaaagagtgattcagagggacgaagagctccttcgcgcaaagcaatgcctgtcatcacctga

SEQ ID NO: 35992 - DNA, 213 bp, Glycine max
  Peptide Sequence Number=SeqID_152770
atgacaaccagcacactttcttctcctgacaccagtcttagatggacaagtgagaagaacaaactgtttgagaatgccttggctatatatgacaaggatacccctgagcgttggaacaacatagccatgtttgttggaggcacaactgaagttcaagtcaagagacaatatgagatactcctagaggacatcaaaaacattgagtcaggcaag

SEQ ID NO: 35993 - DNA, 366 bp, Glycine max
  Peptide Sequence Number=SeqID_152771
atgagacacgtactagatgcagcaacaccaatatgccctcacgacccccatgacgacgatgacaacttcaacgaaaaatgtcaccactttaaaagcaacatcaattttaggagaaccgacgttgaactagcattgttaaaaatgatggagagcagtggagccgaacacaatagagcatatgccctttggacttgggtcacttgttgttgggttacaatgtgggttgagggtgcggggatgcagcaacaccaatatgccctcacgacccccatgacgacgatgacagcttcaacagtaagagagcaacggtgcaggaaacactacggcggtggcactaagaggcgcaaagagatcaaggcggaatga

SEQ ID NO: 35994 - DNA, 1059 bp, Glycine max
  Peptide Sequence Number=SeqID_152772
atggggattgaggaagacaatatcaggaagtacacaacccctgcctacagggcccctgaggtcaccattgaaggttgtggtgaaagcaccacagcctcttccaagttatgggagttcctgggttcaatcttggattgtccatctggtgaacagatgtgggatctgttcctgagagaagtcattaatgagaaggtggacatatgggtctggtttcgtgttaatgagcaactacctattaatttacagaagtcgttacctgacagaccacctgaatcgccctcatctaacaatcatgaaggtgtgtcaatgccctcaaacagatcacctccaatgcctcgtaggaacccacctcctccaccttcatctggagaacccaaaacttcaccacaaccaccccctgcttctaggggagggggaagtgggggtgcacttggtgctttctggtccactcagcatgcaaaggaatcacttgttgctgaggataagagtaaaccaatttttgatgaagaaccatctagccaccatatttcaccgaaacatgataggattcttcctgaaaacgaacagttacccaaaaatgttggtcctaacaaagtggttaacacacaaactcataccgtgaaaagcagtacacatggaaaattacacaagcctgatactgtaccctccaaggattttgaaataaatttgtttaaggataaagatcgcgtacgtgagagtacaactaactttcaaaaccaggcttttaacacttttgttgctgaatttgatactactaatctcaactctggacttagtaacaaacccgaaagggaacaagcattagaggctgaggtggagaaactcaaagagcagctgaaggaagctaacttggaaaaagctgaaataacatcaaagtatgaaaagctttctgctatctgccgatcacaaaggcaagaactgcaggatctgaagcaagcactcacagctaggactccttcgccaattagagatggtttgaaaacctctcctgcagttacatcatctgcatctgcatctgcggtaataagcattttgtag

SEQ ID NO: 35995 - DNA, 504 bp, Glycine max
  Peptide Sequence Number=SeqID_152773
atgcgcgaccaggccatccactttttcgatctgctgcgctggctaactgaggatgaagtggtcaccgtgggcgcgctcggtgccgcgctggcgatgccggcgatccgcgacattgacgtcgatacctcagtgctgattatgcgcctgcagcagggcgcgctggcgcagctcgataatgcccgtcgtaccgcttacggttatgacgagcgcatcagcgtgatgggcagtctgggcatgctggcgtcggaaagccaggcggtgcgcggtgcgactctttatcaggggcagcacatccgccagccggggctgtatgcggactggttcagccgggtacaggagacctattacagccatctcgatgcgtttgtgcgccatctgggcggcgagaaagtggccggtctgccggggctgattgacgggctgcgcgcgcaggccatcgcggaagcggcgcagctgtcgctaacgcgcggcgagtttgtggaggtggagtgggtgacggtgtga

SEQ ID NO: 35996 - DNA, 453 bp, Glycine max
  Peptide Sequence Number=SeqID_152774
atgactttgaatcaaacacgacgtcaatatccagcatcaaattcgtcaaggacctttcaccgtctccatgaagcaagtgtcgttgatggaagttacgacgccgtcgaagatttgctcacagagcttcttctcgctcgcaaagagagttctaacccagaccttggcgacttttatcccgcgtctgattttgttctcgagctgctcctactcgaggcgctgaatgtctccgatgttgagcttttcgatgtggagcttgcgaaagctcgtgtccacaaaggattttcgcacgctatcgtagacctagatgcactcgcagaggtaaccggagaagagcttgcgctcagtgatgcagcggaggtcatagacggcgttgaagggaatcaaatcaatctcgtggatgctgctagtggaacggtaactgctgttgttaatggagttgcggagatgatataa

SEQ ID NO: 35997 - DNA, 1560 bp, Glycine max
  Peptide Sequence Number=SeqID_152775
atggcgattaagctctccgcatcagaaaaccgtgagaaccaagctccaaatgaatggccagaagagtctccacgggccaacggttcccattccgaaacacttttcgcacgcgccccatcgccatcaccatcaccaacaacaatacttcaccaacgaagactctcactcttctcacacttcgatgcgcttcttcaaaactcatgccgaaacgctcgccacctccttcaaatgcaagccctcctcgtcacttccagcctcttccgcaaccccttcttggcacgcaccgttttgagccgcgcctcacacttatgcaacttcgcttacacccttttgatctttcgaaccatcaattccctcggcacgttctgcgttaacactgtgatcaagtcgtattgtaacagccacgctccccgcgaagcgattgtgttctacttccgctctttgatgtgtgggtttttccccaacagctacaccttcgtgccactcgttgcttcatgtgccaaaatgggttgcattgattccgggaaggagtgtcatgctcaggccacgaagaatggggttgactctgttttgccggtgcagaactctttgattcacatgtatgcttgttgcggggatgttcagcttgctagggtgttgtttgatggaatgttgagtagggatttggtttcgcggaactcgatcattgatgggattatgatggttggtgagttgaatgctgcacaccgactgcttaatgaaatgcctgataggaatttggttacttggaatgtcatgataagtgggtatttgaagggtaggaatcctggttatgcgatgaagttgtttcgtgaaatgggccggttgggattgaggggagatgctaggactatggaagggaagtcggtttatgggagcatcgttaggatgttggtgaggtcaagtttgattcttgatacggtgttgattgatatgtactgtaagtgcagaaaggtggaggatgcgcggagagtgtttgagaggatgggagaaaggaatttggtctcttggaatgcgatgatcttggggcactgcattcgtgggagtcctgaagatggactcggcctgtttgatgtaatgattgggatggggaagatgaaatatggagttgagagtgacgagactccaaggttgctccctgatgaaatgttggctgaggggaggtctttcttcaaacagatgactgatgcgtttggtgtgaagcccaattatgctcatttttggtgcatggcaaaccttcttgcaaatttggggcttgttggcgaggcagaagagtttctgaggagcatagcagagtttgatggcgatatgtcacgtgagtcattggcatgggcaagtttgcttggtttgtgtcatttcaagagggatgcatacttgggggaacggattgctaagattctaattgaaatggatcctaagaaccgcgcctgttaccagtttttactgatcatttatgccgtgtccgctcaatggcagaatgtttctggagtgcaaaaactgattaaggaaagaaggctggggataatagctagaagcagtctt

SEQ ID NO: 35998 - DNA, 372 bp, Glycine max
  Peptide Sequence Number=SeqID_152776
atgcagccattaacggagacgcgaagcttacctcaacgatggaacaacaaaatggagttgcaagtcctcaatgctaacaatgaaccacccaatgcgcgacaaacgaacttccatggaaagcaaacggcgccgacaggagaggaagctcgaacgtcatcacaaaaacaaccaaacgacatagggaagaggaacatttgtatagcacaccacaaaaaatggaatcgtgaaactggactcgacacatatcctaaagaacgtgcgcccacaatgcgactaattcattctttcttcgttgataagaaaaacgaagccatgcactggccagatagagaacaagaatgctttccccaggtcaatccttaccaagtttag

SEQ ID NO: 35999 - DNA, 429 bp, Glycine max
  Peptide Sequence Number=SeqID_152777
atgggacactctcaacaaaaggtatgccaacaagactcgtgccaaatcatgtatatgaaagaacgcctcactcatttcaccaaaggctctcgatccacgattgattatctccatggaataaaatccatggttgatgaattagccatcatcaatgctccattaggtgatgtagaccttgtcattcataccctaaatgggctaggagttaagtacaaggagtttgagagttatttcaagagagatgacaacaacaatgatacctcatttgttgccactgctcatgcaacacacaagggtgccgcttgggtggaagtgaaagtgttaccagtgggtggtagttgttgtggtggttggttcgtcgtcaaaggtacactaggtacgcgagttggtgacgctggtttccctgagtgggttgatccgtatgtttaa

SEQ ID NO: 36000 - DNA, 702 bp, Glycine max
  Peptide Sequence Number=SeqID_152778
atggatgaaagtcatcaacaaaaagattctatggttggacctgaagataatcctcttcaacaggccaatagaaatactcattatgaggagcaagcagaagcaaacaataattacatcacaaaagatcccttggaaatcctacagcacgtaaaggttgataatgttcctcaatctccaatatcaacaattaaaaaagcttttactgattccagtgataatgaattgagcttcagcaaagaagagctgagaaaagttaaagagcaactgagacttgtgtttgttgagttctatcaaaaactcctccatctcaaagattacagttttatgaacctctcagcattttccaagatcatgaagaagtacgaaaagcatacatcaagggcagcatctgcagcatacatgacagtagtggataactcctatgtgggcagttctgatgaggttaactttctattggagaaagtggagtctaccttcatcagaaactttacacactcaaatcacaaaaaggggaggaagctattaaggcaaaaaacaaaaacagaaaggcacaacacaacatttttcacgggggcaagtggtaacgagaaagaacaactcaccagtgacgacgacgttggggtgatactccggcgaaaggcggcgagggagctgaggctacgattccacggcggcggcgggggaggttcttcgaacctttaa

SEQ ID NO: 36001 - DNA, 336 bp, Glycine max
  Peptide Sequence Number=SeqID_152779
atgctgaacaccacaaagcacaccacgagcatgcccagcaagaaggcgatcagtgccggcggggtgttgtatggcgctgcggccgatgatgacgacatatcgtactccgatgaagacacagttcttcgtagtgggttgtttgcatggatgagaggacaaaatgtaaagagagattcaaggagctatgccaatggttttctacgagtggtagatagtgggtcaatatatgaggacagtgatgcggaggatgggaagggttgcttatgtgccagtccttatgagaaggacgagaggactagtgtccgaacattatttgttgtgtatatgaaggcttga

SEQ ID NO: 36002 - DNA, 825 bp, Glycine max
  Peptide Sequence Number=SeqID_152780
atgtgcaagtattgcttctctggtgtgatcaacacctgggcttcccagcctatcatttcgagctccctcattcgccttacaccgtttcggtcccctcctcgaggcctcgacccaaagcttctccaggttttccccaccttcccttacgcctctattaaagaccttagcaaggatcaaaagtacgacctcgaatgtgcaatttgcttgttggagttcgaggatgataacatggttcgcctcttgacgctctgttgccacgtcttccaccaggattgcattgatctctggctccgctcgcacaagacctgccccgtttgtcgacgacacctcgattcgcccccgaatgaaatagagaaagtcgtggacgttaacgagggtgtggtggtcacgtccacgagcagggagatacatattgatgtaacagaagggaaattggatggttgtggcgatgatgatgatgatgatacaagtggtggaaataaaaaacaagaacatgaacatggtcatgagaatcatgaggtgatcactcatcaacaagggggaaaaacatttgcacggtcacattcgacggggcactcgatagttttgataagaagagatggaaataaggaaaaaaatgatcatgagaagtatacgttgatattgccggagcatgttttgagagagaggcataataataagcacaattgtacaaggagttgtgtgagttacaaggacatggccatgcttgttgctcctcttcctgttgcaccttatagtaattgtggctttgttcaaccagtttcgccagctggcacctcctcccctgaccatactcggaaataa

SEQ ID NO: 36003 - DNA, 762 bp, Glycine max
  Peptide Sequence Number=SeqID_152781
ggctgcacgccctcgcccattagaggactacacgtcctcgccatcacatggctgcacgccctcaccatcaaggaactacacgtcctcgccttcaaagggctgcacgccctcgcttttagaggactacatgtcctcgccataaggggactacacgtccgcgcctttagagggctgcacgccctcactttaggaggattacacgtcctcaccatcagagggctgcacgccctcgccatcacaaggctgcacgtcctcgccttcaaagggcaacacgtccaaacctttagaggactacacgtcctccccatcaaagggctgcacccctcgccatcagaggactacacgccctcacctttagagaattacacaggactacacgtcctcgccatcagagggctgcacgtcctggccattagagggcagcacgccctcgccttcagaggactacacgtcctcgccattagagggttgcaagccctcacctttagaggattacacgtcctcgccattagtggatttcaggtcctcgccatcaaagggctgcatgccctcaccttcaaagaactacacgtcctcgccttcagagggttgcacgccctcactttcagaggactacacatcctcgtcttcagaggactacacgtcctcgccatcagagggctgcacgccctcgccattagaggactacacgtcctcgccatcacatggctgcacgccctcaccttcagaggactacacgtcctcgcaatcagagaactacat

SEQ ID NO: 36004 - DNA, 348 bp, Glycine max
  Peptide Sequence Number=SeqID_152782
atgactcctactcatgatgccctgttatatttcaacgggagttggaacatgccacgccaacacgactttgtgggttactcattcacaagaaaaaatccaaaaagatttgacattccttcgggatgtagcatcgatggactaaaggatgtgattaagaaagttgcacttcaagggattcccccttatggtattcatgaatcacaaatgctgaaaattgacgatgacatgttgaaggtcttagtacagtctaattactggaaacaatttggcccaatagaaattttagctgtttttagtaaactagtaatcataatggaagacaacatgtctcgattgcaacatgattaa

SEQ ID NO: 36005 - DNA, 1821 bp, Glycine max
  Peptide Sequence Number=SeqID_152783
atgtcgagtatcactttcttccagcatctctctagagctttccgtgataaccagtcgcatcttaagcttgtactgctctgcaccgccgtaagtggtggtggtctttgggcttatggtgagagtgttgccccagaagaggcagttagcgagaagaagaaggtggtggtgctgggaactggttgggcggccacaagttttatgaagaatttgaagaatccaaaatatgaggttcaagtagtatcgcctcgtaactactttgcattcactcctttgctgcctagcgttacgtgcgggaccgtcgaagcgcgcagcattgttgagccagttcgcaatatttttaagaaaaaggtggacgtacaattcagtgaagcagaatgtttcaagattgatgcagaaaataggaaagtttactgtcgatctagtgtgaacaataatttgaatgggaaagaagaatttgttgtggattatgactacctaatagttgcggtgggtgctaatgtcaatacatttaatactccaggagtgacggagaattgccatttcttgaaggaagttgaagatgctaaaaaaattagaagaacagttattgactgcttcgagagagcaaatttgcccgatgtaagtgaagatgagaagaagagaattcttcattttgctattgttggaggtggacctactggagtagagtttgcagcctcacttcatgattttgtcaatgaggatttgctccgtttatatcctgggattaaagatttagttaaaattacacttctggaggccggagatcatatcttgggcatgtttgacaagagaattactacttttgctgaagacaagtttcgaagagacgggattgatgtgaaaacaggatccatggttgttaaggtatccgagaaagaaatttccactaaagaactgaaaaacggaggagagattaagacaattccgtatggaatggctgtctggtcaactggtattggcactcgtccatttattaaagatttcatggcacaaatcggtcaggctagcaggcgtgctctagctacagacgagtggttgagagttgaagggtgcagcaatgtctatgcgcttggtgactgtgccacgataaaccagcggaaagtcatggaagatatcgtggcgatctttaagaaggctgacaaagagagttccggaacacttacggtcaaacaatttcaagaggtcatgaaagatatctgtgaaagataccctcaggttgagctatatctgaagaataaacagatgcacaacattgctgatttattgaaggaagccaagggagatgataaaaaagaatcaattgaactgaatattgaagaactcaaaactgcactttccaaagtggattctcaaatgaaatttcttcctgctacagcacaggttcatgccataatttgcttgtggcattcacaacggttgcatctcagcaaggcacttacctggccaagtgttttaatcggatggaagagtgtgaaaaaaatcctgagggtcctctcaggttcaggggagaaggtcaccatcggttcaaaccctttaggttttccattcgccaatgtttttactcattcgcacattgttgattgttccccaaggtacaagcatttaggtcaatttgctcctttgggaggagagcagacagctgcccagcttcctggagattgggtttcaattggccatagcagtcaatggctgtggtattctgtctatgcaagcaagcaagtaagctggcgtactagagcgttagtagtttcagactggacaagacgttttatttttggaagggactcaagtagcatctga

SEQ ID NO: 36006 - DNA, 612 bp, Glycine max
  Peptide Sequence Number=SeqID_152784
atgggaatagacttattggcgggagttgaggcagttataagtcatctagtggtgaaggagttccaaattccttgtgcacatgctcctgcaatgtctccacttcccatgagcctatctcttagtccaaaatcagcagctgaggagtgtagatttggtaattatggagttgataatttatgccaaatcaaatcgattgggtataccttcctaccatgtgtgcttgctggcctgagtaatgctccacaatacttggtcatggactccaaatgcttggaaaaaggttgcatattggcaagtgatgtggattctgtaatccttcccaaagatgcttgtggaggggatgcatctcttgcttttgctagaaataaaaacaaaaagccacttataattactgtggaagaaaatcaaactgttcttgatgacactgcagataaatttggtcttgaagtgctgcatgtatcaaattattgggaggctattggagtgattgcagctcacaaggcagggatagatccattttcacttagacgagataaaattctcaacattgggtgcagttcttttatgcccatcaatggtcactccattccaagagaaagagttgtttcatga

SEQ ID NO: 36007 - DNA, 528 bp, Glycine max
  Peptide Sequence Number=SeqID_152785
atgattagaatcgaagcattgcgttgggccttagatagagttttaggaagagtcttaggtggacaaattactgatgatgagaaagaagtccctcagtgtcgaaggctaacaacatttgcatgtagacaacagacaactgtagctgttgctaaaaatgttgaccatgtggatcatgcagctgatgagcttcatgagcagcctcgggagctagttacagatcatgaacatactgagttaaagttaacctttcatgggaggaaggtagggaaatttggaaggtctgcacttgagattgaaggcatagtgacagctactgaattaagttctctgattatatgtttgttggagacaagtgctttccatacctttgatgctattgatgtagacaaagtcgtggatttgttaattgagttgcttgaagccaatacacaagaagcaagagatgagattgagcaatgcaaatgggcatatgtttgcctagcctcactcagagacatttatcgtagcaaatatgacacaagacaatga

SEQ ID NO: 36008 - DNA, 231 bp, Glycine max
  Peptide Sequence Number=SeqID_152786
atggatggatcaaagggacatgggtattttggtcaatgtggtgggaatagggcaactcaatctgtaggatgtttttgtttggaaagaagggggacaatgcaggtccagagagaaagggagggttcagagcaagcaatggtgaatttgtctatactcaaggtgattttggatatgcgacataaaaggtatgcaaattatggatcaacaaaaagacaagggagatttatataa

SEQ ID NO: 36009 - DNA, 288 bp, Glycine max
  Peptide Sequence Number=SeqID_152787
atggctgcgataaatgatggtggtgagcatagcggagcgcatatgcagcagaatggttacattccagatacagcgaacgcgatagcccagtatttcaacaaagcatcgttaccttctcagcaggagacgctgggcgaaatcgtgatggacattctcaccgaagggcggcatttaaaccgcaaagcgctttgcaccaagttactgagccgtcttgacgtcgcacgagccccggaagaagaaaatcattatcaaacgttgattggcctgctgtttgagcgtcaggagtaa

SEQ ID NO: 36010 - DNA, 518 bp, Glycine max
  Peptide Sequence Number=SeqID_152788
aggactacacgtcctcgccttcatagggctgcagatttgcgccttcagagaactcaaggtcctccgcccttaatggttaatcgaggcctgcgctcccggccaaagagggaggctatcgtgaaactactatgcataccagggcaagatttcacccagccgctgcaaggagacgagtatggatcatgcacaccaccacaactccgatctccccctgctggagtgtcagttgggatcgtgcccacaagacaccctgtggacgtggagaagtccaacatggccctagggtttctagctttggttgtgggcctctgtcagtcctaccgggtgctcgtccccccagcaaggtcatgccatcgtgacatagggatcgcgcctataagacactcagtgggcccggagaagtccagcagggtcctggggtttccagctctgactacgagcctttctcagttctacggagtgcccgttgcccctaacaaggtcatcaggcctcctactaatcgagctttcatcaggaa

SEQ ID NO: 36011 - DNA, 642 bp, Glycine max
  Peptide Sequence Number=SeqID_152789
gatgaccctaacaaaactccagcttcagcacgacacaaaagaggatgtaattgcaagaaatcaagctgcctaaagaaatattgtgaatgttatcagggtggtgttggttgctccataagctgtagatgtgaaggatgcaagaacacatatggtagaaaggatggttctgttccttctggattagaagccgagcccgaagaagaaacagaagcatgcgaaaagggtgtggtggaaaatgcttccctgaaaactgaaacaaagaataccgaagaccatccggaccaatctcttgctacaacaccattaccactttccagatcattgcttccattatccttttcatcaaagtgtaagccaccaagatcttctgttattaccatctccagttccggattgcttgtggggcaaaagcttgggaaatcaaatgctccgtggtctcaatctcaacctaaatgtgaaaagcctttggaaactgttccagatgatgactcttctgtcacctgcatcaaaacttcttctcccaatggcaagaggatctcctctcctaattgtaaggtgggatcatcacctactcgcagaggtgggaggaagttgatattacaatctatctcttcatttccttctctcacccctcaccattag

SEQ ID NO: 36012 - DNA, 5415 bp, Glycine max
  Peptide Sequence Number=SeqID_152790
atggcaaccttgttacattcggagtcaaggcgcttatactcttggtggtgggacagccacattagcccaaagaattcaaaatggcttcaggagaaccttacagacatggatgccaaagtaaaagcaatgatcaagcttattgaagaggatgcagactcatttgcaagaagggcagagatgtactataagaagcggccagaactcatgaaattagttgaggaattctaccgagcatatcgtgcattagcagagaggtacgatcatgcgacaggggagctctgccaagcccataaaaccatggcagaagcatttcccaacttgctgactgatgattcaccatgtaattcttcagacactggagctgagccaccgcacacaccagaaatgccacatggcccacatccaattcgtgcattattggactcagttaacctacagaaagattcatttgggttttctttaatccaaaatactttaaaaatgaatggagagagtttagaagaatctgcaaatggtctaagccgaaagggtctgaagcagctaaatgaaatttttgggttgtctcaattatcagctgaaaaacagaatgtgaaggcccagaatcatgctgagtctgagcgttcacagaaagcagaaaacgaagttcaaaccttaaagaaagtactggaagatatacagtctgacaaggattctatctttcttcaacatcagaagagtttggagaagttatctgaaatggaaagagagcttaataaggcacaaaaagatgctggaggccttgatgaacgagcaagcaaagctgaaatcgaaatcacagtattgaaagaagccctagcagagcttaaatatgagaaggatgccggtctagttcagtacaagcagtgtgtggaaaggatagctagtctggagactatgttatctctggcccagatggatgcaaagggaaatgatgaaagggctgccaaagcagaaactgaagctaaaaatctcaaaaaagaacttgccacattggaggctgagaaggatgctgctcatcttcaatataaccaatgtcttgaaaagatatctgttttggaggctaagatcgcccatgctgacgagtattccaggaagttaaatgagcaaattgaaagaacagagctggaagtcaaatcattgaggaaagatattgctgagctgaatggagagaaagaagctgtaactgtcctgtacaagcagtgcttgcagaaaatatctacattggagagtgaaattttgcttgcccaagaaatatctgaacgactaaatagagaaattgaaagtggggctgaaaaactaaagactgctgaaaaacattgtgatatgttggagaaatcaaatcggtctcttcagctagaggctgatgttctattgcagaagatttctttgaaagatgaaaagcttttagagaagcataccgagttagagagactgcagactctgatgcatgcggagaagtctcgttttcttcatattgaatctactctgcatactctacagaagtcatactctcaatcacatgaggagcaaagatctcttgctttggagcttaaacatggccttcagctattggaggacttggagctttcaaaacaaagttttaaggaagaaatgcaacagattatggaagaaaacaggactttgcatgaacttaacttctcttccaccaggtcattgaaaaatcagcaaatggaaatttctgagctgaagaagatcaaagagaaacttgaacgagagtttgctgtaaaagttgaagaaagtaatgtcctccaatgggaatctcatcaaataaaggatgaaatcctgggcttgaataatagataccaggctatactggaagaactaggctctgtgggtttgaatcctaaatcttttgcagcatctgtgaaggatttacagaaggagaatacaatgataaaggaggcttgcaaaatggagcgagatgagaaagaagctctgcatgaaaagtcaaaggatatggataagcttttgagtgaaaatgcctatatgggatcttccctgtcaaatttgaaggatgagctgcatggattaagggatacagtgaagaaatttcaagaatcctgtggtgttctgcgggaagaaaaatccattcttgctgctgaaaaatcatctttactttcacagttacaaattatcactgaaagtatgcagaatctattggaaaagaataccttgctggagaagtccctttctgatgcaaaaattgagcttgaaggtttaagggctaaatcaagtagcttggaggaattttgcaatttactgaataatgaaaagcacaatcttctgaatgaaagaaatgtcctggtatctcaattggagggtgttgaagcaaaactaggtaacctggaaaaaaggtttacaaagttagaagaaaaatattctgatatggagaaagacaaagaaagccaagtctgtcaagtagaagaacttcatgctttgcttttggcccaaaaagaaaagcatgctaatcataaacattcaagtgaagctcgaatggccaatttggagaatcttgttcttcggttacaggaagaacgccgattagggaagatagaatttgaagaagaacttgataaagctgttaatgctcaggttgagatgtttattttgcaaaagtgtgttgaagacttggagcagaagaacttgggtttattaattgaatgtcaaaaacacatggaggcatcaaaattttctgatgaagttatctctgagttggagagtgaaaaccttatgcaacagatggagctagagttcttgttagacgaaatcagaaagttcaaaatggggattcatcaagttcttgcagctcttcagattgattcaggtggggggcatggcaaagggatcaagcaagaggaaatgcctatatcgcatattttcaataatattgagggcttgaaaggctctcttgtgaaaacccaagaggagaagctgcagctacttgtagagaattctatcctcctaactgtacttttgcaacaagaatccgagggagaagaactggtgttagagaaaaggatcctagagcaagagtttgaaaatacaagagagcagcatgcaatgttgcagaaggttaagcttgaacttctggagatgaacaagcaacttaggtctgaagtgaccaagggagaagaaaaggagagtgaattacagcccaaattggaagcccttcaggtggagttgatagatttgcaaagaactaatctagtgtttgaggaagaaaattgtaagctacttgaggagaaaaatttactacttgggagtgttttggagctcaaagatgcaaagtttgctgctgaacaagagaatagtgtaatcctccatgaggcactggctctaaaaaaccttagtttggtctatgagagctttttcactgagaaggtcttggaacagcgtgcacttgctgaacatctcagcgatcttcactctgtgaacagtgaccttaaacaggagcttgttctattaagggagaagtttgaggtgaaagaatctgaaaatgtttatttgaaggagtcagttgagaggatggacaaagatctgcatgaagccaaaactgaaaatgaccatttcaattgtcagattgagagttcagagcatcttcttgagaagaagaacgtggaactgttagaaatggagggaaggctaaaggctgcagaaatgttgagtgcagagttttgcagagatattgagaaattgaagatggaaaaacaacaatcaagactgatcaacgaaaatcttgaaaggcagattcttgaactatcagaaggttgcatgaatcacaaaagagaaattgagcaccttaatgaagcaaacagaagtttacagtcagagatgagatgcttacgtcaagaagttgaacaacagagggctagggaggaaacattgagttcagagctgctggataaaacaaacgaatttgaactttgggaggctgaggctgctacattctattttgatcttcagatttcctccattagtgaagcgttgttggaaaataaggtgaacgagcttactggagtatgcatgaggcttgaagatgaaagtgatgcaaaaagcttggagattaaacagatgacagaaagagtcagtctacttgaaagtgaaattggaggactgaaagggcagttatctgcatataatccagtcattagtttattgaaagaggattttgcttctttagaacacactgccctagttcggataaacaaaatgcctgttgaatgcaatcaagaacaaaatgatgcagtaattgaaacttgtctccaaggaaatggctatcaaagttcaacagataacaaaagcgctttgataccagatggggtttcagatttgcttagtgtgaaggcaaggattagagcagttgaaaaatcaatggtggaagaaattgagaggcatgtgaaggaacaaaatctaaccactacagctaacctaggagctctgacaaaggtgccaaatgtggagaatcgcaacagaaaagaactcaaggatgagagcacacatgatgtcaactcgtggagaacaagaactgaaaatgggtcattgatgaaagatattccacttgatcacatctcagacaattcagcctccaaaagcggcaggagagagaatagtggtgctgatgatcagatgcttgaattatgggaaactgccgagcaagactgctttgatagtcccatggttagtgaagcaatgaaacaaagttctgttccaaccgaggatgttattacataccatcagtcagatcattcaggtaaattccaaaatacctcctcagaattggatgtggaaaaggaattgggtgttgacaggcttcagctgtcgagaagtataaaagagagaactcaagatggcaagaggagaaagatactggagaggctttcttccgatgcgcagaaactgaccgttctcaagacagccgtgcaagatttaaaacagaaaacggagaccaagaagagaagcaagaagggagctggcactgaatatgaaacagtcaaaagacaaatagacgaagttgagggagctgttgtgaaattagtagatactaatgatcaactgacaaaggatcttgaagagagcgccccgtctctgaacaggcagacttcggttgagttggaaaagagtagacacatccagagaaaaagaataaccgagcaggcacgaaaaggttctgaacagataggaaggttgcagtttgaggtgcagaacatccaatacactttgctgaaattggctgatgagagcaaagggaagagcagattcactggaaaaacagtggtcttgcttagggactttattcacagtggcagcaagagaactagcaaaaagcgcaacaaggggttctgtggatgctcaaggccttcaactgatgagcactaa

SEQ ID NO: 36013 - DNA, 1419 bp, Glycine max
  Peptide Sequence Number=SeqID_152791
atggacacgccagataggagcaagatcaacacccctctttcccaatttgaggattcgcctgtatttaactatatcagtaatctatctcctatagagcccgttaaatcagttcaccttactcatacattcaactcatatagcttttcatcacctccatcggttttcacatcaccccatggcaactgtcacaaggaatccagattcctcaagaggcataaccttttggagacatccaaacctaaggtttggtctgaagatgtaaatagtgtttattcatctgaagagactcttgcagattcaactcaagcatgtcatgaatcaagtgagcaacaggaaaatactgctcaaaagatttccattggagatgcctcaattgagccatgtaacgaaaacccaaatatctcaattgagcttccacaagtcttaaaatgtaatttgggtagccctgggtatgaacctctactctgctgtgatgaggctaactctcttttggaattacccggcaatggcaagccagcatcagatgttgcttatgttccagaaggctctgaaaaagattcaattgagggtgagatgcatcttctggggttatgtcagattgaggaggcaaaagttgaaggcccaaattgtggtgtggatagtttaattactgaagtctctgatctgttaatgcttagccccccaaatgtgacagaagcttttaagggtttaaataaacaattaaatccttcaatagagcttggcaatttcatgactttgataccacaatctgccaccaatgatggtcaacaaatgcacattggtaatgcagttgcttctggttcagaacatgaaattgaagatcatccttctgaatcagcagctgccacaggcacaggtcagagacaggacaatcttgccaatgttgctttggtggctagccatccaagtgaaaatatggataataagcttgtttatgcgagacaccgtggtatacgaagacgctgtctagattttgagatggccattgtgcaatggaagaacccagctgataattcaaacaccaactcaagtacagcaatatctgatgaggggaatgttggtaatgaaaagcaactgcttcccacaaaacacagtggggattcacggaggtgtgttttgccaggaattggtttgcacttgaatgcacttgcaagcttaaaggattgcaaaaatgtaaaaattgaaaatttgtcatctggaaggcaacctaatctgcactgctctccttcatctgtgcaactctctgcaagccaagaacttcaactatcattggtacctgcatcgtcagaaatagatttggtgccatcagagaatgaggttcagcctggtgaagatttccagcagaatagcccaaaaaagaaaaggcaagtacaattgctgattatcaattctgcttga

SEQ ID NO: 36014 - DNA, 1962 bp, Glycine max
  Peptide Sequence Number=SeqID_152792
atgtcttacctcattaagttctctatgtatcccttcttggagtgtaacataatgcagtacctgagtggaaacaagagatatttgatgcttagaaatataaggagagccgcccaatctgtttgtagaatcaatagaagatacttggaggtgagtgaaaatggggcagttgccttagttggaccgaatatccaccactgccggttgtacatgcaatataagtttccaagtgaagcatgcagttcattcttgtggcatgggacaagggaaggctttcgtaaatgtggttctttcaggaacttttccgtaacctcagcaagtaatgcagtcacacatcattcccagattgcttggaaaaggctgtacagaaagtattgttccagtggtgatggtacatttcctcccaccgtaaatatgattgctcaggcagtaagcttggctttggctcgttcttattttctagttcctggtattttggcatttacatggggagagcttgcattagctcagcgaaattgggcagaagcagaacgttacccatcacaaaatggtttgtatatgcgcgcacaagatgggtataattacatgtttacatttacattcataatagttgaaggacttatcttattaatgagggctctctatctagcaatattattctctcctagcattgtgatggcaccatttgctgattgttttggaccaaactttaggaaactgtggctcaatgtagttcatcgcacactagaaaaatcaggtccagcattcataaaatggggtcagtgggcagctacacggcctgatctctttcctcgagatctgtgcactaagctttcagaacttcataccaaagctcctgagcatagtttcagctacacaaagaaaactatagaaagagcatttggtcgaaaaatttcagaaatttttgacaattttgaagaacttcctgttgcatctggaagtattgctcaagtgcaccgtgcttcattaaaatgtcgttatcctggtcagcaagcaaagccactattggttgcagttaaggttagacatcctggcgtgggagagtcaatcagacgggattttgctattattaatttggcggcaaaaatttcaaagttcattcctgctcttaattggttacgattagatgagagtgtacaacaatttgcggttttcatgatgtctcaagttgaccttgctagggaagctgcccatttgagtcgcttcatttataatttccgcagatggaaggatgtttcttttcccaagcctgtctatccacttgtgcacccggctgttctggtggaaacatatgaaaagggtgaaagtgtctcatattatgttgatgatcttcaaggacatgaacgggttaaatccgctcttgctcacattgggactcatgcacttttgaaaatgcttctggtggacaacttcattcatgcagatatgcatcctggaaatatccttgttcgagtgtctcagagcaagtctcgcaaacggctcttcaaatcaaagcctcatgtagttttccttgatgtaggcatgactgctgaactctctggtagtgatagagtaaatttactggaattttttaaagctgttgcccgccgagatggccggactgctgcagaatgtgccctcaacttgtcaaagcaacagaactgtccaaatccggaggccttcatagaggaggtggaagagtcgtttactttttggggcaccccagaaggtgatattgttcatcctgcagagtgcatggagcaattacttgagaaagttaggcgtcatagagttaatattgatggcaatgtttgtactgttatggtgacaaccttggttcttgagggttggcagagaaagcttgatcctgggtacaatgtgatgcagacactgcagacattgctacttagagctgattgggcaaagtctctttcttacacaattgacggactcatggccccttag

SEQ ID NO: 36015 - DNA, 1107 bp, Glycine max
  Peptide Sequence Number=SeqID_152793
atgggaagagcaccttgttgtgacaagaatggtctcaagaaagggccatggacaaccgaggaggaccagaaactcattgattacattcagaaaaatggatatggcaattggaggacactcccaaagaatgctgggttgcaaagatgtggaaagagttgccgtctccgttggacaaactatctccggccagatataaagcgaggtcggttttcatttgaggaggaagagacaataattcaactacatagcattcttggaaacaagtggtctgcgattgcatctcgcttaccaggaaggacagacaatgaaataaagaactattggaacactcacattagaaaaaggcttctgagaatgggaattgaccctgtgacacacagtcctcgacttgatctattggacatcaattccattctaaacgcatctttctatggttcatcacaaatcaacatccaaagactccttggcatgcaccagtacatggtgaaccctgagcttttaaaattggcttcttcactcttctccacctcacagcagcaacacaatgaccctgatgacatgcctgctcaaaaaggtcaattacagaaccagctttgtgatcctcaaattcagaatcatgttccacactttgtccaatttcaagatccggttcaagaggtgcctgcatgcagcaccatgttcagcaccccttgtgtttcaattcctctaactcaaccacagttggttgagccaaataatgtggaccaatatccatcgtcaactttcacagacttcagttaccaacaactaagtgattggcaactatcaagcttaacagatgattatgtccctcaattatcaagctataattattatagttctgatggtcaaaatctcatgtatgatccattgtccgagccttcaaattttcattccaataacagcaatcagaacttcaggttcgcttcagttctatcgacaccttcgtcaagccctacaccgctgaattcgaactccacgataatcaatgggagcaacacagaagacgagagagatcaaagctatgacagtagtaacatgttgaaatttgaaatcccagatattttagatgtgaatgagttcatgtaa

SEQ ID NO: 36016 - DNA, 1005 bp, Glycine max
  Peptide Sequence Number=SeqID_152794
atggcgatggatatcctgcgttcacctgtctccgccgtccgattatttaacggtggcgcaactcgtagtcgtcgcttcaacgtaagggcgaccctgccatttccgcagcaaaacgcaaagcattacaaagagcttcaagccgctattgacgttgttcagagggcttgccgtctctgtcttaatgtcaaatcatccttgttctcaactgatggaaaggttcttgagaaaaatgaccagactcctgttactgtggcagattttggagttcaagcactcataagtttcgggattgaaaattttggttttatatcttatgtggttgtcaaaacagagttaaataagctgttcccttctatacctttggtggctgaagaggactctgctttcttgcgaacaagaaacttggcaggtactgtgcttgatgcagtaactgatacagctagctccacttgtaaaccattgacacaagatgatgtactcgaagcaattgatagagggggcaaggatgctttcgtatttggatcaaagccggccacatattgggtgcttgacccaattgatggcacacgtggttttctaaaggctggcaaagccttatatgtggttggtttggctcttgtggttgaaggagagattgtaattggtgttatgggctgccctaactggaaggaagatttatctgagaaatcctctgttgagattgaggagggttgggattctcttggtggatcaggaactgtaatgattgctcataaaggctgtggaacatggatgaaaagtttgaatagccaactcaaatcatctggtgcatgggaccatgctgttggcattatatgtgttcatgaagctggtgggaaggtaacagactggaaaggcagcgacatagatcttgcagcggatcatgttggccggcggattatatttccctctggcggtgtccttgttgccaacggcaatttacataataagattttgcagattatcaatcagacttcaagagtttga

SEQ ID NO: 36017 - DNA, 648 bp, Glycine max
  Peptide Sequence Number=SeqID_152795
atggggaaaaaatcgagtccggcggagggggaagaagcggtgccggagcatctgcggtgcagccgtacggacgggcggcaatggcggtgccggcggcgagtgaaggaaaacctaaagctgtgcgagattcactacgtgcaagctcggcgtcggcagcacaagaagacgctgaagcttaagagaaagaggcaaaacgacgccgttgaggttcagattggggccaagcgggaccgaaaatcgagagaggcattggtcaataggaggaaccaattggagctcataaggatggttctgcagagggaggttgagaagaagaagaagaagcaatcgcaattgaatttgaatttgcatttgcatttcaatcacgagttgaagaaggaactgccgaatggggttatggctattgcgtccaatatggcatcttctcgttacttcaggtccaagaatgctgagaggggctctgttagttgtgcagtgtggacaaagcataaagaaggggaggaggaagaagtgtcattggtgtcagagaaccatagtccatttgtgaagggaggcctgttatggtggtgccataggctgcaatggcgtgtttatatggcagaattttggcctttcaccataactgccattgttaacattggttcatag

SEQ ID NO: 36018 - DNA, 2094 bp, Glycine max
  Peptide Sequence Number=SeqID_152796
atgaggttaagatggcatgtccagtttgtcgaggaacttgcacctgtaaagattgcttgtcaagtcaatacgaagagagtgaaagaatatttggctggtaaaaacagagttgataggatattgcattttcattatttggtctgtatgctccttcctgtactaaaacaaataaaagaagaccatcatgtaggcgtagaaaaaacagcaaaaatcaaaggtggtaactatggttcttctgatatgatggcttctagattacaacctgggaaaagaacttctgatattatcatcaagcctgtcgattttgtctgcaacgagaaaaattactgcaattactgcaaaacacccattttggatcttcatagaagctgccttagttgttcctacagtctttgcttaagctgttctcaggcattaagtcaaggaagcacctctgaagaaatcaactcttctatatccaacctacctgacaaaataaatgcatgcatttttagtgaaggtcaccttttggatgataaggtcatttctaatggcaatttaactgatacctcaacattagttgagtggacaaattgtaatggtgctgacattgtgtcatgcccacctacaaagcttggtgattgtggtgatagccaccttgatttgaaatatgtctttcccttaagttggatcaaagaaatggaagtaaaggcagaagaaatagtttgcagctatgactttcctgaaactttggatagaagttcaagctgctcactgtgtgttgacaaagatcataaaactagcagatacaagcagttaccagaagcagctcaaagagaagattctaatgataatttcttgttttatcctacaattttggacatcagttgcaatcattttgaacactttcggaaacactggggaataggccatcctgtagtagtgcgagatgtgctccaaagtatgccaaaccttagttgggatccactggtcatgttctgtacttatcttgagaggagcatgacaagatatgagaataataaggacttacttgaagcttgtttggattggtttgaggtggagattaacgttagtcagtactttactgggtctcttaaatgtcaacctcagaaaaataattggcatgagatgctgaaacttaaaggatggttgtcttcccaactattcaaagaacaatttccagctcattttgctgaagtaattgattctcttccaattcaagaatacatgaatccctggtctggtcttctgaatttagctgcaaatttgccacaggggagtacaaaacatgacataggacctcatgtttatatttcatatggctgtgctgatgaagaagctgattccgtgacaaatctttgttacgactcatatgatatggttaatattatggcacataccatggacatccctctctctacagatcagcttgctaaaataagtaagttgttgaaaaaacacaaaactctatgtcagaaggtgtcatcatctaaaactactagtgagcattcagaagacagggaacaaaatgaaatgcatggtatggtaagagaaggaactgactttctaaggagagtcaatagaacagcttccatctctactgaagccaaaccgatatctaatcagaagttagacaccaatatttctgatgatgaagaatgtggttccgattctgaaactgaaaaggcacaaagctctttacctttccaaaggagagttctaagcactgaaatgtctccagatcataatcctagaaatccctttgaaaactcaaacagtgataaaaggaagaagtttactgagaattctggtgctcattgggatgtctttcgaagacaggatgtgcccaagctcttagaatacctcaaaagacactctgatgaattttcttataatagtgaatgtcacgagaagatggttcatccaattctggatcagagcttctttcttgacaatactcacaagatgagacttaaggaggagtttaaaattgaaccatggacttttgagcaacatgttggagaagctgtcatcattccttctggatgtccataccagattaggaatcctaaggtctctgttacaattgtataa

SEQ ID NO: 36019 - DNA, 957 bp, Glycine max
  Peptide Sequence Number=SeqID_152797
ttagatctagcaacatcagggaaagggggaattggaccttacattggtttgtgtgcactttctgcttgttttggagtcgcagatgctcatgtccaaggtggcatggttggagatttgtcttttatgtgtcctgagttcatccagtccttctttgctggtttggctgcctcaggagctctagcttctggtttgagacttctcaccaaagtgggttttgagaaatctgatcatggtcttcgaaaaggggctatgctattctttgcaatctctacactttttgaattcttctgcgtaattctctacgcaatatacttccctaagttgtccatagtaaagtattaccgttcaaaggcagcttcagaaggatcaaaaactgtgtcagctgatcttgcagctgccggcattcacaatgacaccaacctgcaagttggatttgatgctaaacagcaagaacggttgagcaataaacagctaattcttcagaacatggattatgcagctgatttgtttctgatatatgtattgacactgtcaattttccctggattcctgtttgaaaatactggatctcaccagctaggaacatggtacccacttgttttgattgcaatgtacaacctattggatctaatatccagatatattcccctcatcaaatgcctgaagttggaatccagaaagggcttactcattgcagtgctttctagattccttttggtcccagcattttacttcacagcaaaatatggtgaccagggatggatgatccttcttgtgtctttcttgggactaaccaatggttatctcactgtttgtgtatttaccgtggcaccccaaggttacaagggccctgaacagaatgcattgggtaatttgctcgtgctgtttcttttaatcggcatattttctggggttgctcttgattggttgtggctcataggaaaatcaggattctaa

SEQ ID NO: 36020 - DNA, 1224 bp, Glycine max
  Peptide Sequence Number=SeqID_152798
atggatgccaatgatgacagtggagcaccgagacaacctgagggaaaatacaaagcaatggcaatttgtttcattcttggaattgggtcccttgtttcctggaacagcatgttgacaataggagattactactacatattgttccccaaatatcatcctgcaagggtacttaccctggtttatcaaccatttgcaattggaacaatgttaatactggcatactatgagtcaaagatcaatactagaatgcggaatttggctggattcactcttttcttttttagcactttctttgttcttgttgtggatctagcatcatcagggaaaggtggacttggaccttatattggtatatgtgtgcttgctgcttgttttggaattgcagatgctcaagtcgaaggtggcattataggagagttgtgttttatgtgccctgagtttatccagtcctaccttgctggtttggcagcatcaggggctctaatttctattctgagaatgctgaccaaggtagctttcgagaaatctaataatggacttcgcaagggagcaatactattcttggcaatctccacattcattgagttagtttgtatcattctgtatgcaatctgcttcaccaaattgcccatagtgaaatattaccgttcaaaagcagcgttagagggatcaaaaactgttgcagctgaccttgctgctgctggcattcaaacaaagactaatgatcaaggtggatatgatagcaaaaaagaagagcggttgagcaacaaacaattatttgttgagaaccttgattatgcagttgatttatttcttatatatgtggtaacactgtcaatcttccctggatttttgtatgaaaatactggaacacatcagttaggcacatggtacccagttgttttgattgctatgtataatgtggtggatttcatagcaagatatattccccttgtgccatggctaaagttggaatccagaaagggtctactaatagcagtgttttctcgattcttgctgatcccagcattctactttacagcaaaatatggtgaccaaggatggatgattctactcacctccttcttgggactcaccaatggctatctcacaggtcctgagcagaatgctttgggtaatttgcttgtcctgtgtcttttgagcggcatatttgctggggctgttcttgattggttgtggatcataggtaaaggaacattctga

SEQ ID NO: 36021 - DNA, 657 bp, Glycine max
  Peptide Sequence Number=SeqID_152799
atgatttgcagggcatggggtacagtatgtttgtcactagcatttgtttggcaactctatgccatatttcttcttgttcagcttcacgaatccgtccccggaattcgtcacagcagatacctcttccttgccatggctgccttcggtaaaaagttagggaaggtggcagcattattcccggtaatgtacctttcaggaggcacttgcgtcatgataatcatcaccggtggtgggaccctgaaacaattactgaagacgctttgcgacaacgatgatcatgttcatgagcaaataacatgtaatgcccacgcgcttagcggggctgagtggttcttggtgtttacctgtgtcgccattctcattgcacagttgcccaacctcaactcaatggccatggtttctctcgtcggcgccgttacctccgttacttattgcaccctcttttgggttctctctgttaagaatggtaggcccaacaacgtatcctatagctcatccctgcagtcccaagaacacacaccagtggctaagatcaatgacgttctcaatgccattggaatcattgtgctagccttcagaggacacaatgttttgcccgaaatacaggcaagtatttcaagtttgcatacactagtgtatagtatacacattgcatga

SEQ ID NO: 36022 - DNA, 1806 bp, Glycine max
  Peptide Sequence Number=SeqID_152800
atgagtactacgattattggcaccacaaaaggtgaggtgttattcgtttcttcttcttcctctgcttcacctgagaagagctttggtgcacatagaagaagcaaggccacggccaagatcagaacaacattgggagtgtttgtaagagactttgtccctagtgctttggtttttctgacgaagggggaacctgaaattgttagaaattttatcttgaagacccttcgccttcaatcatgggagaaaactattgataagtttcacctagaagaaggagtaatgccagcaagttttaaagtacttcatgatccagtcagaaaccatgagaccttgatagcagactttggtgaaagtgcaataggcagggtttcccatattgattcgggattttggtgtgcatacacaaagtccacaggagacaattccttggctgaactgcctgaatgtcagaagggcatgcgcttgattttgaatttatgcctttccgagggatttgacaccttccccactctactatgtgcggatggatgctgcatgatagatcgtagaatgggtgtttacggttattcaattgagattcaatcacttttcttcatggctttagggtgtgccttgctattgctaaaggaagatgctgaaggcgaggagttcagagaacgaattaccacacgcttgcatgccttaagctatcacctgagaagctatttttggttggatttgaagcaacttaacgatgtatatcacttcaaaacagaagaatactcacatactgcagtcaacaagtttaatgtcattcctgattctctacctgattgggtttttgatttcatgccacttaaagttcttctatggcttcttgttgctgcctctatcaagacaggacgaccccacattgcaaaacgagcccttgaaattgctgaaactaggttgctcaaggacaactggaccgaatattatgatggaaagcttggtcgttacattgggaagcaggcacgcaaataccaaacttggtccattgctggttacttggtggctaagatgtttttggacgatccatcacatttaggtatggtggcactagaggaagacaaacaccaaaagcctcattgggaatcaatcagcgaccccatgagacctcagagaacgtcgatccacgccgtcacgacatgggtgaggcgacagcccccaaaggtgaaggcttttctcgccgtcgtttccggcatggcggctctcgtgctccttcgcttcatcgtccacgatcatgacaacctcttcgtcgctgccgaggccgtccactccctcggaatttccgtcctcatctataagctcatgaaggagaagacatgtgctgggttatcactcaaatcccaggaattaacagctatctttttagctgtaaggctgtactgcagttttgtcatggaatatgatatccacaccttacttgatttcgctactttcgtaacaacagtgtgggttatatatatgattcgttttaagctcaaggctagctacatggaggagaaggataactttgcaatatactatgtgattgttgagccattcacagctcactacgtatttgcactgggtgttgcaagattcttgagctgtgctcattgggttcttcaggtgttagatagccgtgggcatttgttggtggccttggggtatggtttatggccatcaatggttcttatctcggaaattgtccagaccttcatcttagcagatttctgttactattatgtcaaaagtgtcttcgggggacagcttgttctacgtcttccctctggagtggtgtga

SEQ ID NO: 36023 - DNA, 996 bp, Glycine max
  Peptide Sequence Number=SeqID_152801
atggattcagctaattcccatgttgttgttaaacaacttccgtgttctgttcagagcagcaaaccaatctgtttgatgggaaagaactctttaaagcgaaagtgttttgcttctattggggcacatgagattttcagaccagagatgtggaaagcagcactaacagaattaacagccactgcctctctaatgttcaccttgacaacttccatcattgcatgcttggactcacatgagatcgatcctaagcttcttgttccctttgcagtcttcacaatagcctttttgttcctaattgtgacggttcctctcacgggaggccacatgagtcctgttttcacattcattgctgctttaaagggtgttgtgactctcacccgtgccctcatttacgtgctagcacaatgcattggttcaataattggtttctttatactaaaatgtgtcatggacccaaaattagcttacacatattccttgggaggttgtgccatcagtggccaaggagtgatcaattcttcttctggtggtattaagccactagatgctttgttagtggaattcacttgcacatttgtggtactctttgtgggggtaacattggcatttgataagaaaaggtcaagggatttgggcttgccaatggtgtgcttggtggtggcaggagctatggcattggcggtatttgtgtccataactgtaactgggcgggccggttatgcgggtgtgggcttgaaccctgcaagatgcttaggcccagcgttgcttcatggagggttactctgggaagggcattgggttttctggcttgggcccttcttggcatgtgtagtctattatgctgtgtctattaacctaccaagggagggtttggtttgggtggatggagaatatgatgtgttgaaattggctctcggttcttgtgggaatgtctataatacttccgtttcaaaggatcatcaactagaagaaccaagtgcagggttccaagtctaa

SEQ ID NO: 36024 - DNA, 159 bp, Glycine max
  Peptide Sequence Number=SeqID_152802
atgacccttgtgcccattacatatgcatacccttgtttcatgtggctatccctcaagaagcctcgtccaagagggatgcttctcagtgctcttttggtagctgcagctatacggactctagctctcaatggcctagatgctaacttcttcaaaccataa

SEQ ID NO: 36025 - DNA, 1809 bp, Glycine max
  Peptide Sequence Number=SeqID_152803
atgatgctcgacaactccaaggacgtcgtggatgtgctcccgacaagccaggagcactacaataacatgctcaattcaattgaagagtacaagaagcaagtggtattgcacaatgtggtggaggcatgcttcaagttcaacgtgtcgagcttgacaagtgcactgaagcacttgatgaggtcgttgcggtggtgccgagtgacaggggtacttggtcggcgtaggaattggtatggaagaggagctttcgtggctgcggaggacccttatagattcttcgactggaccattacctatggtgacatttatcccctaggagttaaacaacaggttattcttatcaatggccaattcccaggccctgaaatctattctgttaccaatgacaatttgatcattaacgtgcacaataacttgaccgagccgtttcttctatcatggaatggtgttcaacaaaggagaaattcttatcaagatggagtttatggcaccacatgccccatccctcctgggaagaacttcacctacacacttcaagtcaaagatcaaattggaagtttcttctatttcccatctcttgctttccacaaggcagctggtggttttggagccatcaaaatccttagcaggccaaggatccctgtcccgttcccagacccagctggtgatttctcccttcttattggtgattggtaccaaatcaatcacaagaagcttcagagtgttctagattttggacacagacttccattccctcaagccgttctcatcaatggtcgtccaagtggcacaacattcacagttgagcaagggaaaacatataggcttagaatatcaaatgttggacttcaaaatacactaaactttaggattcaaggtcatgacatgaagttggtggaagttgagggaactcacaccatacaaaccacatattcttcattagatgttcacgtgggacaatcttattctgtgcttatcacagttgatcaagcacccaaggactactacattgtagtgtctacacgtttcactaacaaaattttcacaagcactgctatccttcactacagtaactcccaacaatctgtttctggcccaattcctagtggcccaaccactcaaatcgattggtcaatcaaacaagctcgttcaataaggacaaacttgacagcgagtggaccaaggccaaatccacaaggctcctaccactatggattaataaacattagtaggacaattaccttggtgagctcaacagcacaagtgaacaagaaacaaagatacgcagtgaacagtgtttcattcacacctgctgacactcctttgaagctagcagattacttcaacattggagggattttccaagttggaagcatcccagatagcccttctggtagacccatgtatcttgacacctcagtcatgggtgccgactttcgagccttcgtcgaggtcgtgtttcagaaccatgaaaacatcatccagagctggcacattgatgggtactcattttgggttgtaggaatggacggtggtgtgtggacgcctaatagtcgtaaccaatacaacctcagagatgcagtatcgaggagcacaacacaggtatatcctaagtcatggaccgcaatttacatggcattagataatgtgggtatgtggaacatgaggagtgaattttgggcacgccaataccttggacaacaattctatttgagagtttatttaccagttggatccattagggatgaatatccaattcccaagaatgctcttctttgtggcaaagctgcaggcaggacaaccaggtga

SEQ ID NO: 36026 - DNA, 807 bp, Glycine max
  Peptide Sequence Number=SeqID_152804
atgctgagaaatctccgatcccgtcgtcacccccgttacggcgtgttcctgtgcgtcgtcgtggtcgtcgtttcgggtctccttctgttggcgtgcgtcaccgtctccctcctccacagcccgcactcccacccctcctctcgcgatttcaactacgactccctcgtctccgattccggcaacgacgactccgtcgccgacgacgaaaccctcgacaccatcgacaccctcgacgttgtggaggacgagccagaggacaccatcgacgccgatgtcgacaccgacgacgaggagtccctcgaccagaacgccgccgcctcggggtacttcttccaccacgccgagggcgtgatccgaagggccttcagcaagagctcattcatcaattacgacaacaacaaacccttcgtggaccccacggaggatcgcagcaagaccgcgtttggctccgacgacgtcgccgttgaggagaacgtgcgatccaaggcgattcaagtgaagggcgttgaggacgcgcttttgttgaagagcacgggaaggagggtttctcctttaagagaaggttggggtgattggtttgataaaaaagttgactttttgagaaaggataagatgttgaggtctaatttagagggtttgaatcctctgcgtaatcccattcttcaagatcctgatgctcttggtctcactgggatcaccaaagctgatagaattattaggaattctctattacgtgaccttaagactaagaagcttccctattttcctcctaggaagatcattcaataccacaacaacttgctctaa

SEQ ID NO: 36027 - DNA, 561 bp, Glycine max
  Peptide Sequence Number=SeqID_152805
atggtttgggccacgagggagttctctagcacctgcagggcctggctgcggttcagcttctacaggtcgctgaagacggtgtgggaatggagtggaggacgcgtgactgtgcctggaggaacttcacgtatttgtagttttcttccagaagcgtcgcctggtccattttcttctcccacggcatcagcttcaagagacaccgcattttctcgctcaactgcgagccaagttactctgcgggatcaccagaggacactgcgactccacgggctgccgcttctgctccggctagcaaaggggagggaggcggtggtggtattgagggaagaagttgaagggctcgcatctaggccattgagagctagagtccgtatagctgcagctaccaaaagagcactgagaagcatccctacacaaccgagtgcaacgttgaagcaccaaacaaaacctcttggacgaggcttcttgagggatagccacatgaaacaagggtatgcatatgtaatgggcacaagggtcatgcttccgagtagtgctgataggcgtggaaggaatgggaac

SEQ ID NO: 36028 - DNA, 714 bp, Glycine max
  Peptide Sequence Number=SeqID_152806
atggtagagttaattgcaactttttgcactaatgctcaccctaacgagttgcaatatgcatttcctctatccgggggtcatatgaaccctattttcacattcattgcggctttaaagggtgttgtgaccctttctcgtgctctcctttacgtgtcagcacaatgcattggctcaataattggtttctttgtgctcaagagtgtgatggagccaaaattagcagacacatattctttgggaggttgtgcccttggtgatctcaaaggaaaaattcctggcataaagccacaagatgctttgttgttggaattctcttgcacattcttagtactctttttgggtctaacgttggcttttgataagaaaaggtgcaaggaattgggcttgccaatggtttgtttggtggtagcagcatccttggcactggcagtgtttgtgtccataactgtaactgggaggcctggctatgcaggtgctgggcttagcccagcaagatgcctaggcccagcgttgcttcttggaggcccactatggaatgggcattgggttttctggcttggacctttcttggcctgcataatctattatagtgtctccattaatctaccaaagaaggatttggatggggtagatggagaatatgatgtcttaaaattggctttgggttcttgtgggactatctctaacaatgttgttatcaatgatcttccttga

SEQ ID NO: 36029 - DNA, 516 bp, Glycine max
  Peptide Sequence Number=SeqID_152807
atgggttgctctaaccacatgactggaaacaagcattggctgatgaatcttgatacttcacaaggcagcaaagtgaggtttgttgatagttttttaatcagttgtgaagatgttcactgcatgactgctgaaggaaatgatgtcaattggctttggcatttcaggaagagtgaggtgtttgctatttttcaaaaatttaaggcatatgcagaaaagcaaagtggagcaaccttgaagatcttgaggaaaaataggggagaagaatacacctctaaggaattcgaagacttttgtgaaagcaaaagcatagtatatgaagttacaacaccttatactagtcagcacaatggtttgactgagagaaggaacaaaactttgttgaacatggcgaggagcatgctaaaattgaaggggctgccaaaggaactttggggagaagcagtcaccacagttgcctatatactcaataaatcacctacaaagaagctagaagagatcacacaagaagaagtatag

SEQ ID NO: 36030 - DNA, 2013 bp, Glycine max
  Peptide Sequence Number=SeqID_152808
atgtcactattgtctgcgccatgccatttttataacaaagggccccacatatccactgatccaatggttgttgaagatgagatattccccaaccagcgcatgccacgtcatgagctggaccctagggtcacggaaagacactctctgcaaacggcgtttcttttcttgcttttgcccccccccccatctcatctcagacaacgttaccaattaaccctcgctgtcccacactccgctgcttcttcactttttactgttgcagtaacggcattgtgtgatatcaatcaatgttgtgagatctgtgtgggaacaatggggagcgtttcgtccgaagatgcttcagaccacatgagcaaccgttgtgggagttatagtctcagtgctgatgtcagcgagtcggagagctgcagcagcttctccgcccgccgcttcgacgccgagggagcttccagttcagccaacctctcaccgcgccccgtcgctgctcactttaacttcccgccggcgcaggtcttgcttcccgtcattggcggcaaagacgtcttcgtttgggatcacaagcgtgatctcgatttgtctgaagtggaaatgatgaaggagaggttcgctaagctgcttctgggagaggatatgtctggtggtggaaaaggggtgtgtactgcacttgcaatctccaatgcaataaccaatctctctgcaactgtgtttggcgaactgtggaggttagagccgctggcgccacagaagaaagctatgtggcgtagagaaatggagtggctgttatgtgtgagtgattccattgtggagttagtgccatctgtgcagcagtttcctgggggtggaacctatgaggtgatggcgacgcggcctcgctcagatttgtatatcaatcttccggctctgaagaagcttgatgggatgctgcttagtatgcttgatgggtttcatgacacacagttttggtatgttgaccggggaattatattgggcgattccaaggattgtgatgcctatggtagaccttcggttaggcaagaggagaaatggtggcttccctctcccaagcttcccccaaatggcttgtccgaggaaagcaggaaaaggttgcagcagtgtagggattgcacaaatcagattctaaaagctgctgtggcaattaatacttctgttcttgctgaaatggaaattccgggtgcctacattgagtccttgcccaagaatggaaaggcttgtctaggggatataatctatcgatacttaacggcagaccagttctcgcctgaatgtctccttgattgcctggatctttcgtcagagcaccacactctggatatagctaatagaattgaggctgctatacatgtatggaggctgaaggaccataagaaacatctaagttcagcaaaatccagacggccttggggtggaaaggtgaagggacttgttgctgacagtgagaagaacaagaacaactttcttgcccaacgggcagagacacttctagaaagcttaaaacaccgatttccagggctccctcagactgcactagatatggccaaaattcaatataataaggatgtcggacagtctattcttgaaagttattcaagagtgatggagagcttggcctttaacataatggccaggattgatgatgtcctatatgtagacgatagtataaagcgatgcgcagctgcagattctctctcattgttcagcaggggaggttttggtggcatgcccatccagaagcgattctctcctagtcccttctcaattcaacacaccccatatgcctccccatttgcaacgccaacattctgttcctccactcctgttactgggagcccttgcagtcctgcaaggatacatgatgtgaaaaggaatgctccgaaggagggtgcagactcgaagacagataagttggccacatctgagtttgagagggtttggtcatacgcgggaaacctcagtgcaagaagagtgtctggcgatgctccagaaagagactga

SEQ ID NO: 36031 - DNA, 306 bp, Glycine max
  Peptide Sequence Number=SeqID_152809
atgggttactattattgtaaacccaggccttgtgatactcgtactcccaatgttgttctgatcttggccgtggccttgcttcttctatgtgcaccaaagctcttctcaggtgaagcagaggaagaagaagaaacgaataacacctcaccttttgtggtgccaataatcgtagttcaagcagaagaagggtttgtgtcaagccaccatattgtcagtgtacgtatgcctgctactgttacagatagtgctatcgccgtgatcacggatttgatctctaagtttatgtgtgtgaaattaaatttttaa

SEQ ID NO: 36032 - DNA, 408 bp, Glycine max
  Peptide Sequence Number=SeqID_152810
atgggaggacagagtatagtgttcgagaacttgaatgttcagtcaggaaacgatggaactggggtacccactgatatgttgtcgttgaactcaacggtcagaattttgtatagaaacccagccactttcttcggcgttcatgtcacttctacccctcttcaccttagctattaccagcttgcaattgcctctggccagatgcagaagttctatcaatcgaggaagagtcagcggaagttggcggtagtggtgctaggacaccagattcctctctatggaggagtggctttcatcttgggaagattagttaagtctaaattctatcgaagaatcacatgttctgtcactttgcatggcaacaaacttggaaaacatcttaatttgacggattcatgtgtctacaagtga

SEQ ID NO: 36033 - DNA, 186 bp, Glycine max
  Peptide Sequence Number=SeqID_152811
atggagagctcctttctgaaggggcttagtgaattctccagccgcgcctttcccctggaaaagtaccatgaaaggccaagcaagatgaagatcagtgctaagattaacagaacaggatatggcaaagggattcagagtgaagccatccaaaacagcggaggctctgcttctaccataagccattga

SEQ ID NO: 36034 - DNA, 243 bp, Glycine max
  Peptide Sequence Number=SeqID_152812
atgacccaagagctggtagcccgcggagacaccttacggttatccgcacctcgtcattcagtgaccccaagtgtgattgacgagcagaggccaatgtggtcatctgcgccctttccggagatgtcagcatcttccggtggagactttttcaagtctcacaagttatcaagaactacgagcaagagcctcgcttttgtcggccaccttcacaagttctgtcatgctgacactagagtcacgtga

SEQ ID NO: 36035 - DNA, 195 bp, Glycine max
  Peptide Sequence Number=SeqID_152813
atgcgggggtccggggaatttgtccccttcctagatacgacgtctaggggtagcaaaatgccccaacgtacgtttttaagaaggcgacatggaccctccgttgtttctagaggtattatcctcttcgaagaacatattgtagcagtagggactactagcaacaataagttttcaaagaaaaaaagctctagatga

SEQ ID NO: 36036 - DNA, 687 bp, Glycine max
  Peptide Sequence Number=SeqID_152814
atgccaccaaagcaaaaagttcaacaaaccatttgtagaagaagaaaaaacaacgcgtccaatctcaccggagacaaaggcatcaatagcagcatacgcaacctgctcgtcagtgaggtagcgattgtcccagcggctcatggtgacgttttcgggcttgtcaatctcaaagcccaggacgtagtggcccaacgcggcgagcccggcccattgcagctgaaacacctgaagctcctccgcggcgagggagcgaagctctccgacattggtgacgcggagattgtagtctctcagaagcttgtcggcgtcttcttggatgccgaccccgacgaagatgacgtcggggttgttgaggaaggaggagagggcgcgtgggataaggggcgcgtagaggatctggaagatgaggcagttgtggccgatgcagagctggagggtggcgacggggttgggcggctgcatgttgggccgggtgttgggcttccattccacgtccaggcccacaatcatgaggtcatccgcgttgttgcggatgttggaggagagccaggagccgacttgggagggggaagcggtgacgagggtttggatggtgtagttacccatggtgacttcgtagcgtttgtagttgttggtgccggtgccgttttcttctatcagtattgccgtcgtaatcattgtggttga

SEQ ID NO: 36037 - DNA, 528 bp, Glycine max
  Peptide Sequence Number=SeqID_152815
atggttgaaaaatcttccagaaccaaccttggccaccatcaagattttggcatggaggcttactccatagatggtgtttcttcacaaagtgagtccaaattctacgatgatgatggtcatgttaaacgaacagggaacgtttggactacaagctcgcacataataacagcagtggtgggttctggggtgctgtctttggcatgggccatggctcaaatgggttgggttgctgggcctgtagttatgatcttcttcagtgctgttacgttgtatacgacgtcgcttctggctgattgttatcggtgcggtgaccccgttacggggaagagaaactatactttcatggatgcagttcaatccattcttggacatataaattatgaagcatcgataccgatacggatatcggacatgacatcgacacggacatgcgggtattatgatacgttttgtggggtagttcagtactcaaatctttacggaaccgctgtaggatacacaattgcagcttctattagcatgatgtga

SEQ ID NO: 36038 - DNA, 207 bp, Glycine max
  Peptide Sequence Number=SeqID_152816
atgtggaacccaaagagaaggttcgttcttgttgttgctgctgctgtggggagtgagaatgagtttggtcaaccaaaccatactgagcagctagctctcattactcttgttgtttatagtatagctgggcttaagattcggttcaattttggcgtgtgggacaacgaccattttctctgtcacaaccgttcacattttcctacttaa

SEQ ID NO: 36039 - DNA, 1320 bp, Glycine max
  Peptide Sequence Number=SeqID_152817
atggcacccttcctcccacgggtaattgcatattggtttaagctaaagaagttggaggagttagatctatccggaaaccaatttgagggaccacttccctcatcttttgttaacatgacatctctccggaagttggaaatttctgaaaatcacttcattggaaattttgattctaaccttgcaagccttacatcacttgaatattttggtttcataggaaaccaatttgaagttcctgtttctttcactccatttgccaatctttcaaagatcaagttcatctatggtgaaggaaacaaagtcgtattggactcgcaccatagtttgcaaacatggattccaaaatttaagttacaagagcttattgtgtcttcgacaaccgcgactaaatctcttcctctcccaaattttcttctttaccaaaacaatttaaccaatatagatttgagtggttggaagttggaaggagactttcctcattggttgttggaaaacaacacaaaaattaccaaagctctgtttaggaattgttctttcactggtactttccagctaccaatgcgtccccttcataacatacaaacaattgacgtgtcggacaataccgtaaatggccaaattcctagcaacaatatcagttcaatttatccaaatttgcaatatctaaacttgtctgggaacaacatccaaggatcaattcctagtgagttaggccaaatgagcttattgtattcattggatctttccgagaaccaattgtccggaaaaatacctgagaacacatttgcagatgggtaccgactccgattcttgaaactttcaaacaatatgcttgagggacctatttttaatatccctaatggtttggagaccttgatattgagccataatagatttactggtagactcccaagcaacatttttaactcatcagtcgtttcattggatgtaagcaataatcatttggtgggaaagattccaagttatgtatataacttctcaacgttgacggggctttatatgtccaataaccattttgaaggatccattccaatagaattggcagaacttgaagatctaacttatttagatctttcccaaaataatttgactggtcatgttccatcatttgcaaattctcccgtgaaatttatgcatttgaacaacaaccatttaagtggattgtcgaaaagaatgttcaatgaaaactcttctctagtgatgctagaccttagctacaatgaaatatctaacaacattcaagatatgatacaggaccttagttatacaaaggttgaattttatccttttgaaaggtaa

SEQ ID NO: 36040 - DNA, 651 bp, Glycine max
  Peptide Sequence Number=SeqID_152818
atgaatgatgatcaggttctgtggcctgaatgtggttggcagccagtttctttgactgatttgattacagctgctgctgttagaaaggtttataggaaagctacattgtgcactcatcctgataaagtacaacagaagggtgccactattcaacagaaatatattgctgagaaggtttttgatctactcaagagggtgtgttggaaagagtgcagtaaaggcattattcttttgaaaaattggtatccagtgctccattctatttgtgcacttcaccacaggtgtttactgtcgatttgctgcattcctgttagtccagccaatgggtggggtttgatcaatgattatgtgcatagagcagcacctgtaaggtcaagcacgatactggcaactgagccaacagcagctgcaactgatactatgagacaaacaacacttaagatttgcataccaatccatctactactccacctaggggtcctcttttgtttgatactcatctgcactgggagaaaaacacttaaaggccaaaaccccagtgctccaagaagtcccaaaacgtcattgaagaatggaattaacattgctacaatagtggttatgataacaaacaccgttctccaaactaatctaaatgggcttagattgtaa

SEQ ID NO: 36041 - DNA, 693 bp, Glycine max
  Peptide Sequence Number=SeqID_152819
atgacatatttattcctgatcctcgacacacccctcaagctaaagcttcctaagttgagagagcttgttccaaataagccaacaaaggcccacaatgataatggagaccagtgtgactcttgtcagagatgcgtcacgctttgtgtgcgtgaactatacacgctgaaaaagggccctgcatggggtcacatgcagcggtgttttgagttgactgtgcatatgaatggcatggcgatctttggcgatgagcgacagtggttgaacgtgagctccgacggaaagacaacgggaagtttgtcacacaagggcagagcagccgcatggggcaatagcaccaatggaagtgcggccgcaatggcagccggatgcgctggaacaatggagcacgaaaatgctccgatgaggtcgtcgccaccaccattgtgtagatcagtggacagcgatgctggtggctgggtcaccagccggaaaggcaccgtagctccagcagcagctaccagaaaatgcgaaggaaaagaggaaagggtcatcggaataagtatgactgaccataaaggtccactggggacagtagagtatattgcgggacaaattggcttctttgttgtccttttcctagctgtccctgtgctgtccatcacagggacagctggaaaagggacagcagagaagccaggtccattgcgggattga

SEQ ID NO: 36042 - DNA, 912 bp, Glycine max
  Peptide Sequence Number=SeqID_152820
atggagcactttagtcatgcctcacctttaccagcagtaggaactgatgatgattttccaccaacacatcaaaatagaatccccagaggagcacatcttgcaggaaatggaagtgcagtaggttcaattccatatgcaaggatgtatggagaaattgatatggaaactcaaattcaccaacttgagaaggaagcatacagttcagttctacgagcctttaaggctcaagctgatgtcattacttgggagaaggaaagtttgactacagaacttagaaaagagctaagattatcaaatgaggaactcagagaacttctaggtcatgttaatgcagatgatgtcatacaaaatataagggagtggagacaggcaggaggcaatcagcttggtgtgctgagttttgggcaagctattcatgattcaattccaagtccccctatctctgcatcccgtaagaagcagaagataactccatctgcactatcacaatcttttggtgggccttctccatttcatccccaatccgtggatgcacctgttcagtcatctttggttgaaaaacgaggacctgtttctggatctaagggcaagaagcacaaacctggccatgcattacctggtgtatcttcaataaagcaatatccttcatctggactaggtggaaggaatcaagtacctaatagagttacctctggcactgtcatgggtgagcttgctgagggagcatcgttggattcattagttggtagaagagtgcgaacaagatggcctgatgacaacaacttttatgaagctgttatctccgactacaatcgatccgaaggtctacatgctttgttctatgacttggggactgcaaatgaatcatgggagtgggttaatctgtcagaggggaaacttaatctcctctaa

SEQ ID NO: 36043 - DNA, 435 bp, Glycine max
  Peptide Sequence Number=SeqID_152821
atgactctcaaaggcttggtatcacttgtcatcaatttaattggcctagctgagggaacaaggaacaatgatgccccccctttaccttgttacatgctatctagccatatacaaaataacaagcaacaatcatctgaatcagcatcagcatccaattttaatgaggatagttggtgttgtgtgtgcttgtcaaggttaaaggccaaagatgaaatccgtgtccttccttgctcgcacaaattccataagatttgtgtaaataaatggcttaagggtcgccacaagacgtgtccactttgccgtttctcaatgggagccgaggagaagtctcatcgtgccgaaatgttcactgaagagatgttaatatggttttcttctttccatgtagctgttttctacaagcagagccttgctttgctttcaagttttgtttaa

SEQ ID NO: 36044 - DNA, 414 bp, Glycine max
  Peptide Sequence Number=SeqID_152822
atggaagcagtgctcttccatatgtctcctgcagatattcagtgggttggtgaggatcccggagtcaatcgtcgacagggttttggtggatctggtaatgggatgagaagatctgtaggacgtggaagtgttccaggagttggaaaaggtaggggaactgcaaaggggcaatccagaaaagatttcttaccatcacagaatggaataggaatgaagactccagatgatatacaaatacttcacacagacacgttagtaaaggaggtggagagggtattcaatgcaaaacatcccgatgcacttgaaatcgagcaagtcaagaaagtattgaaggatcatgagcaagctcttattgatgcaattgcaaggcttgcagatctttctgacggcgaaagtggtatttctcagttttga

SEQ ID NO: 36045 - DNA, 201 bp, Glycine max
  Peptide Sequence Number=SeqID_152823
atgaacagcgctaggaaaggacattcatgggtctccgaaaaaaagtggagaatggataattggcgaacagcgctacacaataacttcatggggctccagactcgttggtggaggacacatgaacagcgcttggcaatgacattcatgggactccgaaaaaaagtggagaatggagaattggcgaacagcgctacccaataa

SEQ ID NO: 36046 - DNA, 2319 bp, Glycine max
  Peptide Sequence Number=SeqID_152824
atgttttcaggctcaattgaaaacgcagtggcatgggttgtaattttaaagtgtgttagccagcgtgaagcttcgtcccaaatctctctactagcttcattccctaactgcaacctttcatcgttgcgggtgacatctccatctaccctagcggcacctgctccggcaacatttctgagccttgtttggggcaaaataactgggtcaggtccctttgacccagtttccaaatccctaaaacttgtgtttcactgttcacatgaccttgtttgcagttggtgtgacgtcgaagttgttccattaccgctgatctgcgacattgttgctaccagtcgtcttcccaaacagagattcttcttcttacgaacgtgcctttgttcctactttgaagttcgattgaccattcctgatattaatttgtcaccagaacctactatcgatgcttctaagacagcctctagtacaacagacgaccctttcaaagtctttgaatcaacttcagccccagtggattcatcctcagactactttacagacccactggaagaaattagtaaatttactagttctagaagcacaaaaaatgataggtcatcaaattctaatggtgaagtatatgatgatattgatccctttggtggacttggaaattctgtacctgcattctcagcagagagaaatagcatgaagggtagcagctctccaacgccaaggtcaaatacaagttcaagctggaccagagataaagaatcaaatgacatatcgtctgtgaggagtcctgacagaaagacaccaaacaagattcttgttgatcatgatcaggaatttcatcaggctgcatttgacatgcctacatattcatctgattcttacaaaccagttggccaaaggtctactttcccttcatatgataacaacggttttaaacaggctaatactctggaagatatgtctccaaaatatgaagaaaagttggaatcaaatgatgatatatggttgatggtatcagagattcctcttttcactcagccaactgctgctccaccaccttcaagaccacctcctcctcgaccagtacatatcctcaagtcaggagcaggttcatcagcttctgccaatgtcagaaagaaggataatgatttttcttattttccaagttccactcaattttctcagggtcctaaatctgctcctgctgcagccaagttttcttctgcatctcagtttgatgaacttgaagattttgccatgggaaagagtcgtgataatgacgatgaaggtgtaaatggtcttgccgacaaagaattagagatgaactcagctgctgcagctatgaaagaggctatggatagagctgaagctaaatttaggcatgcaaagggggttagggagagagagaatacgaaagtggctaaaagcaaggaacctgtccaattggataaagatggtaaagtggtgtcagaggacagaggaaaacaggaaaggttagaccatgaatggcagcaaaaggagagagaggaaaaggagcaaagaagatgtgagaaggaaagggaggagaaagaaagagaacaacagagacttgagagagaaagagaaagggcaagacaggctgtggaaagagctactagagaagctcgtgagagagcagctgctgaagctcgccaaagagctgagagggctgctgttgagaaagctaatgcagaagctagaaagcgtgctgaaaggaccgcagttcagagggcacaagctgaagcccgtgaaagggctgctgcagaggcaaaggaaagagaagtgcgggaaagagctgcagctgcaagagctgaacctgaagcaagagttaaagctgaacgtgctgctgtagaaagggctgctgcagaggcccgagaaagagctgtagcacaggcccgagaaagagctgcagctgctgcaaggatgagccaacaacagaatgacaatgatcttgaatcgttcttcagcacagatgcacgagctaacagtgctccaaggcctcctaggcccagctcttcagactctgtatttgatgcccaatttcagtcagatgtaacccggaaatctacaggcgtgtcttcaagcatgaagaaagcatcatcatccactaatattgttgatgatctttcctcaatttttggagccgctccatcatcatctggagagtttcaggagattgaaggggaaactgaagaaagacgaagagccaggttggaacgccaccagaggactcaggagcgtgcggctaaagcactggctgagaagaatcaacgggacctacaaactcaaagagaccaagctgagagacat

SEQ ID NO: 36047 - DNA, 213 bp, Glycine max
  Peptide Sequence Number=SeqID_152825
atgagaagactacctgagagattaacttatcactcaaggcttgaagcttctgaggcacaagagaatcctcaaaatttccatgtcctagctggccatatttgctccacccagtctaatcaggaaagtttcaagattcacagtcaaaagaaaaagaacaaaaacaagcctagcgaagtaggagatgcaaacataaaaaatgctacaaccctatga

SEQ ID NO: 36048 - DNA, 531 bp, Glycine max
  Peptide Sequence Number=SeqID_152826
atgaacgatttcgatggtctcttagccaccgatttcgggttcaaaccccaaggcaaatcagcgccaatggctgcttccaaagtctcctccaacaacaaaacttcttctctcaacttcgatttaggttcccgatccactcgcacctccaattcttccgtcaacgccgccgccgccgccgcctcctttgacgatctcttcggcgactcctccgtctttcgggcctccgccgatttccgttccaagtccgtcaacgtgccggtgcacgacgggccggtctttgacaaaccagtctacgacgatgacgatgacatttttgacggcgttcccggcctcaagagctcctccaaggtctcctatgacgacgttttcgctccgggagggagcgccgccgccgccgccgcgttcgacgatcttctcggcaggttaggcaaatcggagaaggtcgagaaaggtgccgcggattttgatgacttgatccctggattccggagcagtaaggcctccactgatgggtatgttgcgcatgcgtga

SEQ ID NO: 36049 - DNA, 435 bp, Glycine max
  Peptide Sequence Number=SeqID_152827
atggagggtgctgggactggagctggagcaggtgctgatggagttggaggagcggaagaaaaaggggcagaagtgccaggtcccctagccctagtcttgcgagtccttagaaaggtgatcgtgagatcattcgggttccaacaattcttttggatatatgccaaattaatggtagggctaagggactcaaaagtcagagaatcggatactactcctctggctatgcacaaggctgtaatgagtgcagggatgcctagccgagaggagttgggctgggccatttgttatatctggcctgaaatgagcgagcccaagtgggggcgaggttggagtatgaaagcactctccaagtctgggcgagggtggtcaggtccttcctcaggagcttctagggcactccctcaacattcaatacaaaacctcgccctggaataa

SEQ ID NO: 36050 - DNA, 360 bp, Glycine max
  Peptide Sequence Number=SeqID_152828
atggcttatgcctgcattagtcgattatcaacatggaggcctttatggcccaggttgcctggccaggagtccagccttctcctttggggggagctagacaccgagccggaggcgacaccagaggccgaggccacaccggaggagactccagagattacccctgctgccacaccatctgaggcacttgaggagggaaacggcgctgcagacacatattatgttgcagatatggctgcggcgcagagcacttgggatccctggcccactccaacactagagacatcattgccagtccaggatgctccctcttcacctcaggatgatcccataccagcacagatgactgaagacaggacttga

SEQ ID NO: 36051 - DNA, 300 bp, Glycine max
  Peptide Sequence Number=SeqID_152829
atggttcaacgcagctgtatacagccttatttaccaacaacgacgggtgctcgaggcaccgtcgttgaaacctcaaagaacaatgacggtgtcctcaccaccgacgttgacatactgccaaacaacgtcggtggtgagcccaccaccgatgttgacaggaaacaaaacaaatacgggtgttatgcgtacccgacgttgatatggacaacaacaacgacgagtcttgctaacccgacgttgaaatggaccaaaacaacgacgggttgtataaaatgtgcgtcgttgaatccttttttataa

SEQ ID NO: 36052 - DNA, 366 bp, Glycine max
  Peptide Sequence Number=SeqID_152830
atgtccagtgtccttcttaattgtatctctgcacttgtgactagttttctctcagcacaaggggctgccaccttttttattttatgtttttggggtgattttggaaggttgggtcatggcaattctagtgatttgctcattcctcagcctattatagcattgcaaggtctaaggataaagcaaattgcctgtggggatagccactgtttggcagttaccatggaaggcgaggttcagagttgggggaggaatcaaaatggtcaacttggacttggcaacacagaggattctcttgtgccacaaaagattcaagcgtttaaggtacccgtttcaaagacattcatcaaggttatctgtgataaataa

SEQ ID NO: 36053 - DNA, 255 bp, Glycine max
  Peptide Sequence Number=SeqID_152831
atggtggggaccatcagaatggccattattcaacacctggtgattgccaacaggaagaggaggtccattatttgtagaatcaagccaaacctcaacagagcttctaaggaaactaccaaggctacagaggccaaaagaagagaaggtcaagcagctggtatctcgcttagtgaggcatatgtgcttagcgagtgtcatccgataagcgaggcactcagctcgcttagcatgatgagaaatcctagaagaggataa

SEQ ID NO: 36054 - DNA, 369 bp, Glycine max
  Peptide Sequence Number=SeqID_152832
atgtatcgtccctcccatggcttcaaagtgcatcctcaaggagctcaaggacttatagaacaactcaccaatttcttacagcactgcgggtcaagttcagggtacaaggaaaatgtggttggcttgttcactggtattgccgcagtagccactggccacccctttgacaccgtcaaggtgatgttgcaaaagcacaatgcaaaagcacatacgattcagtatagaaatggatggcattgcactgctaggatattgaagactgaaggaggtcagatcgaagcttgggatgaatcagccttgcttttgttcaggagaattataagcaattgggcttggatccggaattgggatgaaccggcttggacttga

SEQ ID NO: 36055 - DNA, 1173 bp, Glycine max
  Peptide Sequence Number=SeqID_152833
atggcgaattcacgcaattttcccgttggagaaaaatactttattttcccccctaatttcgggaaacaaactaaacaggataccgatagatacaaagacctagtgaaacagcccatggacttagaaaccatacaattgagactccaaaagggtcactattcctcatgcaccagtgcattcttccgcgacctcctcctcctcttcaccaacgccaccgtgttcttctcccatgacaccctggaatcacaggtagggcggcagctgcaccgccttgccaccacggagatgaagaaccacggccaagcacaatccgatcctatcccccggaagaacgattcactcccaccaaatgcatcattagctaaaccagattctctcatttccaagaacaaagcctctggtcctatattggtatgccgcaaacgcagttcaatgttagccaaaccttcctcggccacctttggccaaaagggtgaccaacccaccttcaatgacaagaaggaaaggccatcatctgatgcaaagccacccatgaaaccctcttcttctgatacagacgaagaggagcttcccaaggctaaggaaaagcctgtcactggagcaagaagcttgaggaggagctacaagaacctcaataataataataacaagaaaccatcctctaactccactcctaagacagggtcctcggggaacaagccgtcggagaccgtcaaaccggagaagagcaaagcagagggagggccagacaagaagaggaatgcagctgcagatttcttgaaaaggattaagcgcaacacttcggcggaagcatcaaagggtggtagcggtggcagtggtggtggtggaagcggcggcggtggaggaagtagtagcagcagcaagggtggtggaggtggtaatggtgtcaaagagcagaagaaaatggtgaacaatggaaaaggggataaagggaaagaaagggcatcaaggcataataacgttggaggaggttcagggtctggagataaaaggaatagtaagaatgttgagaacaactcacagtcaaagagaagtgttggtagacctccaaagaaagcagcagagacaaatgcaggttctgcaaagcgtgggagagaaagtagtgctagtgctggcaaggataagcgacccaaaaaacgttccaagaaatga

SEQ ID NO: 36056 - DNA, 219 bp, Glycine max
  Peptide Sequence Number=SeqID_152834
atggcatatctgttgaaggaggcatttcgtgttgaaagaggaacaagaatttcccctgcaacaacaagaacaaacgtgaccgagaatgaaagtgtgttagggggtgtatctatccctgggcccatctggaatattttggagggaggttgcttcaggtggaagctacctagctctcctggacaagctgggcggcaaccacctccctcatttttgctataa

SEQ ID NO: 36057 - DNA, 827 bp, Glycine max
  Peptide Sequence Number=SeqID_152835
gcaatgactccattacatttgaaaaagtcaagtctggtcactattcaagagagcttcgactaaaggcgtctgagaatgttgatgaagtctatgcgtctgaattatcgataattgattctactaaaggaatgactcatcattggaaagcaacttggttttggctattggtgaacaactacaacaacattctaaacaataggtactggactcaggttgttcttatcatatgtgtccacacagacattggttgtgcacaaatcaacatacatgatggtgttattaaaaccttaattaaagttagtcatgttctagagcttaagaaaaatcttgtatctatgagtgttatggattcgaaaggtttttcatggtgggttgaaggtggagttatgcagatcaaaatcatgcgtccaatggctagtctaaaaattctctgtggcatctgcatctggcattgcatctctggaaagcaacatcgaacgaagttcccaaaggttatgcacacaacaaaagccatgttggactacgtccattcaatgttaggggcctttgagagttccatcactgggagggacaaggagtttctaggtcgagatagtcaacacaacatgttatctcgtgaatcgctcaccatccaccaccataaacttcaagacccttttaagcccagaggcaagaaggaattctttatgggctatggagatggagtcaaaggattccttgacatcatataccacttcattcattctaagaagagggtagaagtcccaaaagttaatacatgggaaagtccaactgatatgttcacaaaagcctatttcaagaagcaa

SEQ ID NO: 36058 - DNA, 594 bp, Glycine max
  Peptide Sequence Number=SeqID_152836
atgtcaggacctgagtgttgctcaaacccaccagttctgaacccgaatgcaagagttggtcacgttgaaaaactcgctggtctcaattcctatctttctagttcccttaattccaatgccattcctctcatctctgacatttatggatatgaagcaccaaatttgaggttgcagctgctggttgttcctgacttctcacatggtgatccctataatcctaagaatgctagcaggtccatccctgtttggttaaaagatcatggcacggacaaaggatttgaagttgcaaaatccataattgaagctttgaaaagtaaagctaccataggtttggctgcatatgagaacccatttggtgtggttcttggaaactttgaaacatcaaatgcgctattcaaacatatattcttcctccagaaggttgttgcttctggaggaagcaaccttgctcgcctgggcgagctgggtggcaagctcctcccctattttgctataaatagggggaggagtgaagggagaaggggttcagccttcttggcacttcctattctctcgaaattgctgaggaaaattgtttccgtgaagaaaatctaa

SEQ ID NO: 36059 - DNA, 462 bp, Glycine max
  Peptide Sequence Number=SeqID_152837
atgaaatcagagttttcggcgagcaagaaaattgttagaaaatattcaagggaaaaatggactcaagcctatgatggtggcaaacgatatgtccatatgactactaattttgttgagtgtatgaattttgctttaaaaggagcacacaccttgcctataattgtctcggtgaaagcaacatttgagagaataaaagcatgttcagttgaaagagggatgcatgtatcctccatgttacatgtgggacacggctacccgaaaaaggcattgcgactcccttgctctcatgttattgcaatttgctcctcttgccaccaacagaccgacttgtttgttgacctaacatacaagttgcataccatttacaagatttatgaacttcagtttcactcccttggaaataaggattattggtctcaatacatggatccaaattttgttcctaatcttgacaaacgatga

SEQ ID NO: 36060 - DNA, 1767 bp, Glycine max
  Peptide Sequence Number=SeqID_152838
atggccatgaccggtaaccattcccctcgccattcctccgataaccaccaatcgcgtcgcgccacgcgcctccctgcttcttcgccgtggaaccaggtcgtctgcggcgaatcggagcccgttgcggcggttccgtcttcctcgacggaggatttcccctctgccgccgcgccggtggaagattttagctcctccgcgactgagagctcagacaatggcggcgctgccaagaggcctgtctggaacaaaccttctcctaatggcgcggcggcggcggcggcttcggaggtgaggccggagatggacgcgaactcgtggcccttgccgtcggagtccacgagagctgctacgaaatcggaatccttgaagggtctgttggatggatcttctgtgccacaatcgcagggtttgggaagtatgtcttcttcttccccttcacagagggaagtcagtgataatgcaagcaccaacagtgtggtgccggctcggcagaaatcaacaaagcatcacagttctaatgcatcttctaatggtggccacatgcaacactctgcgtcccaggtttcgatagctgcaactgggtcccgaaactcctctccaaaggaccacacacaaagaagtgggtttgcgtctcatgatcatccacagcagcgtaattcgtttagaaatcgtaatggcggtcaacaccagcgtggagatggttctcaccatcataactatgggaacaggcatgatcaggactggaataataatagaacttttggtagtagagatacacatgtgccaccaagagttgttccaagatttatacggccgcctccacctcctaattctgctcagttttttcatccatcaccaatgcggccatttggtagtcccattggtttccatgaactagcacctcagctggtatttgttgcagctccacctccacccccggattcactaagaggtgttccttttgtgcctcctatgccacatcattccctgttctttacaggcccagatcctcagttgcacaataagatagtcaaccaggttgactactattttagagagttgactgtagacataccacaacttgtctattgcagtaatgaaaatttagttaaagatacattcttgcggcagaacatggatgaccagggctgggttcccataaaattaattgcaggcttcaacaaacatgtattgtgtcccactggttgcattgtctgtaccatttcagtagaaaatatgttagaccgggaaaaacttggctcactaaagtcaagtttttgcatcaaaatcttcaaagtaatgttaagtgttgccgttcttcaattatcatctgaagcagttcaagttatgcattcgtttaaaaatttctcctatttggaagttatgcatttgactgacaatatccaagttatattagatgctattcgaacttcatctgttgttgaagtgcagggtgacaaaataaggagacgaaatgattggaggagatggatcatgcatcctcctgttcagttttctaatgctacaaccattggagtgttgaatcctgacatgctggcagaacaagtacacaatattgctctggagacaagtgactatgatggtgcaggaggaccggatgttctaccagatacttcacgacatagatctacatttagggatttgcagctttccactagcgagggtcctggtcctggtcaagttggtattcaagaggctcagatcactccattccaggaagaaattagagctgtaaatgtgctttag

SEQ ID NO: 36061 - DNA, 390 bp, Glycine max
  Peptide Sequence Number=SeqID_152839
atgaaagccttcattcacgtgaacataggtgcaggcttttcagaaacaaagctaacacgtgaaccatgcagacgtaacccacagaagcctatcccgcagaacccagtggcgggatcctctctccccctgtcccgcaaccgccactggcggtaccacccctgcaccctctctctcctgtcccgccagctccaagggcgggacaccctctctctctcctatcccgccagctccaagggcgggacacctctctctctcatatcccctcccatcccgccagcagcaatggcggcacccctccccctctctcctagtcagcccctatcccaccattggcactggcggttcaagcttcccgccagtgtcaatggcggcacccacgtgcataaataa

SEQ ID NO: 36062 - DNA, 975 bp, Glycine max
  Peptide Sequence Number=SeqID_152840
atgtcgggccggaaccgcggacaaccccttcctccgccgcacgcggcggggctgtcgccgccgctccacgatcagctatacggcgcgcgggcccaccaccaccatcatctagtgggccccgtccctccccatccccaccaccttctagaagacttccgcgactcgcagctagggctgggcccgccgcgaggtgggcccatcccgctgcatccggcggcgatcatcgaggagcgcctggccgcccagcaccaggacatccagggcctgctgggcgacaaccagcgcctggccgccacccacgtggccctcaagcaggagctcgaggccgcccggcacgagctccagcgcgtggcgcacttccgcgactcgctccgggccgacaccgaggcccgcatgcccgagctccacgacaaagcggcccagctcgaggccgagctctgcggcgccgaggccgcccgcaccgagctcctccaggtccgagcagatgtcaaggagctcactgccgtccgccaggacctgtccggacaggtgcaggccatgacgcaggacttggcccgcatgaccaccgatgccaaacgggttccggcgctgagggccgatgtggaggccatgaaacaagagttgcagtgtgcaagggctgccattgagtatgagaagaagggatttgcagaaaactatgaacatggtcaagtgatggagaagaaattggttgcgatggctcgggagatggagaagcttcgtgcggagattgccaatgcagagaaaagagcacgggctgctgtagcggctgggaatccaggtcaagggtataatgcaaattatggcaatgctgatgctggatatgcgggaaatccttaccctagcatttatggcatgaatccagtacagcctggagtggagaattttcctcattatggacctgggcctgctgcttggggtgcatatgacatgcaacgagctcaaggacaccgataa

SEQ ID NO: 36063 - DNA, 1228 bp, Glycine max
  Peptide Sequence Number=SeqID_152841
cttgcattttgccaatgtttctgttgggactccaccgttatcgtttctggtggcactggatactggtagtgacttgttctggttaccttgtaattgtaccaaatgtgttcgaggtgtagaatcaaacggagagaaaattgcttttaatatctatgatcttaaaggatcatccacaagccaaaccgttctgtgcaatagcaacttatgtgagctacagagacaatgcccttcatctgatagcatctgtccatatgaagtaaactatctatcgaatggtacttcaactactggattcctggtggaggatgtgttgcacttaattacagatgacgatgaaacaaaagatgctgacacacgaattacttttggttgtggccaagttcagactggtgcatttttggatggagcagctccaaatggtctatttggactaggaatgggtaatgaatctgtcccaagtatcctagccaaagaagggctcacttcgaattctttttcaatgtgttttggatctgatggtcttggaagaatcacatttggggataatagtagcttggtccaaggaaagacaccattcaacctcagggcattgcaccctacttataacatcactgttacccaaattattgtgggaggaaatgctgccgatcttgagtttcatgcaatatttgactctggtacctcgttcacacacctaaacgacccggcttataagcagattactaacagtttcaattctgcaattaaactacaacggtattcatcttctagttctgatgagctcccctttgagtactgttatgacttaagttcaaacaagactgttgaacttcccattaatctgaccatgaaaggtggagacaattatcttgtcacagaccctatagtaacgatcagtggtgagggtgttaacttactttgtttgggagtcctgaaaagcaacaatgtgaacatcataggacaaaacttcatgactggttaccgtatagtctttgatcgtgagaacatgattcttggttggagggaatctaactgttatgttgatgaactctctactttagctattaaccgatcaaattcccctgctatttctcctgccatagctgtgaatcctgaagaaacatcaaaccagtctaatgatcctgagctgtcacctaatctctcatttaagataaaacctacctctgcgtttatgatggcccttttggtgcttttgaccatactttga

SEQ ID NO: 36064 - DNA, 1347 bp, Glycine max
  Peptide Sequence Number=SeqID_152842
atggaggctaaggttgcagcaatagagtcggaggtggcaggactcaaaaccgctatgaaaagtatgcagctcaaggcagaggagaaccacgagaggttgattaaagccgaattgcctatgttcgacagagaagaccccacgggttggattgtttgtgtggaggtctattttcaagttcaagagatgcatcccgatgtgaaggtgagcttggctcaactatgtatggatggatctacaatccatttcttcaagtcgcttctcaatgaacacaatgtgctgacatgggaacaactcaaggcggaactcttggagcgatatggagggatcggagatggagacattttcgagcagttagcggctatccagcaagaaggaagcatcaatgagtacattaccaaattcgaatgcctcactgctcagtatgcgtacgctgggtccattaacgtattcgaggatgatgaatctcaccaaggcgacggaattatagttccgagagggaaagagattggcatgggtttcgatcacccaatacgaggcagaagtggactgggccaagggaacaggaatagcccatcattcactagtgagtttcatggatccgatctgagcccaattttgaaccacaatgttctacccccaatgacagaggcatttgtcatctatcctactaggagcagtcggagtgcaagaggaaagggctctgctacaagggaagaaatggacgatgaggcaaatgctatgattgcagaagacgagcttgatgatgaagaggacgaaggagaatgcattcttgtgttggtcgataggggggcacacataacttcgtctcctagaaggaatgtgcaagggtgttaccttggaagtggattcattgtagttaacagtggacatagtgttattttatttggagggcatcaacttgattttgggggtagcctggctcactcctttgggggagatgcgagtggattggctagtaacagcaccataacaccagaacctgaggcagtgttagctccgcggtctgtccagaaaggtggagaattggtgaatcaggtgttagttcaatggaaagacgagggactcgaggaagcaacctgggaagaagaattcaacatcaaaagtcaatttcctgacttgcgacttgaggataagtctctttttgaaggaggtattgataggaatgggagtgtgggcttagaagtaagggagaggcccaagatatggagggtgaatgcaaggagaaacaaaagtgtcaaagagagagatgggtattgggaatttttagaattctgtcatggagagagaattgtaacctctctggaagagcttggctctgggcagtag

SEQ ID NO: 36065 - DNA, 291 bp, Glycine max
  Peptide Sequence Number=SeqID_152843
atgaagcttaatccaaatttaaaacaagctacctccaaaccaaactatcatatccaaattgaaacccctacacgattttgccccaaatccatatttgtggcaaaggctgttgtgcaaaattcagatttcatgggcagcaaaccaaaaacgaagcctgatcaaagatttgcggcgaaggtgaatggtgacacgaaggacaaatggcggttgttggtggctatggtgtttgatggaatggtgtttaggttgaaggagaagattggaaaagaagatgatgtgttgtgttgttag

SEQ ID NO: 36066 - DNA, 1155 bp, Glycine max
  Peptide Sequence Number=SeqID_152844
atggagcttggtttgagcttaggagactcttcaaggcctttgcttggtttcatggaaaagcctcgtgaagcctccaaccaacttggtttaggcttcaacacaacgttatcaattggtccaatcattactacacataaagatcatcaacaagatgaagatgaagaataccaagaagaagaagaagaagaaacaaagccaaagaacaacaacactcacagaatacaaggtcctgatggcctttcttccaatcccaacaacaacaacaatacagttctgcatcaacttgatcttctccctcaactcgctctcccatggcaccctccttctgaaaacggaagtttatcatctgagttgggaggctcttctcggggcttggacgtgaacgcgcagccgccggcggtggaggacgaggcggaggaagcggcggcgctgtcgtcgtctccgaacagcgccgcctcatcatttcaaatggatctctgcatatacagcagcagaggagggagctcctataagagggactttgagggtgaggcttatgatcaaaggacctcttcaagggccagtgacgatgacgacaataataatggtagtggtggtaatactaggaaaaaactcagactctccaaggaacaatctgcattccttgaagagagtttcaaggaacacaacactcttaatcctaaacaaaagcttgctcttgctaaacaactcaatcttcaacctcgtcaagtagaagtctggttccagaatcgtcgagcaaggactaagttgaagcaaacagaagtggattgtgagtacttgaagagatgttgtgagacactaacagaagagaatagaagacttcacaaggagcttcaggaattgagggctttgaagacttcaaaccccttctacatgcaattaccagccacaactttgaccatgtgcccttcttgtgagcgcgtggccacaaattctacatccacttccttatctattagtgccaccatcaatgctacaaattcaggagccatggccagtgtcaaaacaagtaataacaataacaacaatgactcaccctccaaagccattggattcccctttggaaaaccgaggtttcacccatttgttcacactagccaacaaccccatcaacaccaatccacagcatcttga

SEQ ID NO: 36067 - DNA, 525 bp, Glycine max
  Peptide Sequence Number=SeqID_152845
atgagagaaaaattggtgaaactctcggatgcaatagtagaattggatctgggggaagacactatactgatttgtggctgtggtcaggctgggtgtggttgcctaaagctcgatggcagacaagcgtgtagagggttgtgtggtggtgtgaggggctatgatggaggaaggttaatggcaaagggggcacttggtcattggatcacattggcaaaaaggcacccacagcagaaagatgtaattaaggctcttcctaaaccattgcctgcatctatggtggctagttatctgtcaaacaagaaagaggatgaaaaagatgaagatgagaaggaagagaatgagcagtctgttgagcacttgtcacctcaagatctattgaagagacatattaaacgtgccaaaaatgttagagcacgaacattgctagacttagttgacagcaaggttgtcaaaaattgtgattttacttgtaagattgttagatcctacgagttatggatggcttccatgcttgattcagtgtag

SEQ ID NO: 36068 - DNA, 2682 bp, Glycine max
  Peptide Sequence Number=SeqID_152846
atggactccgacgctattgccaaggactcaacagagctaaagttgaccgagctattgaaggaggtcaccgtagaccactcacatcagttctccaagctcgtcgacgacaccgtttccgccattaaaacctccatcgacaaaatccccaacgatttcaaggtaactgctgatttagcatcgcgctttgttacggacattggcgcagataaggtcgagttcaagtttaagaagcccgcgtttgttaagattggtggaagttgctccatacagagtctcgcgaagcctgaagttaatgtcgatcttattatcaggttacctaaggaatgcttccatgagaaggattatttgaattacagatatcatgccaagaggtgtctctatctctgcttggtgaagaagtatttggagaagtctccatctattgatagggttgaatggtccactctgcagaatgaggccagaaaacccctgctcgttgtgtatccagctgctaagcttgttgaagttcctggtttttttgtaagaattattccatcagctaaggctatatttagcactgcaaagttgaacctgaaacgcaacaacattcataatttgagtaatgggacttctcttcaggctacaccaaagtacaattctagtattttggaagacatgtttatagaggatgcagagtttatcaacaactattatcttggatggaaggaactaaaagaggctttaatcctgcttaagcaaaggatgcaacttaaagagtcatttccagttgtcatatgtcatccatctggaggattcaatttggcctttcgaatgtctaggattggttttactcggcttcaaaatgaggctactttgacacttaggtgcatggaaaagtgtagagattgtggatttgaggaagtttttatgaccaagattgactatgctgttaaatatgactattgtatgagttcacaacttcagggcttgtcggtacttgataaagtgcccttgttcgtaggattttcagtgagttctttggagaaagcatttaggatggttgatattggcccaaatgctgaaagtaaagaagaggctcttgaatttcgaaagttttggggagaaaaagcagatcttagaagatttaaagatggtagaattgcagaaagcacggttgttgtggatcaacttgatttctctttgcttcacggagctggagatcctatatcatactctggaagtttgcttggggcatttgatgttttatcaaagcgtttgcgtcttattgaagacctccctttgaaggtgtctagtgtacagcctttagactctgctttcaggtttacatcagtcttccctcctgaacctcatcttctagcaaatgaaaaaaatgaatctctcagactgaataagttagttccgtcatgcattcaaccactggaagttatgattcagctggaaggttctgggaactggccaatggatgaaatcgcaattgaaaaaacaaaatgtagtttccttatccaaattggagtaagtcttcaaaagatgtgggggatgacatgtactgccactgaggataatgtggacgtgttaatgtctggatatttatttcgtctaaaaattttgcatgagaggggccttagtttgctcaacaaggaaattgggagtgatcaagctaagcggattccttctgctgacaagaaactttttatccatagtcagcatgctaacatgatcaatggattacaaagtcgttatccaatatttggaccagtagttagacttgcaaaacgatgggctgcttcacatctattttcagcttgcctgttagaggaggctgttgagctattggttgcatatctttttcttaatcctttgccttatgatgttccctgctcacggatcactgggtttttgagattcctgcggttactctcacactatgattggactttctctccgctggttgttgacataaatcatgacttgagtccaagtgatgagaaagaaataaatgacaactttttgctaaaaagaaaaggtcagggagaaaatggacaaagtgtaggaccagcaatgttcttagctacagtttatgataaagaatctgaggcttggactggattatcacctagtggaatggaacttaaaaggttagttgcatatgcccgaagcagtgccaatttgttggcaaaactcacatttcaggaagagattggtccatataggtgggagtgtctttttagaactcctttaaacaattatgatgcagtagttattctccacaaggacaaactaccgtatccccaaaggcttctcttcccatcagaagttaatcatggaacacatgttgcagaaggacacgccagcaagtgtttccaaccctttttgttgcctaaagatttgaagggcaggccagaggaacttaaaaataagttgctggtagattttgatccatcaaagtgctttatcagagatttaaaggcatgtacacaagaattctcaaccacattccaagtatggcatgattatctgggaggtgatgttatcggcctaacatggggagagtcatatccttccaagaagcggaagcgcgaggatgtagttgacccctgcaaggtgttaaaagcggtgggggaagttgggaaaggatttgtgaggagtatatactttctcaagcccccaaagctcatgaattaa

SEQ ID NO: 36069 - DNA, 669 bp, Glycine max
  Peptide Sequence Number=SeqID_152847
atggatgtggcgattgccatccgtacggccgtgattaaggacagcaaactctatgtgcaggccggcgctggcattgtggccgactcggtgccgcagagcgaatgggaagaaacccaaaacaaagccaaagcggtgattcgcgcggctgagctgtattttggcgagctggggcaagatgtacatgtgcacagaaatgatgaaatcacactcgaacagattaaggcgatgaagcctgaaaaaatcgtgatttctccaggcccttgtacgcctaacgaggcaggtatttctgtgccactgatacatgagtttgcgggcaagattccgctgctgggcgtgtgcctgggtcatcagagtattggtcaggcctttggcggcaagatcatcaaggctaaaaccttgatgcatggtaaaacttctttgatccaccataccaataccggcgtgttcagaaacctgcccaacccttacaccgcgacgcgctaccattcgctggtcatcgagcgtgagaccattccggattgtctggagatcacggcatggacagaagatggtgagatcatgggcgtcaagcataaaaccttggctgttgaaggtgtgcagtttcaccccgagtctattctgacggagtatgggcatgagctgctggataacttcctgaaaggctattaa

SEQ ID NO: 36070 - DNA, 180 bp, Glycine max
  Peptide Sequence Number=SeqID_152848
atggcagtgatgatgcaacccttttttgtgattaattccatcctccttgtcgatggtgacaacctcctaatcgtcgtagaggtggtagaagtccaatatgagcttagcgttgtaggagtctgtggtgatctccatgtgccacatcacgaccatgttgcgaaagaaagagaagagatttga

SEQ ID NO: 36071 - DNA, 219 bp, Glycine max
  Peptide Sequence Number=SeqID_152849
atgttaggattcacaagcagttctcctcaaatttcagccagcccgcatcaattggactttacaccttacgcttcaaggtcatacagtgctcaatggaatgtccaggaactcctccatgatatgcacatgttgcattcgagtcgtatcctcggaaaaatggaggttgaggaaccctggcaggggttatggctaccattgcattatcaagcatgtggctga

SEQ ID NO: 36072 - DNA, 234 bp, Glycine max
  Peptide Sequence Number=SeqID_152850
atgtaccgcggtgactggctcgtggttcatggcgtcaatcacatgctttcgggtactcaccatgggaaacgacaccctacacaccgagcgaagaagaatgattcgtatcgggtttcggttgaggaagaacaagatggtggtgatcaagagtcttcttctgggtttgaagatcatcgccaccgcgagggtgaggaaaattctccgcatcattaccacttctctgcttttcattag

SEQ ID NO: 36073 - DNA, 489 bp, Glycine max
  Peptide Sequence Number=SeqID_152851
atggacaaagatacactggggtatagtgggcgaaaatgttcaaagaacctgggggaattagcgagtggtgactatttgacatttggtgcacttatttggcgtagttggaagcttcaagatcgatttacgatgagtccatatgtggctatcactcctgattatcatccacataaatgtataagaccatcaagacctaggaggattggtggcagcggttgggtcctaataggagcggaggactcacccctacaaccaacaactttcaagttcaagagatgtctatggagccgcaccctctacgagcttggcgtactaagcagacatatagagcctcacgatgctcaagaattcatagtgaccataatgaggtttaatgtgagagataacatcctgagttggagattcgagttagtacgtctcatgcaggtcattgaggatcgaggagatcacgcctatatgatgcttgaggaggaggaagtgttagactaa

SEQ ID NO: 36074 - DNA, 573 bp, Glycine max
  Peptide Sequence Number=SeqID_152852
atgaatgttgaatgctttcctttccttgcaggttcaccatgggtcatcttgagccgatccttcctggagtattgcatatttggctgggataatttacctcgaacgctcctgatgtattttacaaatgtcaagttatcccaagaaggttactttcattcggtcgtttgcaatgcaccagaattcaagaacacaacagtaaatggtgacttacggtacatgatctgggacaatcctccgaagatggagccacttttccttaatgtatctgtttatgatcaaatggtagaaagtggtgctgcttttgctagacagtttgaagtaggtgaccgggttttggacatgatcgataaaaagatacttaagcgtgggcgtaatcaagctgtgccaggagcatggtgctcgggcaggaggagctggtgggtggatccatgctcacaatggggggatgatgtcactattctgaagccaggccctcaggctaagaagctcgaggagtctgtttcgagccttcttgacgattggagctcacacacaaatcagtgccttattaccagtgaagagacagaagactag

SEQ ID NO: 36075 - DNA, 660 bp, Glycine max
  Peptide Sequence Number=SeqID_152853
atgggtgttgagagaaaatggctcttcaccctcttcactgcagcattcctctccttcatcattctcatgttctcttccttctcttgcttcacatcccctatgccctttccctctattgtccactatggtccacaccaccctcctgcttttgcctacttcatatccggtggcaatagggacagcgaccggatcttccggttgctgctggcggtgtaccaccccaggaaccgttacttgctccaccttgggatggatgccagggatgaagagaggcaaaggctggcggcggccaccatgtcggtgccggcgattcgtgcctttcggaacgtggatgtggtggggaaggctgattatgtgacctacttggggtcatccaatgtggctgttgctctcagggctgcttctgtgatgatgaagttggatggaggatgggactggtttgtgaccttgagtgctcgggattatccccttgtcacccaggatgctaggttggaaccaaaacaaaagttgagcggaccccaagatatggtaaagaagtttggagttgagaatgatggaggggttcaatctggtttggaaccaagacaaaagttgagaggaccccaagatatggaaaagaagtttcgagttgagaatcatggaggggttcaatgttgttag

SEQ ID NO: 36076 - DNA, 423 bp, Glycine max
  Peptide Sequence Number=SeqID_152854
atgacggcaccaacaagttcaacagattgtgaccttgttatttctatcgggaagtcagcttcagccccgtttccatctttggttttacgatcttcaacatcaggggatgattcaagagaaaaggacaaaatatatgtggaccatcgtcctagaagtagcaaggatacaggcacaggtgttgcacgtgatcttggtcctctttctctggattcccctgtagttgacgatttcaaagaaggtacaaatcttgtcctccttcacaaacttgaacttggtggcatccacaatggagaacaagatggagcccttgttgtcggcttcaaagtagaagtccggagggtacacataaacggagttcagattcaggttggacccgcactacgtacaactgtacacgaaagccatggttccattggaatgtga

SEQ ID NO: 36077 - DNA, 210 bp, Glycine max
  Peptide Sequence Number=SeqID_152855
atggtgacaaaaggaaatcactggaaattgactgtaaaagagatgggtcttcgtaaacttatgacgaccgatgagaacagagaccagacgcccgaaattggcaggaaaagagctgcgcggcagtgtgcgacagtgagaagcagttctggaatctggaggagtgcagtaaagagctctcttgagggggcttgcacttgcaagggcacatga

SEQ ID NO: 36078 - DNA, 366 bp, Glycine max
  Peptide Sequence Number=SeqID_152856
atgacttgtttgcagcccagcctcattacaagcctagtaaaagtgcttcggattcaagtttgtgtgttcttgactgtatggcttagcgcgagattgacactaagctcaaattcacttactcgcgctaagcacgagaatggcgctaagtgcgacgtcaagatcaggaagccctttttaagcctgatttgcacggaattgaaggagagccaagagaattgttcactacttaaaggcatgaagagtgtgaatttcagagagcgtagagcagagcaaggggccaagttttcatcttttagggagattagtgagtttttgagtgattgtgagattcctagaggaggaggagacatccccactcctttgtaa

SEQ ID NO: 36079 - DNA, 522 bp, Glycine max
  Peptide Sequence Number=SeqID_152857
atgcctttcatcacacggggttttagtgaccccaacgcgagggtacttcgaggagtccgtaaggcatgggatgcggtccaaaggaaggacaaagagcttaggggaaacggtaatgggatcatcaaccgctatcgtaagtggctgagattccacacacaaggtttggattggctcccaaagtttagggttgtggcagaggaagaggccgaagctctggaagagagtgaggaggtacaagccctaaaggcggagcttgagaaagcccaagcagtcaaggagaagttcaagtcaacaaccatcaaagtccgaaaggagtatgatgaactgaaagacatcaacttggccaccgtcaaagccttggagcaggaaaccaaaagggcccggaagaaagaacacgaccgaaacaagttccgaggagctttatggggcagcaacaaagagcctaagctccgaagagacgaaagggatcagtcgcgagttgaaggcatgatcttgaaaggacgggttaaaggcttgtcttag

SEQ ID NO: 36080 - DNA, 213 bp, Glycine max
  Peptide Sequence Number=SeqID_152858
atggaagtcaatgaaaaatgtgatgtgtatagctttggggtattagcaattcaaacaccttttggagagtaccatgaagattttataacttcattgttgacatcttcatcaaatttcattgactcaacacttgatattccttcgttgatgggtaagttagaccaacgtctcccttaccctccaaatcctattgcaaaggagatagttttaact

SEQ ID NO: 36081 - DNA, 507 bp, Glycine max
  Peptide Sequence Number=SeqID_152859
atggtgtctgagaacatagttgaagccaaaaaagagtttgacaataaacatctcattggggttggaggacaaggaaatgttttcaaagcagaattacacacaggccaaattgttgctatgaagaaactccattcaatacaaaatggagaaatgcccaatattaaagctttatcaagggaaattcaatctttgacaaaaattcgacatcgtaacattgtgaagttatttgggttttgttctcattcacgattcttatttttggtatatgagttcttggaaaagagaagcatgggaatagaaggatcaatgcaattaattaagggtgtagcaagtgctttatgctatatgcatcatgattgttcacctccaattgttcatcgagatatattaagcaaaaatgttctttcggatttggagcatgttgctcatgtctcagattttggaagagctaagcttcttaatcttaattcaaccaattggacctcattcgcagtcacttttggataa

SEQ ID NO: 36082 - DNA, 201 bp, Glycine max
  Peptide Sequence Number=SeqID_152860
atgaaacacagctccaaactcgaaagtggaggacgcatgaacgaaaacgcaattcatgggctccgaaaaaaggggggagaatggaggattgccttgagggcaatcatgaaacacagctccaaactcgaaggtggaggacgcatgaacgaaaacacaattcatgggctccgaaaaaagggggagaatggaggatttctttga

SEQ ID NO: 36083 - DNA, 497 bp, Glycine max
  Peptide Sequence Number=SeqID_152861
atgggagttcttgattatatttcagaatttttctcagtgtcacctgccactggaaagaaacgcaaagcaatgcagacagtggaaatcaaagtgaaaatggactgtgatggctgtgaaagaagagttagaaattccgttgtccacatgaaagctatattcatggtcacaaggtggcataataactacaacagcaatatgttggtaaacggtgtgaagcaagtagaggtgaacagaaagcaaagcaaggtaactgttacaggttatgtggaccgaaacagggtcctaaagaaagtgcagagcacaggaaaaagagcagatttttggccatatattccttacaacttggtggcttatccttatgtggcacaggcttatgacaaaaaggcaccatcagggtatgtgaaaaacgctgcacaagcactacctgcctctaactcactcgatgagaaactcacctctctcttcagtgatgaaaaccccaatgcatgttcaatcat

SEQ ID NO: 36084 - DNA, 453 bp, Glycine max
  Peptide Sequence Number=SeqID_152862
atgggtgaagtagaggaggtgcaaaagcagatgaaggccgacatggaggccatgaaagagcaaatggccacaatgatggaggccatgatgagcatgaagaagataatggaagccaatgcggttgcagtggctgttaccagcgctgttgctaaggtgaacccgatgcccccatgtggcctaaaccaaataaatcattcaacctcagatatggtaggtttggaaggcaaagagttggaaggtacgggcagtcctcatttagtgcgaaaaataagcatgccttcccaccatatggctggcctcccaactatacaccgcccaatgtggcgtacactcccagtgagaatgccaataactccactcttatacccattgagagccgacaaccccaaactgatcatacacatgtctctcaaaccgtgggggagacacatgaaattcctcaccacaatctag

SEQ ID NO: 36085 - DNA, 336 bp, Glycine max
  Peptide Sequence Number=SeqID_152863
atgggaaaggttgatcatcaagaggaaaggctcaaggccattgaaggaggcaaagattatgcctttgctaacctagaagagttgttcctagtacccaatatcatcacccctcctaagttcaaggtgttggactttgacaagtacaaggggactacttgccccaagaaccatctaaagatgtattgttggaagatgggggcatacgcaacagatgaggaaatgctgatacatttcttccaaaaaagtcttactagggtagctgttacctggtacactagcttggaaccttcccaagtccattcttggaatgacctaatggttgccttcattaggtag

SEQ ID NO: 36086 - DNA, 357 bp, Glycine max
  Peptide Sequence Number=SeqID_152864
atgcggctctcaaaagccaatgaaccggcaagaagtctttcggtcatatccacttggttggtgcaaaccaaccggcgggcatcatgcacagagaaatcgaatttccattcatcaatcagtgcaccctcaaaaggtaatttcagagacatgaatggaataagattgaagttttcaaatgcttggaagcattcaaaattctcatttgagaagaactccatatcaatgaattttgggtctacaatggaacgagagcaaaagaggtttgtgtaccatatatgttgttcctctgatgagaataatgatccagagggaatggagggaggaattggggcttcctatgaccctgaatgccgctga

SEQ ID NO: 36087 - DNA, 303 bp, Glycine max
  Peptide Sequence Number=SeqID_152865
acacgatcgagcctggatggaaaggcgcagaatgaccataatttgtctctgtgcaccatcggacacgatcgcctctggatggggaaaagggtgcagaatgaccataatttgtctctgcgtgccatcggacacgattgtgtctggatggcgaaaagacacgatcgagcctggatggaaaggtgcagaatgaccacaatttgtcactacgcaccatcggacacgattgcctctggatggcgaaagggtgtgcggaatgaccataatttgtctccgcatgtcatcgggctcgccgcctctggatga

SEQ ID NO: 36088 - DNA, 369 bp, Glycine max
  Peptide Sequence Number=SeqID_152866
atggaggagtgtagtactaggttgggttatggtcagctttatggattctttgagcctcagctcatacacaatgcaaaggatagatgcgatgaagcccataattacattcaaacatgggtcaaggaatcacatagagaggtctacctaggaccttacatgaatcacttatcattgtgtgccctaggaatgatgttgttgtgtggttctattcattgcgctactttggatggtaaatgtaatcaagttgcacctcattggattaaagtaaagagtcatgcacaaagcagaggctatgagtatgactattatgtaatgcattggatgtggaacatagtgatgagtggtttcaagaatgaatggaccaagtga

SEQ ID NO: 36089 - DNA, 738 bp, Glycine max
  Peptide Sequence Number=SeqID_152867
atgatagcaggtacaagacagccaggaaatgatagtgatgtttatctaactcccttgattgaagacttaaaaaaattgtgggtagacagggttgatgtgtttgatggtaatcctcaacagacattcaagttgcgtgtaatggagtatgaaagtgtgtcgaaacccttagctggaaatgaagtttatgatcagtctgatcttgaagttagacactgtatagacgtgatgcatgtggataaaaatgtctgtgatagtttaattgatacccttcttaacattaaaggagatcaggttgtgtggtccggtttatttgcggtggatgtgtccagttgggcgttacatgaagagtatgttgaattagtcaaacccattgggcttccacaatgtcgtcatgacaacatacgtagagaggttgctcccttcatagatactcacaaagattttttgatggttgctcacacaaaaatgaacatgatgaaggtgttgcaagagcataatagaagtttcataaattggtttaaagaaacaaccttttgtgatgacagtacttctaaaacattaagattgttagctattggaccaaatctcaatgtccccacatggaagggatatgatatcaacaactatttcttctacgtaaagtcacaagatgataaaagtagcatgcagaacaatggtgtcaaccttgagccagattctgatcacttttgcagggcatcagataacaacccgatctga

SEQ ID NO: 36090 - DNA, 693 bp, Glycine max
  Peptide Sequence Number=SeqID_152868
atggcacaagaaatatctgataaaattgactccttgcaagaagagatgacacagggaagctttgtcccccatggttatgaggatattctcgatactgtcattgggcgactagaacacccaagtcgtgttcgagctgcgggaagtggtgtgacaataagccagttctttggacaagcaccacgttccatgaacaattcatctgcctcgatcaatctgcaacagtcggatgagataataggaaatcttaaagaacaatggaggagagaatttgaagaggaaaacagacaaagtcttgagaaaatgaaagaagagttaaaggagcaaatcaaaatggacacaaaggggagttatggtgaagctgctgcaaatccatcaggggaagaaaatgtcatggatgtcaagccaacgatggggttgcacgttgtacatgataattctacccgcctagtggcgttgggaaaagtatatgaaggcgcgtccaccatacacaacatcccttatgcaaatgatgtcataagagtgagtgttgaaaaagtttatgatggtgatgctcaaatcccttttcctatgtcagaggatgaacttattcataggtcgactgttgttggtggaactgatctattagttgatttgattcaaaatatgcatgatcttaacgagaagcttcttgaaatgctgtggaatgggacttaa

SEQ ID NO: 36091 - DNA, 288 bp, Glycine max
  Peptide Sequence Number=SeqID_152869
atgtcacattttagagttagtgatatcgtagtgacgaggcgggtcgttacagaggaagttcgaactcgcggtggttgttccattgttggctactatactactagatgttatgttactcattgtcatcctgccattgatctggtagcaaccatgctctccttaagggatagggaagttttacttgggccccatggtgggctccaaaatgatatcttctttcttcataatctactactaggcagtctgaagggtggggtacctacaagaggcactccgatactcaagtaa

SEQ ID NO: 36092 - DNA, 252 bp, Glycine max
  Peptide Sequence Number=SeqID_152870
atgaagcacggacaccctagcctcagccctttgtcgtgttcggtgtccgactcgacaccaacaccgacacgacaccgacgcttgtgtggtggagtagtagacaaaacttggattcacactctaatgcttttgtcatctgggggaagctccattttgatgtcaactgcaatttcttcacaatcaacgaagctgagtggctgcgtttcaaacctcacgaattctagaggtcaaatgttcggtattacctgctag

SEQ ID NO: 36093 - DNA, 2937 bp, Glycine max
  Peptide Sequence Number=SeqID_152871
atgaagggatcgattttcggagtaatatcgactgagaatcctttcaatagcattttgacgacgctcgaaaagcccggtggtgctggcgagtttggaaagtactttagcttgcctgctctcaacgatcgtagaatcgcaatttcagtgatgattgatgagttaaatttgaatctggggaggttaagaattgatggtgacattcgtgtgtttggcaatacagatagacttccttactctgtgaggatacttttggaatctgcaatccggaactgtgatgagtttcaagttaagagtaacgacgttgaaaaaattattgattgggagaatacctctccgaagctggtggagattccattcaagccagctagagtgcttctccaggattttactggcgtgcctgctgttgtcgatcttgcttgcatgcgagatgccatgaacaaacttggtggtgattctaataaaattaatcccttggtaccagttgatcttgtcattgatcactctgttcaagttgatgtggcaagatcagaaaatgctgtccaggcaaatatggaacttgaattccaaagaaacaaggaaagatttggtttcctcaaatggggttctaatgcattcaataatatgcttgtcgttcctcctggatcagggatagttcaccaggttaatttagaataccttggtagagttgtgttcaacacaaatggtgtgctttatcctgacagcgttgttggaactgattcacacacaactatgattgatggcctgggtgttgctggatggggagttggtggaatagaagcagaagctgcaatgcttggccaaacctgtgtggttttgaccattggagaagttattcccatgagcatggtcctaccgggtgtcgttgggttcaaattattaggcaaactacgagatggtgtcacagctactgacttggtgttgactgttacacaaatgctaagaaagcatggggttgttggcaagtttgtagagttttatggggaaggcatgagtgaactgtctttggcagatcgtgccaccatagcaaacatgtctcctgagtatggtgcaaccatgggcttctttcctgtggatcatgtcactttgcaatatttgagactgactggcagaagtgatgagactgtttctatgatagaatcgtacttacgagcaaataagatgtttgtggattacagcgagccccaagtggagagagtgtactcatcgtatttggaactcaatcttgaggatgtagaaccctgtgtctcaggtccaaaaaggcctcatgaccgtgtccctttgagagaaatgaaggtagactggcatgcctgcctcaacaataaagttggattcaagggttttgctgtaccaaaagaatctcagaataaggttgcagagttcacattccaagggacaccagcacatcttaggcacggtgatgttgttatagctgctatcaccagttgtacaaatacttcaaatcctagcgtaatgcttggagctgcattggttgcaaagaaagcatgtgaattgggattgcaggtgaagccatggattaaaacaagccttgccccaggttctggtgttgtgactaagtatttgcagaggagtggcttgcagaagtatttgaatgagctagggtttaatatagttgggtatggatgcaccacatgcattggaaattcaggggatattaatgaagctgttgcatctgcaattactgaaaatggtacatatcctttggtaaatggtattttttctttgtactcacttgtgaatctccgaggttacctaagcattggttttctgaatattccagatatagtagctgcagctgtactgtctggaaataggaactttgagggccgagttcacccattaacaagagctaattatcttgcttctcctcctcttgttgttgcctatgcccttgctggcacagtggacattgactttgacactgaacccattgggatagggaaggatggcacaaagatcttcttcagggatatttggccatccagtgaagaaatagcaaatgttgtacaatcaagtgtgctgcctgctatgtttagggacacatataatgcgatcacccaagggaatcccatgtggaataatttatctgttccaactggcactctttatgcttgggaccctacatcaacttatattcatgagccaccttattttagagatatgagcatgtctcccccaggctctcatggagtgaaagatgcttactgtttgctcaactttggagacagtatcacaactgaccacatctctccagctggcagcatacataaggacagtcctgcagccagataccttatagaacgtggggttgatagacgggacttcaactcctatggaagtcgccgtggtaatgatgaggtgatggcccgaggaacttttgccaatattcgcattgtcaacaaatttttgaatggagaagttggacctaaaactattcatattccttctggggagaagttatcagtctttgatgctgcagagaaatacaagagtgaggggcatgatatgattatcttggctggtgctgagtatgggagtggaagctctcgtgattgggctgcaaaggggccaatgctactgggcgtgaaagctgtcatagcaaaaagttttgaaaggattcaccgaagtaatttggtgggaatgggtatcattccattgtgttttaagcccggggatgatgctgattctcttggattaactggccatgaacgttacaccattgatctaccaagcaatgtgaatgaaatacgacccggccaagatgtcacagtggtgacagatgccgggaaatcatttgtatctacactgagatttgatacagaggttgaactagcttacttcaaccatggaggcatcttacaatatgtcatcagaaacatggtcaatgctaaacattga

SEQ ID NO: 36094 - DNA, 519 bp, Glycine max
  Peptide Sequence Number=SeqID_152872
atgtggatatacttgatcaaacacaagagtaagaggtttgatgtcttacaaaaattcaaagctatgtctgggaggcatagtggcactatgatcaagagtctaaggactgatggagggaaagagtatacatcaagggagcttgagaacttatgtgaacaacttggcatacaacatgagattacaccaccctatactcctcagcataatggcatagcgaaaaggagaaatagatctgtcctcaatatggctagaagcataatgaagcaaaagtcaattccgcattctttctggggtgaagcagcaacaactgttagcttgaaagagaaagtacctgaagaatactggtcaggaaggaaacctctagtaagtcacttgagagtgtttgattccctgtgctataagcatataacagatgctaggagaaggaagttagaagataagagcaaacctatgatcttgatagggtatcacataactagtgcctacaggttgtatagtccaaaaaagggaaaaaattga

SEQ ID NO: 36095 - DNA, 153 bp, Glycine max
  Peptide Sequence Number=SeqID_152873
atggtaagaaccgagtatcggacactcagggaacttgtgttatttggtacctatagggaagatccaacagaggacttagctttccataccaggaaacctcctttacaacaaagagaagaacaagatgaaagattgcaaaaatacaagtggtga

SEQ ID NO: 36096 - DNA, 237 bp, Glycine max
  Peptide Sequence Number=SeqID_152874
atgttgtacgcagccttacccttgcatatgcaaagaggctgtttccggattcgaacccatgaccaacaagtcaccaaggcacaactttaccgttgcaccagggctcgtcctcgggaaccattactatataagcccgaaaaaaaaggcagcgacactggtgaggtgtgtaacatgtttaagcacgaagaagacatcccaaatgccttatttgggcaccatcctaacatcactattccg

SEQ ID NO: 36097 - DNA, 639 bp, Glycine max
  Peptide Sequence Number=SeqID_152875
atgatgattttaaagattatattgtggaacaaaagaattttggcagagactttcccaatgaaggtggtggagttgttcctaacaacaaggattatggtggataagggaaatgataggaaacatgacaatgaagattatgatgttggttatggtggttgtgctgcaatgcattccctagagaatatgagcatagaaattgcaaaggatacctcagaatgtggcaatgattttaaaaacaactacttcttggtggctaattcagcaaggtctcgccaatacccattacctcaatatgtcaagtatgtcatctctaagtaccaaaagcttttacagccacttctgtcaatgacaaggttctcatcaacattggcttttgaaatagaccacaaaagcaaaattgataatccattagtcagacttccacttcctcttgcatacaaattagagttaaatttagtggcaaagaggaatgctggaaatgttccttttgtatgggagaaggcaccaggaagtcccaaagatgaaagcaaattactgatgcaatcctcacaaggaagggacccatccccaaagccatggctaggagactccaagaagattgggccagagatgcaggaggaggctctagggttctcatga

SEQ ID NO: 36098 - DNA, 750 bp, Glycine max
  Peptide Sequence Number=SeqID_152876
ttgttgatgggacaaacctgtgcatagaattgaagtttgtgatggagcatttgggccaaatagaagagcgtattagatgcctagaagcagtagttttcagggctaggcagcgtcagaggtggcgaccgagtcaggctccaattcggataactaactatgcaggagaatcggtaacagtagctgaccttcaagctgaagaagacagggtgcatcaagagtttggtggtgttgatgttggaggcgagatgatgggaagtgggagaatgggtaaaaggaaagctagctatttggttgctaaagcattgggtgtggaaaccaatcagggtgagggttttgcaacaaatttgtttcattgtaatatatgcttggacaaggcaagagatccagttttgacttcttgtggtcacttgttttgctggccatgctttcataagttgtcatatgcttattcaaatgtgagggaatgtccggtttgtaaaggagatgtcactgaagaaggaattatcccaatttatggcaatgcaagtgttgataacaatggcaagtttgaatcgaatgaaattggtttgacagttcctgctcgacctcgtccacatagaattgagatccctggtgaagcatctggcatctcaatcttcactatgtcaataaagactcacaatttagcattgctgccacaaaccaatcagagtcatactccagatgttgctgctaccacttttgcagcctcatcttctgtatcttcttcaa

SEQ ID NO: 36099 - DNA, 189 bp, Glycine max
  Peptide Sequence Number=SeqID_152877
atgtcggctctgaaagaacaaatggcctccatgatggaggccatgttagaagcaagatgttttgatgtcttgatgatgctaaaggatcaagtgcttctaagttttattcaagacaagaatccaagaaagtcaagatatatgatcaagtttgatctcttagaatctttaggaagaagtttcccaaattga

SEQ ID NO: 36100 - DNA, 285 bp, Glycine max
  Peptide Sequence Number=SeqID_152878
atgtatgcattgcacgtaaaacacctcctcttcctttactcctcttgcacggccgagatctttgaggatttctttaacaaggttgttttctcttacataagtggcggtgtgacgtcgacaacgttgagaccaaagagggtggtgtatacgctaaaatatggggacaatgtcaatgcgatgctatgcatgggcatggtgaggtcgaagtgcagtctcaaagggttgcaccacccgcaattgtcgctggaagagcatagcttggaggacaaaggttttctgcaatga

SEQ ID NO: 36101 - DNA, 204 bp, Glycine max
  Peptide Sequence Number=SeqID_152879
atggagaagttaccggatgaaggcatggcggaggaaacgagggagggcacggcagcggaggtaacaaaaataagcaaaaatgttaatggcgggcacaagggatggcacgagagagagggcacatggaaaggagggattatttataatcctgccaccacgtcaaatacgacaacagttttggcaaaaaaacatcgtggtttttaa

SEQ ID NO: 36102 - DNA, 324 bp, Glycine max
  Peptide Sequence Number=SeqID_152880
atggcttcctatggtgtaacaaaacattcaaaagggaaaactaaggagaggggaagttctatttcaaatgatggagatgaggcatgtgaagatgctcgtgacctgctttccaggattgaatcattcttcgtgagttttagtgtgagtggcttgagtggatgggataaacaagaggtccaaacatttggaagtttctcgagtgaccatcaacaaggacgtgatttcatgattcataggtttttgcttgcagcaaaggcaatgacatttgaagcatctcaatatgcttccaagaaagcacttattggacaagaacatcaaaagtag

SEQ ID NO: 36103 - DNA, 411 bp, Glycine max
  Peptide Sequence Number=SeqID_152881
atgagtgttgtgttagagctcctaattgctaaaaaaacagaggaaataaagaaaaagggggtttctccacggatcaaaagcgtgagaaagaaacagccaaatccatgtgtgggacaagcatctcctcgtcctcctgctgctactgcaaaaaccaaaacacacaaaccaaaaagaaatcatcactatcaccctacttcggatccatcgaagaaccaaccccaaccaaatccccaaattctgagcatggaatgcatcgtaagggaacgttacgtcaatgggagcaggagtcatcacagtcatggtgattgcgcaattgacctctatggcactgcttatggagaagcaatggaagagagagaaagcagaatgaggaaggagatgaggggacacgagatgacggcaccgcgctag

SEQ ID NO: 36104 - DNA, 174 bp, Glycine max
  Peptide Sequence Number=SeqID_152882
atgaagaaacggattttctcgacgggacatttggatggagaccagaggaagcaagcgtgctgtagagtgcaaccaccattacgtccacaccaacatgaccggagacggctggagagtgagacacctgaccttgcccacagaaggaaacaaaagttttttgtgtatacatcttaa

SEQ ID NO: 36105 - DNA, 786 bp, Glycine max
  Peptide Sequence Number=SeqID_152883
atggcattgatccacatcaatgaggttgcactcaacatgattctagttatgaaagccatggacaaaaattcaagtatcctaactcagtattcagaacttgacttgaagagacaactagctaccaaatgggttgatgaagaatgcactttggctagctctaaggtgagatataatgggaagattgacttagaaagccaatgtcttacaaagttaggccatcaagaaatatttggtgcaagcttttttggacttcctattgttcttccttctctaaaagctccatcagagtcttggcttaagcgcactttacctacaatttgcaaaaagaacataacttcacagtctaaccttactgcaaacatttgtgcaagaagtaaaactcccgacacaacatcatcattgtgtcctaagtgggaaacaatgatgttgaagccaaatttgcatgtttgtcttcacaatttgttgctgagcaaaactgctgatgaagaaaagaaaatagctaaacacaaattgacatctgccaatgaagacgttgtcaacttaaagaagattattgcaagattggaaggtgaattacatgtcaaagataaagttcaatctgatttggtttctaagttggaggaagctcaacgtcaagtggtcgtgttgcttctagattttgattgcaaaatactggatgttaattgtgatgtggttgatggtgagattgttagagattctcaactctgttatgatgaggaggaggaagaacaaaagaatgaagtagaatcaaatgcagctatttag

SEQ ID NO: 36106 - DNA, 330 bp, Glycine max
  Peptide Sequence Number=SeqID_152884
atggtttcaaggtctcaacaaggttgcaaaaaccaaggcaaagaaagataccaaggagaatatcacaagtctcaaaggtaccattttgaacctgacaaaccctctcaaggaaagcttcgaaaaacagaagagctacaacaaaggctttattgtagacttgaagagtttcgcacatgctgtaatggtgggaattcagatagcaagaggagggatgaaagaaatgctaagagaggtgatgacgatgtcgaatcatctaaaaacaaactaggattccaacaaatctgcaatataggaataacctatttcgacttagagacacaatccaattag

SEQ ID NO: 36107 - DNA, 597 bp, Glycine max
  Peptide Sequence Number=SeqID_152885
atgatgcctcactctcagatctttcaaaacaaccaaaactacgccgtttggacgcatcccctgccgccgtacccgccggagaacgcggcggtgttctctcgccgggagacgttcaatccacatccgggtcgggtcactgggaacaaaaggaaagactgccaccgaaccgggtcgggtccgccggcgttacgttccggcgggaaaggtcgccggattcaccacccgaagcgaattttcggccggggcggtggcagcagtcgactcacgccgccgttcgcgccgcgcaacacgacgtcgttcataatcagggcgaagaactgcggcggcatggtgtcgccgccgactccagaggcggcgatttttccggcggcgtctctgtctccagcgacgttcgacgagaagtcggcaaaggagcagtggggcttcaacggctacggctccatgaagggccttatccggctccggcccggaaacttggattccggcgccggcaggttcgagatggtgtaccctaattccggtgaagaacataataacttggacaaaagggtttctgaacaggacacccatattgcgcaccttgaagaacagaattga

SEQ ID NO: 36108 - DNA, 136 bp, Glycine max
  Peptide Sequence Number=SeqID_152886
atgccaacgtcatcacgtcggctcggcggctcttcaccagaatcttactccctgcaccctgctgctgtcattctgctcccacgaacaatgttcgtgatcatcactggtatcaaccacacgatacaaaattgcaaag

SEQ ID NO: 36109 - DNA, 1434 bp, Glycine max
  Peptide Sequence Number=SeqID_152887
atggcatttgagttgtatgggatgttagctgggaatgttagtccactgactggtgaacctgtaaagcctgcctatggtggtgataatgaggcttttcttatgaaagtagtgaaaccaatatatgatgtaatagccaaggaagctaagagaagtaatatgggaaaagcaaagcattctcactggagaaactatgatgatttaaatgaatatttttggtcagttgattgttttcggctaggttggcctatgcgtgttgactctgatttcttctctgttcctttccctcagcaggaacgtcaagttaacaaagacgaggaaaacagaggtcctgcttcagaccggtggagtgggaaaactaattttgttgaaatacgcacattttggcatatatttagaagttttgatagaatgtggagcttttatatactctgtttacaggcaatgataatcattgcttggaatggttctggcgaattaagctcaatatttaggggtgatgttttcaagcaagttctcagcatcttcataactgctgcaatattgaagcttgcacaagccattctggacatattccttagttggaaagcaaggaaagtcatgtcgcttcatgtccagctgcggtatatatttaaggcaattttagctgcagcttgggtcataattttaccagtcacttatgcttacagttggaaaaatccatctggctttgcacaaaccataaagaattggtttggcaatggtacaggttccccttctttgttcattttggctgtcttcatctacttatctccaaatatactctctgcactgttatttgtgttcccattcattcgccagtttcttgagaggtctaacaatggtgttgtgaagctcatgatgtggtggtctcagcctcggctcttcgttggaagaggaatgcaggagggtccaatttcattgttgaagtacacttctttctgggttatgctaattctatctaaactagcattcagctactacctggagattaagcctcttgtggctccaacaaaagccatcatgaatgctcatgtatcagtttacagatggcatgagttcttccctcatgccagaaacaatattggtgtagtgattgcaatatggtcccctatcatacttgtacgtgtatctttctgtcacatgtctcaccaagtctactttatggatacacagatttggtatgctatcttctctacaatagtaggaggcatatatggtgcatttcgacgtttgggagagttgaaattgataagagaaaaaagtcagatatcaattgataagaaccttaggagaaccataccaccaaagctatccgctatagttagagtccaataccttataaacctcatgctagaataccatacttccaatgttgaactcgagttccataccttgcattggatcttaactaagtaa

SEQ ID NO: 36110 - DNA, 2397 bp, Glycine max
  Peptide Sequence Number=SeqID_152888
atgtatatccgacaagcattggagctacaggcttttcttgatatggcaaaggatgaagaattaatgaaaggttacaaggctgcagaactagagagcatggaaagtacaactggtgagcggtcactgtggacacaatgccaatcattagctgacatgaagttcacttacgtagtttcatgtcaacaatatagtattcataagcgatctggtgattctagggcaaaagaaattttaaagcttatgattaagtacccatctcttcgagttgcttacattgatgaggttgaagagcatatcaaagattcatcccgaaaaacagacaaggtttattattcagctctagtaaaagctgcattaccatcaaaatcaaatgattcctctgaaacagttcagagtttagaccaggtaatttacaagataaagcttccaggacctgcaatattgggtgaggggaagccagaaaatcaaaaccatgccatcattttcacacgtggggaaggcttgcaaacaattgatatgaatcaggataattatatggaagaagctttcaaaatgaggaatttgctacaagaattcctcaaacaacatgatggtccaagaatgccgacaatacttggactcagagagcatatatttactggcagtgtttcatcccttgcatggtttatgtccaatcaagagcatagttttgtgacaattggacaaagattgttggcttatcccttgaaagtgcggttccattatggccatccggatgtgtttgatagacttttccacctgacaagagggggtgtaagcaaggcttctaaagtcatcaacttgagtgaggatatatttgcaggcatgtattttagtttctcttcctgttacaattctacattacgtgaaggcaatgtcactcatcatgagtacatacaagttggtaaaggaagggatgtgggtcttaaccagatatcaatgtttgaagcaaaaatcgctgctgggaatggtgagcagacaatgagtagagacatatacaggcttggacaccgttttgatttcttccgaatgctatcttgttattacactaccattggcttctatttcagtaccttgataactgtcctcacagtttatgtattcctttatggacgcctctatcttgcccttagtggagttgaagaaagtttgaacaaacaaagagctatacgagacaacaaagctcttcaagtagctcttgcttctcagtcagttgtgcagattggatttttgttagccttgcctatgttgatggaaattggcttggagaggggatttcgtgaggctttaagtgaatttgtactaatgcaactacagttggctcctgtatttttcacattttctcttggaacaaaaacacactattatggaaggacattgcttcatggaggtgcagagtacaaaggcactggtcgtggttttgtggtgtttcatgccaaatttgctgataactataggctctattctcgcagccattttgttaaagggattgaattgatgattctgcttgtggtctaccatatatttggccatggatacagaggagtggttgcctatattttaattaccgtaaccatgtggttcatggtagggacatggctttttgctccattccttttcaatccatcaggttttgagtggcagaagatagttgatgactacacagattggcaaaaatggataagcaaccgtggaggcattggtgtatctcctcaaaaaagttgggaatcctggtgggaaaaggaacatgagcatctccggcactctggcaagcgcggtatcgctactgagataatattagccctccgctttttcatttatcaatatggcctggtatatcacctttcagtcactgatgagaagactcaaagtgttttggtttatggtctttcatggctgataatctttgtaatattgggtttaatgaagggaatgctcctgagtgttgattgcctgcacatgcgccgcctcagtgcagactaccagcttctatttcggttgattgagggttctattttcttaacattccttgccatcttcataatcctaatactactggccaatatgacaattaaggacataatagtctgcattcttgcagtcatgccaacaggctggggaatgctgctgattgcacaagcttgcaagcctctcattgaaaaaactgggttttgggggtctgttcgagcacttgctcgcggatatgaagtaataatgggcttgcttctcttcacaccagttgctttcttggcatggttcccatttgtttcagagtttcaaaccagaatgcttttcaaccaagctttcagcagaggtttgcagatttctcgtattcttggtggacaaagaagtgaacgctcctccaaccacaaagagtga

SEQ ID NO: 36111 - DNA, 747 bp, Glycine max
  Peptide Sequence Number=SeqID_152889
atggtggaacctattgtagttgacgaggagtatcgcaaggaaatagaaatggctcgacgagaacttggcgttttcatcaccaacaataaatgcgcccctctcatgcttcaatttgcgtacctcacactacttaattactgctttcatgtctttctagctaattctctccattgtctccggtggtggaatgatgctgcaacttacgatgccaagagcagaagaggaggccccaacggttctatcagattaaggattggacaagagttgaaacacgaagcaaacaagggattggaaaaagcagttcaatactgtgaaatagtgaagaccaaacttaagcttaaaaaagtttcatacgcgaacctttaccaggattcaaatgagtctccacgaactgaagggcgctttatagatggtgaagaagatgccaggaatttaagaaaaatcttctctcgtatgggtctgagtgacgagcaagacattgtggctctatgtggtggccacactttgataagaacgatgtatccaaaagtctccatggatgaggaaatttttttcaaagaatatgcaatctcacataagaaactctctgagctaggcttcaatctcaataatctagatcagcccaagggaccatatgcgaagctaaatcagcacaaaggactcataggaataggtatagcatcagttgtggtgaccgtcatattaggttatttactgaagaggaagaaaaaccaattgaaaaattga

SEQ ID NO: 36112 - DNA, 459 bp, Glycine max
  Peptide Sequence Number=SeqID_152890
atggaaaaattgtttcaaattaaacgcaatttcttgaagtttctgacaaaacaacctgcggcggctttagtagtggcctttcagaacccaaccatgatgagtccatgtcgatcacccgcacgtatggtttcgataattccgaaggaagcgcgaaggaagcacaagggcgaaagcttcagcgccagagagcccacatcgcccacagtatcgtgcatgggccaagttcagggcaagaagaagaaaaaggcccggaaacagaaaagggcccaggcccataaggattccattggtgaaaagaagaagattttgctttggattcagaagggaagtgatgaggggcgaaagcatagggtgttggaagagaaggcagtggaagccccgtcattgaatacgatgaagaaatttgctagtgggagaggatctttgtatgatttcgatgttaaaattgcagaaagatga

SEQ ID NO: 36113 - DNA, 1317 bp, Glycine max
  Peptide Sequence Number=SeqID_152891
atggcggatactggcgacgacaatggcgttacctatcttcacggcgacctcgatttgaaaatcatcgaggcgcgccacttgcccaatatggacatcttctccgagcgcctccgccgctgcgtcaccgcctgcgacactatcaaattccactccgacgctcccgccgccgccgacggcgacggcggcagccagcgtacacggacgcaccatcatcggaggatcatcacgagcgacccgtacgtcaccgtttcggtgccgcaagccacggtggcgcgcacgcgcgtgctgaagaacgcgcagaatcctgtctggaaggaacagttccacatcccgctcgcgcatcccgtggtggatttggagtttcgcgtcaaggacgacgacgttttcggcgcgcagagcatgggaacggtcaaagtcccggcgcggcggattgccaccggagcgaagatttccgagtggtttccggttctgttgccgtccgggaagccgccgaagccggacacggcgctgcacgtggagatgcaattcactccggtgtcggaaaatttactgtaccagcgaggcattgcggcggatcccgagcacaacggcgtgaggcacacgtattttccggtgaggaaggggagttcggtgaggctgtaccaggacgcacattgtacggaatctggtgaagggaagataccggagattaagcttgagaatggaaatgtttataggcacgggaagtgttgggaggatatttgttatgctatttctgaggctcatcacatggtgtatttggttggttggtctatttatcacaaggtgaggctcgttagagagcctactaggccgttaccgcgaggtggcgatttgacgcttggtgagttgcttaagtataagtctgaagaaggggtgagagtgttgttgctggtttgggatgataaaacttcgcacgataaggttttcctcaagacggctggtgtgatggggactcatgatgaggaaaccaggaagttttttaagcattcttctgttatgtgtgttctgtcgcctcggtatgccagcagcaagatgagcttcttgaagcaacaggcaagtgttggggttgttggaacagtcttcacacaccaccaaaaatgtgtgattgtggacacacaggctgccggcaataaccggaagataactgcttttataggaggtcttgatctttgtgatggtcgctatgacacacccgagcatcgtctgtttcgtaatcttgacgatgtatttgatggcgatttccacaatcctacatttcctaaaacaggaaagtcttattttaactattttcaatag

SEQ ID NO: 36114 - DNA, 5613 bp, Glycine max
  Peptide Sequence Number=SeqID_152892
atggatatccgattccctttctctccggcggaggtcgccaaagtccgcatggtccagttcggaatactcagtcctgacgagatcaggcaaatgtctgtggtgcaaatcgagcacggggagactacggagagagggaagccgaaggttggaggattgagtgaccctcggcttggaaccattgacagaaagttgaagtgtgaaacttgcacggcgagtatggctgagtgccctggccattttgggcacttggagcttgctaagccaatgttccatattggttttttgaagaccgtcttaactataatgcgttgtgtttgcttcaactgctctaaaattcttgctgatgagaatgatcacaagtttaagcaagctttgagaatcaggaatcccaaaaacaggctaaaaaagattctggatgcttgcaaaaacaaaagcaagtgtgaagggggagatgagattgatattcccggtcaagatactgatgagcctgttaaaaagagtcgtggtggctgtggtgctcagcagccgaagattactattgaggggatgaaaatgattgcagagtataaagcacaaaggaagaaaagtgatgaccaagaacagcttcctgaacctgtggaaaggaaacagactctttctgcagaaagggttcttggtgttctgaaaaggataagtgatgaggactgtcagttgttgggcttgaatcctaagtatgcccgccctgactggatgattttacaagttcttccaattcctcctccacctgtgagaccttctgtaatgatggacacatcctccaggagtgaggcaagtgctttatggcactgttttatgtgtttttggttattacaagatgatttaactcatcaactggccatgatcatcaggcacaatgagaatctgaagagacaggagaggaatggatctcctgcgcatattatttccgagtttgctcagttattgcagttccacatagcaacatattttgataatgagttgcctggattgccaagggctactcaaagatccggaaggcctatcaaatcaatatgtagcaggctcaaggcaaaggaaggccggattagaggtaacttgatgggtaaaagagttgatttttctgctcgaacagtcattacacctgatccaacgatcaacattgatcaattgggagtaccgtggagtatcgcattgaacctaacatatcctgagactgtgactccatataacattgaaaggttgaaggaacttgttgagtatggaccccatccaccacctggaaaaactggtgccaagtatatcattcgtgatgacggacaaagacttgatctcagatatttaaagaaaagtagtgatcaccatttggagcttggctacaaggttgagcgtcatttgaatgatggagactttgttctcttcaatcgtcagcccagtcttcataaaatgtctatcatggggcatagaatcaaaatcatgccttattctactttccggcttaacttgtctgtaacttcaccatataatgctgattttgatggggacgaaatgaatatgcatgttcctcagtcttttgaaaccagagctgaggttttggagctgatgatggtgcctaaatgcattgtgtcaccacagtcaaacaggccagtgatgggaattgtccaagatacacttttaggatgcagaaaaatcactaagagagatactttcatcacaaaggatgtttttatgaacatattgatgtggtgggaagattttgatgggaaagttcctgctcctgcaatattaaagccagaaccattgtggacagggaagcaagttttcaatctcatcattcctaaacaaataaatctaattagatattctagctggcacagtgagagtgaaaggggatccataacccctggggataccatggtcagaattgaaaagggggagctacttactggaacactttgcaaaaagacgcttggaacatctactggaagtctcattcatgtgatttgttgtgaaactttgtggctctggaaactgtttcaatcagttcctttcttcttcgtttacgtcactgaaagtctacttgaatacagggaagaggttggccctgatgctgctcggaaatttcttggtcatactcagtggcttgtaaactactggcttttgcagaatgcttttagcattggaattggtgatacaattgctgatgcttccactatggaaaccataaatcagactatttcagcagctaaggagaaagtgaaacaacttattagggaagctcaagagaagaagttggaggctgaacctggtcggacaatgatggattcatttgaaaatagagtgaaccagactctaaatagagctcgtgatgatgctggaaatagtgctcaaaaaagtttatctgagagcaacaatctgaaagcaatggtgacagctggttccaaaggaagttttatcaacatttctcaaatgactgcttgtgtgggccaacaaaacgttgagggtaagcgaattccatatgggttcatagaccgtacattgcctcacttcacaaaagatgattatgggcctgaaagtcgtggctttgtggagaactcatatctacgtggacttacccctcaagagttctttttccatgccatgggtggtagggaaggtcttattgatactgcagtgaagacctctgaaactgggtacatccagagacgacttgtgaaggctatggaggacatcatggttaaatatgatgggacagttagaaactctttgggagatgtcatacaatttctctacggagaagatggtatggatgctgtttggattgaaacacagaagctggattcccttaaaatgaaaaaaacagagtttgacagggtgtttaggtatgaattcgatgatgaaaactggaagcctacttacatgcttgaggagcccgtagaagacttaaaaaccatcagagagtttcgcaatgtgtttgaggctgaagttcaaaagcttgaagctgatagatatcaacttgcaaccgagatagccactactggtgacagttctctgccactacctgttaacctgaagagacttatctggaatgctcagaagacatttaaggttgacttccgaaggccatctgatatgcatccaatggagattgtggaagccattgataagctccaggagcggcttaaggttgttccgggtgaagatctcttgagtcaagaagctcagaagaatgctactctcctgttcaatattctgctccgcagcacttttgccagtaaaagggtcttggaggaataccggctttctcgtgaggcatttgagtgggtagtgggagaaatagaatcaaggttcttgcagtcccttgtagcctctggagaaatgattggctgtgtggcagcacaatcaattggtgaacctgccactcagatgactctcaacactttccactatgctggtgtcagtgcaaagaatgttactcttggtgttcctaggttaagggaaatcattaatgtggcaaagagaattaaaacgccttctctgtctgtgtacttgagatcagatgttggtaagactaaagagagagccaagagtgtgcagtgtgctttagaatataccactctcaggagtgtgactcaagctacagaggtgtggtatgatccagatccgatgagtacaataattgaagaggacgctgattttgtgaagtcctactatgaaatgcctgatgaagaagttgctcttgaaaaaatttcaccttggttgcttcgcatagagctgaatcgtgaaatgatggtggataagaagttgagtatggctgacattgcagagaagattaaccttgaatttgatgatgatttgacttgtatatttaatgatgacaatgctgaaaaacttattcttcgtatccgtattatgaatgatgaagcacccaagggtgagattcaggatgagtctgctgaagatgatgttttcttaaagaaaatagaaagcaacatgctgactgaaatgaccttacgaggtatcccagacatcaataaggttttcataaaaaatactaaagttcagaagtttgatgagaatcaaggttttaagcctaatgaggaatggatgcttgataccgaaggtgtcaaccttctagctgtgatgtgccatgaagatgttgatgcgaccaggaccacaagcaaccacttgattgaagtcattgaagttcttggtattgaggcagttcggcgagctcttctggatgaattgcgtgttgtcatttcttttgatggttcttatgtcaattacagacatttggctattctttgtgataccatgacttatcgagggcatttgatggcaattacacgtcatggtatcaaccgaaatgatactgggccaatgatgagatgctcatttgaagaaacagttgatattctgcttgatgccgcagtatatgctgagactgattacttgaggggagtcactgaaaacataatgttaggtcaacttgcccccattggcactggcgaatgtgccttgtatcttaatgatgaaatgctgaaaaatgccattgagctccaattgcctagttatatggatggtcttgattttggtatgactcctgcccgttccccaatatctggaactccatatcatgaaggcttgatgtctcccagttatttgttgagcccaaatttacggctctctccaactagcgatgcacagttttcaccttatgttggtgggatggcattttctcctacttcatctcctggttacagcccatcatccccaggctatagtccctcatcacccgggtacagtcccacttcacccggatacagccccacgtcacccgggtacagtcccacgtcacctgggtacagtcccacctctccgacttatagtcctagctctccgggatatagtcctacaagtccagcttattcgcctaccagtccatcctactctcccacatcacccagctacagtcctacatcacccagctacagccctacatcacccagctacagccccacctctcccagctacagccccacttcaccagcttacagccccacttcaccagcttacagccccacatctccttcctatagtccgacttctccttcttatagtccaacttcaccttcctacagccctacatcaccctcttacagtccaacatctccatcatatagtcctacatcacctgcttacagccccacatcgcctggatacagcccaacctcaccctcatatagcccaacctcgccatcgtatagccctacttcccctagttacaatccacagtcagcaaagtatagtccttcgttagcatattctccaagcagtccgagattgtctccatcaagtccatatagtcccacatcaccgaactatagcccaacgtcgccatcatattccccaacatctccatcttattctccatcaagcccaacatacagtcccagcagcccttataattctggtgtgagcccagactatagcccaagttcgccccaatttagtcccagtacgggttactcaccaagtcaacctggttactcaccatcttcaaccagccagtacactccacaaactagtgacaaggatgatggaggcactcgctga

SEQ ID NO: 36115 - DNA, 2247 bp, Glycine max
  Peptide Sequence Number=SeqID_152893
atgaaacttaagcttgggattagatcaataggtgaagcaggaaagcatgccttcaaccataatcggcagattattcaacttgggaaactgggaaaagttgaagaggccatcagaatcttctttaacatgacccacaaaaaccttgtaacatacaattccatgatatctgtgttggccaaaaatgctagaatcagagatgctcgacaactgtttgatcaaatgtcccttagaaaccttgtttcttggaacaccatgattgccggatatcttcacaacaatatggttgaagaagccagtgagctgttcgacgtaatgccagaaagagacaatttttcatgggctttgatgataacttgctatacgcgtaaagggaagcttgaaaaggctagagaattgcttgagttggttcctgataagttggacactgcatgttggaatgcaatgatagccggctatgcaaagaagggccagttcaatgatgctaagaaagtgttcgagcagatgccggcaaaggatttggtttcttacaactcaatgttagctggatacacacaaaatgggaaaatgcatttagcattgcagttttttgagagcatgactgagaggaatgtggtttcatggaatttgatggtggctggatatgttaagagtggtgacctgagttctgcttggcaattgtttgaaaagattccaaatcctaatgctgtttcttgggttacaatgttgtgtgggttggcaaaatatggaaagatggcagaggccagggaactttttgacaggatgcccagtaagaatgtggtttcttggaatgcaatgattgcaacctatgttcaagacttacaagttgatgaagccgttaagctgttcaagaaaatgccacataaagatagtgtatcatggactacaataattaatgggtacattcgagttggtaagcttgatgaagcacggcaagtttacaatcagatgccttgcaaagacatcacagcgcaaacagcattgatgtctggattaatacagaatggaaggatagatgaggctgatcaaatgtttagtcgaattggtgcacacgatgttgtttgttggaacagcatgattgcaggctattcacggagtggaagaatggatgaagctctcaatttattcagacaaatgcccattaagaactcagtttcttggaatactatgatttctggatatgctcaggctggacaaatggatagagcaacagagatctttcaggccatgagggagaagaatatagtttcctggaattctcttattgcaggtttcctacaaaataatctatacttggatgctcttaagagtttggttatgatggggaaggaaggaaagaaacccgatcaatcaacttttgcatgtaccttaagtgcatgtgctaatcttgctgctttgcaagtaggcaatcaactccatgaatatattctgaagagtggttatatgaatgatttatttgttggcaatgccctgattgccatgtatgcaaaatgtggaagggtacaaagtgctgaacaagtgttcagagatattgaatgcgttgatctcatttcctggaattccttgatttcgggttatgctttgaatggatatgcaaataaggcatttaaggcctttgaacagatgtcatcagagagagtggttcctgatgaggttaccttcattgggatgttgtcagcatgcagtcatgctggtttagcaaatcagggtttggatatatttaaatgtatgattgaagattttgctattgaacccttggcagaacactacagctgccttgttgatttgcttggccgcgtcggtaggctagaggaagccttcaatacagtgagggggatgaaggtgaaagcaaatgctggattatggggttcactgcttggggcctgtcgtgtacacaaaaaccttgaacttggaagatttgctgccgagaggctttttgaacttgaaccacataatgcctccaattacattaccttgtcaaacatgcatgctgaggctggcagatgggaagaggttgaaagagtaaggatgctaatgagaggcaaaagagctggaaagcaacctggttgcagctggattgaagtgcaaaatcagatacaacattttctgtcgcatgatccggcaaagctcagacctaaaaatattcagattatattgaatactttagctgcacatatgagggataagtgtaacacatctgacatgaaatcagcttttgacatattatga

SEQ ID NO: 36116 - DNA, 237 bp, Glycine max
  Peptide Sequence Number=SeqID_152894
atgcaaaggatactgggctgccttgcagcgacgttctctgcttgtttagcgccgggaaggggcaacgatcgatcggtcgtgaccctatccccacttgcatctgtccctatgtaccttcaacttgtctcgacttctaaccgtgacctaagaaggccctgcccctgttaccacaaaatatgcatgtgtatgtgcatgtatgttccttatgcgataactttcttagtgaaggctggttag

SEQ ID NO: 36117 - DNA, 831 bp, Glycine max
  Peptide Sequence Number=SeqID_152895
atggctaaagtggtgcagagtgagtttcagaaggcatatgagggtgggatagctaaggcaaggtattgggagccaacttatgaggatacaatgaatctaattgctcgtttgccagccattgctgcttatatttatcgacggaaatacaaggatggaaaaatcataccgttggatgattctttggattatggtgcaaactatgctcacatgttagggtttgatgatccggaaatgctggagtttatgaggctgtatatttccatccacagtgatcacgaaggtggcaatgttagttcacacacagcccacctagttgctagtccgctatcagatccttatcttgcatttgcagctgctttgaatgggttagctgggcccctgcatggtttggccaatcaggaggttctacgatggatcagatcaatagttgcagagtttggaactcctaacataagtacagaacaattggctgactacattaataaaactttgagtaggggccaggttgtgcctggatatggacatggggttttacgccagacagatccaagatacacatgtcagagggagtttgctttgaagcatttgcctaatgatccatatttccagctggttaaaaatccatggccgaatgttgatgcgcacagtggagtgctactgaactactatggtctaactgaggaaaactattatactgttctctttggtgtatcaaggagctttggagttggccctcagttgatatgggatagggctcttggaatgccacttgaaaggcccaaaagtgtcacactagagaagctcgagcaattggttgccaaatcatcgtga

SEQ ID NO: 36118 - DNA, 585 bp, Glycine max
  Peptide Sequence Number=SeqID_152896
atgttaccccttaacctaaaattgtgcttaattacacttttgtccttgctccttgcttgtgttaaccttgtcgcttttaatttaatcaaagagatccatggttgcgccgtgaggaactccatccacctgcatcaccagttgagcagtgctttgattgaagtgtttgagagatgtggttctcttcgttgtgcaagtttggtgtttgagaaaatgagggatgaggataaagatgtggttatgtggagcaatttgatccctacgtgcaccttccacggtgaggcggaggcttgcaatcatgttgggttggtggatgaggcggtgtggtattttgcaaggatgagtggggagtatggtgtggaggctgggagtgatcattattcgtgcttggtgaatgttttggggagggctgggaggttgcaggaggcttatgaggtgatcaaggggatgtcggtgaaggtgacggaaaaggcgtgggaggggctgcttggggcgtgcaagaatttcgaggagctgaggctggcaaaggttgcatcaagggcattggtggaggtggagtcagggaatgcagctaattatgtgctatag

SEQ ID NO: 36119 - DNA, 222 bp, Glycine max
  Peptide Sequence Number=SeqID_152897
atggtggaagcaaatcttgtgggagcaagagctagcaacttcaatgtgttgaatgaattgaacattgtggttgtggtggtggcaattagttatgactatgacaacgatggtgatgctggtggtggtgtcaatgacagaggtggtattagtgttggtgtcggagacaatggtggtgatagtgatggtgttagtgatagtgacaacgaaaagtgtcatagttaa

SEQ ID NO: 36120 - DNA, 144 bp, Glycine max
  Peptide Sequence Number=SeqID_152898
atgcaaggtccccttccccatggagggctcggtcaaggtctagatctaggcctaggtcccgatcaagatcttttgaaaaacaaaggccaagatcccagtcgagaagtcgtggaagatcaagatcaagatgtaacgaaaggttag

SEQ ID NO: 36121 - DNA, 738 bp, Glycine max
  Peptide Sequence Number=SeqID_152899
atgcatcgctgttgcagtggttcccaggggcacgtgatgggaccctgcacatgtggtatgtttcacagccaaaccaccagctccttcgccatgttcttctccatgcccaaccacaaaccaccaccctacgatgattccgacaacatttatgactattcttccttcactccctcttcctcttcttccgttgactgcaccctctccctcggtaccccttccacccgcttctccgaagacgaagaaaaacgaagccgccacgaacgccgttccgtctctaacttctgctgggacttactacaatccaaacacaacaaccctcaatcccattccaagtcctcccgaaccaccaacaccaccgaccctctcctcgctcgccgctgcgccaattgtgataccacttctactcctctctggagaaatggcccccgtggccccaagtcactgtgcaatgcgtgtgggattagattcaagaaggaggagagaagagcgagtgcggccgccgccacgccggcatcggcggcttccggtggcgttatggaatcggcgcaggtgtacaataactcgtggtacgcacaccagcagagtcagaagatgcagtgcttctcgccggggatggggaacgagttccgtttcgtggatgacgccgatagagacgccgccgataacggcattccgttcctctcgtggagactcaacgtcacggacagaacgagcctggttcacgacttcacgagatga

SEQ ID NO: 36122 - DNA, 210 bp, Glycine max
  Peptide Sequence Number=SeqID_152900
atggacattgctgctcttttaacttctgctggagttaacatctcttattacggaaacaacccagcaatgtccatgtgtacttttgaagaaagtctactttctggatgcacctggtcccaggaatcatatgccaggagtacatgttttgataacatggcaccaacatcatgcactacaaaaactcttgatcaatatttattaaaatgctga

SEQ ID NO: 36123 - DNA, 1068 bp, Glycine max
  Peptide Sequence Number=SeqID_152901
atggcaaaaataagagaaaatggcatcaaatttgcttcggagaagctcgttctcactgccggcgcaactcccgcgaatgagattctgatgttttgccttgctgatcctggggaagctttcattcttcccacaccctattaccctgggtttgatagagatctgaaatggagaaccggggttgagattgttccaatgcattgctccagctcaaatggctttagaatcacttcctctgctttagaacaagcctaccaacaagcacaaaaactgaatctcaaaatcaaaggggttttagtaaccaacccctcaaacccactgggcataaccatgaccaaaactgagctcaaccacctagtagatttcgcaattgacaaaaacattcacataataagcgacgaaatctactcgggtactgtcttcgactcacccaaattcgtaagcatcacagaagttgtgaacgagagaattactactgtcaacaacaatagcattaccagcatttggaaccgcattcacattgtttatggtttctccaaagaccttggcataccaggatttcgtgtgggaatgattttctccaacaacgaaactgttgtggctgctgccaccaaaatgtcaagcttcggattggtgtcttcacaaactcagtatttggtggcaaacttgcttaaggacaagaaattcacttgcaagcacatggaagagactcagaagagactgaagaggcgaaaggagatgcttgtgtctggcctcagaaacgcggggattaggtgtttgaaaagcaatgctgggttgttctgttgggttgacatgagacacttattgggctctgccactacttttgaggcagagaaggagctttggatgaacattctttgcaaagttgggttgaacatatctcctggctcttcttgccactgctgtgaaccaggttggttcagggtatgctttgccaacatgtctgaagacacgttagaagttgcaatgcggcgcataaaggcttttgcggactcaattaccatctctactagtgtcgtaagaggatccattgctaagtgggaaaattaa

SEQ ID NO: 36124 - DNA, 303 bp, Glycine max
  Peptide Sequence Number=SeqID_152902
atgtctatgtgtgggtttcttcttttttcgaggatgagggtgaaagccccgtcgagtctgatgacacaaaagtccaaagttggagctgtgaacaaacaaattatgtcacatagaaagtgggaatataattcagggtcgaacacgtacaagagaaagcgacttggtactgctacaaggaaaggattattacttattagcaccatgactaagatgccaagccaaccatttatttcaccaaaagacactagagagctccatgttttgaattgtgatgggtttggttgtaggcttgtagctagctag

SEQ ID NO: 36125 - DNA, 1187 bp, Glycine max
  Peptide Sequence Number=SeqID_152903
atggccttcaatcaccgccgcattgtcgctgtacgcgctgagcgtgtgctgcggggtctgctggtgggtgttcttgatcatccggaacagcgagcggtcctgctcctgaccgtcgatggtccagctggcgttgaagatcttgtgccggcagtgctcggaattggcctgcgcgaacatcatcagttcgacgtcggacggcgcgcggcccagcgcggtgaagcgttcgcgcaggtagtcgatctcgtcctgggccatggccaggccgaggcgctggttggcggcctccagctggtccaccggcacgcgttccagttcgccacgggccggcgccgagaacagcgcctggccctgctccacggcctccagcaccgactgcgtcatcgggtcgtgcagcgccttgaccagcgcctgctgggcggcggcatcggccggccagccctgcacgtcgatgcgcaggccgcgctcgacccggctcaccggctgcccggcaccacggaccagctcggtggccttgctcgaccacggcgacagcgtgcccaggcgcggcaccacgatgcggctgaccgcgccttcggccacggcctcggcctgcggcgccgcttcgaggatgcggcacagggtggtcaggtcgggggcggcgctgccttcgggctgcacgaagtagacgtgccaggcaccactgatgcgcagggagggagcgatggactgcaggcgggattcaagacgttcgcggcggaacggcgacagggcgggcgcgccctcgaggaccatcatgtccggggaaccgtagttgggaaacgggcccgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 36126 - DNA, 447 bp, Glycine max
  Peptide Sequence Number=SeqID_152904
atgggtgaggaagcaaaacaagaatcacccaaggcccatgagtctaagccagaggaaaatcaagaagagaagaaagagcctaaaccaccatctccgtgtgtgttgtttcttgacttacattgtaaaggatgcgccaagaaaattaagaaatctattatgaaaatgagaggagtcgagggagtggtgattgatatggctaaaaatgaagtgaccataaagggaacagtggagcctcaagcaatctgcaacatgatttcgaagaaaacaaagaaaagagccaaagttatatctccattgccagaagcagtagaaggagaacctataccttctcaggctagtgaaccggttattgtagaacttaacataagcatgcattgtgaagcttgtgctgcgcagctcaagaggaagatactcaaaatgagagaaagagacgttaacaataagtaa

SEQ ID NO: 36127 - DNA, 402 bp, Glycine max
  Peptide Sequence Number=SeqID_152905
atgaaggctgacacggaggccatgaaagagcatatgacaacgatgatggaagcaatgatgagcatgaggaagatgatggaggttaacactactacagttgttgctgcaagtactgctactgagatggacccgattcacccgtccagtttcaatcgagaaaggctgagggccattgaaggaggaggaaattatgcctttactgacataacagagttgtgcttggtacccgacgtggttattcctctaaagttcaaggtgccagattttgataagtataagggaaccacttgcccaaagaatcacttgaaaatgtattgtaggaagatgggggtgtatgcgaaagatgaaaagttgttgatgcatttcttccaggagagtcttgctggggcagctattacctag

SEQ ID NO: 36128 - DNA, 933 bp, Glycine max
  Peptide Sequence Number=SeqID_152906
atggatcaggttcaacgtcagtcttttagcaagttagcaccaaccatagaggagttcgaggggatcttaggatgcccgataggaggaaggaagccatacctcttttctgggtactacccttctatggagagagtagtgggagtagtcaagatcttagaattactatttccgaatatagatggacttgtagatctagcaacggttgatgcctttcttgcttatcaccacaacaaggaaagcctgttaaggtatcatatgagaggtgcgccattggaggaaaccatcatgcctttcatcgcacgaggattcaacgaagctaatacgaagatacttcagaagattcgtaaggcatggaataaagtgggaagaaaagataaggagcttagaggaagaagcaatggtgtcataggcaactatcacaaatggctgaaatctagagtgcaaggggctgagttggaaaagacaaaagtagtgaagaagaagatgaaggtagtagtcactagagttaggaaagaatgtgataggctaatagatatcaacatgtctgcgactgaagcgctagagcaggaaatgaagaaagccagaaaggaagataatgagctcaaacttagaaaggctgagacagacaaatcaaggatggagaacgtaatgttaaaagatgagttaaggaattgtcaggagtcaaagggaagtttgaaagagcaattgagcaagagggaaaagaacatgttgataatcattgatcaatataaagagaagaaaaacctacctgctggtcgggggcaggtgttgaaggatgaacatgcaaaggtgtcggcctttcaagttgaaagggaggcaagggaagaggtgatagagttattgcatgaagtggatggacaaatttgctctcactctaaatggaagtctagagcttccaaggctattagctag

SEQ ID NO: 36129 - DNA, 180 bp, Glycine max
  Peptide Sequence Number=SeqID_152907
atggcagaaccatcgaagaagcgaaagggtgtttcgacttcatccgcagtcaccggaactcgaagctacggagcatccaaagcacatacaactcaaattcctccctccatatcatctcctacgttgttttcctcggaagaacaacatatctggaatggatacccgcatcactcagcttga

SEQ ID NO: 36130 - DNA, 111 bp, Glycine max
  Peptide Sequence Number=SeqID_152908
atggttcaagtggtcgtagacatgcttttagtgcaagtttttgcaactgggatgcagattctatcgaggatcatactgagaccgcgcgaagaagttgaggtagtcgattga

SEQ ID NO: 36131 - DNA, 264 bp, Glycine max
  Peptide Sequence Number=SeqID_152909
atgctcatcctcaacgaggtgcttctaggcttgaataattcccgccagaagttgctcacaaaaaatagggtcttggtcagataccaaaccttgaggaaaatcgtggagtttacagacattatcgaggaagagttatgcgactctatacgcgttgaattgggattggagagccccgaaatgcacaactttagaaaatatgtcaactaccgccatgatgatagtatacccctgcgaatgtggaagactggtgatgaaatccactga

SEQ ID NO: 36132 - DNA, 252 bp, Glycine max
  Peptide Sequence Number=SeqID_152910
atgcgtgacaaatttcaccttgaggacaaggtgagttcgttagggggaggtattgatagcaatcaagaaccagaaccatcaccactagagaacattgaaccagcagtccaactagagattccatcaagccaagaaggcaggcccaagaggagcactaccagaccagtttatcttaatgaattcgtgaagtgtggaaataaacaattgtcaccatcaacatgtcttagtgaagctgaacctttccctgattag

SEQ ID NO: 36133 - DNA, 451 bp, Glycine max
  Peptide Sequence Number=SeqID_152911
aggcggcaggcccgatgacatgcggggaaccatttggtcccgcaatttttcaccttttgtcatccagaggcggcggaggcggcgggctcgatgacatgcggagacaaattttggtcattccgcacaccttttcgccattcagacacagtcgtgtccgatggcactcagagactaacttcgtcttctgcgccttttgtcatccagagccattcagacacagtcgtgtccgatggcacgcagagactaacatcgtcttctgcgccttttgtcatccagaggcggcgggcccgatgacatgcggggaaccatttggtcccgcactttttcaccttttgtcatccagaggcggcgagcccgatgacatgcggggaaccatttggagtagcgagtcgagtgataaacacgcggagacaaattatggtcattctgcaccttttgtcattcagggaca

SEQ ID NO: 36134 - DNA, 1062 bp, Glycine max
  Peptide Sequence Number=SeqID_152912
gatccgagttgccgcgagagcgactacagagcgtattggttggcaaggaatcacaggatattggattggttgttgaatgataggtcttccattatctgtcttcaggaattttgggttggaaatgaagagcttgttaatttgtacgaaaagagccttggagacgctggttatgtcagtttcaagcttggaaggacgaacaaccgtggggacgcgaatggaagtttcagtcagttgaattgtaatccggctctcataaatgttgttatgttccatgtgcttagttttgatccagaactgcctgttgaagatttatgtcttctaatagcagtgcaaagggagtactttaatattcttaattataaggagttgcatttcaatgattttggtgatcgtgtggctcagttgttacatgttgaactagcttctccgatttcgcaatggcgaaacagtaatattaggcaggaaattttgattgttaacactcacctgatatttccccatgattcaactctatcccttgtacgactgcagcaggtttacaagatacttcaatacgtagaatcttatcagaatgatttccaactcaagccaatgccaatcgtactttgcggtgactggaatggaagcaaacgtggacacgtctacaagttcttgaggtctcagggctttgtatcatcttatgatactgcacatcattacactgatgcagatgctcacaagtgggttagccaccgcaatcaccggggaaatatatgtgctgttgattttatttggcttctcaatcccgacaaatatcgaaaactactaaaagctagttggagtgaagcagtttttggtatgttcaagtatctactacggagagctatattgactgagagtgatgcatttgcctttctaaaggttgataacgaagattgtattacctattctggtttctgtgaagcacttaaacagctcagtttaactggtcattgccatggattgagcgacgaagagataaaggacttgtgggtccaagcagatgtagatggaaacggtgttcttgattataaaaaatttctg

SEQ ID NO: 36135 - DNA, 672 bp, Glycine max
  Peptide Sequence Number=SeqID_152913
atgactagagatagattacaagatgttcaagtgaataatatcaagttgaaattgattgctaatcgtgagaaagatggttgtacatataatgtacctactgttcctgaagttgcaacactaatagtaggcgattttgatgcaaattcaaaaatagatattattattgaaactcagcatggacaactacaaaggatccatgaattacattctagctatctagctctacaataccctctcttatttccttacggggaagatggatatagacctgatattctacatagcagtcgatcagatgtcagaaaggctttcttacatcagaaacaaccaaaaaaaacttttgaggtgaccaagttttgtagcttacaacagtcattggatgatggaagtgggagaggcctaaataaagccatgtgggcttcccaaatctgttttattactttaacctgcaatccaaactggcctgaaatccatagattgctgaatccgttgaatctgaaagcagcagataggccagacataatctccagagtcttcaaactaaagtatgaacaaatgcttatggacctgacaaagaatcacatgctaggcaaagttattgcatatgaaattgatcaaattatatcagcagagataccttcacagcaagatgatccagaactgtattcatta

SEQ ID NO: 36136 - DNA, 286 bp, Glycine max
  Peptide Sequence Number=SeqID_152914
atggggactggtggtggtggtggtggttgtgtgagggtaaatagtggtggggaagaaacaggtggttattcgggggacaataaccaacctatgaaaaaagaagtgttgagtaaaggaatttcttctctggtagcctccaacaggttgcttcccatggccaaccctaagcattttgctactccaacacatatcttatacgctgatgatatttttgtgttttggaggggaacaaagaaaaacattgttaatttgatggatctttttcattccaacggtgaagtttcag

SEQ ID NO: 36137 - DNA, 384 bp, Glycine max
  Peptide Sequence Number=SeqID_152915
atgactacatcaataactaccttgaaaccaagtattatgatacaagcaagcgctacttgcctcaaccctttgctaaactcctcattgaaaggctctctgagcaatttgaggaaattgtacggattgggagccaggaagctaattatgtttgaaattggacctattgggtgcatcccatcagtctcaaggaaacatctacacaaaggtgactgcatagaggaaacaaaccaaatggtgacatacttcaatgaaaggcttcctccaatgctgaaaaatttgacatccagtcttccaggctccacctttgttcttggtcgttccaattcactgggttatgatgcaataaaaaatccatccaaatatggtaaaattcccaaacaataa

SEQ ID NO: 36138 - DNA, 342 bp, Glycine max
  Peptide Sequence Number=SeqID_152916
atgggagcaactgagagagtagcagattacataacaagagtcttgaatttggccaaccaaatgaaggggtgtggaaagaagattacagagcaaatgatcatagagaaaattatgagaaccttaattccctgctttgactacattggagttgcaattgaggagtcaaaagacattgaagtcatgaaggttaaagagctacagggttccttagaggcacaagaactgagattgatccaaagagaattacacaacaagaggcctggaagaaggttgaaaaactggagcagcacactcaacgcgtcaaaacaaccatttagcgcgaggagtcaacttggaggctag

SEQ ID NO: 36139 - DNA, 225 bp, Glycine max
  Peptide Sequence Number=SeqID_152917
atggtgggagaaaatgcactacacataggaccatggaatgaaggcttcaatctctttttcttttctctaacatttgggaacgctaacaaagcaatcggaggaggagctctagagagcactagaaacgttccaattgataacggagaacacttgaatgagaacatcgaggtaagggatgagtttatcgcaattgggattagaatgaacatgtgtaaggatccttag

SEQ ID NO: 36140 - DNA, 1467 bp, Glycine max
  Peptide Sequence Number=SeqID_152918
atggctcgcgtaaaacgtggtgtaattgctcgcgcacgtcacaagaaaatcttaaaacaagctaaaggctactatggtgcacgttcacgtgtttaccgcgttgccttccaggctgttatcaaagctggtcagtatgcttatcgcgaccgtcgtcagcgtaagcgtcagttccgtcagctgtggatcgcacgtatcaacgctgcggcgcgtcagaacggtatctcttacagccgtttcatcaatggcctgaaaaaagcgtccattgaaatcgaccgtaaaatcctcgctgacatcgctgtattcgacaaagtggcattcactgcactgggcatttcaatagtgcggtttctatcaagacaagacctggtggcccgtgccacggccgccatcgacgaggcgtcggatatcgccgccctggacgccgtgcgcgtcgaatttctgggtaaaaaagggcacctgacgctgcaaatgaccaccctgcgtgaactgccggcggaagagcgcccggcggccggtgcggtcatcaacgacgccaaacagcaggtgcaggaccgtcttaacgcgcgtaaagatacgctggaaagcgcggcgctgaatgcccgcctggcggcagagactatcgacgtgtcgctgccgggacgccgtatcgagaacggtggtctgcatccggtgacccgcaccatcgatcgtatcgaaacctttttcggcgagttgggtttcccgttggcgaccggtccggaaattgaagacgattatcacaactttgatgcgctgaatattccggggcatcacccggcgcgcgccgatcacgacaccttctggttcgatgccacgcgcctgctgcgcacccagacctccggcgtgcagatccgcaccatgaaaaatcagcagccgccgattcggatcatcgcgccgggccgcgtttaccgtaacgattacgatcagacgcacaccccgatgttccatcagatggaaggtctgattgtcgataaagacatcagcttcaccaatctgaaaggcacgctgcatgacttcctgaacaacttcttcgaagagaacctgcagattcgcttccgcccgtcctatttcccgttcaccgaaccgtcagcggaagtggacgtgatgggtaaaaacggcaaatggctggaagtgctgggctgcggcatggtgcatccgaacgtactgcgcaacgtgggcatcgatccggaaatctactccggcttcgccttcgggatgggcatggagcgtctgaccatgctgcgctacggtgtgaccgatctgcgcgccttcttcgaaaacgatttacccctggacagcgccgcgctgtctgagcaaatcaccatggccggtctggaagtcgacggcgtcgacccggtggcaggggcgtttcatggcgtcgtggtgggtgaagtggtcgagcgcgaccagcacccgaacgccgacaaactgcgcgtcaccaaaatcaac

SEQ ID NO: 36141 - DNA, 675 bp, Glycine max
  Peptide Sequence Number=SeqID_152919
atgacttacaccaagaaaactgaccaaatgatgtttgaggcggcaaaggaaattgctaacaagattggaagattccatggaggaacaggcctcacaggattcctttgtcgcccatggacgttaagatccaatgtcacgatcaaacaatactttggaccgactccaaggacctcccacacatcttcgtccatggctccgaaagacatggagcagttgacgcaaaaaatcagggaccagctggaggagtcgatcacagaaaaagtgactcgacaagtactcgcactacctcctgagcctgtggatggtcgttcagctactcatgtcagcacaaaggaaaatgttgtcatctggttttgttcgttgcataataggctagacttcctgaaaggaattattatcaggtcagatatatttttcaatacatttacattagcattatttgggaacatcaatattttaattgtgcaattcacatccatgtttgtattgaacaatgctttgaaaggatttgacgatactccacaaagtaaatccaaggctactgctaggtggattgttgttaaatgtaatagacaaaaaggaagtactgcgtgcgagtattacgtcatgcaccggatgtcaactataatcttaggaagtttcaagaataattggaaaatggttaatttggggtaa

SEQ ID NO: 36142 - DNA, 483 bp, Glycine max
  Peptide Sequence Number=SeqID_152920
gtaattgggtatttaaacggaggtagtattttgaatctggaatgctgctcttctgttaattgtgatttggttaaggctgttcctgatgatcacaagaaatttcttgctgatttggtttgggtccatgaagaggacgatgtctttgtgaacactgatgatggagttaaatgctgcaaattgattgctgttcatgctggtttggagaaaggaaaagatgtgaaagagcagttaaaacttttgaaagctcgggatactcgggtgcctaaggtggaggctctaagtgggagaaagagtgtttgggatattccagaggaactaactgcaagtccagccattgttgttagtggtcaccacgcgaaactccatgtagaaggcttaaggctgatcattgatgaaggtggtggatataaagatagaccagtggctgcaattattcttccttcaatgaagattattcgtgatacagatgaattagcaaaatag

SEQ ID NO: 36143 - DNA, 658 bp, Glycine max
  Peptide Sequence Number=SeqID_152921
atcagtgttggaatcagggtactactggggaagagcagcgctggatccggagccggggcggtgccggaggaccgacggcaagaagtggcggtgctcgaaggacgcggtggcgggtcagaagtactgcgaccgccacatgcatcgtggccgaaaccgttcaagaaagcctgtggaacaacgtgatggatctctttctgctatagcctccgtttcttcttcaccctcttcttcatttaatctccttcacctcagtgaaagttcctctggggccaagagtgacaacaagagcttctttgaaaaccatgatcatgtggatggggatggaaattcagccaaatctgatggccatgtcttgaggcatttctttgatgattggccaaggacactgcaagagcctgacaatggtgaaagcaatggttgccagaacaacaactcaggaacatgtctttctatgtcaacaccaggaatcacttcctcggatgtgtcgttgaaattgtccactggccatggagaggatgcgtgccacgcggcctcaatgggaggaccacttgcagaggcattaagatcatccaccaccagctccacttcttcaccaaccagtgttctgcttcagttgcctcctagttctgcttctgaggctagtttcattagcacctaa

SEQ ID NO: 36144 - DNA, 189 bp, Glycine max
  Peptide Sequence Number=SeqID_152922
atggcattgtcaaacttattgttccctataatacaagcttttgatctagataatttaatttttgtggaacctaatgatgatgcacaatctgaggaagaccttgatgatgatgatggagatggagatcatgatgaaagtgatgatattcatggagatgatcctattagaggattggacatgcttctttga

SEQ ID NO: 36145 - DNA, 2241 bp, Glycine max
  Peptide Sequence Number=SeqID_152923
gcatcagaaatggctgccatgaaaagattatcaaagtcaactgcttctccacgaatatctgaggttgggaagatacagacattgtacaactcagttgtagttgaaggtagacgatctgggccttctaatgctgagagtaaagggagtacaagtgaaatatctctagtgccagaagagagcaactcactttccttggataatgcttcccagtctcatccaactgttaaaagcacttcactgagcccaaatgttcaatcttccaaaattgctgctgcaattgcaactacacaaaatgatactggggcttcattgatgccaagtgacttggctagttcatcaagtaaagttggggttctatcacagtcatcagagcctgctcaaatagaaaaacaaacatctgaatcttcttcatctagttgtaacaccaatggaagtaaattagagtttcccgaaaatgcttcttcccctaaaaagataggaaataaagcctctgcatcaaacagtgggcggaaaggtaggttacaaacagtctcttcctcatctacttcagtaaatggcaatagagtgtgcaaactgtcacgcaatgcccctcgtacagttaaatcatttatcaagaacaaaaaatttggaaagaaaaaagtaaagcaggattcagtttctgctttatttgatcctacatccaatgaagtaaataacaagtcagtttctggtacaactcaacttgtttgtgagagatgttggtgtgctattgaaaacaacgaaggtgttacatcattggactctctcagtcctggagagggaataaactctgttaatgtgcactctggcgcagcatcagctggctgtaatagcagcagagaagttacaaaagtgaaaaagaacaccgtattgaaagagcaacttgaattttcacaaagttcaaagagtagccaaggtgactacagtagtagtacaagtaccagtgatgagagtaatctcagtgggtctagttgtggcaataggcctcacatgtcgaaggatgttagatggaaagccataagacatgctcaaatgcagcatggagtcttgggcttgagacacttcaatcttttgaagaagctaggttgtggagacattgggactgtatatcttgctgaactaattggcaaaaattgtttgtttgctattaaggtgatggacaatgaatttttggcaagaaggaagaagacgcctagggctcaaacagaaagagaaatattgaggatgctggatcatccttttcttccaacactgtatgctcagtttacatcagataatttgtcatgtctggtcatggagtattgtccaggtggtgatcttcatgttctacggcagaagcagcttggcagaagtttttcagagccagcagctaggttttatgttgccgaagtccttcttgctttggagtacttgcacatgcttggagtggtttaccgtgatttgaaacctgaaaacattctcgttcgagaagacggccacattatgctcacagattttgatctgtcgctaaggtgtgatgttagcccaacacttctgaagtcatcttctgatgtggatcctgctaagatttctggtccttgtgcacaatcaagttgcattgagccattctgtattgaaccagcctgtcaagttccgtgcttcagcccaagaatcctgcctcctgccgcaaaagcaaggaaattaaaaactgatcttgctgctcagctcagatcgttgccacagcttgtggctgagcccacagatgcaagatcaaattcatttgttggtactcatgaatacttggcgcctgagatcatcaaaggagagggacatggagcggcagttgactggtggacattcggtgtttttctgtatgaacttttatatggtagaacaccctttaaaggttctaataatgaagaaacattagccaacgtggtgttgcaaggtctcagattccctgacaccccatttgttagtatccaagggagggatctcattagagggttgttggttaaagagcctgaaaatcgtttgggttcagagaaaggggctgctgagataaaacagcaccccttctttgaaggcctgaattgggcattaatacgttgcgctatcccaccagaactgccagacttacgtgaatttggagtttcagagatgaccctacagtcccagggcaagggtgttaagtatgtagagtgtaatgcagcaggagagctagtggaatttgagttgttttga

SEQ ID NO: 36146 - DNA, 387 bp, Glycine max
  Peptide Sequence Number=SeqID_152924
atgctacatataaaaccagcatcaagtaaaaactggttccctgctattttctcatcaattcaaagttttcaccaatcagtgaaatcaacaaaacagataaaatcaaaccatagtcaaggtagaatccaagagcagcagcagcttcttcttcttccttttcaaagtgaagttccgaaaccacaaaaagaaaagttcgaaatctcagttaacggaatcaggcaaaacaacacagtgatgagtgaacatgaacgaacatcaaacaacaccgttaatcggaggctaacggaacgagacatcacaaatcaaacggttcaggcacgaaacgcaatcgaaaacacagaagccgcacctgcaagcaagcaaaggcgaagaaacgatgcgcattga

SEQ ID NO: 36147 - DNA, 137 bp, Glycine max
  Peptide Sequence Number=SeqID_152925
atggccaaatcttttaagtgtgttgctatttctttgggttcccaacctgtttctcttttaacgaagatcgagagtgagagcaagagcgataccgacattgaggagtttcaacgcggagtgagtgagagtgagaaagg

SEQ ID NO: 36148 - DNA, 300 bp, Glycine max
  Peptide Sequence Number=SeqID_152926
aaagtgctcttttctcacccatagccatcacgaacggagagagacagaaaagaaaggccaaaggaagtgaaatcctatttctctcattttcaagtgcaccagagaagatcctatggagaaaggattcagaccttaatgtgtggaagccagttgaacatagtagtgatgcaaagcttgcaggtgaatccgatccattgggagagttgatgaagatattgttttatgtgtaccagaatccagtggaagtgtcgtgggaggcgagccaatttggacttcctgatattggggcaacaatatcag

SEQ ID NO: 36149 - DNA, 3043 bp, Glycine max
  Peptide Sequence Number=SeqID_152927
atgggttcggtggactgttatccgtctcgtgtggacgatgcggccgtggtgtctctagattcgctgccgttagggttccgattccgacctaccgacgaggaactcgtcaattactacctgcgacagaagatcaacggtaatggtcgcgaggtttgggttatccgagaaattgatgtctgcaaatgggagccttgggacatgcccggtttgtcggtggtacagactaaggatccggagtggttcttcttctgtccacaggaccgaaagtatccaaatgggcatcgattgaacagagcgacgaataatgggtattggaaggcgacggggaaggatcgtaaaatcaagtctgggacgattttgattggaatgaagaagactttggtgttctacactggtcgagcacccaaggggaataggaccaattgggttatgcatgagtatcgccccactttgaaggagcttgatggtaccaatcctggacagaatccatatgtcctttgtcgcttgtttaagaaacatgatgagagccttgaagtttcacactgtgatgaagcagagccgactgcttccactcctgtggctgcctattactccacagaggaaatacaatctgatctggctgttgttgcaggatcgccgtcacaagttacagaagatgataagcatcagtcaatgatccctgcacactctgaggaagcaatatccaatgttgtaaccccggttgatcgccgtactgatggatatgatgcttgtgatgcacaaaatcaaattgagttaccaactgcggaggagtttcaaccattgaactttgatatatattatgacccaagaagcgagctactggatggcaaattattctcccctgtacttgcacatattcaaccagaatttcattatcaagcaaacatcgaatcagatggtcgatatgggcttcaatatggtacaaatgagacaaacatgtcagactttttgaattcagttgttaactgggatcaagtaccctttgaggatcccaattgtcaacagcagagctaccccttgtttaatgttaaggataacatattaaacagcgacttagattctgaacttgccaatatgacatgtatgcaagctggttatgcagagggggcaattgacggaaggattcctttgttgataacttcagaattttgcagcaccactggcatccccgttgactgtgttggtgacgagcagaaaagcaatgttgggttatttcaaaacaattcccagagagcttttactgatgttaatatgggtcaagtatacaatgtagttgatgattatgagcaacaaagaatctgtagtgcagttgctagtggcaatactggaatcataaggaggcatcgtgaggtacgaaatgaacagctaagcataaactcaacacaaggtactgcacagaggagaattcgtttgtcaatggctacacatggctcaaataagacggtgaaaagtgaaagttgtgcacaagaagagctttatgcaaaaccagtcattgctgtgggggagaaaggttcagaaaatcatgcttctgatgaaagtgctactcttactaatgatgggaatgaactgcagaagacacccgagtcaaccggcaaaagaaagatttctcaacaagttacaaaagcaggctccaccttggggttgaaagaccttttcttgctcagaaggtgtggagagatgagtgcatatttgataacagccattcatctgttacttgtgttcctgtcatcatccacttccctttcgaccgtgttcggctccgaggaggaacaattctatgccaaagaaattctcggagcagcacagaaggagaaggaatggttagtttcagtaaggagaaagattcacgaacacccagaacttgctttccaagaatacgaaaccagttctcttatacgcagtgaactcgacaagcttggcatatcttacacatacccagttgccaaaaccggcatagtggctcatcttggctctggttctcgccccatcattgctattcgtgctgacattgatgcactccccatgcaggagcttgttgagtgggaacacaagagcaaaattgagggcagaatgcatgcatgtggacatgatgctcacaccaccatgctacttggggctgcaaagttgctcaaccagcgccaagataatcttcagctcatttgggaaaaacatggaggtggtgttgaagtgaagtctgccatgatggagttatttgttgatccaaataaattggggtcaattccatctactaaggtatatgtacaagatgttgctcaatatgggttattctcatctggttctgaagttatagctgtgcctcttaagcatatgtctgttctgactttaataccaccagttgctggattagatggcatgctacagatcataagttcattgaaaggaactgtaagacttctattccaacctggtgaggagggagctagaggtgccttacagatgataaatgaaggagtgcttcaagatgtagaagcaatttttgcattacatatcgatactacaacacctactggagccatagcatctattccaggtgcattgacagcagctggatgcatgtttgaggcaaaaattgtaggagtaggtggtcatgctgcatcaccccacaagaatgtagatccagtgctggctacatcatttgcaattttggcactgcaacagcttgtttcaagagaaagtgatcctcttcacaatcaagtgctatcagttacttttgttgaaggtgggactgcattaaacgtgattccatcctatgtaaaatttggaggcacacttaggagcctgacaaatgaaggcatgtaccatttcagacagcgattaaaggagattattgaaggacaggcagctgtgcacagatgtaatgcttatgttgatttcaaagaagagtacttcaccccatatcctgctgttgtcaatgacaataatctgcatctgcatgtcgaaagagtaggccaaattctgcttggtccagacaatgtccatgcagccaagaaggtgatggcag

SEQ ID NO: 36150 - DNA, 273 bp, Glycine max
  Peptide Sequence Number=SeqID_152928
atgggtgaaacagtggaacgagcaagggaagatacaagagttcttttctggggtgattttaaagagccctgtgttgtgattactgcaccatcacttgacaagaggccacaattacttgatagtgaaaatgaaaacttgggaaacggtgaattaacgaataagttggatttaagaaggatgctactattttttggtggtgagcaacgggtgaaaaagccacttaggcaagaaaaaacaaaggttgcatatcatctcttaatacaccccgcctaa

SEQ ID NO: 36151 - DNA, 255 bp, Glycine max
  Peptide Sequence Number=SeqID_152929
atgggaggttgtgtgagcgcacctaaggaagttgccttgaacgaaggagagttggccccggtagctgagaccgttgttgctcaggagaacacccaggaagagggtgacaagaaagaagagcctctggtagagctgactgaggctaaagaggagaaagtggaagccaaggcagaggaggctgagaccaaggaacctgaaaaggaggaagttaacgcagaggataagaagagtgaggaacctctcgtaactctatag

SEQ ID NO: 36152 - DNA, 396 bp, Glycine max
  Peptide Sequence Number=SeqID_152930
atggccggaatcaccaaaacctctcacttttccgtcgttttgatcgccgtcgtcgccctctgcgtcttcccggcagcgacatccgataacgtggcctcggcggtcctcgggttgccgtcccatgtcgctggcgaaggaaagaacttgtgcagcgcggcagcgccgtcgtcgtgtcccgtgaagtgtttccgaaccgacccggtttgcagcgtggacggcgtgacgtactggtgcgggtgcagcgaagccgcgtacgccagcgcacagattgcgaaattggggttctgtgaagtggggaatggcggctccgtcactctttctggtcaggcattgcttctggtgcacattgtgtggctcatcgtgttaggcttctccgtcttctttggtctcttttaa

SEQ ID NO: 36153 - DNA, 1320 bp, Glycine max
  Peptide Sequence Number=SeqID_152931
atgggtaccctcggaaacgaacaaccaggtacccagatcccagaaaacgctaaaagtttttcccttttcagatacaattcacccttcattcagatcgtactcatcgggttggtctgtttctgttgcccgggaatgttcaacgccctctccggcatgggtggcggtggccaagtcaactcgaccgcctccaacaacgccctcaccgccctctacaccaccttcgccatcttcggcatcgtcgggggcggcatctacaatatcctcggaccccacctcaccctctttgcaggttgctctacctacgtcctctacgcgggctccttcctctactacaaccactaccagcaccagttcttcgccatcgtcgccggcgccatcctcggcgtcggcgccggcctcctctgggccgcgcagggcgccatcatgacctcgtaccccccggagaatcgcaaaggcacctacatttcaattttctggagcatcttcaacatggggggtgtcatcggtggcctcattcccttcattctgaattacaatcgcggtgactctgctgccactgtcaacgacggaacctacataggattcatggtatttatgtccgttggggctgttctgtcgttgaccatcttgccggccagcaaggttgttcgcaacgatgggactcggtgtactaacatgttgtactccaatgtggcaactgaatctgttgagattctcaaacttttctacaactggaagatgcttcttattattcccgctgcttggtctagtaattttttttacacctaccagtttaaccatgtaaataagccgcagtttaatttgaggactagagggttcaacaatgtgttctattggggggcgcagatggtgggttctgttgggattgggtatgtgatggatttcagctttaagagcaggaggaagagaggggttctggggattggtgtggttgctcttcttgcttctgctatttggggtggtgcacttgcaaatcagataaatcatgactccagggtgatcttggattttaaggactcgggctctcgttttgggttgctggatgccatgttccagagcatggtctattgggttattggagccctggctaatgattctgagattcttagcaggtatgctgggttctataaaggcatacaaagtgcaggggcagcagtggcttggcaaattgataaccagaatgtgtccgctatggctcagttgattgtgaattgggtactcactactgacaacaagggagaagaggaacctatcaaacaggtcgctccttcgtcagctgaaaatggctttgtccaatga

SEQ ID NO: 36154 - DNA, 225 bp, Glycine max
  Peptide Sequence Number=SeqID_152932
atgaaggaccaaactccttccttgttgactgatttggttcaattggtaatggaaaggacatctttcaaactttcagttggaaaccaacatcccttttttgctcacaggactaaggctaagttaaacattccacatatcattcaagcaaacaccaacgctgaaaactgcaaaggtcaaaaagggaggcaaatggaaatgctgcaaaccctagagaaggttcgatga

SEQ ID NO: 36155 - DNA, 660 bp, Glycine max
  Peptide Sequence Number=SeqID_152933
atgcagcaggagttggaaaatgccaaacaggtgactgggggaaggctggaatgtgagggaaatggttctgctcctcctacctcactgtttgagataacacttggtgcaggtaatggacaagactactatgatgttagcatggtagatggcaacaatttgccattactcgctctaccacgaggtgtatatggtggtgtctgtaatgccacaggttgtattactgatattaatagaggttgtccaagagaacttcaattactaggaggccatcaaaaccaacaggtagtcgggtgtaggagtgcttgtgaggcattcaagacagacaagtattgctgcagaaatacgtgcaagccttcctattattcaaccattttcaagaaggcttgtccaagatcttatagttatgcctttgatgatggcacaagcactttcacttgcaaagcatatgaatacgatattgttttctgtcccaacagcaacgggatgagaagaccaaatcttgcatctcctccaccaattaggcaacccttttggaagcatcagcaggaaaaaaaaggcacaatcaatgagatggaatcgatggacagcaaaaagatattacacttgaagaaccctctgaaaacaaatgattcagaaagcagtcttctaaagctccaataa

SEQ ID NO: 36156 - DNA, 366 bp, Glycine max
  Peptide Sequence Number=SeqID_152934
atggttacttatcgatggacatggcagcgttattcaactattagtgtactcattgccaagagtagtgctgttaagttgtattattttaccccttttatatccctcaattccactggaaactgctcaccattatcgatcttatcacttattaggctttcagggtcaggtataagcttagctgctcaggctctaatatacccctgccgaagtttatacaacaatgatgggcctaaacagcctctttgcatatgcaagggtaaggctgtgtacaacatccctcccccataccttcgcatagcgaagagcctctgggcaatggggtacgaagttttttatcatttcttgcctgtggactgtagtgattga

SEQ ID NO: 36157 - DNA, 243 bp, Glycine max
  Peptide Sequence Number=SeqID_152935
atggagatttacgtcgtcttccgcgcagactacatctgtcaagcactaacccgtgaggttagggggcaggcggatataccccaagtgatttacgtcgtcctccgtgcagactacctttgtcaagcactaacccgtgagactaacgtcgtgttctgcaccctttgtcaatcagaggcaagtgagcccgtcgacacgaggagatttacgttgtcttccgcgcagactacctctgtcaaccactaa

SEQ ID NO: 36158 - DNA, 300 bp, Glycine max
  Peptide Sequence Number=SeqID_152936
atggttcaggttgttttgccgcaggatactatctcacacttctgtcagcataacgtggttgggaaaggtaaagcacaagctactgcgtggaaggttgtatgggttgccatcatgtgttgcatatggaactttagaaataaaattgtttttagacataggattttggcttctgaagatttgttggaaagcataagaatcaaaacatggatgtggctgaagaccaatgtcaaaggattttcctattctatgtttgaatggattaatagttcagatctatgtctaagtaatatggaaggctga

SEQ ID NO: 36159 - DNA, 276 bp, Glycine max
  Peptide Sequence Number=SeqID_152937
atggcagaaatcgaccaaggtaagacgatgaccggtcacgattggtcgcatatcatttggctcttacttgcaggttcaagtgggaaaacgctaacccatgaggaaggaggggacatggttaatgttcccctaaaaaaaaaatggcaggatttgaatgagaaggccttaggcctatgctgtattctaaagcaatggggcatgccacattgtccccatcctcttgcaatttatgtccaaacatgcgctcaccaagtgctcggtgaaatgccccaatga

SEQ ID NO: 36160 - DNA, 1020 bp, Glycine max
  Peptide Sequence Number=SeqID_152938
atggtggtaatagcaatgggaagatggattcagattcattcgttagttgccccttctgcgattcacaagtacccttttctcaacgtactgggtatgcatgtctctgtccttgtacataacatgcatgttcatttccatttcttacccgcatttgaatattatgattctgcaaacaaacgcaggcacttcaagacgcacttttgggatctcgacgatgattttgacctgcccccaacacctcaatctcaatctcttccgagagagcaagcacccaatggctcacggtccggagcaaactattcgtgtggtggtgagactaatagtgataatggggaatgcaaagtgaatgacaaaatctcttgcttgattggttcgcagacaaggagcaatttttacaaagttgaaggtggtctgatggcattgttgagaaactgtttagactctgaagttggaaattcttatagtattttgtcaggttatgttgatcatttccagtgccttgaatctgaggatgccggatggggttgtggctggtgtaacattcagatgctttgctctcacttactagtggaaagaccagaagcaaggaaagctttgtttggtggttctggatttgttcctgatatcctgtcgctccagagatggcttgagattgcttgggaaaagggttttgatgcgcctggatcagctcaattcaattatgttatttgtggttcaaaagaatggataggaactactgagtgcactgctcttttgcgttcctttgctcttcgggcaagagtagtggattttggtcctaaggaatcccaatccctcacaggttcaagtgttgataacatgagggataaagcaaatattcataatatagtaaaaagaaaagctgaaaagagtgagggttatcaagttctcatggattttgtgtggaattacttttctgataaaagctcaatcctattttgccagcagcatgttgtgatcagcctctatactttcaacataatggtcactcaagaacaatag

SEQ ID NO: 36161 - DNA, 1378 bp, Glycine max
  Peptide Sequence Number=SeqID_152939
ggttatcctccggaagagaaaaaggagtactattcctattcctaatttagacaccaaagcaaagcgtgacaagtcagccactgaggtggttaatggttccatagacgtaaccaatcaaggtgatgagacaattgcaacacctgatgttggtagagtagagacacctgctgataattatgaacctgaaagagaaccagaagtgttcagatgtttatcatgcttcagcttctttattcctatgagaaatggaatcaaactgttccccagttttggtggtacccgtgagcctgaaacttcacaaaaacctttggtcacaccttcatccaatgtggaagatccttcaatcgtagtagcggcttccaatgcaaattggttcttcaatctgtttacttcaatcaagggaagaaaagatagtgcgcaagttgatgcttcaattgaagattctagaacagatcctgcttcaattgaagattctagagttgataatccagaaagtccacttgctaatacagctataagtcagagtgtgaatctgtcagcagatattaagcctggacatggaggtgtaaattcttcaattccctcaatacttaagtcggtaataaagattgaatcatggatagaaaaaagcaagaaatccaatgtggcattgcagaatgagccattggttgatcagaatgattcctgggatttttcagcaaaggaacagcttctgactgaaaatgttaaaaccgatgtgggagacaaaaatcgtgattcagtggttgggataaagacagatactgttgcagatatatccaagcgtgatagtgttttattaacaactgttgctaccactgaaaatgtgagaaccgatttgggagagaaaaatcgtgatccagtggaggtgataaagacagctaaccatcatgtgcaatccatctactcacttctcccaagtggagctggaaaatcctctgttttggcccttttactaagattttatgatccacaggcaggaaaggtattaattgatgggaaagacatacagaaatataatctaagatggttaaggacacacataggactggtacaacaagagccactgctttttaattgctccattagagacaatatttgctatggcaataatggggcttctgaaagtgaaatagtggaggttgctaaagaagcaaacatacatgaatttgtaagtgatctaccactgtcagctttccggaggacaaaagcaaagaatagccattgccagaacattactatagaagcctgcaatagtgaatgctttaaaagcaatacaactgaaggaagacagtggcttgtaagagaaaagaatgaaggcgttaaggagcaaggttcttacataatttctggattctaa

SEQ ID NO: 36162 - DNA, 708 bp, Glycine max
  Peptide Sequence Number=SeqID_152940
atgggagcggtgacgtcgtcgatggcggcgaagttcgcgttttttccgccggatccgccgtcgtacacggtggcggaggaggtggaggggagggcacggatggcggaggtggctctgagggaaaacgtcgacgttttgaaggtgaaaacggagagagggaacagcgttgtggcgatgtacataaagaacccaacggcgtcgttgactttgctttactcgcacggaaacgccgctgatctgggtcagatgtacgagttgttcagcgaactcagtatccacctccgagttaacctcatgggttatgactattctggatatgggcagtcgtctggaaagcctagtgagcagaacacttatgcagatatagaagctgtttataaatgcctgctggagaagtatggggcaaaagaggaagatattgttttatatgggcaatctgttggtagtggccccactatagatttggcttctcgtttatcaaaccttagggctgtgattctccacagtccaatcttatctggccttcgtgtcatgtatcctgtaaagcgcacatactggtttgacatttataagaacattgataaaatccctttagtgaattgtcctgttcttgtgattcatttagggactagatatatatcattgcatagaaatggctggaattgcacaatgctactaaaggttttttttcatctctcaactgcataa

SEQ ID NO: 36163 - DNA, 372 bp, Glycine max
  Peptide Sequence Number=SeqID_152941
atgggtcaagactcttggtcggtggtccgcaaccatctgcttaaagaacttgccaatttctcagaagactatatcaagctctttggtggcacggagagatttgaggaattaaggatgtcactacttgttgatgggttaaccaaggtgacaacggataagtggatggatataatgaacatgggacatgtcattgcatcaaggtataacgtttatttaaaagaacgttgtcccttaccgcctgtatcattgttatggtctagcaattgtcatccgcaggcgaagtcatggccaaatccatatattagcagaatgcagcattacaagagcttcgtgatgttcaagagagactatgttgacataaatgatgattga

SEQ ID NO: 36164 - DNA, 1512 bp, Glycine max
  Peptide Sequence Number=SeqID_152942
atggagacacgctttgctccctcgtattacgacgatccttacggtgatctgttcaaactccatcaacgcgccaccgttaatgattacctatccgattttgaacgtctcgccaacagggtggttggattggcccctccgatattgctcagctgcttcatatctggtttatcgccggacctccgtcgtgaagtccaagcactgcagccgatgtgtctcccacaggctatggccctggcaaagcttcaagaggacaagctcgcggaccgccgccgcggtcattgctcctccacctctgccggtatggttccccaccacaacccttcccactctgtaccttcttcccaacccaacaacccctcccccaactgcttccctgtgcatcgcctttcacctgaggagatggacctcaaaagagacaaaggtctttgttactactgcgatgataaatggaccacgggccaccggtgttcgccccgtattcaccttctcatcgctacagacgatgttgaaattccgccgtcccttgactcttctcacaaatccagacccaagtcacccccatcggatcctcctttccaattgagcctcaatgctggaatgcctgctccgaaaaccttccgcgtctacggctctgtgctccaccatcgtttctccattttggttgacggcggtagcacgcacaatttcgtgcagctacgcgtggctaggttcctcggcttacacgctgtcccgatttccccactccccgttatggtgggtgacggcgacatcattcagtgcacccaccgttaccctcgcgtcgccatttccattcagggaaacacctttgtcacagatcttctcgggttggagctccagggcgcagatattgtgctaggggtccagtggttacgcgaattgggcccggtaaccactgattacaccaccctttctatgcacttcacccacatgggcctcccagtccgtttattggccgacgttcctgccacaccacccacggcttcggcccatcaattgaaacgcatgatccagacccacgccatttccggcctctttcaattgaccctttcacccccttcatccattaccacatcatcccctacctcctcttcccccatccttctggaatctacctccccctcaccagacctcacttccttactcaccaaattccatcacctctttgccgaacctactcaattacctcccacccggactatctcccaccatatccatttactgccggactccaagcccatcacggtcaaaccttaccggtacctccatagccagaagacagagctcgagaaccaggtccgctccatgctcgactccggcctcattcgcctcagtcacagcccatattcttcccccgtcctcctcgtcaaaaagaaggacggtacctggcgctgttgcattgattatcgcgccctcaactccatcaccgtcaagcacaagttcccgatgcccaccattgatgagctcttggacgagctcggtgccgcctcttga

SEQ ID NO: 36165 - DNA, 1512 bp, Glycine max
  Peptide Sequence Number=SeqID_152943
atgacggaccttaaaaactccatcgtccagtcccccgagtatcgcaccttacgtgaccaagtcctccaagatcccgcgaatcaccctgattatgacctttctactgaatggctctgtttccgcggcaagatttggattccggcaaacaatcctttcatccctatgctactgtacgagtaccactctactcctttaggtggtcacatgggcatcaccaagactctacgtcgactccgcgacacctccttttgggaaaccatgtctcgcgatgtgcaccgcttcgtctcgacatgctccacatgtcaacagattaaatcaccttgccgcaaacaggcgggcctccttcagcctttgccaattccttcggggctatgggaagatttatcactcgatttcatttccggcttgccgtcatcacacaacttcaccaccattctggtggtcgtggatcgtttctccaaaggtacccacctcggagcccttccctccaagtattcagcgcatagggtcgcccaattgttcatcgataccatctgcaaacttcacggcttccctcggagtctggtctccgacagggttcctgtctttctcagcgcgttttggcgcgagctttttcgtctctccggcacgaagctccgttacaacactgcataccatcccgaatccgatggccaaacagaagtcctgaaccgcacccttgagcagtatttacgctctttcgtccatgaccgtcctagctcatggttctcttatctctctctggctaaatggagttacaacacatcggcccttaccagtaccgacatctccccgtacgagttgacttatggcaaacctccaccttccatgcccacgttcacttccggttcctcacccattgaggctgcagacacacttctttccacgaggcaggcaatgcatgctaagttttgtcaacgcctcattaaggcccaatccaccatgaagatgtatgctgaccgtaaccgccgtgacgtgtctttcaaggtaggagactgggtctacttaaggctccgcccgtatcgacagctctcactccgcccccactactctaagttggccaagcgtttctatggcccgtatcaaatcatcgagaggatcggtcaggtcgctttccgccttcaactgccggaggattctaagcttcactttgtattccacgtttcattgctgaaacttcatcatggtatccctccggtcaccaatgacccattgccctctaacactgtggaccaccacccaattgtggagcctctttcgttccttgactggaagtggaattcggattgcacccctccctctcgcatggtcctggttcagtggcgcgggctcgcccccgaagacacctcctgggaggactgggactcacttcaagctgcatacaacctcgaggacgaggttggtttcccaggggagggtattgatagcaacacggcccagagcaggcccaagagaactcacagagtaccagcacgttaccgtgaccctgcatga

SEQ ID NO: 36166 - DNA, 2214 bp, Glycine max
  Peptide Sequence Number=SeqID_152944
atgaagcaacacctgtatgtgaaccaaccagatctagtgagagaaatgaatcagtgcatcactttggatttgggtaagcctacttatataacaaacaaacttgctcctatgcttggcaatggcattttgagagccaacgggctcagttgggcccaacagaggaaacttgttgcagctgagttcttcatggacaaagttaagggaaaagaagtcttctcaaagcttagaagcatacagaaggccatgtccaagcatggtggcttcctttttgggctcagcagtttccgtgacaaactgaagcatttgtcgtcaaagaagcaaaacgagatagcaagtttggagaaagagatagagtcactgatctgggagttggtggaggaacgcaagagggagtgctcagggacatcctcatcagagaaggatttgatgcagttgctgttggaagcagcaatgactgatcagagtctggggaaggacttctccaagcgtttcattgtggataactgcaaaaacatttactttgctggccatgaaaccacagctgttgcagcctcttggtgtctgatgcttcttgctttgcaccctgaatggcagacccgtataaggactgaggtggctgaactttgccccaatggtgtaccagatgcagattctgtccctctgttgaaaacggtggctatggtgattaaagaagtgctacgtttatacccaccagcagcctttgtttcaagggaggcatatgaagatatccaaattggaaacctcaatgttcctaaaggcgtttgtttatggactctgatcccaacactgcatagagatcctgaaatttggggaccagatgcaaatgagtttaaaccagaaaggtttagcgagggtgtctccaaggcttgcaggtttccacatgcttatgtgccatttggattgggtactcgcttgtgcttgggaaagaactttgcaatggttcaattgaaggttgtgctagcacttatcatctccaagtttagcttctctttgtctcctagttataggcattctccggcatatagaatgattgtagaaccgggacatggtaggaaaacacattttggtgaaaccagcagaaagggtgacagacatgaacaagtcatcatggtggaggcaactcatttggagtggttaaagaacacatgtctctatacaaagggagggtattcaagagctatttttcatggaaggactaaacttagtatctacgaggatttgaagaacatgattgatggagcaaaggagtggcttaaagagatatttgaatatattgtaccgtggtctctagagcaagccacaggaaaccaaaagatgtctgagattgaagggaggtcttatacagtgaggatcgtagaggagatggaaatacaaagggttactattgacacatgctatggtgaagagagactcagatcagttgatggctcatcaatcatagggggtgatcgattgccggcgacggtgaacggaaaaacgaaagtggacgttagcaaggagggtagtttgggtaatggagatagtctttgtcaagcatttaatgctgatggtacagaaaagcaatctgagggccaaatacaacagaggtctctctgtttagaacatatgtgtgatggaatgaaacacagaaggggtaggaaagggtcagaggcatcatgctctcacaaagcgacaagtaagaagacgaaaggtttgacaaatgaaaaggagacaggggtgggagaagggattgagtctctaaataaagataggctaggtctttccacagcagttccttggttgttaaggatgactaggctgaggcaaaaagaaaaaggtgtttttgatgtcactgatcatttatcgggggttggtttcttgggaattacgggtatttggaagaaaggtaacttcaattataaagagttttacctgtataggtctaactcttattctaagagtagactggacaagtacctggtgtctgaggaatacgagttggataggaatctgtcacatcattgcccaattgtcatgaagaatgtggtgattggttggtgccctaaaccctccaaggttctcaatggataccaagtggaaagaatcagaggcttaaggaacaaggaggagcatgaggaattaaacaagaagattgaggagttagttgttaacatccatattctggatgttaaagatgaggatgaaggcttataa

SEQ ID NO: 36167 - DNA, 1716 bp, Glycine max
  Peptide Sequence Number=SeqID_152945
atggaaggtggcaggagaattacggtgagtcctcgaccttgctgcggccgcagaatcgttgccgcaaagaagagaccgcgtgcgaacgatggcttcgtcaacagcgtcaagaaactccagagacgcgaaatcagctccaagcgtgatcgcgctttcaccatgagcgatgctcaggagagattccggaatattcgcttgcaggaagaatatgatacacatgatccaaaaggtccttcatctatggtgttgcaatttctgagaaaaagatcaaagattattgagattgtagcagcacgcgatattgtttttgctcttgcacaatcaggtgtttgtgcggcatttagccgagagaacaatcaacggatatgctttttgaacgtcagtgctgatgaagttataagaagtctgttttataacaaaaataacgactcacttatcacagtttctgtatatgcttcagacagttacagttctttgaaatgcagaagcacaaggatcgacgtcttggtttactggtgtggcattgtagctgctatccgcctatcctggagtggaatagtgggtgcaattgcggtggtggagtgggaacaactccaaaagttgaaagaaatccctaaaatgcccttatttcatgactggaatggggggtattttggggattttagttgtgcacgagccttcaaagggggaaataccctcgacaagttatttgtccctcctagtctcctagggactttttggaaccaacacaaagccattatcctgttcactgcagctgctattcagcctgctatttggtctgtggctatagccactacattaaactgctctgcttcagtgttcaggggccactctgccctgctatgcacaataacatgttatttgagccctgctcctcactctcaaaagagaaggatagagaaaacaaaattgctcaagggtacaccagatgctggctttgctctttttgaatctgagtctctgaagtggccaggttttgtagagtttgatgatgtaaatgggaaggtattaacatactctgctcaagacagcatatacaaggtatttgacctaaaaaactatacaatgctgtactctatttctgataaaaatgtccaagagattaagatcagcccgggaatcatgttgttgatttatgctaaagcaagtagccatgttccgcttaaaatcctttcaatagaagatggtactgttttgaagtcattcagccatctcctttatcggaataagaaggtagattttattgaacagttcaatgaaaagctactcgtaaagcaagaaaatgagaatctccagattcttgatgatcacctcttgtggcatcctgactgcaacaccaacaatatatatataaccagtgaccaggatcttatcatatcctactgtaaagctgattctgatgattcattgtctgaaggaaatgcaggttccatcaacgtcagcaacatcttaactggcaagtgtctggccaaaataagagcaagcaacagctttccagtggataacaattgcagttgcagtgacaaaccttctcgtagctattgttgtaattcaaagaagagaaaacatggctccaagatgaggagcacagttgcagaagctttggaagacattactgctctcttctatgatgaagagcgcaatgaaatctatacaggcaacaggcttgggctagttcatgtctggtctaactga

SEQ ID NO: 36168 - DNA, 261 bp, Glycine max
  Peptide Sequence Number=SeqID_152946
atggcgaggaagattgaagttcttttcgaagaaagaaaaccaagaaacacaacaaccacaccccagagaagaaccctcactgtgtcgctgtggtgttgccagggaaggacgcaggggaccgtcaatttcttttgttgtggtggtgttgttcttctgaaaagatgtctcgtgtgtatgttggtaacttggattcatgagtcaccgagagagatctcgaagacgaattccgtgttttcggagttatgcgaaggtttattttga

SEQ ID NO: 36169 - DNA, 2001 bp, Glycine max
  Peptide Sequence Number=SeqID_152947
atggagactctgaaagctgcaattccagaaaacctgaagcgagcgataggggatagcgatgtcgatgaccttcgcagcacatgctcttctcttcaccgcttctttctccacttccacccatttcaccagatgatcactgaactcgcagatccaaagtatgctctgtgcgccaagaacaaggacgctgcgttgaaatccaggctgcttggtaatcagtgcttctccaacgcagattatgctaaggccttggactgctacactcaggcattgcgcgaggctccattagacaccgccagtgatatggagactttacaccattatagaacggatgaattcttgcatttgtaccaggttgttgtggcaaaggatatagatgctgcatggtacaggagaggtaaggcaaatgcttcattgggaaattataaaaatgcaatttgtgatctaaatgtggctaagagtgtggaaccttcaatgggtgggaagagacaaatagaaggtgaactgaaaattcttttagaccaatgcaaaagcacgactgcagtagaacaaatacaacatacagagaacaactgcaatactgtgggtgagatgcctcacataaagctacagcgggtctccacacctgataaaggaagaggcatcgtgtcatcatgtgtcatttcaccaggttttttggttcatgctgaagaaccttatgctatgataatattaaagcaatgtcgggaaacccattgccattattgcttgaacgacctacctgctgatagagttccttgtatattgtgttcaataccattgtattgctcccaccaatgccggatacgggcaactgggcaaatgttcaaaatttacccagagtataatggctttttcaaaaacttacccagtgatcttggagaatatgctgctgaagttattcaatgcaatgattctgaactggaaattggggatattactgaacataaacatgaatgtcaaggtgtacattggcctatggtacttccgtctgagatagttttggctggtcgaatcctagctaggtttttgctaaatatcccacctgaagatattataaactttgtggaaaggctggttgttataattatttctcaaattaaagtaaattgtatgactgtcgttcgtttaaaatcaatagacgcccatggactatcaggtcgctttggagaatttccatttcaatctggtgctcattcaactagtaatgtggaacaggtcagagtgggtaaagctatttataaagctggcagtttattcaaccattcttgccagccaaatattcatgcatattttctttcacgcactctttatttacgaaccacaaatgttgtagcagccgagagtcaactagaattatcttatggtccacaggttgggttgtgggattgtaaagatcgccttaattttctcaaagacgagtatgcatttctttgtcagtgtactggttgttcagaagttaatctatctgacattgtcctcaatgccttccattgtgtcaatacaaattgttctggcacagtgttggaaagcagagtacatgacagtgagaagcagaaaatcaagcacttccctatttctgaccatgttgacaaaaatgctgacatttatgaagtatgtcttcgtgtcttcaaacaaaatggtgcctctattgatattcaacctggatactgtttgaaatgtggttcttactgtgatttggagtcttcacgtgctgcagtcagtaaagctttaacatgcataaaaaggttgcaggatgcaatattgtcacaacaaatttcaagtattactatttctgatgctttgaaatctcttcgattgctaagattaaatttgcatgcatacaacaagcttattgcagaggcagaagacagcattgcccaggcattttgtttagtgggagaattacaattatctttggattattgtaaagcatctatccaggttttcaagagcctgtctctccacaattcagattcttcctaa

SEQ ID NO: 36170 - DNA, 2652 bp, Glycine max
  Peptide Sequence Number=SeqID_152948
atggatctaagactaacagctttgagcgagaagttagttgaaacttttaacaaggccactggtgctacatgctcccctgaagatctgagttatttaggaaaattttctcaacattttgatgccactaatatagagcattctttatgcaagtttatagaacttacccaaaagagccaggatgttggtcccctgagcaaagaaacaaccttgcactcatgtgatgtgaccaaagatgatgcaaacaaggccgtcaaaaccctgcagattgcaaaaccattaccttcagatacaccagttaagtatggtgtttcaccagcaaaagcggcccaagttgagagacacagttcaacagaaagtgaggaatcttctaaatctagtgatgaggatcaaagatctgccgagagaagtcgttctctagtaagatctgcaacacccagaaggtcagcatccccaatgcgaagggttcaaataggaaaagctggaccccgcagagccgctgcattaactatcaagagcctcaattattttcctggcagagagaggccaatatcgtttagagatgctgctgaaaatgactttgaaggggaagtatttgaactgcccaataaaaagtcagaaattgatgtcaagaggataactgtacaagatgccatcagtctttttgaaagcaaacagcgggatcaaactacagatgttcagaagaggaagtcattagtagatgtttctgttagtacaaataaatctgtattgagaagatggagtgccggtatgggggaaacctctgttcaagaccaggcagaacatgttcctgaagatcctgttccagtgacttctaatgatgtggtacatgctgaggctcctacaaattcagaagtaggagtggtgtctgattttattaccgaaagtcacaataataatgataacactgatcccgacgtaaaaccagaaagacaggaaaatataggttcttttgctgcagataatccagatgaaaccaacccaacagtgaaaggggaaactaacaaaaagttagcagcatcagcagagtggaatcaacgaaagcaagaagagttcaaccaaattcttaaaaaaatggtcgaaagcaaacctgttttatttgggaagtccaagcccagcagaaaccagaatatttcatttgagcagagaggagggtcttatgataattataaggaaaaacgtgatgcaaaacttcgaggagcaaaggctggaaaacaagtagaaaaagaagcacaatttcaacaaatgcagcaactactcgataagaggaaagttgaaatgcccaaaagtgtgagtgcaagtaaaaaaagttctccaaggatgccccaaaattctcttagaaaatcaactccacctgcaaattccacaaaggaaacctctaaacctttaactacgaaaaaaatatcatctagaacatcacccatgcctgctacacgtaagtcttggtcagcaacaccttcaccaagggcagctgggacatcccctgccaaagtgcgtggtggaatttcatcagctaacaccaccccaacacgtcgtaagccagtgtcaacaacatctgttccccaaccaacctcccaaagggaaaaatctatgccctggaacagaaatgagaaagaaactcagaccaataatgccaggagcctcaaaagcatggatgagaagcggcagccagctgtcccgaacaagaacaaggcaatcaaagcaaaagtgacgaaagcttctgaagaagcctctgttccttcaaagactaacattggtaacaagggaaccaagaaaagcagtgtggtgccattggaatcgaaaccatttctacgcaagggttctcgaatggggcatggaactgctgatcttaacaagaaaaaaggtcctcctaagatggacaaatctcagagagagagtgcagatcttattgaagatcaagaaagtgagttggttgtcaatgcttctgacttggtcagtcagcattcagatggggacacagtgacacctattcatcagaatgctgctacagaaccagacccacagatacataaccaactgcaatgcagtgagacagaaaacttagaccaaaatcctacagatggtgaggtcttaacatacacagaagagtcttccttaaatataaggaatgaagaatcaaccatatcaccttctgcctgggtggagacagaagaggatctggaaatgcccaagccgtgtgaggatgacacatttcagtctgtatctctagccaatgctgccccagtgggatcagctagtcctcgtgttcgtcattctctgtcacagatgctgcaagaagaaagtagtgaacctgacacatgtgagtggggaaatgctgagaatcctcctgccatgatataccaaaaagatgcacccaaaggttttaaaagactcttgaaatttgctcggaagagcaagggcgatgcaggttccactggctggtctagcccgtctgttttttctgaaggagaggatgatgctgaggaatttaaaaattctaataaaaggaatgctgacaatctactgagaaaggccgcactcaatgtgaaaagctatggacaaccaaaaaattcagtacatgaaggatatgaaagaaatttaggtagtacattttccccctttgctttgttctga

SEQ ID NO: 36171 - DNA, 477 bp, Glycine max
  Peptide Sequence Number=SeqID_152949
caactttgggaaaattgtaaacaaaagtacgagcccttatggattaaaggaggaaatcactgtgatttggagctttaccctcaatatataaagcacctcaagaaattcatcacggtcattgagaagtcaccacatcaaaaaactggatctgatcgtattcctgatcaacttgacaaacctaggaacagcatagattttcgagagaaatccagacccagcatggatcaaagggagaatttgaagagtattgatcagaaagaaaagcctagtgcaagcacagaccataaagagaagtcaagagccagcgtagacaggagagataaatcaaggaagagtatagatcgccctgagaagtcatataatggatcagatatacccgaaaaagctagaaatagcatcgaccgttttggggagatggtgagatcggttggattatgcaatattgattgtttcaggcccacagcgactcatgcatga

SEQ ID NO: 36172 - DNA, 582 bp, Glycine max
  Peptide Sequence Number=SeqID_152950
atggtgacaataatgagagtcgcagcacaaacccagacacagttacagttgaagaaacacatgatagagggtttcggttccaaatacatggaattaaaatgggtaaggcgaagaacaagcaaaagctctcagctcgagaagacgaagaagctatcatcaaaaccacctttcccaatttacatttccaccgacccacgccatgtggacccgcaccgtctccgagacctcttcgctgattgcaaccactctacccaccgattccctacccgacccgaacccgtggatatccgcaagctccgcactgcactgtctcatagtgccgttcttgtctccgtcttctacaacccccaacatgtaaacgccgttttccatcagaattcatcgtcgtcttcaatcgcggatattttcatgccggtttctccttcacgcgatcaattggtcgggtttggccgcgccgtttccgattatggcctcaccgcttctatttacgatgtcatggttattccttccctgcagagaatgggaattggtcagatgatagttaaaaaaattgttaggtatgcagttgtggacgagacttaa

SEQ ID NO: 36173 - DNA, 1002 bp, Glycine max
  Peptide Sequence Number=SeqID_152951
atggggattatatgggtggaggtctgcttgatatctgcacatggactccagctttcaacctcactttggaagcgtcaatggtttgctgttgggtggattgatcataatagcaaatattgcaccaaagttgttaattctgggaatgcaaatcctgtatggagaaccaagtttgtcattcctgttgatgactcggtgtcaaacatccaagatttggcactgaacgtggaagtttacagtatagaccccgttttcttcacggaaaagcttctaggctcagcaacagtttttctgagagagtttcttgtcaagcgggtaaagaattctgaggtgtcaaaacctaggcaaaaggaagttggaagctaccaattacgaaagaaaaaatccagcaaaccaagaggtttcattgatattttaattcgtatttctgacaaaaagaaagagccaaattcccacccaggtagcaaggaaggaattttgctcttagatgatggtgatggtacccagttgaccatagaggaaggaataaggcaagtctatccacagaagccccaagtttcaattcatcagccagaaaaagatcatgtacaaacaaatgtcccagactaccattcagtgccattcgccactacagactattatgatccatatgtgggtgaagcaagcaaccatgagatgggtgaaccaagctaccatgaggtggctggaccaagctatctactgcctagaacaataacgcctcctccaccacccccaccatcaaatgttggctatattccaacttttctcccaagaaatgatggcttgtctccaagctacacagagatgtcaacatccagggcagctcctggtcagagggtacctgcaggagttgcaatggggttaggtgctggagcactagctgctggtgctataatatttggtgatgacttcatgtcaggatttgatgttcctccgggcataggagattctagcttcaacagaggaattgatcctgctttctga

SEQ ID NO: 36174 - DNA, 279 bp, Glycine max
  Peptide Sequence Number=SeqID_152952
atgtctagaggcctaaaacaaggtgatctattggtaccatttttgtttttggtggtggcaaaagggttgagtggcttgatgaggatggctcatatgggtggcttgttttcagaatacaaagtaggggagaataatgtggaggtgtcattaatgcagtttgtagatgataatcttttctttgttgagcccttggtgcaaaatgtcatgtgcataaaggctacattgagatgctttgagatggcgtccggattagaaatgaattttcataagggttactga

SEQ ID NO: 36175 - DNA, 1301 bp, Glycine max
  Peptide Sequence Number=SeqID_152953
atgatgttgaggtgggcaaagatgtctgatggaaaaggtgatcactgtgacagtgaggagatggagatggggttcaatgttttgggtggtggtgatgaaattgtcaagtccaagaggttgattgtgagacctgggatcaaggtgtggatggcccgtgccatcactacagtgatactttggacttgtgtggttcagctgatggcaattggggagttgaggggaccaaggttgttgaagggcatgccttattgtttcagccaccaagatgcatctcaacctatgtcaaacgcttatgttcctgcaagagttgtgctcccaccaaaaaggattcataagaataatggttatcttgtagtttcatgcaatggaggactcaaccaaatgcgagcagcaatatgtgacatggttgctattgcaagacatttaaatgttactctcatagttccagagctggataaaacttctttctgggctgatccaagtgagttccaagacatatttgatgtagataatttcattggatccttaagagatgaagttagaatattaaagcaactaccacctaggcccaagagaagagttgaacgaggattattctactcattgcctccagttagctggtccaatatttcttactatgaaaagcagatcctgcctctgttactgaaacacaaggttgtgcacctgaatagaacagatgctcgacttgcgaataatgggctgcctctggagattcaaaagctgcgatgccgagtgaattttaatgctctgaggtttacttcccagatagagcaacttggtaggaggataatcagaattttgagggaaaagggacccttccttgtacttcatcttagatatgagatggacatgttggccttctctggctgtactcatggatgtgacggcagggaggtggaggaactcacaagaatgaggtatgcttatccctggtggaaggaaaaagtcattaattctgagcttaagagacaagatggcttatgccctttgacacctgaggaaactacactaatattgacagctctaggcatagatcaaaatatccaaatttatattgctgctggagaaatatatggcggacagagaaggatggcaagtttgcaagcagcttttcctaatttggtgaggaaggaaactctgttggaaccttcggatttgatgtattttcaaaaccactcatcacaaatggctgcactggattaccttgtgtctctagagagtgatatattcattccaacatatgatggcaacatggctaaagttgtggaaggccatcgaag

SEQ ID NO: 36176 - DNA, 204 bp, Glycine max
  Peptide Sequence Number=SeqID_152954
atggcagtgtcataccctaatttcgtctggggacttttgcttgaaggcatacaacctttgattgaccgcttcaaaatacttagcaccctttgttgcacaatatgtgaagtcccgagatgcgccgaaaatcaaaagaaagcatggtggaagcaaccaagctcgcctgggcgagcaaggtggcaaccacctcccccgttttgttaa

SEQ ID NO: 36177 - DNA, 287 bp, Glycine max
  Peptide Sequence Number=SeqID_152955
acattgtaaaagggattttacaagatagtggaactctcaagcgggttgcttggggactggacataggcacaaggatatctgaggccacttgtccaacaacgggtggaagtggatcgatgcttcaacacaaactctcttgctggagaagtgcgcctatccagcttctggcgcttccgactattttagacacgtgcggaaggggcgggcgggaggtgggttcaatgggagaagaagtcccacatcaggttaaggaatacaaggtttataaggaaaatgttgaacattag

SEQ ID NO: 36178 - DNA, 282 bp, Glycine max
  Peptide Sequence Number=SeqID_152956
atgaagctttgcttctacatgtggaacattgatcgggtttcagatttcgggttggcgagggtgcattctcactttggtttgatcgcttatgcttgcaaggttcattctacaagttggtggactttgttcatatttctgacacttgtggaaatcagagatatctacaacaatgggtcgaggaattggaacttacttaccactcctctggcagctcctgtgaaggacataatcaatagtatttccttgatcaaatctacttacaagtggattacctgtgcctga

SEQ ID NO: 36179 - DNA, 241 bp, Glycine max
  Peptide Sequence Number=SeqID_152957
gaggtaaatgtgaaacaacctgaaggtttctcctctagcagtggtgcgcatttggtttgcaagcttaagaaatctatatatggtttaaaacaagcctttcgtcagtggtgccttaagtttcatgggataatttcttcatttggttttgatgaaaaccccatggatcaatacatataccatagggatatgggtgatgcatcttatgtcattggcattaagattcataaagatagacttcaag

SEQ ID NO: 36180 - DNA, 321 bp, Glycine max
  Peptide Sequence Number=SeqID_152958
atggtggtggtggcagtgatcatgttagtggtgataacagtggtcatgatggtgattacggtggtgacgacaataacaatcatattggtgatggtggtggttgatgatcatgctagtgattgtaatggtaatcatgacacttgtggcgggaacgatcgtgataatggtgatagtcatagtgatcatagaaagagtgagagcttgaaagaaccaaaacaaagtagttcttttatggatagctggaggttgttgcctctgccttgtcaatttttggttttcggtatatgggttggattgacccaacaacctatagcttactaa

SEQ ID NO: 36181 - DNA, 360 bp, Glycine max
  Peptide Sequence Number=SeqID_152959
atggcaaccttgtttaacaagctagtgctcacaggctacttggttccagattattatactagtcagcagttgactaaaaagagtgatgtctatagttttggagtgctaatgctaaagttgattattgcaagaaagccaatagaacaagggaaatatattatgaaagtggtcacaagtacaatagataagacaaaagacttatatggtcttcatgaaattattgactcgaccatctgttcaagatcaacacttgagcgttttgagaagttagtggaccttgcaatggagtgtgttgaagattcaggagttgacatgctcacaatgagtgatgtggttaaagaaattgaaggcatgttgtag

SEQ ID NO: 36182 - DNA, 417 bp, Glycine max
  Peptide Sequence Number=SeqID_152960
atggcaagcactcgcactccacacgaagagttcatgtacatggcaaagcttgcgaaacaggtcgagtgctataaggagatggtggatttcatggagaaggtctttgccttcaccgtgagtgaggagttgatcatgggggagtgcaacctcctcttcatagcctacaaaaatagggaatctttatgctttcttgacatttatgtgcttgtgatttatgcattagagttgccaaagtctcctgattggtcacaatacttttatgtcgtttctcagcaaaagctgtttaacctagtgaagaaacaaaatgatgggactgttgaagttgatctagaaaaagatgcacctcttgcatcagaattcttgaagttccaatcttttgaagagtcaacaatgagtggaactattatttatgaataa

SEQ ID NO: 36183 - DNA, 531 bp, Glycine max
  Peptide Sequence Number=SeqID_152961
atgtacaaccttcaaattgttacgaggaatttacaaaagttagtaataagggtaatttacaaaacaaaagttgaaaggaaacatattgacctgatagacgaggaagaagcacagattggtggtgatcgttctagtgcaacctcgaataaagctgagatttataacgaggaggcatggaagaaaaaacagaagcataaactaaagagggtggagagtgtcaatgatgatgcagaagcctttgctgaagcactagaccatacgaagaaaagagatacaggccatcaaagtgtgtcattggagaatgagacaggagattcaactatgctgaagatgggagattcagctaaagttgtgataaaacaagacatgaagggaagagagcataaatatgggtttaacaacaatgaacgtgagaagccagagaagaaaagggtggtggatgatgaaactggcgacaaacatgagctggatgaagtcctaaggaggcaaattgaaacaaaaaaccgatgcctcaatcagagaaaaatgtag

SEQ ID NO: 36184 - DNA, 132 bp, Glycine max
  Peptide Sequence Number=SeqID_152962
atgcttggaatagcagaaaagagagagagagagggagcgctaaatagtcgtaagagcatgaagagtgaaatacacagagaacttgatagagcaggatcaggttaccgtatgtctggacatggagtgcggtaa

SEQ ID NO: 36185 - DNA, 1356 bp, Glycine max
  Peptide Sequence Number=SeqID_152963
ccacgtgccggagtgcggcatcgcgcaccgtatgccgccgatcaggtaccgaacacgccgcacttcgccttggctgcgggtatgctggccgtcccatgtaccgcaggaagcccgcatgacccgcaccgcacccgccctgccgtccctgctgcgccgcgccgccctgctgctggcgctggccgtggccagcgttccggccctggccgcgccaccgaccgatggcgacatcaaccgcctgctgtccgcgtcacgggcgcagagcatgatcgacaccatgctgccgcagatcgaggcgatgcagcagcagcagttccagcaggtggccgcacagcgccagctcaacgcccagcagcaggaacagctgaagcggatccaggcgcggaccagccagaccctgcgccaggccctgtcgtggcagcagctgcggccgatgtacgtggacctctacaagaagaccttcagcaaggaagacgtgctggcgatggccgagttctacgagagcgcggccggccagagcctgctggacaagaccccggcgctgatgcagaacgtgatggtggccatccaggcgcgcatgcagccgctgttcgcggatctgcagaaggacctggaagcgatcgtcaacgagccggaaaagaaataacgggccgagcccacgctcggcttaccgcagcagcatcaggcgtcgtccacctgccagccgaacaggcccagcgccttctggaactcgcggtccagcggcgcacgcacatccaccgtgccaccgtccggatgcgggaaacgcaggcgctcggcatgcagcagcatgcggtgcacgccctgcatgcggaagatgcggttgtggcgaccatcaccgtggctggtgtcgccgatcatgtgatgcgagagatgcttcaggtgccggcggatctgccggaagcgcccggtctgcggctggcaacgcagcagcgcgtagcgcgaacgggtgaactcaccgaccgggaccgacagctcgccggtggccaggcgctggaagtcggtgaccgccggcttcttcaccggcttgcccgggccaccgtcgaggtcgtggtcgacccgccaggacagttctgccggccagccacggcagacggtcaggtagtccttcagcacttcaccgcccatcaacgccttgcccagcgcgctggcggtttcgcggtcgaaggccaacagcaggcagccgctggtggcccggtccaggcgatgcacaaggaagatcgggcggcccagctgctcgcgcaggcggtcggccaggaagttgtattccccacgggccagcttgctgtcgtggaccatcagcccggcaggcttgttgaccacggccaggcgttcatccag

SEQ ID NO: 36186 - DNA, 285 bp, Glycine max
  Peptide Sequence Number=SeqID_152964
atgggaaagtggaaggactgcttctacctcaaggatttgtctatctattcaatcaagagtatctttaggaaactcaattcactcttgaggttcagacgtgaagggcacagaaatgggcttgttaatctttacaaggatatggagccttttgaagaaaatgatgatatacaagttatgtggaaaatgattcaagttcaatcatcaactcctcaatgtacctgcaccgtcaaaagggccaataggtgtttattggaaactatgttttcaaccgacttgaaattttaa

SEQ ID NO: 36187 - DNA, 1308 bp, Glycine max
  Peptide Sequence Number=SeqID_152965
atgctggctggtgccccgtcttctcatatgagttcatctgtctcaacatctcaaggaatatttccaacttcaagaattggaagtggtgaatcccccaatagtggggcctcttcttttacccagcctattgcagatatgaatgaaaatgacgaaacagacttgctctcaatatcatggaatcaggactatggttgctttgctgctggcacaagtcatggttttcgtatctataattgtgaaccttgcaaagaaactttcagacgtgatttaaaaagcggtggttttaaaattgtagagatgctgttccgctgcaatattctagcacttgttggtgctgtagctaattctcactatccaccaaataaagttttgatatgggatgatcatcagagcaggtgcattggtgaatttacatttaggtctgatgttcgtggagtgaaattaagacgtgatcgaattgtagttgttcttgagcacaagatatatgtttataacttcacagatttgaagcttcttcatcagattgagactctggcaaatcctagagggttgtgctgtctttcacaccattcaaatacatttgttttggcttgtccaggtcttcacaaaggacacgttcgagttgaacacttcggactgaacgtgacaaaattgatcaatgctcatgattctcaaattgcatgcttcactctgacattggatgggctccttcttgcaactgctagtgtgaagggcactttaattagaatcttcaatacaatggatgggtctcgtttacaagaagtaagaagaggggtagatagagctgaaatcaacagtatagctttgtctccaaatgtccagtggttggcagcatcaagtgacagaggcactgttcatgtattcagcttgagagtgagagtgtctggggaggatagtttgactcagccaaatgcttttcaagggcctgcactgtttcatcagaattcttcatcttctttagatcccttgatttctccaaatactggtgctaaccccaattcatcattatctttcatgagaggagttttaccaaaatattttagctcagaatggtcatttgcccagttccacttgcctgaatacactcatttcattgtggcatttggatctcagaactctgtgataattgttggtatggatgggagctattggaatgcacttaaatggccaatgatacaattttctccttctctgtttgatacctgggaatgtgttaactgccgtttgcagcattccaaacttctaaacatgcctttaatgaagcatgctgttgagattaatagctaa

SEQ ID NO: 36188 - DNA, 177 bp, Glycine max
  Peptide Sequence Number=SeqID_152966
atggtgtgctctagaactcgttggcacataatattggtgcaatattttgggagaaaatggaatgtggaaatgctcatttccactgcagagccaggtttgaagaagggtgaatcggatttggatttgcctttgtccaccattctcacttcctgcctgccttgggtttttgcaatttga

SEQ ID NO: 36189 - DNA, 1113 bp, Glycine max
  Peptide Sequence Number=SeqID_152967
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaattaccgcccgattgggggctgcattcccaaacacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 36190 - DNA, 208 bp, Glycine max
  Peptide Sequence Number=SeqID_152968
gtgcattagcagcaccttgacaacgcaacaaaagaaagacatttccatgaaggagttgcggcccctgacgccacccgatgcaaggccaccactgggtcacggtgatggcagtgacgacatgacggcccaacgtggtctcaccgaagttgaccaaaagaaaaaaaacacggtgaaaaggagaaagatgacgataagaacatttgaataa

SEQ ID NO: 36191 - DNA, 966 bp, Glycine max
  Peptide Sequence Number=SeqID_152969
atgatcaatgtacagtttatgcagctgtacttggttatgaacatcagatattggctggttatgaacgtttgtaaattttgtcatcatggcagggatcatgctggtggaaatgaaaagataaagcaattggtgcctggaatcaaggtctatggtagtttaattgataacgtcataggttgcactgataaggttgaaaatggggataaggagtcccttggggctgatatttatatattgtgtcttcacacaccttgccacaccaaaggtcacataagctattatgttactggcaaagaggaggagcagcctgctgtttttactggagacacactgtttattgctgattgtgggaaatttttcaaaggaactgcagagcagatgtatcagtcactatgtgtaacattaggttcattaccaaagccaacacgagtttactgtggccatgggataatcccaaataattttaggccaggccttactggtaaacttgtacaaatgcaagggttacatctccacttggttgcacagataagtcagactgatttgaatgtttcttgtcaagaagcaattgcttcaggaatccttacgcagttaagcatgacaatccatagatctttaataacacaaggttttggagatccaatagccaacttcataattataattggaaaaaggagtggatttctcttgatactcccttactcaatgaatgctaagaatcagcagcaagctggtcaacttacaatttcctccaccattgaggaagaaatggaaaccaacccatttaagagggttgaccaacccgacattcaggagaaggtagggtgcaagtctcccgttgaagctttaagagagttacggaagctgaaagacaactggaagggaaaattgataatattcacaggaggtcctcgtacggagtcgcacacttacttgagcagtgcggaagactggggaatgggttga

SEQ ID NO: 36192 - DNA, 627 bp, Glycine max
  Peptide Sequence Number=SeqID_152970
atggaatcgtcaccgtcctcgtcgtcttctggaagcgacaccagtggtggtggtggtggtggtggtggtggtggtggcggcggcggcgctgtcacgtggttcgggatgagtttcccattccgttctccgctctctctcgtgatggattactgcgtacgcgaggattctgcggagcctgtgattatcattccccgcacgcgcccgcgttttcaggcgcatgccgaatcggacgctgcttcggcctctgattccgatgagaatgcgtgcaacggcgctgctgaggaggttgcgatacgcataattggggtcggcgagcaggagagcggttcatcgccctcatcgtccaggggccggggcggggagctgggcggtgaggaggcggtggttgggaggagcgggatgctgtcgtctcgccggcgaatggcggaggagagggtgccgttggtgtctttggatgatgggattgttggcgctagggattcttcttcttcatcatcgtcctctacttaccagaggtatgatattcagcaggttgcgaagtggattgagcagattctaccgttttctctcttgttgctgattgttttcatccgccagcatttgcaaggtatcgcttcttcagtttag

SEQ ID NO: 36193 - DNA, 186 bp, Glycine max
  Peptide Sequence Number=SeqID_152971
atgaaaatctatcacgttccttgtcttcgagacaattattcctacttaatcgttgacaagagcaccaaagaaggtgcggtggtggaccctgtagagcctcagaaagttctagaagctgccaattcacattgggtcaatctcaagcttgtcctcaccacacatcatcacgggtgctgctgctactag

SEQ ID NO: 36194 - DNA, 153 bp, Glycine max
  Peptide Sequence Number=SeqID_152972
atgtatgagatgaggcacatgtacagaatgaaagttttgttaggaattgaagaatttaagataggaattgaagaatttaagagagaaaggcctttccagtgtgtgattgctcaaatattccgtacacctgcaccgccaccgtgtctgaaatag

SEQ ID NO: 36195 - DNA, 1347 bp, Glycine max
  Peptide Sequence Number=SeqID_152973
atgaagttgcagttctctattgttgcacttgttctattaggctccacactgtccttctgtggcctgatagtagctgacttgaactctgaccaacatgctctcttggagtttgcttcaagtgtcccacatgccccaaggctcaactggaagaatgactctgcttcaatttgcacctcatgggttggtgtgacatgcaactccaacggcacacgtgtcgtaggcctccatcttccagggatgggattaaccgggaccattccagagaacagcataggaaaactagatgctcttagggtcctgagtcttcattctaatggacttataggaagtcttccttctaatgtactctccattccttcactccaatttgcataccttcagcacaatagcttctctggcctaattccttctccagtgacccctaaactcatgacattggacatttcttttaactccttttctggcaccatcccaccagcttttcagaaccttagaagactcacttggttgtatctccaaaacaattccatatctggggctattcctgacttcaaccttccaagtctcaagcatttgaacttgagctataataacttgaatggctcaattccaaactccataaaggcattcccttacacttcttttgttgggaacgctctcttatgcgggccacctctcaatcattgctctacaatctccccttctccatctccttccactgattacgagccactcactccaccagccacccaaaaccaaaatgctacacaccataaggaaaactttggcctagttactatacttgctctagtcattggggtcattgccttcatctctttaatagttgtagtgttctgtttgaagaagaagaaaaacagcaaaagcagtggcatactgaaaggaaaggcttcttgtgctggaaagactgaggtttcaaagagttttgggagtggagtgcaaggggctgaaaagaacaagctatttttctttgaaggttcctctcacagctttgaccttgaggatttgctgaaggcttcagctgaagttcttggaaaaggaagttatggaacagcatacaaggctgttttggaggagggaacaacagtggtagttaaaaggttgaaggaagttgtggtaggaaagaaggagtttgagcagcagttgcagattgtggggagaattggaaaccaccccaatgtgatgccactaagggcttattactattccaaagatgagaaacttctggtttacaactacatgccaggtggcagcttgtttttcttgttgcatggaagtggaactgacaattacagtataaccaacttgtttccacgatgtcatgggtga

SEQ ID NO: 36196 - DNA, 954 bp, Glycine max
  Peptide Sequence Number=SeqID_152974
atgcctaagagagtggaaggagttgttgccatgaagcagcactttgtgcttgtacatggcataggtggaggaagttggtgctggtacaaaatccggtgccttatggagaattcaggctgcaaggtctcatgcatagacctcaaaagtgctggaattgatcaatctgatgctgattccgtgctatcttttgatgattacaataaaccacttatggatttcatgtctgatttgcctgagaacgaacaggtggttatattggtggggcacagcgctggagggttgagcattactcaggcctgtcacaagtttgcaaacaagattcgtttagctgtttatgtggcagcaactatgctcaagttcggattcctgaccgatcaagatcttaaagattgtctctggaatcttgaaggttttccagcaaggacgcctttggagacaagagagtcaaataaatttcttgctttcttttcgttccctcaatccgacaaccctgtttattccacagatccactttgtcctcaggagggggtgcctgatttatccgagtatggggatgtgtatgagctgggatttggattgggacatgataagcctccaaccagtgctttggtgaagaaagaatttcaacacaaaatcatctatcctttgagccctcacgaggattcgacattggccgcgatgctgttgaggccagggccattgctggcattgacgagtgctcaattcagagaagatggtgatggtgatggtgaagtggagaaggtttgccgcgtgtacataaggacaaggcatgacaaggtggtgaagccagagcaacaggaagccatgataaagaggtggccaccatccacttcatatgaactcgacagcgaccatagccccttcttctccaccccattccttctctttggcttgcttcttaaagctgctgctgccttggacgcaattaactag

SEQ ID NO: 36197 - DNA, 1464 bp, Glycine max
  Peptide Sequence Number=SeqID_152975
atggagggatctgaaaattttgatgcaggcagtgaccaagggaatgtattggtgacaccatattataccccatatccaaagcacgtgctaccaaaatctggtgttcaacctgttgacatagagttttctcctagctcaggtggtgatagctctgcggcttctatgaaagagggccctggatcatcttcttcatcatcctcatcatcctcggattcagagcaagaaaatcaagtagttggggagggaaaaacagatgatgtatcatgggagagtgagaatagaagttatgatgaattgcttaaagaattccttaaaaatgaggaagagctgaaactttccaactttaaacttaagctctcagaagaagagttgaaggttcaaattgagaaaagtgagggtcagcttaataatgcgttggtagaattaaaagtgaaagaggaagatcttgagtatgaaaaaggacaggtactggagttgcaaaaaaagacagctgatttggaaacacatgttccagattgcagcctcaaaattgcaaagttagtggcacagctggagttggctgaagaacagcttaagatatcagatgatgaaattgcaagattagaagaggaacttaatagcaggtcattgggtactcgtgagttgcaaggtcagcttgaagtagcacaggataatgtggctgcattagagaaccaacttgactcagagagaaagcagattcaggacctagaagacagggttacatggtacaaaactaatgaaaccaacaatgaacttgaggtgcaaaaattgaaggctgatatggttgatgcccaagcacagttctcattggagaaggatcagttgcattctgagattgcacatttgtcagaagagaacaaacagctgggctccagacttgaggaatataagtctagaagcaacatatttgaaaacaaatcaaggcaatttgaagcggaaaaactgaaactagaagagctgcttgccacccaacaaatggttttgcaaggtgaaatcagttgtttgaaggaagaacttgatcagagaagacatgatgttgaagctgtgaataaggaatttgacaggcacaggcagaagtatgacgtgctcatgactgaaaaagatgaggccaatgctaagattcataaccttatggccgagacaagagaccgagacaatcacattgcaaatctggagagagagataatccaggtatgtggacaaaaggcagagctgatcacaggatctgcagctacactgaatcttgtaaatgagttgaaactgaaagttgatgagcttgaaaaagaggtgactaggcagaatgcagtgatctcagacagggctgaggagaagagggaggcaatccgacaactatgcttttcaattgagcactataggagtggttataaagaacttcttcaagcattttctgggcacaagcgtcatgccgttacagctgcctaa

SEQ ID NO: 36198 - DNA, 1107 bp, Glycine max
  Peptide Sequence Number=SeqID_152976
atggtgggcctgacacaagtatttagaagttcacttatggatagttttatgttgctggattctgtgtttgtgaacaacattacgttctcatcattgggagtcttaaatttgggaggaaatgttcgagatgggtttatcatacatttttcatttaaggtgggtaaacatcttaaagttttgacaaagcacccgaggctgaaaattaaggcctttgctattgacctaattgagatatggaaaggcataattatcaaggaaacaagcaaaaataaaaatgggggctctgatagtaaggttgagtcggctaatggggagaaatctaaagctgggaaaatgcaaaagagtccttcggtaaaggttgaaaaaggtgaaactgttaaggttgagaaaattgataggaatggtacaacaaagtcaagctcagaaaatatgaaaaaggtacaaaacgatgtcaagaatgagaaaactgatcgttctgcaagtgtcaaggtggaaaagatagccaaggaggaaaagccagtttctggagcaaagaaaatgtcatccagttctgccgctcccccaaaactaaaaactatgattaaatctaatgatgcaacacgagacaaaataagggaaattctccacgaggctttatccaaggttactggagaagctgatgaagatcttgtagatgtagtcaataattctgatcctatccgtgttgctgtgacagtggagtctgtattatttgaaaaatggggcccttctaatggggcacaaaaggtcaagtataggtccttaatgtttaaccttaaggattcaaacaaccctgatttccggagaaaagttctgcttggtgttattgagccagagcaactgatcaacatgagcacagcagaaatggctagtgagcaaaggaagcaggaatatcagaaaatcacagagaaagctttgtttgaatgtgagcgtggaggtccgccaaaagctacaaccgatcaatttaagtgtggccgatgtggtcaaagaaagaccacctattaccaaatgcagactcgcagtgctgatgaacctatgacaacctatgtcacttgtgttgtctgcaataaccgttggaagttctgttag

SEQ ID NO: 36199 - DNA, 238 bp, Glycine max
  Peptide Sequence Number=SeqID_152977
gctgagtaccctagcccaccaaaccagtctcagaaaaacgacgatctcgaacccgttcaccgttggatcgtcgtgaaatttgagtatcatgttcgcaacacaattacgagaattctcaccgttgggaaatttgatatcataattctatcggagcagtcggaggaaaaacttgaggaatctcaaggaaccgctatagatgccgctatcgttgtcggaagacacgtgagtccgctcagag

SEQ ID NO: 36200 - DNA, 279 bp, Glycine max
  Peptide Sequence Number=SeqID_152978
tcaacaacccaagtagatgtaccctctacttgtaccacaaaggatgtaccctctaatgtgttaagacaaagttctcaggcggttaaacctttgaaactttgtgaatggggatacaaaagaattctcaagcgggaaaagggaatgaaaaagatgaatagcacagttttcacggtttggaaaaccagaaaactttggaaagcttttggcaaaaggaagaagaagaagaagttcaaagagactcagaaatcaattggcaaaagtttgttgtctaaagaatga

SEQ ID NO: 36201 - DNA, 228 bp, Glycine max
  Peptide Sequence Number=SeqID_152979
atgaatataatattttccaaaccctattatgttcaccctaacaagaatccctctgcgaaactcgttactactcttcctaatggttcaaattaccatggttgggttcaagcgatgacgttggtattggagatgaagaacaaaatcaacttcatggatgacacgattccaaaacctaatgagcaagattcgaactacagtgcttggaaacggtgtaacaacctgatttga

SEQ ID NO: 36202 - DNA, 423 bp, Glycine max
  Peptide Sequence Number=SeqID_152980
atgaattcaatgttcaatacatcaaataagaaaagaaaaatacttgaatatcctcccaaatcaagtcctcctgagcagtggggacctttttccagttcttccttgccggtagcagtaggtggtctagtagacaacgatcgtagacgtgtggctttgtgtgtcttcttcacggcagacgatgaagcttatgcgtctggaggaggaggaggaggaggaggaggaggaggcgagccaggtggagaagccatgatcctttatacaaaaaaaccagggttaataaacattacaaaaaataactatatgacttatatgatgacaaaggagatgacaaaaagctcaaagaacaactcaagtgaatcaagaacaattcaagagttcaagataagaatccagaagaattcaagactcaagaagaaagtttag

SEQ ID NO: 36203 - DNA, 643 bp, Glycine max
  Peptide Sequence Number=SeqID_152981
attctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 36204 - DNA, 510 bp, Glycine max
  Peptide Sequence Number=SeqID_152982
atggaagacgcacccgtgagctctcgcgtcgccctcccgccgaagggtaggttgcgacagtccaaaattggtgaagatcaattattttattttcagcaaatgggaatagactatgaaaaagcaatggctgctatgatctctggattttgccatgatgtctttaatgagcttcctgatgaatttggttctgaggtgaaccaactcatgagcttgaagcttgagggattagtagaagaaacttttgttgattctgaagcactgaggttggaaaaggctattatattgcaactaggaaaggttggtgctcttgagttattcaatgtttatctatcaagatcagttggaacctcacttgtgtcaaactatgttgtcaaagtggatgactacaaggacaaagtgctagcagagttagagaaaattaggacagctatagaagaggataccaagccagtagcaagcttgagtacctgggcagacgcatctgaagttcatgagaaggtgctacagtag

SEQ ID NO: 36205 - DNA, 249 bp, Glycine max
  Peptide Sequence Number=SeqID_152983
atggctaccattgcattatcaagtagatatgggagcaagttagcatatgacactggaatttggggtgaatcctacaggctttttgctgcaaaattcctttttggtttgcgctataactggtgtttaggcattgggcgtgtggcttatgggagatttgaccctgtaggaatggtagtcatagcaagggtttctgcctcattctcatcctcttcatttgccctagttttcacattcatcaaagcaggatga

SEQ ID NO: 36206 - DNA, 402 bp, Glycine max
  Peptide Sequence Number=SeqID_152984
catgttcacattttagtgaaaagccctgcttttgtcgaccaccctacctttttctaccatggcccaagatcccgatggcatacggagacacccgacggtaacccgcacacaccctttgctatacagcgatccgagagtctagtagcatgcagagacgccttacggttatccgcacctttccaatgtggtcatctgcaccctttccggagatgtcagcatcttccggtagagactatttcagtctcacacttctctcaagagctacacccagagcacgatagcattcagagactaacgtcgtcttctgcaccctttgttaatcgcggccaacaagccggtttacacgcggagatttacgtcctcctacgcgctttctgtcacactgaccctgaaatcaggtga

SEQ ID NO: 36207 - DNA, 637 bp, Glycine max
  Peptide Sequence Number=SeqID_152985
gagcgacttgagttgaagctggtctcccatggtaggaaagttgataaatttgggagttcagcgcctgagattgaaggccttattgccggcaccatattaagtccattgatcaggtgttctatggtcaccgacgatcctggacttatatccgcatttgcagagaggtggcatagggagaccatcaccttccaccttctagtgggggagttgacgatcacactggacgatgtggcgtgtctcctcaatcttcctatcacaagggcattacacaggtttgagcctctgggcgtggacgaggcggtcttgctgttgatggagcttttagaggtattcagcgaggaggctcgagctgagaccataggtgctcatggggcttacgttgcaacccatgttgatgtggtgcatctggagggttttcgagacttgggtcagtttaggggctatgtttggggagttgttgtgctggttcacatgtatgaccagctaaatgaagcttcgcagacccccacacaacagataggtggtgttcatcagtgtgtcactgatgatgggtacgctgagacgaccccacgtgcctgcaggtggcttaagacgaaggcgcacatgaaggggatcaagggagtgtcgtacagggcac

SEQ ID NO: 36208 - DNA, 210 bp, Glycine max
  Peptide Sequence Number=SeqID_152986
atgaccaagaatagggtgttgaaagagcataacaagactttcctaaattggtttaaagatacaatctttggtgacaataatacttctgaaacattaaggaagttagtatatgggcctaaaagaaatgttataacttggcaaggatacgatatcaagtattcgttctacatggaatcacaagatgacaagagtacaatgcaaaacagtggg

SEQ ID NO: 36209 - DNA, 279 bp, Glycine max
  Peptide Sequence Number=SeqID_152987
atgaaggagccacttaccttcatggaaggaggaataagtgcgagaatgagggggggggaaggagtcaccacaagagggaggggtattgtcattgtgggtgtgttgggatgccgctgcaagggtgtgtcgttgagggagttgagggagatgctgttgcgaaatgagagaaggaagaagggaggtgggaaagttccgttattgtgtcccaattttttacttgaaaggaaggcccagtatggcccaaaacaatggtttacaagtcacaacatgtattcatag

SEQ ID NO: 36210 - DNA, 399 bp, Glycine max
  Peptide Sequence Number=SeqID_152988
cgttttgctgctgttattatgaggatcagggaaccaaaaactactgcactcatttttgcatctggcaagatggtctgtactggagccaagagtgagcaacagtctaaattggcggcaaggaagtatgctagaattattcaaaagcttggtttcccagctaaatttaaggattttaagattcagaacattgttggctcttgtgatgtcaagttccccattcgacttgagggtcttgcctattcccatggtgctttctcaagtgtaagtgtgaagtgcaataatcatctgtttttcctggtgaatttcatggaaaaatggtcctcacaaattcctgccctagtaatcagtcctacatatggtcctcttgacgtgggctattctataggatgttgtacatga

SEQ ID NO: 36211 - DNA, 111 bp, Glycine max
  Peptide Sequence Number=SeqID_152989
atgtctggcatattcagcgtaagcaagaggcaaccaaacaaccatatgcaagagattgagcttcgatataaattgctcggatctgttttgaattttaaccaggcgaaatga

SEQ ID NO: 36212 - DNA, 531 bp, Glycine max
  Peptide Sequence Number=SeqID_152990
ctagaggttggtccctcagttgctcgtgtcaacacaaaggagagttgtgttgatccctcagggaatgacttagacacgggtgactcagagaaatgcgggttgtacgtcgaagaaaatcctccctgcctagttgccctaggaatactttatgaggggtcgacaaccgttcacaacatccctttatgccatgatcaagacaagttagtgttgaggaagttagagatgcagatgctcccattcctgtacccactcaagaggttcagagttgtggaaccgacaaaacctgcacataggccagatcatcatgtcgacgatcccctgtatctgatgacattgaccatcccacaactttttcttaagccgttgcaggttatgtgggatgctactgtgtttggagtgtttaatgacaacttctccttgtacgtaaagcatgaaaatctgtttgacatagcacacggtggtcaatgtctccgcatgtctattatacacttatggattttcaataggcatatgatcgagacaagtatgtga

SEQ ID NO: 36213 - DNA, 278 bp, Glycine max
  Peptide Sequence Number=SeqID_152991
gattccatggaggagcaggcttcataggattccattgtcgcccatggacgttaagatgtgctgactattgtcattggccgaccaaaacaccttggtcgtgtgcgtgctgctggagccgatgtcacgatcaaacaatactttggactggctacaaggacctcccacacgtcttcgtccattgctccgaaagacatggagcagttgaggcaaaaaatcagggaccagctggaggagtcgatcacagaaaaagtgactcgacaagtaatgttgtcctttag

SEQ ID NO: 36214 - DNA, 240 bp, Glycine max
  Peptide Sequence Number=SeqID_152992
atgaccctcctacgatgcgtagatgccaaagaggcgaacttcatgattgaggagatccacgagggttcttttgggacacatgccaatgggtcacagtacatggggatggatgcaagtggggatagggtcatgaccgaccagtcgttgccccttcccggcgctaaacaagcagagaacgtcgctgcaaggcagcccaatatcctttgcatttgcagtttcttttactattgtttgttttaa

SEQ ID NO: 36215 - DNA, 306 bp, Glycine max
  Peptide Sequence Number=SeqID_152993
atgtcattgcctagcgctgttcatgcatccaccacctacgagtctggagccccgcgaagttattgcgtagcgatgttcaccaattctcaattctccacttttttactgagccccttgaatgtcattgcctggcgctgttcatgcatcctccaccaacgtgtctggagccccgcgaagttattgcgtagtgctgttctgcaattctccattctccgcttttttacggagccccatgaatgtcattgcctagcgctgttcatgcatcctccacctttgagtctggagccccgcaaagttattgcgtag

SEQ ID NO: 36216 - DNA, 690 bp, Glycine max
  Peptide Sequence Number=SeqID_152994
atgcataccggggcaagatttcacccgttccactgcaaagagacaaggatcgcaaccacaagacacccagtggacccgaaggagcccaacagggccctggggtttccagctctggttacgagcctctgtcagtcctacagggcgcccgtacccccagcaagttcatgccatcgtgacatagggatcatgcccgtaagacactcaatggacccaaagaagtccaacagggtcctggggtttccagctctgattacgggcctctgtcagttctacggagtgcctgtcacccccagcaaggtcatcagaccccttaccaatcgagctttcatcaagaagtattgcgcccccaggcaggtgcagggcgagacaccacagcagcccggggatggccgacagcgggcaaccaacgcaccgccgccacctccagggccccttagctcatctacaaaggccggagcgttgcctacgacccgttgccgactagcgggcgaccaagtagcaagataccttggatatgcatgtagcaagataccttggatatgcatgtgtcgcaacctactcttcggcggaagggcgacgcgtgactcgcgggtgcgtgttccaagaaaggaatacgcgcggagtcgccaccaacgtttatttgaggaaaacgtcggaaaaaccggaaaagacgtgatctacgaactttaa

SEQ ID NO: 36217 - DNA, 212 bp, Glycine max
  Peptide Sequence Number=SeqID_152995
gggttatggctaccattgcgttatcaagtagatatgggagcaagttagcatatgacaccggaatttggggtggtcttcgtcattggaataatgacattgttgggtttggtgggaaacttggccgtataggaatggccgtcacagcatgggtttctccctctttctcaccctcttcatttgccccagttttctcagtcctcctagtaggatga

SEQ ID NO: 36218 - DNA, 228 bp, Glycine max
  Peptide Sequence Number=SeqID_152996
atgaatctgaggttcgttttcgaaaaactcgacgcagcaagcctagatctaaactcaaaacggacaggatcctacccttttccttcgtgtttggctgggctgaaacggctttgggctggtgactggcttggccgatggtggtggttcacggaggaggagggtggcggttctgatgtaggcttggctagtggtggctcacggaggaggagggtggcggatctgatgtag

SEQ ID NO: 36219 - DNA, 213 bp, Glycine max
  Peptide Sequence Number=SeqID_152997
atgcggccacaggtgctcatagaccaccatcgcttcctccgtctcggaatggcgcgccgtatcgatatagcgatagagaccgcccttgtaatggcgatgggtggcgagagccagggcttcggattcggtcatggagcattgccgcaaaagacgcggcccgggcgggaaggctcctgccagggccgacgggttcgaacaagtccgtatttatag

SEQ ID NO: 36220 - DNA, 1338 bp, Glycine max
  Peptide Sequence Number=SeqID_152998
atggccaaccagaatttcctcgacaccatgggctacgaactggacgaagtgatcgggcaacatcaccgcatattcgtgttgcccgacgagcgcgaatccgctgattatctggcgttctgggaccagctggggcagggggcgcatgactcggggcgttatcgccgcattcgcaaggatggcggcgacgtctggctgcaggccagctacaacccgattttcgacaggcatggccggccattcaaagtagtgaagtacgccaccgacattaccgcgcagcagcagcgccaggccgataccgaaggccagctggaggcgatttccaaggtgcaggccatcatcgaattcgagctggacggcacgatcattcgcgccaacgaactgttcctgaatgcggtcgggtaccgcgaggacgaagtgcgcggcaggcatcacagcatgttcgtgtcgccggaagaggcgcgcggctccgcctatgccgatttctggcacaagctccgtagcggacgtcacgataccgggcaatacctgcgcatcggcaagaatggccggcaggtctggatcgaggccagctacaaccccatcttcgacgccgaggggcggccattcaaagtggtgaaattcgccacggatatcacccgccgcttcaccgccgcgcagacgctgcgggtggcggtgcagggcctgaccgaaaacgccgatcgcgccggacaggccaatacgctggcgcaggacgcctgccgggtggccgaagaaggcggcaagaccgtggcgggcgtggtgcgcaccatgggcgccattaccgagagttccaagcgcatctccgagatcatcggcgtcatggatggcatcgcgttccagaccaatatcctggcgctgaacgccgcggtcgaggccgcgcgcgccggcccgcacggcaagggcttcgcggtggtcgcatccgaagtgcgcagcctggcgcagaacagcgcggcggcggccaaggagatcaagggactgattaccacttcggtcgaacagatcgagaacggcgcgggccaggtccagtcggccggcgtcaccatgggggacatcgtggcttcgtcgcgccgggtcacggagatcatggccgaagtggtggaagtgtcgctggcccagtcgggcaaactgggcgaggtgaccgaggacatcacccacatgaccgccgatgccgcctcggtgcggcaggcggcccacgagttgcacggcggcaaccgcgtcctgaaacccgcggtcaagtcggtggcgccggcggtgcgcgtccggccagcggccaacacgccattgccggccaagcctgtgctggagtacgcgcgctactga

SEQ ID NO: 36221 - DNA, 348 bp, Glycine max
  Peptide Sequence Number=SeqID_152999
atgatgagcatgaagaagataatggaagccaaggcggttgcagttgccgctaccggcgctgttgctaaagtgaacccgacgcccccatctagcctcaaccaaatgaatcatccaacctcagatatggtaggtctgggaggcaaagagttgggaggtatgggcggccctcatttagtgcgaaaaacaagcatgccttcccaccatatggcttgcctcccaactatacgccacccaatgtggcatacacccccaatgagaatgtcaataactccactcctacacccatcgagagccaacaacctcaatctgatcatgcaaatgtctcttgacccatggggagacacatga

SEQ ID NO: 36222 - DNA, 477 bp, Glycine max
  Peptide Sequence Number=SeqID_153000
atgactgacttgtgcctggtgccggacgttgtcatccctccgaagttcaagtgttggagagacctagcaacacaagtggcccctcccatggttgagagagaaatggttactatgatagtggataccttgcctatattctattatgggaaattagtgggcttcatgccctctagcttcgcggacttggtattcaccggagaaaggatcgaggtgggtttaaagaggggaaagtttgattacgtttccctcgcaggtgccagaggtaggaggatcggaatagctgaggcaaagaggaaagagggagatgcccatgccgtcacttcaacgcctgcatggcccaagccgccgcaaacctcctatggtacccaccaatatgcacaacatcacccgagcttttcggctcgcgttgagggctattttgactcagcgcccgcccagccaagggcgcctgcgcccccacagaggggcgccccatag

SEQ ID NO: 36223 - DNA, 195 bp, Glycine max
  Peptide Sequence Number=SeqID_153001
atggcagtgtcaatgaagatcaaagaaacatttgttggcctgcatatcaacattgacaatgatacacgtgttgtgcatgtgagggaaattactcattcacatgtagctcttgaacgcctctctgaagaggattccttctctctatcactaccgcaaaaagaccctacaacgacggttctaaaccaacatcgttga

SEQ ID NO: 36224 - DNA, 384 bp, Glycine max
  Peptide Sequence Number=SeqID_153002
atggaaaaacttaagcaatggctaaaccaagcagccccgcaaacttgggcatcagccatcatttgtttctttgcctcaaagaagttcccccatagactaaaagcatcaccggggaaggtttgcaaggcaaaacccttcaccacacccttccgtcatggtccatgttcatggatttttcaaagcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgttcagtggtgtccagtcttgcgaacgtgagggtgcatga

SEQ ID NO: 36225 - DNA, 360 bp, Glycine max
  Peptide Sequence Number=SeqID_153003
atgaggcacagaatcactttcatctcgtcggtgagtagtcatggcaaacatgaaaatggagatgacataatgagaaggttctcttgctgcaatgagagcttgagcagccagctttaccctccatatttgctattgaagccttcttggggtgatgacgactatacatgccaagggtccttgattgcgaaagaggcaatagatgatgaaaaagaaggtgataaggaccttgagtttgagtttgagtttgagagaaacaacgaagaagaagatcatgatgatgaaggggtggcatatgagcatcagatactttctcatatattgagagttttatccccagacaggtggcggaggatcgtttga

SEQ ID NO: 36226 - DNA, 258 bp, Glycine max
  Peptide Sequence Number=SeqID_153004
atggatagactttttcagtctgagatcattgtccttctagaatttgctaagcataaccttcagtggctaagcgcgaggaagaatccagaagaagatgagctgtcaagttcgctaagcgcaccgctccaggtcatcaagcgcaccgcttcagctcatttgctaagcgaaacaagagcgctaagccaaaatccacttatgcacgctaagcgatccagatctgcgttaagtgaacgagcacgaacaaggccacctatttaa

SEQ ID NO: 36227 - DNA, 939 bp, Glycine max
  Peptide Sequence Number=SeqID_153005
ccataagaggaatacacgtcctcgccttcagagggttacacgccctcgccttaaaggactacacgtcttccccttcaaaggactacgcgccctaaacttcagaggactacacgtcctcgccttcacaagactacacgtcctcgccatcagaggactacacgtcctcgccttcagagcgttgcacgccctcgccttcagaggactacacgtcttcgccttcagaggactgcacatcctcaccttcggaggactacacgtcctcaccttcagaggacaacacgtcctcaccttcacagggctacacgctcacccctctagaggactacacgtcctcgcctttatagggctacacgccctcgccttcagaggactacaggtccttaccatcagagggctacataccctcaccgtcagagtactacaggtcctcgccttcaggggtacacgcctcaccttcagaggactacacgacctcgcctttagaggactaaacgtcctcgccataagaggactacacgtcctcgccttcagagggttgcacgccctcgccttaaaaggactacacgtcttcgccttcaaaggactacacatccttaacttcagaggactacacgtcctcaccttcagaggactacacgtcctcgcctttagaggactacacgtcctcgtcttcagagggctacacgccctcgcctttagaggactacacgtcctccccttcagaaggctacacgccctcaccttcagaggactacacgtcctcgccatcagagggctacacgtcctcaccttcagaggactttacgtcctcaccttcagagggctacatatcctcgcctttagaggactacacgtcctcgccttaagagggctacacgtcctcacctttagaagggtacacgtcctcaccggtcgaggactacgcgtcctccccttcag

SEQ ID NO: 36228 - DNA, 921 bp, Glycine max
  Peptide Sequence Number=SeqID_153006
atggcccgcaccaagaaaaatggccaaatgacgtctgaggcatcaaaggaaattgctgacaagattgcctcacagggttcctttgtcgcccatggacattgggatgtactgactgctgccattgggcgacaagaacacgctggtcgtgtgcgtgctgctggagctggacctccacacttctttgtccatggctctcgaagacctggagcagctgatgcaaaagatcagggaccagctggaggagccaatcatagaaaaagtgactcaacaactaatgttgtccttcagccagatgcagtcccagttggtcctttagctgctcgtgtcagcataaaggagagttgcattgatccctcagggaacgacctagacacgggtgactcagagaaatgcaggttgtacatcaaggaaaatcctccccacctgattgccctaggaagactttatgaggggtcaacaaccgttcacaacatccctttgcaccatgatcaagtcaaggttggtgttgaggaagttagagatgcaaatgctcccattcctgtacccactcaagagggagctgtgagatcggggaaatctgcacataggtcggatcatcatgtcgatgatcccctatatctgatgacattgactatcccacggctttttcttaagttgttacaggttatgtgggatgctaccgtgtttggggtttttaatgacaacttccccttgtacataaagcatgaagatctgtctgaaataccacacggtggtcaatgtctcaacatctctgttatacaattgtggattttgcatatgactgagacaagtatgcaagcagggaatgccgatatgtatggattcctcgagccacagtccatacagagatctgggcaatcacaatttgaatcagaaagttatattaagaactggatgtag

SEQ ID NO: 36229 - DNA, 691 bp, Glycine max
  Peptide Sequence Number=SeqID_153007
atgggtgttgtatggaactctgtcaacaaggtggcccagatactcgatctaattctgagcaaggctacacttggacaatttaaggctaaattggccatcttgcaaaacctgaaaggtacattccaaatgcaaaagatgattgtcgaaggatttattgtctgctttaaaaaccacctcgctccttcaagctcgtctagtagctcatccatagttggaattggaaagcgatccttgacgattggtgctgggttgaatgattctatgttgcaacacggacttgacttgagcttttatttcctatttttgaaagtagggatagcgataaggtctgatgtttactgggccagtgttgggaagcagggtgatgggcacatcggagccaagagatcttccagtggcacctcatctaaatcaacaatcaacaagaaaagtttggaagagcatttgtgtccccttgtgaatttatcatcgcaattgaagcatagtcccttctcccgccgcttggctatctcctctaacgataatcttttaagaggaattgggggatatttggttggggttggaagcagagaaggaggtgatagtgaggcgattgtgctctggggtgcaatgatactcgaagaactgggttattttgaagatccaacccatatgatccaagccatcgaatcgaggaaatcgacgattgttg

SEQ ID NO: 36230 - DNA, 564 bp, Glycine max
  Peptide Sequence Number=SeqID_153008
atgaaatgtgttgcagatggtcacaggtgggaaagggaatttaaaattggagattgggcaagggtgaagttacaacctcatcggcaactatctgctaccggcgtaacttattcaaaattgaccaaatgtttttatgggtcattccaagttgtggaaagaattggaaatgtggcttacaaactgcaattgccagagaattctcgtattcacccaatcttccattgttcaattcttaaaccattccatcaaccatccacagtcacaattgagcctatatccctacctccaacaattgtggacaatcaacccgtgatttcacccttagccatcatctctgagcaatgggatcattccactccgaaaccaaaaaggatggtcctagtgcaatgggcaagtctactgcttgaggacacctcatgcgagatctggtcagaattgaaggacacgtaccaccttgaggacaaggtgttgcttaatgggctagggaatgatacagtagagaccagggatctgttgcccactggatgtgaagcgccttcaatctctttggttccaatggtctag

SEQ ID NO: 36231 - DNA, 231 bp, Glycine max
  Peptide Sequence Number=SeqID_153009
atggatgaggatttcaaaatcattgaagagctacgtgatagcaataattatctgagggctcaaataacacatcttgaaagaactctgaaacaggcaactgcaaaggagatgatatctaagggaatggtgctagagccaaggacagagaagctagtaagttccatgaacattcggttgaaggggaggacagaaaaacatgaggatgttgaaggggggagaactagtctttga

SEQ ID NO: 36232 - DNA, 701 bp, Glycine max
  misc_feature (611)..(611): n is a, c, g, or t
  Peptide Sequence Number=SeqID_153010
atggcttctccacctacctgccctcctcctcctcctcttgttccttccgacgcatcagcttcgccgtctgccgtgaagcgacacgcaaagccttatgcctacgatcattgtctactagaccacctggtgctgagagaccaatggtgcatgttgatcctgctaccggcaaggctgacggacttgatttgggaggatattcaggcggaatttgaaatcccagaggcttctgacaccgatcaagacggtgtggaggacactgtctgtgagaaatacgacatcaacaaggaaaaatggctccagttttgccagactcgcaaagacccttcttgggaggatgtgtgcaaaaaggcacaggccatccagaaacaaaacactaccccccacgttttgtctcgtgaaggttatgaatatttggagcaaaggctcctgattgagaagacgaagaagaagctggaggaagctgcacagtcaagaagcgttgatggcgtcatcgaccctacatccccagtcagacgccacatgaagtggaagatggcccgcacgaagaaaataggggagatgacgactgaggccgcaaaggaaatcactgagaagatcgatgttctcaccgntactattggacatccagagcaccctagacgtgtccatgctgctggagccggtgtcaccatcaagcaatactttggatcggctccacggac

SEQ ID NO: 36233 - DNA, 1305 bp, Glycine max
  Peptide Sequence Number=SeqID_153011
atgaacgacggcggaagccgccaaagcgacaacgcaaagccactcgatttggaaaacctgagagttgtctccgccgtggggcgcggcgccaagggcgtcgtattcctcgcgaggaccggtgaccggtcttcggaagagtgcgtggcgctgaaagtgatatcgaaggcgctgatcattcaaaagaaggcgaagttaaacgacacggaggagtacacgagggtgtcgtttgaagagcaagtgctgcgtcgtttcgaccatccgcttctgcctaggttaagaggggttttcgaaaccgatagggtcgttgggttcgccattgattactgtcacggtggcacgctccgttcgctaaggaagaaacagactgagaaaatgttctctgatgacaccatcaggttttacgctgcggaattggttctcgcattggagtatttgcacaaattgggaatagtgtacagagatttgaagccagataatgtgatgattcaagaaaacggccacataatgttggtcgattttgacctatccaaaaagctaaaccctaaattcccttactcattgagtcacaactcgtcctcgaatcctaactcggagaaaaaacacacaaggaggcactggttaacgcgattctacaaattctgcaactgggtaatctcaccctacgactcggactcggagccctcactcaacaacgtcaactcagcacgccacatcgagtccaacttagtcgaaaaatcaaactccttcgtaggaacagaagagtacgtggctcccgaaatagtttcggggaaaggtcatgacttcagcattgactggtggtcatacggcatcgttttgtacgagatgttgtacggaacaactccgtttaagggcgccaataggaaggaaacgttttaccgcatcttaacgaaggagccagagctaacaggggagaagacggcgttacgggatttgattgggaaactgctggagaaagatcctgaccgtcggatcagggttgatgagatcaagggccatgatttcttcaagggggttaagtgggacatggtgttgcgcattgtgaggccaccttatattcccgaaaatgaggtcaagaacaaagtggggttcggcaaaagcgacgtggaagtgttcgtggacaaggtgttttttccaacaggtgatgatggaggaagagagaaaacaaaaatggtgttggaaaagaaggatagtaataataatggtgagaatattaacaatatggtgaaagttgatgaattgagtcatgttcccaccgagaagattgacgattttttgattttttga

SEQ ID NO: 36234 - DNA, 689 bp, Glycine max
  Peptide Sequence Number=SeqID_153012
atgagggcaaagatattagagaatatcataatcatgtctagactcttacgatctttttctcatatctcttttcgctcaaactcctccttatcatcttcttcaagaaactccaatctattaaatgatcaagacaaccagacccaagaggtcgccccaaaacacaatctcttcgatgaggaagtccgattcgaagatatcaatcaaaatatggatgactggaacattccagaaatccctcaggatcaactatacgttcctgagacaataaaagacaaacacaactttgattacataatcaaaacagtagaaaacaatattcctctaggacaagaagtaggggaagaatttcatttactttcaaaaaattcaattcatgaacatagtcgtaagtataaatatctacacatcggttgtgtacaagtagccatcaagcccttaattgatatgggcatagatgcagcagttttaatgtgtctaagagacattaggcataaccaatttgaagactccctaattggaacagtcgaaaccagcctaggacaaggtccaatatattttaattgttatccaaacaaaacagtgagtctgatggacagaaacattcttgactctctgttcttaaacatccactttcatggccttgacatgaaagaaggatcaatcccagcagccttaatatataggatcca

SEQ ID NO: 36235 - DNA, 294 bp, Glycine max
  Peptide Sequence Number=SeqID_153013
atggctcttgcaagaatggagatcaaaaaattcgttggtgaaatagataatttcagtctatgggaggtgaagatgaatgcattgctcattcatcaagacttggatgcaacactttcagagtcagcaatcacaacgagagaagagaagagacgcgtagaggtgatgaataggctcatagtgatatcaatgaaagcggaatggagaaggaagaaagatgattggagatgccacttcaaggagaagataagtcaagaacaagcttaccaccataggaaaccatggataagagcttga

SEQ ID NO: 36236 - DNA, 261 bp, Glycine max
  Peptide Sequence Number=SeqID_153014
atgtggttcaaggagatacgatgcatgcagttcatctttattacttggaatcacgttctacgtgaggcaaaccaggtggcggatgtattggccaagcaagctattatggctttgaatcattttcaagttttgagattcctcctccatgtattatcaatgcacttcgagatgatattgctcatgtttgtttcccaagaggcggcttttggccctcttgatggttgcagttcaccaaaagaagtctatttattctcagaataa

SEQ ID NO: 36237 - DNA, 240 bp, Glycine max
  Peptide Sequence Number=SeqID_153015
atggcttcctactctaatgatgctagagagtggatggttgaaccctttttggttaccttcctcggtttaccaaattctggatatggtctagatggaactttctccatgaagtctacctatgagatagttgttatgaattctccctcccctaaccaaggacttttcatttgtctccacaaatggaaacgtcctgaaagaattataagttttttatggaagctttgccacgagaggttctga

SEQ ID NO: 36238 - DNA, 156 bp, Glycine max
  Peptide Sequence Number=SeqID_153016
atgtcttccaaaatgagacgtggtctgctcaagatgttattcaaaaagcttgtaagctggctcacgattacaatcaggcaaagctgcttgcggcaattcggtgcaagatcacataggagcttttctttgaggagtgggcgtgaatatttggagtag

SEQ ID NO: 36239 - DNA, 192 bp, Glycine max
  Peptide Sequence Number=SeqID_153017
atgaagaaacacttttgcaacttaatcatgtataacttgttgaagattatgagtatcctcttgttccggaaaaggttgacgagaagattatttatcgtcgctaacagtgcctatccctcaagtagaggttggacatcaatccgatctggaatgatacacacgatccccaagcctcaagcacaaaatgcatag

SEQ ID NO: 36240 - DNA, 129 bp, Glycine max
  Peptide Sequence Number=SeqID_153018
atggaatactacgttcttctggagcagggctgcgaatataaagaaagctcggggatcttatttttcggaggagtattggaagctaatggtccgaaaaatccaaggaatttgtttcaggaatacgagtga

SEQ ID NO: 36241 - DNA, 201 bp, Glycine max
  Peptide Sequence Number=SeqID_153019
atggagcacttcaatggcgacgatggtgagaaggagacaacggtcgcaaatgtgatggtgagggagaaaaggttaggttgcaaatggatggtgagcaaggtcccaaacaaaagtgatgagcaaggtcgcaaatggatggtgagggagaaaaagttagtttttccaaaaactgatgttaacatcggttttttcgaaaattaa

SEQ ID NO: 36242 - DNA, 342 bp, Glycine max
  Peptide Sequence Number=SeqID_153020
atgacaaggtcacgacccaaggtcctggctgatgaaattggaaagcgaccacggtataaggtagatggtggatctaatgttgagaatttaagcttgcagaacattgaagctcgaatcagaatggtgctagctttcatgttaccatcactcttaccttgggttcacagcaaacctgggttttatcttgttttggggagctccaatgtggatgaagggttacgtggttacttgaccaaggcgagaaacgatgttgaaagaacaagttactacatcgatgttggtgtaggaaacgatgtagaaagtgcaggttactacatctgtgcctccaccaaaacgatttaa

SEQ ID NO: 36243 - DNA, 207 bp, Glycine max
  Peptide Sequence Number=SeqID_153021
atgaggcgtattgtgttgaggtgtggtgttacgcgacagatggttaggtggatgactacggagaacctcgtgtcaaaggacacgggaacacaatgctctataggatgtgacattgggggtgtcacgtctaccagccatgtcaatttcaccctgacacctgcgtttgttgctgatgcaacctctgtctctatcagaatgccaagatga

SEQ ID NO: 36244 - DNA, 435 bp, Glycine max
  Peptide Sequence Number=SeqID_153022
atgagaatcttgaaactgaccaaatacaggttaaaggcccaagtggagaaggacaaagcccccaagtggagaaggatgaaggcccaagtggagaaggatgaaggcccagaggcagagacactatcaagactattaattacttatcaaggtaatccttgtggcgtctacctggacttatcttcctttatcgaaagtggcgtctaccttgacttatcttccttcatcgaaaatggcgtcatccaaacctctgtagcctgtatcaagcaatccgctcctagtcaggatcacatcatctggaacttaagagggaatgatgtaatcctccctaggaagggaccaatcactagaaccatgagcaagaggctccaagaagattgggctagagctgctgaagaaggccctagggttctcatgaaccttagggtagatttctga

SEQ ID NO: 36245 - DNA, 333 bp, Glycine max
  Peptide Sequence Number=SeqID_153023
atgggtgtttttgcattttccagtgttggctacaatgaggcgaaggcttacaatgttgatggtccactagccactagatggaagccattgagaggttttgggcttgctttgccgaagcgggactggcgtgaggtattttcatttgaagagggtgttgaggaaatttggtcatgtgcagatgattccacgccatctacctccctatccttcttattagcttactatgtaccaggtggatactaccctttccagattgattccccaatggcattaggagctatgaaaaccttgttggacctcagagctatgctagagagcacgagtcatcatcag

SEQ ID NO: 36246 - DNA, 483 bp, Glycine max
  Peptide Sequence Number=SeqID_153024
atgaatggtttgaaacataatgcaacaaagtcttcaacatatttagatcatgagaggttggtttggattaaaggtcgtgggattccaacctatgcttggacgaaaaacttcttcatattgatgggctcgttatatggcgacttcctgtatttggatgatctttcaatgaatagagaaaggttagatgtggcacatttttctatcagaacgaagacacaagatttgatcaactatgtggttaggattaaaattgatgaagatgtgtttgatattaaactagttgataaaggttcagaggattgtctaaagtgtatacaaggtagaaatagaaagaaggaagtcatgaaaacaatcatggagaaaggaagaattttgatagaagactcgacttggatgaaggttttagtggttcagttagttgccaacattcaacaagaggccaaagaagagaaggtgcaaaaagttgctacagaactcgcttag

SEQ ID NO: 36247 - DNA, 246 bp, Glycine max
  Peptide Sequence Number=SeqID_153025
atggaggtggtttctgcccagagacttcttgaggtggtcaaacgaaggtcgcatgccgataaacaatggtccccgaatgaaattagggttcggcaaagtccgttgcctacgtccggtccccaagaaagccgcttgggagttccactatctcgtaatcctttacaccttctgaaacacacaaggacatcccttcctttgtgttcaaatgctttacaacaagagactctcagtctcttagccctttga

SEQ ID NO: 36248 - DNA, 839 bp, Glycine max
  Peptide Sequence Number=SeqID_153026
atgctgcgtaccatctggatcgctaattttgccgatttgatcgtggtgatgaccgacggcggtccggccggttcaacctcgattctttccagttacatcttcaccaccgcttatcgcaaactggattttggttatgcctcggcgatggcgggcgtgacgctgttacctggcggtttcaccctgagccactttgcgaaggtattgaccgacagtgatttccccacgttttttattaacagtctcattgtctcctgcagcactgccgcgctgaccaccttgattgctgcgggtgccggctatgccttttcccgctttcagtttcgcggcaagatggtgatggcggccctgctgctgtttacgcagatgtttccgctggtgatgatcattgcgccgatttaccgggtgatggccccgctgggactgacgaatagtctgctggggctgattctgatttacagcgccttcaatgtcccgttcgccaccttcctgatgcagtcattttttgatgccatcccgaaagatctcgaagagtccgccatgctggaaggctgcacccgctttcaggcgctgtaccgcgtgctgatgccgctgacgctgcccggcatggcggcgacgctcggcttcgttttcaccgccgcgtggagtgagttgctgttctcactgatgttgatcaacaaaaacgaagtcatgacctttccggtcgggctgctcagtttcgtctgccaattcgccgtttcgtggggcgaaatgatggctgccgccgtgctggcgttaattcgagcgctgtctgatcttcgcttgcattcaacgctatcgtggtttcacggactcactcgccg

SEQ ID NO: 36249 - DNA, 177 bp, Glycine max
  Peptide Sequence Number=SeqID_153027
atggctgatggaaaactgatagagatgaagggtagagttaacctagggttaaaaagtgagaataaaatgcttatgcatggctggttgtggaaagggttgtacatattgggttctggacggttcctagcagatcccaacggtcaaaatgtagatttatgtactagggacctccagtaa

SEQ ID NO: 36250 - DNA, 333 bp, Glycine max
  Peptide Sequence Number=SeqID_153028
atggcgacgcagctaatccatgatcgagtggagatggagtgcctagagggagcttgggagaccctcaaaggcaacacgaggtgccgatttcagggcacgattcaatttacgactacttcattggtgcatccagatgaacccgcgcgcacgcttcagcgtactgtggagtggatactacccacgcctacaccataccgtctagtggagccagtccaagtgattgaggtaacgtcatccgaggaagaccctgaggaggatctcgaggagctacctcctgagcctgctgtggatgctcttgactttctagagggtgatgaggacccactccctgag

SEQ ID NO: 36251 - DNA, 948 bp, Glycine max
  Peptide Sequence Number=SeqID_153029
atggagtttgatcttgaagacccactagtcagcttggaagaagagcaaacctttactatatcagaactctttgcctccgaatctgaacacgtgccttcaccaaactgcttaacttcaacacattttcgcgttttctgttgtgaagctatatctctcattcttcaggttcaggtttcttgcaaattggacccatttgtagcttatcttgctataaattacttgcaccgtttcatgtcaagccaagaaattccgaaaagtaaagaaacctttgaacaattgtaccttaatagcattccacaatttccaattttttacccttatgccattagtcctctgagtttgcagcaagggaagccgtggtttctcaggcttgttgtcatatcatgtctttctcttgcttcaaagatgaagaacacaactttatcatttttggttatacaaaaagaaggttgctactttaaggctcagagtattcagagaatggaacttcttattctcggggctctgaaatggcgtatgaggtcgattacacctttttctttccttcatttctttatctctttagctgaaattaaagaccaatcactaaagcaagcacttaaaagtagagcttcagagataatcttcaatgctcaaaatgcacaaactctgaattgcatctctcttatggctgcagacattaagcttttagagtataaaccttcaactgttgcagcaactgcccttatctttgcatctcatgaactattcccacagcaatattctattctgagagcttcaattacagccagcgagtacctagatggggagacgttgtccaagtgctttgacttgatgcaagacatgatgagaatggaagcaaaggagttaatgatagatacaagctttttaagcacagaaactccagtgagtatgttggagagaaacactaaacgacaaagaatttag

SEQ ID NO: 36252 - DNA, 2505 bp, Glycine max
  Peptide Sequence Number=SeqID_153030
atggcaccgtataatatgtcagatagatctctaatttgctacacgccactcatgacaacaacaaatggtttatggcaaggcgataaccctttagattactcccttcctctcttcatcttgcaattaacgatggttgtttgtgccacacgtttctttgttttcatcctcaagccccttcaccaaccgcgtgtaattgctgaaattttgggtggattgctattgggtccatcaatatttggtagaaatctaaaatttgccaatgccgtgttccctctgaagagtgtgatggtgctggagacaatggcaaacatgggtctcatatacttcgtcttcttggtggggttagagatggacatttcgatcatcaaacgcaccggaaaaaagacggtgtccatagcctttgctggtatgatattgccctttttgattgcggtttgtgtctcccatttaatagaagacaaagacaatagcatgaaccaagccagctatgtgctctacattggtattgttctatctgtcactgctttcccggtgcttgctcgcatgcttgctgatctcaaactcatcagcacagacttagggaagcttgctctctcaatttctctgatcaacgatgtgtttgcatggatattgcttgctctagctattgctttatcagaggcaaatactggcacatgggcctctgtcttggttgtaatatcaaaccttgtttttgtttccttctgctttgttattgttagaccagcagtgtcttggttgatagagagaaccccagagggaaaacccttcagtgagttccaattatgcattgtacttactggtgttatgatctcagccttcattacagatgtccttggaacacattgtgcttttggagcttttgtgtatggcctagttattccaaatggcccacttggagctgctatactagaaaagcttgaagactttgtttccgggcttttgcttcctctcttttatgccatttgtgggcttaagactgatatcaagttgatcagtggagctagtacatggacttttgtactcacggtgattcctctcacttgtttaggcaagattttggggactttctttatttcactcattttccagataccaaaccgtgatggagttgttcttggtttactcatgaactctaaaggccttattgaaatgattgtgctaaatgttgggagggaacaaaaggtcttaggagataaaatattctcagttatggtaattgtaacactcgtaatgacagcagtcgtttcacccattgtaacattaatttacaagccaagaaaaaggctcataccttataaaaggagaacaatacagaattcaagacttgatgcagagttacgggtgctggtgtgtattcacacccctagaaatgtccccacactagttaatctccttgaagcaactcatccccacaaaaggtctcccatatgtgcttatgtgctccacttagttgaactcactggtagagcttctgccatgctcgttgtccatgctaatagacaatcaggaggtccagccctcaacaaaacacaagcacaaactgaccacatcatcactgcatttcagaactttgaggaacatgttggtcatactcaagtccaacccttaacagctatttccccttactctaccatgcatgaagacatatgcaatctagctgaggataaaagggtatccctaatcatcattcctttccataagcaacaaacagttgatggagaaatgcatgacactattccagcattcagaatgattaaccacaatctattacaaaattcaccttgctcagttgggatacttgtggatagaggccttaacggatctaaccgcttgatcggaaatctagcatctcataaggtggctgtattatatttcggagggccagatgatagagaggcactagcttatggatggagaatgtcaaggcatccaagggttcaccttactgtcatgcatttcactccaagcaagcatccaactcaaactccggaaacagatcacttgtgggctaatattgatcgaagtttcaccattataaaaaatgggagggaacacacactagatgaggagtatataagtgagttcaaaaagatgattacaaatgatgattcagttgtttacatagacaaggttgtgaataatggggaggaaaccgttgcagcaataagatcaataaacaatgtcaatgacttgttcatagttgggagagggcaaggtacaatgtcaccactaacagatggcctaacagattggagtgagtgtcctgagttaggagccattggggatttgctagcttcttcagactttgaaacaacagcttcagtgttggtgatgcatcaatatgttgggcaaggcccagatggggaggaaaattttgtggttgaaagaccatggcaaacaagtgaacactaccataacatgaaacaacaacaaaacatgcaaagatatacaatgccaatgggaatggggcagtctcttttataa

SEQ ID NO: 36253 - DNA, 435 bp, Glycine max
  Peptide Sequence Number=SeqID_153031
atggtcaggacctgttcgaatcggaaagagagaagagtctttggaaagggattcccaggttcaaggaagtatttacgaagtacaaggctaggacaagaaagagggcttcgagtcactgggcgattcaagctggcgaatggtcgagtcgaagtcatcaagctgacgtatggtcgagtcgaagttcaagacagcaagatttctggacttagcacaatttctgaccaaactccacaaaatcagcttcgacttcgagcaatatggataaccgttctaaggagcagttatgtgcatatccttatatactcaaagtacccagcgcagagagaaacgagtactcaaggagaattgagtgtttgttgcaacgatgaacattcaaaagctttacatttaaacgcaaaatacacaagtgacatgctcctgagattcactagttga

SEQ ID NO: 36254 - DNA, 132 bp, Glycine max
  Peptide Sequence Number=SeqID_153032
atggctcttcatcttctgaattctatccctagtatctgcagtgcatatttcattccaagctctcatcaagtttcatggctaagagatgaatgtaatggaggctggaacacagggtatgccattctcaactag

SEQ ID NO: 36255 - DNA, 324 bp, Glycine max
  Peptide Sequence Number=SeqID_153033
atggcgtttagctgtgcggttgagaaaccattgcattcaatgaattggatgattttaacgcggcgccaaggagcatttttgtgcttctggttgtctgtgctttttgtggtagtagacttttgctatggtgaccatagtacagtcgaggtagtagggttgggagaatgcgcagattgcaaggagaaaaacattcaaactagccaggctttctcaggtttacgtgtgacagtagactgcaaggcagcaagtggaaactttgaaaggagaggggtcggtgagcttgatgaatatggaaacttcaaagtttcccttcctcatgacact

SEQ ID NO: 36256 - DNA, 303 bp, Glycine max
  Peptide Sequence Number=SeqID_153034
atgcctcagaggcactcgaagaacaacaacgatctcgcgttcttcacgtacgacgagaagcggaaactaggttatggtacccagaaggagaggttgggaaaggactccattaagcccttcgatgcttgctctctctgcctcaaatccctaatcgaccctatgagctgccagaagggccatctcttttgcaaagagtgcattctccagtgcctcttgtctcagaagaaagacattcaaaggttatggaatctggccggtttcccgatgcctggtggtggcaatagctccactttttttaagtaa

SEQ ID NO: 36257 - DNA, 324 bp, Glycine max
  Peptide Sequence Number=SeqID_153035
atgtcaccatgcaagcgagtcaaatccgctcactacaaattcatgccaagtgaagcacagagtcttgctccattggcgcgttggaccaaaccagcagagaacatgcttaaatacagtgtagatgatgcttcatgcttcgctattcaacaccagcaatctcattggcacgggtttagtcctcaggaactcaaatggtggttttgtctctcagctttaaccactacccaagctggtactactcatgcaccagaagtagaagcttctacaatgttagttgtgattgattgggcgatagaaaaaggacccagtaatatcggagtgtag

SEQ ID NO: 36258 - DNA, 138 bp, Glycine max
  Peptide Sequence Number=SeqID_153036
atggctgataccagttccgtcgacgcgtctctgtggtgggactcattcactgtcctcttctctgagcttgagaattcctctctgacctcagatctccccccgaatttggtacactttcaacaatctccgtttgccttc

SEQ ID NO: 36259 - DNA, 468 bp, Glycine max
  Peptide Sequence Number=SeqID_153037
atgcagagtaaagaagcagttgtggaagatggggaaataaagagtgtgactgctgtagggtctgaaattgatgggtggaccaattttggggatgatgacataatgcaacagcagtatacaattcaggctgaggaagccaagaaggaaccactgagtagcttagctgctgaatataaattaggcagtcctatcttgctggagaaaataaaggtgcttgatgagcaatatgctgccattcgtcgtactcggggagatggaaactgcttctttcgaagctttatgttttcatatcttgagcatattatggaatgtcaagaccaagcagaaattgatcgtatccaagccaatgttgaaaaaagtagaaaggcgctgcagaccttgggttatgcagacttgacttttgaagatttttttgcgggatattgcactgtgtacgaactaatctctcctaaacattgtggtagttga

SEQ ID NO: 36260 - DNA, 249 bp, Glycine max
  Peptide Sequence Number=SeqID_153038
gggcaactgtcataccctaatttcgtccggggaccatccgttgttgggatgcgaccctcatttgaccacttcgaggatgttcctccagaaggcggttgcttctggaggaagcaacctagctcgcctgggcgagctggaaaatccaatccgaggtgcttccgtaacgtttccgtgggtgattttgcgaagattttcaaccgttcatcgacgttcttcgttcgttcttcgtcgttcttcgatcttcaaccg

SEQ ID NO: 36261 - DNA, 339 bp, Glycine max
  Peptide Sequence Number=SeqID_153039
atggcgttcttcagaagcgtttctgcactttctcgacttcgctctcgcgtggatctttattctgagttgaaggaactagttccagagtatcaggaacgtgttaagaagctgaagaaagatcatggaagtgttgaattgggaaaaattactgttgatatggtacttggtggaatgagaggaatgacagctttagtatggctaggctcagctgttgacccggatgagggaattcgctttaggggcatgtcaattcctgaatgccagaaaaagcttccaggtgcttttactggtggggagcctttacctgaggctgtactgtggcttctattgacaggaaag

SEQ ID NO: 36262 - DNA, 799 bp, Glycine max
  Peptide Sequence Number=SeqID_153040
atttgatgggaaagatttcttgacaaaacttaaggggaagcagatcatgtttataggagattcagtcagtctcaaccaatggcaatcacttatatgcttgcttcgttcttctgtgcctcaaactgaaatattagagcagggcgatgtgaacgtatctaactacacattccaggactatggagtttcggtgattatttttcattctacatatttggttgacattgaagaggaaaaaattggtcgagtattgaagcttgattcccttcagagtggaagcatatggaaagaaatggacattatggttttcaacacttggctttggtggtaccgcagagggcctaagcaaccatgggattatgttcaaattggtgacaagatactcaaagacatggatcgcatggaagcttttaaacttggtttgacaacatgggctaattgggtcaatgcagaggtagatacaaacaaaaccaaagttcttttccaaggaatttctccttcccattacaatggcacggggtggaatgagccaggagtgcgaaactgttccaaggagacgcagccaataagtggatcaacttaccctaatggattgccagcagcattatttgtattggaagatgtgctgaagaacataaccaaacctgttcacctgcttaacattacaactctgtcccagttgagaaaagatgcacatcctagttcttacaatggattcagaggcatggactgcactcattggtgtgtagcagggctgccagatacatggaatcagctgttgtatgcagcaatcactagttag

SEQ ID NO: 36263 - DNA, 666 bp, Glycine max
  Peptide Sequence Number=SeqID_153041
atggagtcatcagcagaaaagtatgctgcatttaaacagaaagttagtaggacagtgtacttggacaacatgtcaccacaagtcactgaatctgtgataagaactgctcttgaccagtttgcaactgtgaaaaatgtcaagtttattcccaactacatcggtccaagcaatcagccacagtgtgcattagtagaattagattctgccaaaaaggccaaggaaattttatcaatgatagcgggttatcctttcatgatgtctgggcagccacggcctgtgagggctcggcctgctgtgatggaaatgtttgatgatcaaccaataaagcctaacagaaagatcaagatccgttggttggagcctagtgatcctgattttgagctggcaaaggaagtaaagaatcttactcgcaaacatgctgcagaagtagaattccttgacaaacattctggtttgaacttatggcctcttgctaactatccaaactcttcagcactgctgctactagaagacgaagagaagctagcaaagcagcaggaagagacacttaaggtgcattacaaaaagtttaagatgatagagggcattatggctgacaaaactgctcatcgtttggcacgaaagtataatctacatgttgcagatgattgggctcgtttggattaa

SEQ ID NO: 36264 - DNA, 429 bp, Glycine max
  Peptide Sequence Number=SeqID_153042
atggcggaaccatcgaagaagcggaaaggatccacgagtcggagtcaacaacattctgggtcacaggaaacaccaattcctccctccattccctctggatcattgttctcatcagaggaacagcgtatacgtgaaggtgtgccttttgagggtgcactgattgatgattggaaattcaatttttctgtgcatgatgcccgccgattggtctgcaccaaccaagcggatatgaccggaaggcttcttggcggttcattggcttttgagagccgcatcctccattaccttattgttcgcatcttactccctagatcttcaaaccttgctcaggtttctgaagaagatctcattgtcatgtgggcctttcataaaggtttacaaattgattgggcacaccttgttagatatcgcatgcataaggcattgtga

SEQ ID NO: 36265 - DNA, 333 bp, Glycine max
  Peptide Sequence Number=SeqID_153043
atgaggatgcatccttggatttttggggtcatttgcctctgccaattgctctgtgtggtgactactggtggaggagggcatgttgagtccaatttcaaatggcagagatcagaagaaaaacatgaattgagttgcaacatgtacgaaggaaggtgggagttggatgattcttaccctctctatgactcttcaacctgccctcacattcgtaaggaatttgattgcttgaaatatggtcgtcctgatcaacaatacctcaaatacagatggcaacccaacgaatgcgacttaccaagttcatacgaggataaggacacagacatggagagatga

SEQ ID NO: 36266 - DNA, 660 bp, Glycine max
  Peptide Sequence Number=SeqID_153044
atgggttcctactgtgctgccagaagaactaatcgccaagcttcgttcagtggcaacaatgaatatgccacaagagcttttgcaacaacctcttgtgcttcattgtctgaagatcagccaaaggataatcctgtctctgatatgttagtagattcatttggaaggcttcacacttacttgagaatatctctaacagagaggtgcaatttaagatgtcagtattgtatgccagcagatggtgtggaactcactcctagtcctcaacttttaacaaagactgagattctgcgatgcgcaaatctgtttgtaagctctggggtaaataaaatacgtttgacgggtggggagccaactattagaaaagatattgaagacatatgtttggaattgtcaaacttgaagggattgaagacattgtccatgactaccaatggtattgccctggcaagaaaacttccaaagctgaaagaatgtgggcttaattctgtgaacattagtttagacactctggtaccggcgaagtttgagtttatgacgagacgcaaagggcatgaaaaagtaatggatgcaattaatgcttccatagaccttggatttaatccagttaaggtgcataacctctatggaaaatttcgtatgcctgtgatggatgcattttaa

SEQ ID NO: 36267 - DNA, 180 bp, Glycine max
  Peptide Sequence Number=SeqID_153045
atgccgtccttggacactgacaaaggcatttattgcgttgctcgaagtggcgttgctgccattaatggggaccttgcaaaaatcggtggctttgatgatggtgatgatgcatcagagattcttcatggtggtagcagcgatgcagtggatgggacgctcttagaacaaaggcatgcatga

SEQ ID NO: 36268 - DNA, 489 bp, Glycine max
  Peptide Sequence Number=SeqID_153046
atggtggcaagggcttcccaaatgcaagtagtaaacaagatagcttcaacttatgctacactaaaacaagaaaggagatgggtgtgtgatattttctctgtctctctcactctcactctttctttttctttctctcgcatacacatggacggtggtgaccaaatcaccaaaccccaatcccatcaaatgatcaagatcaaaataaagggagactgcgagacctccatcccgaagcagggaggttgtgcttacaaagctcctccatgccatgcctccgtcggaccccaacctcttcgccatgctcaaatccttgtggaggaaaatggacgcagcagcactgctgtagttcttagtgtcaaagcaaaaggagtcagcatcgctgcaagcggagatagtggcggcaatggaagaggcagtggaggagtttttaaagagcaaggtggtggagtttctggagatgtttgtggttgcagttattgtgcaaaatga

SEQ ID NO: 36269 - DNA, 2061 bp, Glycine max
  Peptide Sequence Number=SeqID_153047
atgggagaaaagtctgagaagccgcaacggttcaatggatttgctgttcctaatcagactctatccatgaatttctccattgtttcctttctctccactttgacaaggttggccagcttaagggttctcagcttggtgtccttggggatttgggggccacttcctgataagattcaccatttctcttcgcttcaagttttggacttgagctctaatttcatatttggagccatcccaccaaaaatatccacaatggtaaagcttcatgcattgacccttgatgacaattatttgaacaccactatgcctgattggtttgattccttgtctaatctaaatatcttgagtgtgaagagcaatggtataaagggtccattcccctcctcactgtgcaaaattaagacacttgaagtgatttccttgtcccacaatgagctggctggggaattacctgatctgggttctctcactggcctacatgttctggatttaagagaaaaccaattagaatctgaactaccattgttgcctaaatcagtggtcacagttctgcttagcaataactcattctcaggagaggtacctaagcagtttggtgaattagatcagcttcaacatctagatctgtcttcaaatcacctcagtaagacacccccatctaccttgttttctctgcccaaaataagttatttgaatctggcaagcaatgcactaagtggggccctcccagacaaacttagctgtgggagcaaacttgggtttgtggacatttctagtaacaagttaagtggtggacttccctcttgcttggcaaatacttctgatggtagagttgtcaggtatgctggaaactgtttatctgttgattctcagaaccagcatagagggtcttattgtagagaatctagctctggatggaagaacttgaagacatggaaagtagctgcagcaatggccatcattgttggacttgttcttgtggttatggtttcaggagtctttttatggaaaaaatatcattccagaaagataactgggcaggaagtgttgctaaaaattgttcatgataactccacaactggggtttcatcagagatccttgcaaatgccagattcatttctcaaacagtgaagctagggacacaaactacttcaacctgtcgacaattttcaatagaggaattgaaggaagccacaaaaaactttgacttgtcaacttatattggtcaaggtcaaggctccataggaaagctgttcaaaggtaaactagagaatggatcctacgcggcgatacgatctttggctctgtcaaagaaatgctcaattcaaaatcttagagctaaattggatttactctcaaaacttcaacatccaaatttggttagccttttgggccattgtattgatggtggtggacaagaagatcccaattcccacaagcttcatcttgtatatgagtatgtgccaaatgggaattatcgtacacatctgtcagaattttctgtagataaggcacttaagtggtctgatagattggcaattttaattggcgttgcaaaggcagtgcatttcttacatactggtgttatacctggctgttttagtaaccagctaaagacaaagaatgtcttacttgatgaacaccgcattccaaaactgagtgactatggcatgtccatcatcacagaagaaattgaaaaatctgaggcaaagagtgagaaaccaaaaccacgcccaaggaccaaagcggaggatgatgtttataattttggattcatattgtttgaatcacttgttggacccatagcatgcgacaaaggtgaaacattttttctaaatgaaaaggcatcctttggcagtcaagatggtcgaagaaagattgtggatcctattgtgttgaccacttgctctcaagagtcattatcaattgcaatctcaataacaaccaaatgcatatctccagaatcttcattccgtccctcttttgaggatgtcctatggaacttacagtatgcagctcaagtccaagccacagcagatgcagaccacaaatcagattaa

SEQ ID NO: 36270 - DNA, 975 bp, Glycine max
  Peptide Sequence Number=SeqID_153048
atgctgggttcacgtttctgcgtccgcacgttatccggcgtgggctctgccgcagcggatcacacgaatgtcgccaccaccgcccgctccgttccgtgctccgtcgccgtcgacttctcgccgctccacctctcaccgctccggtcccgccgccgcttccgctgccgcagatctatcctcatttcctgcaattcctctcgccgcagatccagctccgacaactctcacgacaacaacaacaaaaacgattatctcgaagcttctctccttctctcagaaacattctcccactatcatatgtggaagcatagatttcaaccggagtttcaatggaaatcgtctacaccgtcaattcctttgtccagaacggatagtagtttattgagacatggcttcttacagcgtttcaaaaatcctacgatttttctcaggatttcttgcgatggagactatattctgcccattgttgtagggcagattgctattgagaaacttatggatgcggaatctgaacaagaaagtgtggaatgtcctgaccagtaccagtttgtggaaaacctagttggaagactagaccatgaagtgataatggtgagaattacagagagagtagtcagcacttactttgccagattataccttagccagccagggaaaactgatcttatcagtgtggatgcacgtccctcagatgccattaatgttgcaaatagatgcaaggctccaatatatgtaagtaaagaaattgttttcacagatgctatcagaatcggttatggaatgggcggagcgcataataaaaaggctatttatgatgtattgctcgacagtgctatagatggtccagatttggtagctcaagaactaagtatgatgcataatatgcattcagctatcaaacaggaaagatttaaagatgcagctatatggcgagacaaacttgcaaatcttcgtaaatcaacccatgagctctaa

SEQ ID NO: 36271 - DNA, 462 bp, Glycine max
  Peptide Sequence Number=SeqID_153049
atgacaaagctacacacttgttatccaagctctgcatcttcaaagctaggaattgacaaagattcacatgtgatctcaaaaaccaagccaaagatcaggataattcatgtgtatgctccagaaatcattaaaactgatgctgcaaatttcaaagagttggttcaaaggctcacaggaaagccaaaagaagaagaagggagaggtaaaagcaagtccaaaactgcactaaccaaagacccaaaggattcacaccccaagaaggtcatggtcatgcaagatgatgagtttctgagtctgcaaaataggacaagggtaaagaatgaatataaagaggaggaaattcaagatgatatgtggaggtcaaagtcaaacgaaaagttcagtggtttccttgatgggttcttagaattggatggttttatggaagagttaagtactgtgccttcagagaatcaaaattaa

SEQ ID NO: 36272 - DNA, 312 bp, Glycine max
  Peptide Sequence Number=SeqID_153050
atgacaacaaggcccaagtcacctagacctcaacgtggtccttggaactttgacaaacatctgctgattcttagagtgatcaaagaaggagaaagccctgccaatgtcccactattcaatgttccttattgggtccaagttcatggcttacctattggttttatgtcccaatctattggccaaagtatagggcatgctgataaactttgtgaaaaattgtttgctaatggtgttaatgatggagttatcttgtggaatggagatctttggtcacaagcacgtgcaaacaccagcatgaggctcccaacttag

SEQ ID NO: 36273 - DNA, 561 bp, Glycine max
  Peptide Sequence Number=SeqID_153051
atgacatggaaaatcggtgatggatccctagctaatatttggagacaatcttggctgagatcaaagcataattcctttatttcttcgcagccaatgattgggaatgagcatgctactgtcaatgcccttattcactcaaactctttcctcgtggaagagattctacccattcctttactcaacaaggatgacactgatcaaatcatacggaaacaaagtcctaatggtagctacacagttcgtttagcatatcaccccactcatggattcaattgtagatatctcgagtttgaaggtccctggaaactggaagctcatctggaatttaaatattcatcccaagatcaaccacttcatttggcgttatcctttggagcatttggaactcaaggaacgacaaagtatggcaagaaaatgacaatccagctcaagtggtggtatctaacagtttgcaatacttcaacgattggaaggattcaagtgcaatgtcgaagcgactcttttcaaagaagatctttcttttggcgttggtatgattatccgcgatcatcaaggggatga

SEQ ID NO: 36274 - DNA, 738 bp, Glycine max
  Peptide Sequence Number=SeqID_153052
atgatgtgggttggagatttaaaagcagggggaagtacaccgtgggggaggaattgtaataataaaacgttagaaaaaaaatgtaacggagggagggagggagggggggcttggaagaaagagctgaatgtcaaaagagcccacgtgaccagcgggaacagtcttccatggatctgccttttccgatcacgaggttttagtgtctcaaacccaatatccgtatctctgcctctctgcctctgccactgccaccctcccaaggaaaatggaatagtttcccactccctcttactctcacgctccttttccttccctcctcaaccacgctctaatcccaatattactaaccatacactactctatactgggaagatatattttcaacagaacaatgaccactcctccaatgactcccactccgttagtcgttatagggcgtccaatccatcaaatctgcagccaacaacaacaacagccacaacaagcagttttttggctgccgtaccgtgcgaatcacgtgaatccaaaacaaaagccaagctcgtcatcatagtaacctcatgccccgaatccacacccattgcttttgcttatgccacaacagtagaagttgtagtggtcgaagagaagatccctcatattttgattgatttttggatcaccaccaaagggggagagagaaagctattcaaatggatactcagcaatcatcaaagcaaagcaatcttgctaagctaa

SEQ ID NO: 36275 - DNA, 144 bp, Glycine max
  Peptide Sequence Number=SeqID_153053
atgaagtcagggaaaaattgtagcaatgagtattggaagagaatgagggtacctttgtggaagaagaaaagattggagagagacttcatcatcatggagaatttgcagtcaatgagatttaaaaataaggaacttaaggattag

SEQ ID NO: 36276 - DNA, 234 bp, Glycine max
  Peptide Sequence Number=SeqID_153054
atggaaaacctacacatggatgaagatgcaagtctggaaataaactttaaaccacctgaagaactcaaagttgatctctctctttgtcttgtagggagatttttatccgacaagaacattcgaagccaaattatgaaagaatgcatgtcgttggtctggaaaccattcctaggaattaccatttctgagcttgaagcaggcatattccttttccaattctatcatgttagttga

SEQ ID NO: 36277 - DNA, 807 bp, Glycine max
  Peptide Sequence Number=SeqID_153055
atggagaaactaggagatttcccttttattggcaagaattctcacaaaggttcaaatctcggacaagcccattactatctcctgaggataggaatcatgaaaggtttcaatttcaggaaggtttgggcttccatgtcgaaatctcataatcctagcataccaccaacactttgccgacctatccaaaactactgcgagcctgctactaagggtaggaatgttgatgtgatccaaccacataacgatgagaagtcgatcactaatgttgatgttaatgacaagcacgtggagaagtcgactactttgattccttctaatcaaccccaagatgagaaagatgttcctcataatactttgtttgaaaagcaaagtgggggtatggtgatccgacatcatcaaggtcctccacgtaggattgatcatgtgattataactcacgatcttccttcgttatggaatgttgacattaagggatttgagttcattactactgatagattgcttacaaaggttgactcggagatgatggacttcgttagagctgacaatagcttagattataccaaagtctttctttacaagaaaattgtcaaagcccttaatgagaagaactcattaatgatcggaaaaattgagatcattaagggtattcaaaagaaaattgctaaccatgaaaagatggtttccatgaaggctgtagaaaatcaaaagcttgttaaggccattgaaagtcttaacaagaatttcaatgccacagttaaggatttagaagaaaccaagaatactgtcaaggccttaaatgattaa

SEQ ID NO: 36278 - DNA, 369 bp, Glycine max
  Peptide Sequence Number=SeqID_153056
atgaagacacttcctacaaaaactaatgaatgtccaacaaagatcatagtgagactgaaggaacaggtatggtacatcatatcagttactgaggagcattcccatatgcttagcccaacaaaatctcatatgttttgtcgtaatagaaagattaatatccatgttcagaaaagtcttcagatcaatgacgaagtaggtgtaaagttgaataagagttattggacatttgtgtgggaagtgagaggttatgaaaatcttttgtttatggagagagatgtaggaaactttgtgggtcaacaaagatgtgcactaggaaagaacggtgatggaaaaactctgttatcatactttgcacgcatgagggaatga

SEQ ID NO: 36279 - DNA, 1746 bp, Glycine max
  Peptide Sequence Number=SeqID_153057
atggctaagtcaaagaacaatgccaacaagttgtcctacatatcagttccatctcagatcatcaactccatatcatcttcttctctgcaatctcttcttgactctcccaagaagtcttcaaggaacaccaacagcaggttctttatcttcttcaccaacaccaacagcatcatcttcagaaaaccaaggatgtggttcctcacactctttctctttggtttccttggcatgctcaagtttggcctcacacttcacaccccgtttcccccctacccatgtgccaccacaacccttctgccacggaacatgatctcaaccaccccacattcaaagccaagccttggtgctgttgtgagagagaataatgaccaaaaaaaagatgaggttttgttggctcatgtggagctgagagcacagggattggagaaggtggaaggtgatgagggtgttgagaagagtgagttttgggagcagccagatgggttgggatacaagccttgcttgagtttcagcagggattacagaggagcaagtgaaagggttctgagggataggagaaagtacctgatggtggttgtttctggggggttgaatcagcagaggaatcagattgttgatgctgttgtcattgctaggattcttggagctgctttggttgttcctatattgcaagtcaatgtcatttggggtgatgaaagtgagtttggtgatatatttgacttgaagcacttcaagagagttcttgccaatgatgttcgagtagtttcagcattgccatcaacacatctaatgacaaaaccagtggagggtagtcctccccttcatgtcactcctagttggatccgttcaagatatctcagaagatcctggttgtctgtgcagttcaacagagaaggtgttttgctcttacgcagtttggattcaaggctgtcaaaggatctcccttctgatcttcaaaagcttagatgcaaggttgcttttaacgcgctacggttcgctcagccgattcaagaacttggtgacaggattgcagagagaatgcaaagcaagggaccttatcttgctcttcatctaagaatggaaaaggatgtgtgggtgaggactggatgcctccccggtttgagtcccgaatttgatgagattgttaacagtgagagggtacaacggccagaactcttgactgcaagatcaaatatgacttaccatgaaaggaagatggctggtctatgccccttgaatgctgtggaggttaccaggcttttgaaaggtctaggagctccaaagaatgcaagaatttattgggctggaggacaaccattgggtggaaaagaagccttgcttccattgatccaagactttccacatttttatagcaaggaagatcttgccttgccaggagaactacaaccatttgcaaataaggcttctataatggctgccatagattacataatctctgagaagagtgatgttttcatgccgtctcatggaggaaatatgggccatgcaattcagggtcatcgagcatttgctgggcacaaaaaatatataaccccaaacaagagacacatgctcccattttttcacaattcttccctctctgaagaagagttcaacaagattatcaaagagttgcaccaagactcgttggggcagccagaacttagaactatcaaagctgggagggatgttaccaagtttcctattcctgagtgcatgtgcaatgactcaaatgctcaatcctga

SEQ ID NO: 36280 - DNA, 1956 bp, Glycine max
  Peptide Sequence Number=SeqID_153058
atggcaaagtttcctgggtcagagatcatttctcaagccaaaaacaaagtgctgtgtaatagtactttggctggggcagaaaagcctattgggagtaaaaatggtcttggaaatgtaatccttcatccatcattgcagagaagaatagagcatcttgcacgtgcaacatcaaataccaaatcccatcaggcaccatttcgtaacatgcttttttatgggcctcctggcactggtaaaacgatggttgcaaaggaattagctagaagatcgggtttgcattatgccatgatgactggaggagatgttgcacctcttggcgcacaggctgttaccaaaattcatgatatatttgattgggccaagaaatcaagaaaaggcctattgctttttattgatgaggcggatgctttcctttgcgagcgtaacagctcccacatgagtgaagctcaacgaagtgctctaaatgcattgctcttcagaactggtgatcagtctagagacatagtacttgtcctggcgacaaacaggcctggtgatcttgatagtgcagttactgatcgcattgatgaagtaattgaattcccacttccaggagaggaagagcgtctaaagttgttgaagctctatttgaacaaatatttatgtgatgacaataatggctccaaggggggtttcttcctgaagaagcaacctcagaagattaccataaaagatttatctgaagatgttttcagagaggctgccaagaaaacagagggattttctggccgcgagatcgccaaactcatggccagcgtccaagctgctgtttatgggcgcccagactgcatcttggatgcccagttgtttagagaaattgtagattacaaggtcgtggaacatcatcaacgattaaaactagcagctgaaggatacttcggctttattaattattactttgttaggaatataggaggaggggctttagcctttaattacttggaagcagcatatcagaaccttttcacctcatcctatagagcaagaagccagggtggagcaaaacccgttaaagccatcaagattggtcgtgaagcgggtcatgcgggtgcgcctccacgccccttcaacacgtgtccaaaagctagggcgccttggggtgatgatgtagttgaagatggagaggaggccaaacattttgcagcaaaagccgtgcatgatgtcgaggaagagacccgctcttgggctgattgggctcaagacaagttctccaaaagtttcggggccgaagaggatcatgaaaaacaagcgactcaaaacatgaagtatcaagctgaagatgctgcttcaagggccacggagagagtgaaatctgcagcatcaggagcctcggactatgcttctcaaaaggctacggatgctaaggaagcagtttcaggtgctaaggtcatcaaaatgccaacagatagcattaacaatgcaaaacacacaatgggagatacctacgaggatgctaagcaaaaaatgaacacagcttcagataaggcttcaagtatggctcacaatgccaaagataacacggctgagtccatggaatatggaaaagatatagcagccaatgcctatgaccagggtaagcaaaaaataaacattgcttcagatacagcatcagagaaattctatgatgccaaggacaaggcaagtgatgttaggcataaagtgaaaggagccatgggttgtggaggagataaggccaataatgatgctaaaaataacatgggcgtgaaaatggaacatggaagggacaaagtagccgaaacttttgaccaggctaaacgtgaagtgggtgaagcatatgtatcagcaaagaataccatgactgaagaggccaaagctaagtacgaggctgcaaaggagaaggcttcggatgcaacaggtgatttaggagctaagatgaggaacaccccaaacgtataa

SEQ ID NO: 36281 - DNA, 261 bp, Glycine max
  Peptide Sequence Number=SeqID_153059
atggaggtggcgtttcggtttttgcaccttcatcatgagtttgtaactcttgaggttgtcattgatggtgagaagtcaaaaggtccaaaaacttcttttggtgctgatgttgttgttgacgacgtcgtcgacatcaacaacaacaccgctctggttgaccataacatgggggattcttcagttgatgtctttgagccattattggatgaggctattggaggtggtgatggaggggtgatattatggggtcttcccttataa

SEQ ID NO: 36282 - DNA, 603 bp, Glycine max
  Peptide Sequence Number=SeqID_153060
atggatttttttatggttgacttgtggcaggaggagatacatgagcttcttttgagttttgcagaagctggggcaactgttgtgagacttaaagggggtgatccattggtgtttgggaggggtggggaagaaatggattttttgcaacagcaaggtatccaagtgaaagttattccaggtataactgctgcttctggaatagcagctgagctgggaattccattaacacaccgtggcattgcaaatagtgtgagattcctcacagggcattcaaggaaaggaggatctgatcctctctttgtatcagaaaatgctgctgatcctgattctaccttggtggtttatatgggcttgtcgaccttcccttcacttgcgcagaagttaatgctcaatggtctgtcccctcagaccccagctgctgccatcgagcgagggaccacacttcagcagcgcacagtatttgctgaactaaaggaccttcatgagaaaattacatctactcagctgaacttctgccctgcttttggggtatctattggagtggttggcttgggaactgattcagaaccaattttgatttttcatgttacagattgggagtaa

SEQ ID NO: 36283 - DNA, 1284 bp, Glycine max
  Peptide Sequence Number=SeqID_153061
atggggttacggattactccgcagacgatgagaactcatatgtacaaaatgaaatggaggagcagcaagttccaacctcagagcagtagacaagggggtaccaacatagaaggacccatggtgtctgaggaactacttggtagaggaaaaagggttaaacaaccttctgttcatttgaaggactttgtgactcgtaccattcgaataagcccctcagcaagttcatcgttccagtcaaaatcctcaggtacaccctatcctatagcacattatgtgaattatgataaattttttgtacaacaccagtcttttctagcagctgttaccatagggtatgaacctaacacgtatgttgaggctgtaaaagatgaatgttggagagaggcgatgtgcaaggagatacaagcccttgaggacaatggaacatggacaatagaagacttgcctctcgggaagaaagcaatcagaagcaaatgggcatacaagattaaatataattctgatggaagcatcgagagatgcaaggtgcgcttggtaattcttggaaacaaacaagttgaaggtatagattataatgataccttcgcgccaacaacaaagatggtcattgtacgaacatttcttgctgttgtaattgcagaaagatgggagttgcatcaaatggatgtgcataatgccttcctacatggtgagttggatgaagaggtgtatatgaagttgccacctggttttgcttccccaacaccaggtaaggcacccagatgttggtttgccaagttggcagcagcgctgaacaagtatggatttcaacaatcgtattctgattactcactgtttacttataaaaatcggcatcttcaactccacgttcttgtctatgttgatgatctgattatatctggcaatgatggggtggctgtgcaaaggttcaaagattatttgagtcaatgttttcatatgaaggatttaggaaaactaaaatacttcttggggattgaagtggcacaaaactcgaagatgcttggtagggagcctgatttacttgacgcttactcagcccaaactgtcttattgtgtgcatatacttgcacagttcatgcaacagtcgaaataagaacattgggagccagctttgagggtcattcgatatttgaagggaaatccaggacaagcttgcagacatctttacaaaggctttgggaacacaacaatttgactttctcctttgcaagttgggcattcaggatcctcatgcttcaccttgaggggggtattgaagattga

SEQ ID NO: 36284 - DNA, 813 bp, Glycine max
  Peptide Sequence Number=SeqID_153062
cctggtcctcgtgattctccaatacagtgttttatcaggaggaacagagaaacttcaacatatctgttgtacattggcctggtaccatcggagaacgagactgataagttgttattagctgcaaaaaagttcactatttatgacagccaacccccacatggagctgcaattcaaccagatagtcagcctagtaggagatttcattcaaagcaggtatctcctagagttccagcatgtaactatgttgttagcaccattgcctatgagttgaatgttctccgtgcaagagggccaaggagaatgcactgcaccatgaactccatacctgtctcagctgttcaagcagggggcaatgctccaactcctacttttcctgaaatcattgatgagcctttttctccctcaccagcactgaaaggaaagggtccaattagagatttagacaatgcaagcctcccagagctactaccagtagagagccaaggctcagctgagcctcttgtacttaaaaataaggctcctagatggcatgagcagctgcaatgctggtgcctaaacttcaagggtcgtgttacagtggcttctgttaaaaactttcaacttgtgtctgctgttgatccatctcataatgtttctgctgcagagcaagaaaagcctgtgaatgagaccaatggcactggatcatctgctggagcaccatcgataccaaaccagcctgtgaatgagaccaatggcactggatcgtctgctggtttgtatcatatatataatatgctaggcacagttaatcaggcctggtgggcatgcaactga

SEQ ID NO: 36285 - DNA, 2199 bp, Glycine max
  Peptide Sequence Number=SeqID_153063
atggtaactgatattggtgaaggggaagagttacaaaatccccgctcctttaaggtgcatagtaaaatctgcacagaactcacagaattagtggatagaatctcaagaatagttccagacatagaggcggcacggccaggatactcttcaggaatagagtctctatgtttgctgaacaatgcaattgataaagtcaaactacttctgcaacattgctccgaatgtagcaaattctacctggctatgacaggagatacagtactctcaagatgcctaaaggcaacaagatcattagagaaaagcttaatccaaattcaagatatggttcctgttatgttggctgtagaggtttctagaataattcatgatctagaatgtacaagacttgttctggaccctaatgaagaaaaggctgggagggttgtgagagagttgcttactttaacctcagattcagctgatgattctgaagttaaagctcttcagtttgcagcatctacactgaatataacatccccaaaggccatcttaatagagcaacgatctattaagaagttgttagataaacttggacccaatgacctcccaaagaagaagatactgagatatcttctgtatctactgaaaaagcatggaaagctcatggtgggggaacatgtggaggaggtctattctcgttctgaggaacaagctgcaacagagaactcgaatcacgattccctacgaagccatcatgttgattcagacacaatcttgaagtatggtcagtataaaactcacaccaatgagttaagtggagttgcaccacttgaggaatataagtgcccaatatcctcaaggttgatgtatgatcctgttatcattgattcaggagtaacatatgaaagaatgtggataaaaaagtggtttgatgagggtaatgacatatgtcccaaaaccagaaagaaactagtccatatgggattaactccaaacatggccatgaaagacttaatatcaaagtggtgcagaaataatggagtctccattccagaccctagtaggcatgcagaagatatttgtgcatgggaagcttcaaacacttccattagcagcttaggaagttatttcaatgatttcaccgcaccagtggatcttagtagcatgtcaattgggccattggatactagtttcagtttagatgcctcacatggtaagaccactcgtggctcaaatttgatgcagaccaagagccgtgacaattctcacaaacatcaggctcatacagagatacatgatactgatttgatgctcttgcctcaactctgtgatcttcaatgggattctcaatgcaaggtcattcaagatttgaaagataatttgaaaagcaatagccaagcttttgtttctgtatcagcagagaatttcatcgaaccactcgtcagaaatggtacgactaatttgaatgaagatactttcattatgttggcaagttttctcaattcagatgtgattggagaaactcttgccataatggaagaactgtcaggatatgggtttagtaaagctaaaattgcagcatccagtgctctcagttctattctaaacatgcttgattctgaaaacaaaggtttccaacagcaagctattagaataatgtacaacttgtccttcagtggtgaagtttgtccccgcatgctatctctcaggtgcatcccaaaattgctgccattttttaaagacagaacccttttgagatactgtatatatatattgaaaaatctttgtgacactgaagagggtaggaaatctgtttctgaaacaaagggatgcttatcttctgttgctgaaatacttgatacaggcaataacgaggaacaagaacatgcgctggctgttctagtctctctatgttctcaacatgtggattattgtaagttggtaatgcgtgaggatgagcatatcataagtcttcttatctatatctcacagaatggaaatgacagaggaaaaggaagtgcattggaattgcttcatcttttgaaagatattgacattgctgagaatgaaggttgtcctgagccaaatatcaacaactcttctcgagattctaacagttaccaccctgaagaaaatcaaccatcaaagaaatccacgtttctgaagaaactatcaccgttctcaaagtccagttcacatgcatcaaaaaccaaaagatga

SEQ ID NO: 36286 - DNA, 225 bp, Glycine max
  Peptide Sequence Number=SeqID_153064
atgacaaatttaattcttaacaacatatccaaatttcatgaaaatccaacggttaacgaaaccggaatcgtaattttactgagaccattttgggtttttgcgagaaaggaaaaggctacaatacgaaaggttaggtggcctgcgggaaaaatagagggttttgggagaagagagaagaacgaaattgtgaggcagaggaggctgaggagtcagtctgaaaactga

SEQ ID NO: 36287 - DNA, 642 bp, Glycine max
  Peptide Sequence Number=SeqID_153065
atggcatatgcaagtagtacatctttgggagtgcgacttactgagggagaggggaatttgcccaagcttgtgctcacttccccggccggtagtgaggctgagatatacctgtttggaggtttcattacttcttggaaagttcccagtggtaaggacctcctctttgttcgccccgacgctgttttcaatgggaacaaaccgataagtggtggtgttccgcattgttttccacagtttggtcctggtccaattcagcaggatggtccttatagttgtactgtgtgggatttcagcttccatgctttattcaaggcttctgtgagtaatgcatcagtaaaggggttgaaaggttgcaaaactctgaacaaagatccagatcctaaaaatccagtggaagttgtcactttccctggatttgtagattgtgcttatcttgatgcttccagtgagttgcaacttgacaatggtttgggtgatctgatatctatcaagaacacagtatatgctgtgttgtggaatccttaccttcaaatggaagcatgctacaaagattttgtttgcgttgaaaatgctaagattggaagtgtccagctagagccagaacaaacttggacagctgtgcagcatcttagcatagcttga

SEQ ID NO: 36288 - DNA, 1695 bp, Glycine max
  Peptide Sequence Number=SeqID_153066
atggctgctggcgtgggtttccgcagtcacaaatctttgttaataattcttttgggttttcttggcttgttctcctttacagttgaagcagacacaaagaaataccaatttgatattcaagtaaagaatgtgagtagactatgtcatgcaaaacccattgtaacagtaaatgggaggttcccagggccaacgatttatgtgagagaaggagacagagtactagtcaacgtaaccaaccatgcaaaatataacatgtcaattcactggcatggaattaaacaatatcgcaatggttgggctgatggaccagcttacatcacacaatgtccaatccagactggtaatagctacacttatgacttcaacgtcacagggcaacgaggaacattgtggtggcatgctcatattttttggttgagggcaactgtgtatggtgcaattgttatcatgcctaaacctgggaccccatttcctttcccacagccagccagagaattggaaattcttctaggagaatggtggcacaaagacgtggaagagattgaaacgcaaggaaatcaaatggggttgccaccaaatatgtcagatgcacatacaatcaatgggaagccaggaccgctatttccttgctcagagaaacatacctttgcaatggaggttgaacaagggaagacttacctacttagaatcatcaacgctgccctcgatgacgagcttttcttcgccattgccggtcacaacttgacagtggtggaggttgatgcagtttacacaaaaccattcaccactcaagccattctaatcgcacctggtcaaaccacaaatgttcttgtcaaggccaaccaagtagcaggaagatacttcatggctacaaggacctttatggatgcaccaataccagttgatagcaacgccgcaacagctatattccaatacaaaggcattccaaacactgtccttccttctcttccttctcttcctgctgccaatgacacacgctttgctttgagttacaacaagaaattaagaagcctaaacactcctcggtaccctgctaatgttccactaaaagttgatcgaaacctcttttacaccatcggtttggccaagaattcttgccccacgtgcgtcaatggaagccggctacttgcttccttaaacaatgtctcctttgtgatgcctcaaaccgcgcttctccaagctcactacttcaatatcaagggggtttacagaactgattttcctgataagccttcaactgcttttaactatacaggtgcaccattaactgctaatcttggtacttcaattggcacaagaattagcaaggttccctttaattctacagtggagctagttttgcaagacaccaacctcctcactgttgagtcccaccctttccatcttcatggctataacttctttgttgttggaactgggattggcaattttgatcctgctaaagaccctgctaagtacaacttggttgatcctattgagaggaacactgttggggttcccaccggtggttggaccgcaattcgtttcagggctgataacccaggtgtttggttcatgcattgccatttggagctgcacacaggttggggattgaaaacggcttttcttgtggaagatggaccaggacaagatcaatctgttgtgcctccaccgaaggaccttccagcatgctag

SEQ ID NO: 36289 - DNA, 1224 bp, Glycine max
  Peptide Sequence Number=SeqID_153067
atggcggctatgcttctgctccttccgccaaacacaaagcagaccaaggctttgctggagagatgttcaaatgtaaaagaactgatgcagatttatggtcaattgttgaaaaaaggcaccatcaggaaccagttaacagtaagcacgctcttggcctcatacgcaagaatagagttgggtaacttagcctatactcctatggttttcgacagcataagctcacctaatactgtcatatggaacaccatgattagagcatatactcaaatagtaatgacccagaagcagcgctgcttttgtaccatcaaatgcttaacaactcagtacctgacaattcttacactttcccttttcttctcaaagcatgttctgctctctcagcctttgaagtctatgccacaaactctctccttcgcgtttatgcaatttcaggcaacatccaatctgcacatggtcctattcaatcagcttcccacgcgagatattgtttcttggaacagaatgattgatgggacaggcatgcacaaagaagccctgtctcttctacagcaaatgctagttgcaggcatcaaacctgatagtataaccctgagttgttctctttcagcatgtgccggccttgacatgtatgttaaatgtggtgaaatggaaaaggccctactagtgttcagtaagttggagaagaaatgtgccagtgcttggacggcattaattggtggctttgcaatcaatggaaagggactaactgaagaagggaagtccctgtttgagagcatgagctctgtttataatattaaaccttctatggaacattatggatgcatggtggaccttatgggcggcgcagggttgttgaaagaagcaagggagttcgtagagtccatgcccgtcaagccaaatgcagcaatatggggagcactgctcaatgcttgccaactgcacaaatattttgagcttggtaaagagactggcaaaattcagattgaattggaccctgatcatagtggtcggtatattcatttggcaagcatttatgctgctgctagagaatggaaccaagtgaccagagtgagaagccagatcaaacataggggactgctaaattatccaggatgcagtagcatcaccctgaatggggttgtccacgagttctttgctggggctggatcccacccacatatccaagagatatataacatgcctaatcttcttacaaacagatga

SEQ ID NO: 36290 - DNA, 756 bp, Glycine max
  Peptide Sequence Number=SeqID_153068
atggatgagcaccgtgatgtgtttccgagatggcagccagggtgccgttggatccccataggtgtgagaatcgacgcatacgagcccacacctgtttctgctcttccttcccacatcctcagtgttcacgccggacactaccactccctctgggcctggggcagaaacaaccaggcccaacttgcccgcggcccatcctctagagaatcatggcatgagccagaaagagtgaagggattagagactctgaatgtaagacttcacctcacacttgtatttcaatccttattggtcttccattgtatccgtcttggagatgatggttccgtgtcgcgtttggatgggggcatgctcttgctcgtactgcggatggcaagttgtttggatggaggctattcagcggacgacatctccgttggaatccgagtctccaaatatctcacagctctcgcggaccttgaagctgctgaaaagagagtcttgcaaggaatggagcaggagaataacatgccaatagtatgggagccccgcttggtcgaagaattacacggtgttcatgttctggacattgcgtgtggccttgatcactctctgattctttgccgtgatggtgtgctcttgagctgtgggagcaacgtgtatggccagttggggcgagctaaaacagatttgggaattttccccgttgaaatgagcttcagtcccgtttttatagcaagggctcggacattcattggcaatatgcgaactcggtga

SEQ ID NO: 36291 - DNA, 1689 bp, Glycine max
  Peptide Sequence Number=SeqID_153069
atggcaagcttggggtgttccatgtctgtcttaacgtttctcttcttcatctttgttggcttaatgtcttcttcatctgaagctgccataaagagataccagtttgatattcaagtgacgaatgtgagtagactatgccatgcaaagcctattgtaacagtaaatgggaggttcccagggccaactatatatgttagggaaggagatagagtgatgatcaatgtcaccaatcatgtacaatacaacatgtcgattcactggcatggacttaaacaatatcgtaatggttgggcggatggaccagcttatatcacacagtgcccaatacagacaggaggcagttatacttatgatttcaatgttactgagcagagaggaacactatggtggcatgcacacattctttggctgagggccactgtgtatggtgcaatagtaattatgcctaaagctggaacaccatttcctttcccacagccagctagagaatttgaaattctcctaggtgaatggtggaacaacgacgtggaagagattgaaaatcaagggaacaaaatggggttgccaccaaatatgtcagatgcacatacgatcaatgggaagccaggaccactattcccatgttctgagaagcacacatttgcaatggaggtagaacaagggaagacttacctcctgagaatcatcaatgctgccctgaatgacgaacttttctttgccattgcccatcacaatttgacagtagtggaggttgatgctgtttatacgaaaccattcaccactcgggctatactaattgcacctggtcaaaccacaaacgttctggtccaagccaaccaagttgctggtagatacttcatggccaccaaggcttttatggatgctccaatcccagttgacaacaaaactgccacagctatactccaatacaaaggcatcccaaacactgtcctccccgtccttccacagttgccggctagaaacgacacacgttttgctttgagttacaacaagaaattaaggagcctaaactctactcaataccctgctaatgttcctctcaaagttgacagaaacctcttctacactattggtttaggccagaatgcttgccccacatgcctaaatggaacccggctcgttgcttcattaaacaatgtatcttttgtgatgccccaaactgcacttctccaagctcactacttcagtatcaggggggttttcaggactgattttcctgaccgccctccatcccctttcaactttactggtgcgcccctaactgccaatcttgccactttaactggcactagagttagcaagattgctttcaattccacagtggagctagttttgcaggataccaatctcctctctgttgagtcacatccattccatcttcatggctataacttttttgttgttggaaccgggattggtaactttgatccagctaaagaccctgctaagtacaacttggtagatcctattgagaggaacacagttggggttcctaccggtggttggactgcaattcgttttcgggcagataatccaggtgtttggtttatgcattgtcatttggaggtgcatactggttgggggttgaaaacggcttttgttgtggaaaatggacaaggacaagatcaatctgttctgcctccaccaaaggaccttccgacttgctag

SEQ ID NO: 36292 - DNA, 876 bp, Glycine max
  Peptide Sequence Number=SeqID_153070
atgaatgatttgatgacaaagtcgttcctaagttatgtggaactgaagaaacaggctcggaaggaccttgaagacgacgatcttgacattgaagcagggaaactcaaccccacggaagaccgcagcctctctcagttcttccaagaagttgaagcaatcaagtttgaaatggaagagatcaccaatctcttatttgatcttcagcaactgaatgaagagacaaagtgcacccacggtgccaaagttctccgcggcctaagggacaggatggagtcagacatggttgccgtgcttcgcaaggcactgatcatcaaggcaatgctcgaggttcttgaccaatccaacatagacaatcgtagtttgtcagaatcctacaaagaagggagccccattgacaggaccagaatgtctgtcacaaatggtttgagggtcaagcttagggacatgatgaatgactttcagtccttgagggacaagattctatctgaacacaaggaagatttgaagagaaggtactataccacgaccggtgaggttcctactgaagaggtgatggagaagatggtttctgggagtcttaaagttgagtttttggctggaaaaacggatgctgatttgggcactcaggttaggcacgaggcattgatggatatccagaggagtttgaataagcttcaccaggtttttcttgatatggctattctggttgagacacagggtgaaaagttggataacattgaggataatgtggttaatgctgatgaagaagaagaacagaaagtggttgtgttgggtttttgctgtggggctgatcatactactcgtatgcatcgttgcaatgttgtcttcttgactggagcaatttgtaaggagtga

SEQ ID NO: 36293 - DNA, 1349 bp, Glycine max
  Peptide Sequence Number=SeqID_153071
cagcaatgccagcccagaagcgctctctgcccgagtcactcgacgaaggggacacttcgcagcagaacctcttccattctcgacatgcgaagcaacaacaacaacaaccagaccagccgcaggaacacgacgaggaaaaccacgaggatgagaacgaagaagaagaagaagaaggagatgaagaagaaggagaagaagaagaagaagaggaggaggaggaggaggaggaggaagaagaagaagtagaagaagcggcgcaaaatgacaacaacgacgaggaaaaaccacaggattccgacgatatcccatcttctggctctgaagaaaaacccgagaacaatgaatgccctgcttgtcgcacacattgcgccagtcgtcgttccttgagagacgatccaaattatgatgccctaatttctgctttatatccagatattgagaagtacgaagaagaggagcttgaatttcgtgaagaggagaagaaccgcaataagcagattcaagcttcaatagcaaaagtagttcaacggcaatctgaagcattggttaagagacgtaaagatacaccaggtacatttgtaacaagatcacagcgtaatcaacgaaataggagacaaactcaagcaattgaaggatctgaagataatgaggaggaaaatgacaataatgaaaagaactcatcttcagatgatgaacggagtacagaacaccggcagagaaggcgaaagagatgggccagagttcgctcctctcaaccctcatcttccatgacaagtcctgatggtggatgcaatgatagtgatatggatataagtagagaaaatcgtggaatttcttcaaggcaggtatcaaaacatggaaagcttacttggggaaggggtggatttagaagtaacactcggcatggtagtggtggcagtagcaatagcaaaagttctcgcagtagtcgattatctaagtttgttgatcatctccgcaacttggatgaaaacactgatgagtttgatgtccatctcatgcttgtttctcttgaccaacaaagtacatcaagtttgcagcaaccttacctttgctgtcgaccaactttgtctgtcaggcacctttacgaacacgttgctcgtcagacacatttgccagttgaaggaattgagatactggcagtcaaaggatgctgcagtacaaaccgtgacaagtcaaccaatgagaattcagacctggcatacgatgagctatcaacgctggttatagatccacacaaagatgaactggaaattttgcaaggacatgagactctgtcagggcttagatccaaatgcatatctaagatgggacatttggtgagtgttaag

SEQ ID NO: 36294 - DNA, 4218 bp, Glycine max
  Peptide Sequence Number=SeqID_153072
atggcgcatgctcggcaacagaacgaggctggcttcacgctctccagcaagatcaacaacaatggtagtaagagcatatacgacgacgtttacggaggtccacccaagttcggcgtttcgagcctctcccctcgtttcgaagactacggtgagatttttggaagcttccacaccccacgcgcctcttccattccgctcctcgatcttcccgccgtccacgacgccgatgccttcttcgatccccgaagccaggctttcaactacaccgaagttttcggcgctttagattttgcagttccgtacgagaatttgtttcgccaccacactgctctcgacggtgcctccgaagaagaagcctggagtcttgcagaaacggactcattctctggagagtcagatcaatctgcaaacaatcaaagcatgtcgaatggatatcttttccattctgttgacggtaatgcagggttcaatgttttgtatcataataaggccaatggtacaagcaatgaatgtaagtcaaaggggaaaactcacatgactcggctgcatgctgttcctggtttcagtcgagtatatgatgaaaccactcaattgcatcagactgatccatcctttcaggatgctgacgttattgatgttgatatggaatttagtgcagacaaagtggagggaaaccgcccaaggaaaacaatagcacatctgcgcaaatttaccactggggaacaaacttttgatagtgatctaaatattcaaaatggaggcagcagaaaggattctcattccagggagatgttcataactgtgtctgacatcaacctcagaagtatgccctctcaagtgcctcccccatgtcgtccaccacctcctgcgctggatgcaaaaaagcggagcatgtctggatttcattcaaacagcaggctggttgtttctgaagagacaccaggtgctggttcaccacctttctttaatgtggaggatcatatgaattcatctgctacagcttctgctgatgctatgaaagaagcaatgcttagagcagaagcaaaacttaggagtgccaaagaattaaaagagagaaagaaaggggattgtgaaagccattcaaaatcaagttatgatgcaaaaattaatgaagcaaagatgtgtaaggatataactagattaagtagtttgaatgatcatacattgcagggaagacattcaaaaacaaaactatctgtcacagattacaggcagaaacttaagaaagcttccccagaaactctggacaatttagaagggaaaagagttttaaacatgtttgaggaaaaggacaagatagaatccaggtcatctcaagaatctgatagaagttcagttgggacatggaaagatgagtctgaattttttgaattggtgggaatcgaagaatcgagaagggtaactcaacccacaaagcagattaaggatttggtgcaaggtactgaaacccaaaaagtggaaagagaagcatctaatgtgcaagaaaagcataaacaagtaaaagcaactgcagaaaattaccagggggaggcgtacgagaaaaaatataaagcagcaaaacaggcttgtgaacatgatgaaaacattatgaaatctgaagcatctaatggtaaacagaggcagagagagcaaatgaaaaaggaaaaaatggccaaagtatttgaggtggaagacaatgagaagagtataaaaatagcccaccagcatggaaaaactgaaaagaaagtaactgaagctgaccaatctggaatcatagaagacgtgtgtgaaatgggacacggagagcataaacaagtggaaatccagaaacccaaagaagtagatagacaaacaccaaatgaagttcagctgaccatggggcttagggaaaatgagaagaaattcaaagaggttgaaaagcaacagcagagtgtgcaaaggcataagcaatctgagaaaatcaaagaaaatggaaaaacagaaagagaagcttttgctctagaacagactgagcatggggaaaagctgaaaggttctgtggagccagaagatatggatgaaaaatcaaatgtggcttttgaaccgtattacacagaggaaaaagaggtctgcaaaagagaaaatgaaatgaaattaaaactaggtaaacagattcagatcaaaaagggactgaaagaagctcatgaaagagtagaaattgggaaaagccccaaaagttcttctgaaaatgaagaaagtgatgatggcctaatacctgctttcaggtggaatgggaatcaaaagcaacttaaagaagactttgaactcgaagtaaatgagataaggctgaaagaggcttccaagctgagggaaaatgaggcatatggaagcgatcaaaatagaaagaaatttaaagatgtttatggagaaggaaatagacttcaagaagcaggtgacaacaaagggattcagaaagttatgaatcaaaccccaatgcaagaacagattaatgggatgttgaatgaggctcaaaggaaaaaagtcactgagggaacatcaagccaaacattagcaatggaaggaagtgtagatgtatcaaatgagaatagtcacctggagcaatctgagaatatggagcaagatgtaggtggaatggaaaaagataagggattgaacaaagcttttgtcatggagaggaatgaagaagagggaaacatgaagaatgctaaagcaactgatgagaccgaggaaattgagagtgaagaagatcttgcagctcaatcaacctccattcatgaagaatttattggaaaactgaaggtatctaaaaaatctgttgctgaccaagatattggaaagatgagagcagaatgtgaagttggggaaaagaaattgaaagagataggggtggaaaatcaactggctaatgaaaaaatcagagcacctgaaatgactgcaggagatgcagagcatttaggtacccaatcagaaaaggagggagacacagtgacaaaggctgataacagaggcacagaagcaactggacctgttacagtacaggagactgtaaatgtccagaaaactgcccagtggtttcatgttggtcaatccacagaaagcaaagcaaagagtactaatgaaacttcttctatggtgaaaaatgctgaaaggatgggaagagagtcagaaaaggatcttacacagacagaagaggagggggatagagaaagagaacgagaaaaagacgttgagaaagccatgctggaggctgagagggaaagggaaagacaaaaggataggatggcagttgatagagcaacttttgaggctcgcgatagggcatatgctgaagcttgtgaaagggctgcatttgaaagagcaactgtggaagtacggtacaaggcactggctgaggccagggaaagacttgagaaggcatgcactgaggccagggataagtcaaacattgataaagaaactatagaggcaagattgaaagcagagcgtgctgcagtagaaagagcaactgcagaggctcaagaccaagccatggaaaaattaaagaatgaaaggactgcatttgagtccagagaacagttagagagatctgtatctgacaagttttgtagaagacaagactcttcatcctccgatatgctggatccacagtttcagaacttaagctcttccacaggttccagacatccatattcactttatggtgctgcctctttttctgagagatcagaaagagaaggtgaatcagctcagaggtgtagagctagactggagaggcatcgccgaacagctgagcgtgcagcgaaagctttggcagaaaagaacatgcgtgaccttctagctcagaaagaacaggctgaaagaaataggctatccgagactctggatgctgaagtaaggagatggtcaggtggaaaagaaggaaacttgcgtgccttactttctaccttgcaatatagattatgctctgtctatatggaatttttaacttttcgaccttatcagatccttgggcctgattctgggtggcaactaatcccattgaccgaggtcattacttctgctgctgtgaaaaaagcttacaggaaggccaccctgaagcttggaacaaattcaactcagaggagcggtaacatgcctggcagccaagaaaatttctgcccatggtatagcaagaaattaagaaattcaaaagtaaatagatataaagcaggaggctaa

SEQ ID NO: 36295 - DNA, 777 bp, Glycine max
  Peptide Sequence Number=SeqID_153073
atggcagccaagagcaaaatcctagttcttggaggaacaggatacattggaaaattcatagttatggcaagcgcagaagcaggacaccccacttttgccttagttagagagagcaccctttctcatcctgaaaagtctaaacttattgagagcttcaagacctctggaggtgatgtaaatgatcatgaaagcctggttaaggcaatcaagcaagttgatgttgtaatatcaacactaggtggacagcagatcgatgatcaagtgaaggtcatagcagcaataaaagaagctggaaacattaaggcactttgttcatatgcctttgctggttacttcttgcctacactgggacaagaaaatgtcacagcccctccccgtgataaggttgtcattctgggaaatggaaacgtcaaagtaatttatgtcacggaggaagatgttgggacttataccataaaagcagtggaagatccaagaaccttgaacaaaaatctgcaccagaaaccccctgctaatgttttgaccttcaatgaactcgtttccttgtgggagaacaagattaagagcaccctccacaaaatctacgttccagaagatcaaattcttaagaaaatccagaagtcttctttccctgccagtttcttagtagcattaggccactctatgctggttaagacagctagtaacaatgaggctgacccttctgtaaaatgccaatatatggaggcattaggccaatttcttagtagcattaggccactctatgcagagtcatag

SEQ ID NO: 36296 - DNA, 384 bp, Glycine max
  Peptide Sequence Number=SeqID_153074
atggcgcatgtgctagtgcttgagtgtgtaggatctaacatgtttagatccactagtactcgaggagggccttccaagtatgagagattagaaaaagaacttgctgacaatggaacttcaaatgaggagtttaagaggagcacaagtttgccttctcgggctatgggttcaacctttcgagacatcaatctacagagaaaccccacaaaaaatgccaatagtaaacctaaggagaagaagagtcacccactcttcagcttctttgatcttcgccggaagaagaaaacaacagctaggcctgaatttgcgaggtatcttgagtatgtgaaggaaggaggcatgtgggatttgaattccaataaacctgtcatgtattacaagtga

SEQ ID NO: 36297 - DNA, 1464 bp, Glycine max
  Peptide Sequence Number=SeqID_153075
atggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtaagcttttactctattgtggttgaaattggcaaaggaagtaaggttaagtatgagctggacaagacaagtggacttataaaggttgatcgtattctttactcatcagtagtctacccacacaactatggttttatcccaagaaccatttgtgaagacagtgatcctatggacgtgctggttctaatgcaggaacccgtgcttcctggttccttccttcgtgctcgtgctattggactaatgcctatgattgaccagggtgagagggatgacaagatcatagcagtttgtgctgatgaccctgagttccgccattacacagacatcaaggagcttcctccacatcggcttgctgaaatcagaagattctttgaggactacaagaagaatgagaacaaaatagttgatgttgaagactttctaccagctgaagctgccattgatgccatcaagtactccatcaacagcactgccactgccactaccaatagcagaatgggaaccttgggcagagctttctacgccgtcggattttggatccgcgagaccggccaagccatcgatcgcctcggctctcgtctccaaggcaactacctctttcaagaacagctatctaggcatcgacctctgatgaatctgttcgacaaagctccctcggttcacagggatgcatttgtggcccccagtgcctccctcctcggcgatgtccacgttggcccagcttcctccatttggtatggatgcgttctcagaggtgatgttaacagcattactattggatctggaactaatatacaagacaattctcttgttcatgttgccaagtctaatttaagtggaaaagtcttgccaactatcattggagataatgtcactgtaggtcatagtgctgtgttacaaggatgtactgttgaggatgaggcatttattggcatgggtgcaaccttgcttgatggtgtatatgttgagaaacatgccatggttgctgctggagctcttgtcaggcagaatacaaggatcccttatggagaggtttggggaggtaatccggcaaggttcttgagaaagctcacagaagatgaaatgaccttcttctcacaatctgccttaaattattctaatttggctcaggctcattctgctgaaaatgcaaaaggactcgatgagactgaatttgtaaaggttcttcacaagaaatttgctcgtcatggtgacgaatatcattcagtgctaggtggtgttcaagaaactcctacagagcttaaatcttcagataatgttttgctagacaaagttcccaaggcttag

SEQ ID NO: 36298 - DNA, 444 bp, Glycine max
  Peptide Sequence Number=SeqID_153076
atggtggtgaggagtgacaggttgaagagggatgtggcagattgtggtgacaacaaccaaaacgggtacgtggagcaagagaagaagataaaaggggtggtgagttgtgctgggaagaaaggtggtggtggcaataataatagcatatatgcggtgttgtcaacgccgatcttcatgaggccaagcagtaccacaggaggcacaggattccacgaattagctgaatttgatgacacaaaaagaagttgccgcagcagtttggccggacacaatgaacggaggagaaagaactcagatcagtctcaagcagaagggtcaagccgcaacaaagggacagggcaccctcaattgaaggacattacttgtggtcaggctgatgagagggggagaattcagataacaatccacgaaaatgctgcttacaaacatttccagataagatga

SEQ ID NO: 36299 - DNA, 720 bp, Glycine max
  Peptide Sequence Number=SeqID_153077
atggcattgaatttggatagagttagagaggttgaagagaatgcagcgacagaattgtctatgaaattcagcagtcctggtacagagttttatgatgcctgggaagaattatcttctgaaggcatgtctcaaaattctacatacaatattgaagctgaattatgtgaaataaggttaagtctgttggtggaggtagagaagcggaagcaagctgaagaatccatcaacaacatgagaagccaatgggaaagtattaggccagggttatatcaagcaggaattgtttttcctgcatatcttactgccgctgttgaggatgagcagctgatttctgatcccgtggaagatctatgtcaacaagtttatattgctaggttcatatcaaataccattggaaaaggaattgccagggcagagttggatacagagatggaagctcaactagaggcaaagaactttgagattgctcgacttttggaacgtctccactgttatgacaccatgaataaggagatgtctcagaggaaccaggaagcagtagagatggcaccgcgtgagaggcaaaggagcagcaggaggcagagatggatttggggctccatcacaactgtaattgctcttagtactgcagcactagcatggtcttatctcccaacgggtaaaggatcatcctctgctgacaatgatctagttcctgaacatgatgacccagccaagtag

SEQ ID NO: 36300 - DNA, 576 bp, Glycine max
  Peptide Sequence Number=SeqID_153078
atgaagcattttgccttggtgtttcttttggccattttggtccctcaggagtgtttccatgtcagtgtggaagcaagggatgatttcgtcagaaccagaggcatccacttcatgcagaatggatacccttactatgcaaatggcttcaatgcctactggttaatgtacacagcttctgacccatctcagagattcaaggtttcaaatgccttcagagaagcagcaagccacggccttactgttgctagaacttgggccttcagtgatggtggctatagaccactacaatatttccctggcttctataatgaacaaatgttcacggggttagattttgttgtatctgaggccaggaagtacgggattaagctcatactgagcttggtgaacaactatgaaaattttggaggcaagaagcagtatgtgaactgggctaggagtcacggccagtaccttacttcagatgatgatttctttaggagccctgttgttaagggttattacatgaaccatgtgagggttagtacaatttttgttctcttgcttggtaaaattcatgtatatgcagttgaatag

SEQ ID NO: 36301 - DNA, 213 bp, Glycine max
  Peptide Sequence Number=SeqID_153079
atgaagttgggtgctcctcaatacaaagcaggcgatgacccatttgagtatctgagctgggtccagactattacagatgagataggggctgatgacagttcagccattcagatggctgggttcacactgaagtgcaagaaggcacgtggttggtttaagaactatgtgaaacccgagagcggacagtatgtcctgggaggagttcgcacatga

SEQ ID NO: 36302 - DNA, 585 bp, Glycine max
  Peptide Sequence Number=SeqID_153080
atgcataggagcaagtggatagtaactgccctctttggcggtttcattctttggaggcatgacgcagaagccttatggtttacagcagggtctgttctgaatgctatgctttctgttttgctcaaacgtatactgaatcaggaacggccttcaaccctgaaatctgaccctgggatgccatcatcacatgcacaatccatattctttactgtcttctttgttattttgtcaggcgtagaatggcttgggctaaatggattcaccattgccatcagtgcatcggtcctgacatttggttcttttttttcgtacctgagggtgtcgcaacagcttcatacagtgagccaagtggttgttggagctgctattggatccattttctctattttatggtactggctttggaacggctatatgctggatgcatttgtatcttctctgtggaatgatgtcggtctgtacccaagcgatcccattacagggggaaaaagagaacgtgatatggatgctctatgctctatggtgttgactgttgagtcccttaccgagaatttgcaaacaaatgcctcagctcacaggagttaa

SEQ ID NO: 36303 - DNA, 210 bp, Glycine max
  Peptide Sequence Number=SeqID_153081
atgacaaagatcgcgcagggtgcagcagttgcagaagacgctggtattgatgccattactcctgaagaaggcaaagccaataatattattgaggcgtatgagtcacctagattccaaaagtttgtgacacattgcagctcacatgttactcaaacatgcagtggaaatgatccattaaataatcaggaggctagtagaatgaatagctag

SEQ ID NO: 36304 - DNA, 399 bp, Glycine max
  Peptide Sequence Number=SeqID_153082
atgcaaaaggaagctcctcaaaatcgtctcttcaattcaagtgaaattaaccacttgaaaaattttgattttgattcaattgcaggggtggataaaattgaagctgatgaagggaagggcacgttgaccgtgacaggggatgcagacccatatgaaataatagttcgcataaggaaagctggcaaacatgctgaagttgtgagtgttgggcctccccaggcccctcaaaaaaaggatgagaagaagcccgaagaaaagaagaagcccgaggcagagaagaaagatgaaaaacctaaggagtccagtatccacatgccatattactatcctccttaccaaccagtagtgctgtacatgaacagatacgaggagcccaatccatcttgcactatattgtga

SEQ ID NO: 36305 - DNA, 234 bp, Glycine max
  Peptide Sequence Number=SeqID_153083
atggagatggaaggttataatggggtagttatattccatgatgtgtttgacaatgagtatgatgttggcggttctcaaatcagaatagaaggtgtatatatatggccttttagacagcttcgaatggtagccaacaggccaagttctgttgagcctgctgagggagatggcttgaggctattgaaggttaagtacatagaaacgtgcaggccaagcccacatatatacaactaa

SEQ ID NO: 36306 - DNA, 239 bp, Glycine max
  Peptide Sequence Number=SeqID_153084
tactaatcattttgaaggccagctccattgtgttgttacctgaatttgaggatccctccttgttttggtctgaggaagtttatcatggcctagcatctgagtttcagtcatgggtttcaatcaagcaatcaagcttcaccgcagcatctaacttaaaagaagaattttctgatgcttcagctcatgttccaagcttggagcatttaatttatatgttccagcttgagggggagtgttaa

SEQ ID NO: 36307 - DNA, 192 bp, Glycine max
  Peptide Sequence Number=SeqID_153085
atgtcacttctctcaggggctatttacaagaaaggaggagagcaatttaggtccattttcacaatggaacataacaggaacttacaaaggtttgcattttttactaacataagttgtaaccagttgaagtattgccgaacatatgcttcactgatgtctgttaagacgatctatgattggataacaagctaa

SEQ ID NO: 36308 - DNA, 756 bp, Glycine max
  Peptide Sequence Number=SeqID_153086
atgtcatccaaaggcatcgtgagcaatgtcgatatcgcctcggcgagggccccacacagaacactctgcactgattccagcttcttcgggaccatgatcgctgatgacatgatggagaggtggccttggtccctcttacgacagcttcggaaccctgcagggggagtcgcaaaccacaacatcaaggtttctggagtatccatgactgcaaagcaatcacactttgtggttgcatcagtcttgcataatattcaccacaacatccctgagttcatctcaaatttgatggcatatgctggagtgatacatcttgtagattttgtcaaggctttaaattacggtccaagttgtgattctgttgcgatcattgatattgaaggaaaccctggtgttgtggccaatatcacaggcgtggattcttttcaaaagcatggattctgcttgctcttaatgacgcaaatcatcactttgtgcactagtcagatcacgtttgataacacccaaaacaccatccctaaacctcaaccaaacaagccatggcctcctcaagccaccatcatcgtaaatggagtcatcgccaccaccatcgtaaacaagccactgcaacaacttgcaaacaaagccattacagcaagaaaaaaattagaagaatggaagaggttgttgatcactgttgccacctccaagttgtcaccatcactgcaagccaaccgcaagcaacaacctcaagagagaaagaaaagagagaaaaagtag

SEQ ID NO: 36309 - DNA, 438 bp, Glycine max
  Peptide Sequence Number=SeqID_153087
atgcagacaacagaagcaaagcaacaagtgatgacgtcaaaacaaacatacagtgtgtgcttctactggcggcagtggctcaagctggtgctggcggagaggcaagagaaggccactgaagaagacacacaagccatcattaataggtttaggcatttccatcacaaaggggttggcctcaatcttgaaactttctttaagtacctctttagtgaagataatcctcctcttcttccttctcatgggctgagcagtgactgctgtgacatccctatcataaatgcactgaagaaaggtgtatgggtgattgaattagacatatggccaaatagatcaaaggataatatagatgtgcttcatggaagattttcaagccaaaagataacatgcatgcatattggaaattggatttttatcactaaggtttacatggcttaa

SEQ ID NO: 36310 - DNA, 174 bp, Glycine max
  Peptide Sequence Number=SeqID_153088
atgattctgaaattgaccctcttttggctactgagcttgtggctgactttggggtccaaagtcaatggcatgaagggaagaaacagcgacccagttgaggaaagaaacttatttttacttctaaaagactcggggatatcacatgttggtttatatgatattggcatcaattaa

SEQ ID NO: 36311 - DNA, 1038 bp, Glycine max
  Peptide Sequence Number=SeqID_153089
atggttcgccaagctgatttagtcatcattggtgtttctgttggtttgacccttggaattctgatatcttgcctcatatttttcggcataaggtggtacaagaaacgtgctcatattagacgatctgcaaatgagtctagtttaacaactctgccgatacgaacaaatggattgggaacaagtagtgactttagtgcatctcttgatagttccatagcctcatcatggtcagaaaatctaaagagaaattcccattttagttggtggaatcatcaaaataaagatcggtttgcttcagcatcaggcattcttaagtatttgtacaaagaaattcaaaaggccacacaaaatttcacaactactttgggacaaggatcatttggcacagtttataaagcgacaatgcctacaggggaggttgtagcagtgaaggtgcttgcacccaattccaaacaaggggagaaagaattccaaacagaggtatttctgctaggaagactgcatcaccggaatcttgtgaatttggttggatattgtgtagataaaggacaacgcatactggtttatcaatacatgagtaatggaagtttagcgaatcttttatatggtgaagaaaaggaattgagttgggatcaaaggctgcaaattgctcttgatatttcacacggaatagaataccttcatgaaggagcagtcccacctgtcatacaccgtgatttaaagtctgccaacatattgctagatcactctatgagagctaaggttgctgattttgggctctcaaaggaagagatctttgatgaccggaattctggtctcaaaggtacatatggctacatggatcctgcatacatttccacaagcaagttaacaacgaagagtgacatatacagtttcggtatcatagtgtttgagctaatcactgccatccacccacatcagaatttgatggaatatgttaaccttgctgcaatggatcatgatggtgtagatgagatacttgacaagcaactggtgggaaaatgcaatcttgaagaa

SEQ ID NO: 36312 - DNA, 498 bp, Glycine max
  Peptide Sequence Number=SeqID_153090
atggtcgataaatgtgacgaagctagtattgaagtaggatctagaggcctggttgacgatttacacgagccaattgagctgaagaaaataaagaagggacaacagactggaaaacctaagagaatcagaccaacaccaatcactaatacctttttcctctctactggttttccctcatactataagcaacacgatggcgtctacaacctttttatttccaactttaggagacgtatggataaggttgaaagcataattgttaactcgttgctcatatttagcaattatcaaatctctcaagaaggacaaagatcaagtgaagagaagaaatgggtaactaaagggggacttcacataccttctattctactagaagactatgtcttggcagagaaggttatgcatcgttcattccttgcaactcaggaggttaatgataaagctcaagcgtttggaagtaagtgtgtctctgactatggcattgctaattgcaattga

SEQ ID NO: 36313 - DNA, 352 bp, Glycine max
  Peptide Sequence Number=SeqID_153091
ctacatgggagatgacatggtgctgctacaaggtctttctgatgagagtgtggaggagagaaataacaataggctttcatggattcattgtttggggataccactacaagtttggggaagcgattgcttttccaaagttgtgaacatatacaaaacttttgtcaaagcagctaaagaaactgagatattggagcatattgaatttgcaaggctcttgattagagtatcatcattgtctttcattaacagatgggagaatcatgaaaactccataaaggatgggtctatggggagcgacattggtatggaacaagctttgccttgtttggattttgctggagtgcacgaatga

SEQ ID NO: 36314 - DNA, 1644 bp, Glycine max
  Peptide Sequence Number=SeqID_153092
atggagaattggtgcatcattggcgacttcaatggtgttagaaagttggaggaaataattggtggggaaggtgtgaatggaattgaaggaaggggtgagattagagactttaacaagtttattgaagatataaagggtgatggtctcaaaggaatgacttatttcttggctagattatgcttaatataccctagagaggaatatctcggatcattgcccttattggtgaagagctccaacatcaatttgggacctaaaccatttagggctttggattgttggttcttaaacaacaatttcaagttatttgttaaggaggaatgggggaagttaaaaaagcactttaaatggactctttgtggatggggtgtggatgagcctagaaaagtgaaggatgaggttctaaaattttaccaaagaaggttcttggaggtggaggaggagagacctcttttagatggtgtgagatttaatatgatttcccatgaggataacacttttcttatgggaaaatttagtttggaggaggttaaaggggtggtgtgggaatatgatagtaataaatgtcctaggctggatggatctcttgcgcaatgtgtgcttctgaccaatgaggttgttcatgaggccaagaggaaaagaaagagttatcttatatttaaagtttattatgagaaaacatttgactcggtgaattggaagttcttgttctatatccttagaagattgggcttcaatgagaaatgggttctttggataaaagcatatttgggaagtagttatacctctatcttgggtctatgtggtcttatgagggagactatcgagaaggagcttttcacaagtttcttgatgggtgagaataatgttcaagtgaatcttcttcattttgcggatgacactctctttattggagaagctacttggaccaatgttgtggtaatcaaaagcattttaaggtgctttgaattggctttgggactaaaggtgaatttcttcaagagtaactttgatgcttttggtgtggattcctcattggtggagagttggttaaaaacatggctgtatggaatggggatgcgtgagaatgggatttttggtggagaaagtggtttagttgggaattacccatggtggaagcttttaacaattctttgtctagtaggaggctatttaggatggatgatgatagatgggtatggaaaaaatgacaacaataatggctgctattccatgaaatctgcgtacacaactctcaccaattccctcacagatatcctgcataacagcaagttcagtcttatttggaacttgcacattcctccgaaagtgagcgtatttttttggaggattttaaggtctgcacttcccaccatagacaatttaaaaaagaggagtattttggtgcctaactatgactacatgtgtcctttatgtggggtggatgaagaatcactagaccatgttctactatgcatgtgctcatatcaagttcgatggatgagaatagtaagtggagagttctctggtgtgctatttcttgggttctatggaactggcggaacaacatcactttcagagacaaggtgttctataaggataaaattctgcatgacattttatatcaaagctggtcttggctaa

SEQ ID NO: 36315 - DNA, 345 bp, Glycine max
  Peptide Sequence Number=SeqID_153093
atgagaggtcgagggaaagcaagaccgatacaccaaggagggctaagggagaaagactggggtgggttgagggagaacaagagaatctcaatattttatttctcaaaattcctagaaaatttcaatgaacacgacatcttgaaagtgtttgcgagggacaatggcagtaatagatatggcgctacaacaactggtgatccctcttatgcaaatgtactacaacaactggtgatgaaagaaaaaatgatctggcaaaggaaacaacatgaagaaagacaaagggaatatggggtttggtcgggcatggatctcatattgtggaggaaagaaaaaagaagtggctag

SEQ ID NO: 36316 - DNA, 258 bp, Glycine max
  Peptide Sequence Number=SeqID_153094
atgaagactgttagatcctttcaaccagcgaaactgcagcatcaaacaactcagtctccaacatcatggcaacctccaccgcaaggctacatatcttgcactcttgacgcatcgatctttaaggacgaaaatatgtttgcagctggaatgtgtatcaggaacaatcatgtccaatttatgtcagctaggagcttcaatttccacggtagaatcagacctccagaaccggaagcaattgctctataccaagccttgtaa

SEQ ID NO: 36317 - DNA, 558 bp, Glycine max
  Peptide Sequence Number=SeqID_153095
atggtacacggggatttacaactattaggtgcacgtgtgagcacaaagggtagccatgttgaaagtgcaaccaatccatctgggggagaggatgttgatgatggggtgcctactatggggttttacgttcaatgtgatcattctacatgtctggtggccttgagaaaagtttatgatggggagtccaccatacataacgtgtcttatgcagatgatgtggttagggtgattgttgaaaaagtttatgatagttacactctagtctcatttccgacgacaaagattcaatatgttagacagacccttgacacattcgttgcatggccgagtcatcttgtgaaacttgtatcacatgagaatagtctaaagaatgtcgttgaacctgttcaaaagtccaatactcttaatgcagatgatctattgggtgactttattaagaacctatatgatgtttaccagaaacctgttgagttgttgtgggatgagagtaaatttgggattccaaataaattgatgttgatatctggcattctaagacggttaaggaactatcattga

SEQ ID NO: 36318 - DNA, 618 bp, Glycine max
  Peptide Sequence Number=SeqID_153096
atggccaagttcaaccctgagatagtcctagagttctacgctaatgcctggcccatggaggagggagttcgggacatgcgctcgtgggtaaggggtcagtggattcctttcaatgcaaatgccctcaaccagttcttgagctgcccgctgatcttggagaaggaccagcgttgcgagttcagccagaagagggaccaagcctccggctttgacaaggaggccatcgcccagctgttgtgcataccggggcaggactttccctggaccgttgcggggaggcggctggtgtacgccatcctgactgttcacgtggcccagatagcgcccactaggcaccctttggatccggagaagtccaacaaagccctgggattttcggccttgatcacgggcctctgccagttctacggagtacttgtcacccccagcaaggtaatccagccaccaatcacccaagctttcatcgagaaatattgcacccctaggcaggcacagggggacacacagcaggctgcggacgcaccaacacctcagcagcccgatccggttagaccactaagcgtggagcagtatctacggcatgtggttcgccagcaggcggccaaccaccgtggggag

SEQ ID NO: 36319 - DNA, 489 bp, Glycine max
  Peptide Sequence Number=SeqID_153097
atggcgaaagccatggcctctccaaggatggaggaaaatgtagcattcttgagtaagcaactaactgagcttgtagagatgcttaaacaacagaaaacaatgcttgaagaacatcaaaaattgattacagatctgggaacaaaaaaggatgatgcacaaaacgaacattcaaaaacactggaaggcaagggggattcactggcaaagaaaaagtgcacagaaaacaaatttaacaaattcaattcccattttctattgaagtccagaatgagagaatctctgaccactatcatcacgagtcttcaactttacaaattcataatggtgaggtgtagcttggctgtggaaaatcatagggtgacaaaacgggtcaacccgcctcacctcgccgttgacccgccaaaattgagttggtcaaccttgccccgcataagaaaaatgggttggaaattcaagtctaccccatatatgctcgagttggtaggttaa

SEQ ID NO: 36320 - DNA, 1380 bp, Glycine max
  Peptide Sequence Number=SeqID_153098
atggtaaccatccactgttcccacctggtggttccctccgagcccacgccatcttcaaccctctcactctccctctgcgaccaaatcaagctcccaaaccacggatctcagctctacctctacagcaacaccagcatcacccaccatcatctcatccacactctctcagcctccctcagtaaagcactcactcactactaccccttcgctggccgcctccgccgcatccccggcggccgcttccagctcctctgcaacgccagtggagctgtcctcatagaagccacatgttcaagtcaattcagtttcaaatattttcgcgatttcgctcccgtccacgctgtccccaaaatcaactacgatgatgtccccattgaggatgtccccttgctggtggcgcaggtcacgaggttccccaacggcttcatcacgctcggtctctccctctgtcgcgctctcctcgatggaaattcggctagcagcttcgttaactcgtgggccaagcttgctaaaggagagaacttagattccagcttgattcctttgcttgatcgaaccaagttagattcatttaaactcaataaaccaccacgttttgaacaccctgagtttttgccaccaccccttttgacacaacagcatacccagatggaaggacaacttggttcgaccatattggaactcacaaagggtcaagttgagaaactgaagaagaaagctagtgactttggaagtgggtatggtattaataacggtaatggttccgtacgaccttatactagttttgaggttataactggtcacttgtggaggtgtgtttgcaaggtgcgttacgcgggtggtgatttgggtcaaccaacgaggttgaccactttggttaactgtagaaaccgtttaaggccttctctccccacggcttattttgggaatgcaacgtttcccacggtgacaccaacttgttcctttgatgagatcatgcacaagcctctgagctatgctgtggggaaagtgagggaagcgattgggaagatgagtgatgagtatgtgaggtctgcgcttgattacatagcaagtgtggaggacttcgatttgttcagggacacgttttatggttctggtgatgggaaagggaagtttaagggagatcctaatttgtatatggttggttggacgaattttaagtattttgagacggattttgggtgggggaaaccggtttctttgattcccggaaacattaattctaatggcaaggcttttcttttggagaatgcaagtggtgatggcttcattgtagctgtttgtttgctggaatcgcatgtagatgctctgaggaagttgttttatgaggatatggaggatgctagttccaaattgtga

SEQ ID NO: 36321 - DNA, 351 bp, Glycine max
  Peptide Sequence Number=SeqID_153099
atgataggaagagccgacatcgaaggatcaaaaagcaacgtcgctatgaacgcttggctgccacaagccagttatccctgtgatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 36322 - DNA, 267 bp, Glycine max
  Peptide Sequence Number=SeqID_153100
atggaccaacctgacagtgccatttggcatttctgtcagaaaagggaaaatggtccaaagtcatctatgattctcctttcttcttattttggttgtgtcaccaagccttcgacagtgcctttgccgccgtcatgttgccaccacccctatgacggtctcgcatcgtcggctagtggcattgaaggaaggcgtaccaccctttgtggtggttccccaagtctggtgccattttgggatttaggtcatctagggttgtttcaaccctga

SEQ ID NO: 36323 - DNA, 2954 bp, Glycine max
  Peptide Sequence Number=SeqID_153101
cctcggactatgagtctcaaagcaatgcattgctgagattgtgttcttcattattgaaggtgcctagtggaggtgtgaaggaaatggctaaaatctccattttgttggtggggctttgggtactaggaagctggacagggttgttggatgcagaatacatgaaatacaaagaccctaaacagtcgattgacacacgcgttgaggatcttgttagcaggatgactcttgaggagaaaattggccaaatgttgcagattgaacgaaaatatgcatctgctgatttggttaagaagtattttattgggagtgtaatgagtgagggagggagtgttccagctccacaggcttctgctgaaacctggattgacatggtgaatgaatttcagaagggtgctgtatcaaccaggcttggaattccaatgttttatgggattgatgctgttcatggccacaacactatttacaaagcaactatttttcctcacaatattggtcttggagccaccagggaccctgaactagttaagaggattggagctgcaactgcccttgaaattagagcaacaggaattcaatatacttatgcaccttatccaagatggggtcgctgttacgaaagctacagtgaagatcctaaactagttcaagctatgactgaaatcataccaggattgcaaggggaaatccctgacaatttaccaaagggtgtcccttttatcactggaaaagaaaaagttcttgcttgtgctaagcactatgtgggtgatggtggaacaatcaatgggattgatgagaacaacactgttatagatagagatggattgatgagaattcacatgccaggctacttcaactcaatcagcaagggcgtggcatccattatggtctcttactccagttggaacggggaaaaaatgcatgctaaccaggaccttattactggctacctcaagaatactctccatttcaagggctttgttatttcagattttgagggtattgataggatcacctcaccacctcatgcaaacttcacttattcaattgaagcaggagtttctgctggcattgacatgttcatgaatccaaagctttacatagaattcatagaagatttaacaatgttggtgaaaaacaagttcattcctatgagtcggattgatgatgcggtgagaagaattttgtgggttaagttcatgatgggtatttttgagaccccttttgctgattacagtttggtcagatatttggggatccagaaacatagacaattggcaagggaagctgtaaggaaatcaatggtccttctgaaaaatggtgaatctgctgacaagcctttattgccacttcctaaaaaggtgcctaaaatacttgtggctggaagccatgctgataatttaggatatcagtgtggtggctggaccataaaatggcaaggagttagtggaaacaatcttctcaaagggactacaattctcgctgctgttaaaaacactgttgatcctgataccacagtggtctacaaggacaaccctgatgcagaatttgtaaaatccaacggattttcctatgctatagttgtagtaggagagcatccgtatgctgaaatgcatggtgataacatgaacttgacaatcccagaccatggtcctgagaccataacaaatgtctgtggagcaataaaatgtgtggttatcattatttctggccgtcctgtcgttattgaaccatatgttggttcaatagatgcactagttgctgcatggcttccaggtagtgaaggccaaggtgttgctgatgttttatttggtgactatggtttcacaggaaagcttccaaggacatggttcaaaactgttgatcaactcccaatgaatgttgaagatcctcactatgatcctctcttcccatttgggtttggcccttcaatggatctggagggaatggctaaaatctccatcttgttggtggggctatggctactagttaactggtcagggttgttggatgcaaaatacatgaagtacaagaaccctaaactgtcaattgatactcgggttgaggatcttgttaagaggatgactcttgaggagaaaattggccaaatgttgcaggttgagcgcaagtatgtgcctgctgatttgcttaagaagtattttattgggagtgtattgagtgagggagggagtattccggctccacaggcttctgctgaaacctggattgatatggtgaatgaatttcagaagggtgctttatcaacccggctcggaattccaatgttttatgggattgatgccgttcatggacacaacacgattcacaatgctactatttttcctcacaatattggccttggagctaccagggaccctgaattagttaagagaattggagctgcaactgcccttgaagttagagcaacaggaattcaatatgtttattcaccttgtatagcagtctgtagagatccaagatggggtcggtgttatgaaagctacagtgaagatcctgaactagttcaagctatgactgaaatcataccaggattgcaaggggacatccctaatgattcaccaaagggtgtcccttttattgctggaaaagaaaaagttataggttgtgctaagcactacgtgggtgatggtggaacaaccaatgggattgatgagcacaacactgttatagatagagatggattgatgaaaattcacatgccaggctacttcagctcaatcagcaagggtgtggcaaccattatggcctcttactccagttggaatggagttaaaatgcatgctcaccatgatcttattactggctacctcaagaatactctccatttcaagggctttgtcatttcagatttcgagggtattgataggatcacctctcctcctcgtgcaaacatcacttattcaattgaagcaggagtttctgctggcattgacatg

SEQ ID NO: 36324 - DNA, 468 bp, Glycine max
  Peptide Sequence Number=SeqID_153102
atgaggcgggctccggcgttggggttggaagggggagggatgggttgggtggggaaggagatggagcggtgctggtgctggtgctggtgctggtgctggtgctggagagggaggtcgaagttggggaagtggaagggcgcgggggagaagggcggagggaaggaggaggaagggttagggttagggttagggttagaggaagagggcggttgggggttgaagaaggagtgcatgtcgaagggaatggggggtggagagttgtggttgttgggggaagccatcgtcaatcagatagaattgagcgccaattctcaacaattcaatctgattgtgggatttgagaagaaaagagatctgaaggatggaacacagagactgggatggaagtggaagaggcgcaacttgcaagccaaactgcaacaatttctcatactattttcaaaattacaaaagagagatattagataa

SEQ ID NO: 36325 - DNA, 468 bp, Glycine max
  Peptide Sequence Number=SeqID_153103
atggcaagcagagaccaagtttggtcattctgcacacatgatacgcggagataccttacggttatccgcccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcggacacagtcgtgttcgatggcaagcagagaccaagtttggtcattctgcacacatgatacgcggagataccttacgg

SEQ ID NO: 36326 - DNA, 303 bp, Glycine max
  Peptide Sequence Number=SeqID_153104
atggttacgcggtccgtgaagttctgtaatgtggcgggaaatcaaaaggaagtattgttacacaatccccaatcaagcccacttgggccttccagattcttcctccagaaggtggttgtttctggaggaagcaacctggctcgcctgggcgagctgggtggcaagctcctcccctattttgctataaatagggggaggaatgaagaaggaaagggtttagccttcttggcacttggtattctcttgaaattgctgaggaaaattgtttccgtgaagaaaatccaaaccgaagcgcttccgtaa

SEQ ID NO: 36327 - DNA, 222 bp, Glycine max
  Peptide Sequence Number=SeqID_153105
atggaggttgaggaaccttggttggggttatggctaccattgaattatcgagtggatatgggatcaagtttagcatatgacaacggaacttggggtgaaccctacaggctttttgctgcaaaattcctttttgttggtgtttttgtgcggtacacaggctttgtggttgatttagggatgacctttgtggataactgggtggtgggaaacttggccgtatag

SEQ ID NO: 36328 - DNA, 198 bp, Glycine max
  Peptide Sequence Number=SeqID_153106
atggttgccgctgaaagattgaagctttttctgtgtaagaggaggaaagggcttggaattttgttgcaggttgcattttggtggtgggtggttctactgttagttaatcctgtggcgggtctcagacccttgagagaaagaactaggccctgggatgatgagttttttaatgactgtggtggtaattggagaatgtga

SEQ ID NO: 36329 - DNA, 1137 bp, Glycine max
  Peptide Sequence Number=SeqID_153107
atgtcctattgctcctaccaaggcttcaagattttggcctcaaactacttagaaacttcctctgaccaccccctctttggagaggtagaggggctaatagaggacatacagataacccctgcgcaagtggcagaggaactgatgaagaacgaagaccctgaggccacacttgaaggattcgtgaagctacttaagaggaagaagatggaaggtgatgtgtgtgaaaactctactcctgataaagcagaacctactcgtcagcaatctaaaaggcgcaaggttggttgcaagcaaaaacgaggcaagagtaatagtggtgtacatgtcacccaaataaggacaagaagaatgagaggttgtagtcgtaacaatggtcacaggtcagcatattcaaacacaaggtgtttacttccctcaattccagacacactgggcttgaatgttgagttgaagcaagtcatcgttgatgatttggaacgcttcttgaggaggaaggaactttacaagaaagtgggcaatccttggaaacgtgcctctccgaacaggaaaatcaagcctcctagcagcaatgaactcttcgtagccgcccaggagtacctttccgccaagattacaagattactcaacacgtgtttggataagacactcgcgtcgtggactgtcttcgcagtcaagaaccaacgcggcaagatctacgacctcacgcatctggcggccagcactgcgaggtgccgcaccacggcagggtccggcggagggccaattcggcagtggcaggttccggcaaagtcactggtcttaatcaacagcatcgccctgtccaccacagacaaaggactaaagttaacatcaataacgtttcttccaccattggacatgtattcgacgacgagtaatttgttgtcgtttgggtcggtgctgaagccgatgaggttgacgaggcaggggctggggatttgggagagaatcttgatctcgtttttggcggggactggtgcagttgccgcagtgggtgcatttggtggcgtggtttttagaggtgctggtgacgacaagtttggtcgttctgacagcggcgaggagcttgtcgacgtccagggtgactctttagactctgtcgtggctgcctctgcctag

SEQ ID NO: 36330 - DNA, 252 bp, Glycine max
  Peptide Sequence Number=SeqID_153108
atggttggtgtactttcaaaagaagaataccgatgcgacatggggagtcgcaggagaactgggacacaacggcgtacaccaccgcacctggccactacaacattcagtcaacgatatacctcgaagtttaagcatcatcacccagaaatttctcggacaattaaggtaaacttctcctgcattatgtggcaactgccaacaatgcatatgcatttgaaacttcttcggatgagactacacaattacacatag

SEQ ID NO: 36331 - DNA, 786 bp, Glycine max
  Peptide Sequence Number=SeqID_153109
atgtggtctgaaatgctcaaatggaggaaggaatttggtgctgacaccatcacggaggacttcgaattcaaagaacttgatgaagtcttgcaatattatccccaaggccatcatggagtggacaaagatggaagacctgtgtacatagagagattaggccaagtcgatgccacgaagatgatgcaagtcacaaccatggatcgctacatcaaataccacgtaaaggagtttgagaggacatttgatgttaagtttgcagcttgttcaattgctgcaaagaagcacatagatcaaagtacaactatcctggacgtgcagggagtggggcttaaaagcttcagcaaacatgctagggaacttgttactcgccttcagaagattgacggtgacaactatccagagaccttgaatcgcatgttcatcatcaatgcaggttctggatttaggatactgtggaacaccgtaaaatcattccttgatcctaagaccacggcaaaaatcaatgttcttggcaacaagtatgacaccaaattgctagaaataattgatgcaagtgagttgcctgaatttttaggaggcacttgtacatgtgctgatcaaggaggctgtatgcgctctgataagggcccatggaaggatgcagaagtaatgaggatggttcagaatggtgatcacaaatgttcaaaaaaaagtgcctcacaaggcgaggaagagaaagaaaattctgagcttttcgcatatcatattgattttctagagactatcagtgctttctgtcattcatga

SEQ ID NO: 36332 - DNA, 1401 bp, Glycine max
  Peptide Sequence Number=SeqID_153110
atgggattctacacacagaaccttttttcttctttcacctcagcttcatcatggttcgaggtgtacgctgccttctccacattcacgatgctcctcagaacagcattcattcaactcattccccagcaattccgatccttcattgtctcaaagctagagtccttcttctccaaataccaagcaaatagcgaaatccgtctaaaaattaacaaattttgggacaaaaattcgggagaccgcaatgaacttttcgatgctgcccaggagtacctccccaccaggattattcacacctacaagtcgctcaaagttggcaaactacaaggcgagaagcacattgagctcgcagtgtatggaagtgaagatgtggtggacgaatttgaaggcaccaaattcacttggaagctggatgaagaagggtccaaacaggactctaataatcacaacaagaagtatagctttgaattaaccttcaatgagaagcatagagagaaagcattggatctgtatattccacatgtgattaaaacatatgaggtcatgaaagctgagaggaggattgtaaggatctattcttggttagatgatgattggaacgatagcgagttatcacatcctgccacattcgactcactggccttgagtcccgagttgaagaaagatatcattgatgatttggaacggttcctgaggaggaaggagcattacaagaaagtggggaagccttggaaacgtggctacttgttgtatggacctcctggaactggaaaatcaagccttattgcggcgatggcgaactacttgaaattcgatgtgtatgatttggagcttacttctgtttattctaactcggacctcatgcaatccatgaaggaagcatctaaccgttccatcgttgtgattgaagatattgactgcaatgaagagctgcacgctagatcaattggtctttcagatgatcaagattcagacgctgacaatgaggctgccaaggttaagacaagtaggtttagtctgtcgggtctgcttaactacatggatggtttgtggtcaagcggaggagaggagcggattataatattcacaaccaaccacaaagaaaaaatagaccctgctttgttgcgcccgggtcgtatggacatgtacattcacttgtcctacctaaaaggcaaggcatttcgagtcttggcttccaattatttggatattgaaggagatcatccactctttgaagaaattgatgagctattggagaaattacaagtcacccctgcagtagtagcagagcaactgatgagaaatgaggatcctgatgatgctttggaagcccttgttacatttctcaaagaaatggacaaggatagtaattgtgacttagagctaagagggactagtgagtag

SEQ ID NO: 36333 - DNA, 441 bp, Glycine max
  Peptide Sequence Number=SeqID_153111
atgaaaacatggcaatatcaccaaaaaaacaaatacatagagtatcatcatgcaacatacgaagaagaagagacgggaggatcactaaccttgaagaagaagcggcaccaacaacaacgatctcacaacggaggaagacaagcgatgctcacaccaagaacacaaacgctgctcaccggaagtggaacaagcagcaacaagcatcgcgctcacaagaagacgaagaagcaaatgcaaagtggaagagaaacagcaccaacaaaagaagagaagatgaagcaaatgagcacatacgaaaagttagccttttatataattaaggtgaaggacatttatgccctttcaccacacctgctgggtgctccagcaaaaacgttgggtgcaccaagtaacactccaaagaagatacacatgcttgctgaagcccatttaatggtttag

SEQ ID NO: 36334 - DNA, 621 bp, Glycine max
  Peptide Sequence Number=SeqID_153112
atgtctcacggatgcagcttctgggaatatgttgaccgagtccgtgacgcaaatcttgtcactacagttactgtgacgcaggagattgcgcaacagccgttgacgttagagtctttgcctttcatttattatttttatatttcccgcttacttcccagtttccacactcctaaaaaaaccctgttttctttttctcctcttcctcacaccatgcaccaaacaagccccaacggcacacgtcacgcaccgcctcccgccggagcaagcggcggacccagtggggctgaccacgccaacgtggtcaaaatggtttcggagaatcccgtgattgtggtcggggcacgtgggtgctgcatgtgtcacgtggtacagaagttgttgcaaggccaaggagtgaaccctcccgtgtacgaggttgacgagggggaccaagctgacttggcccgggagctttcgcggaatattatcggtggcagcgatgataatagcggtgaaacgatgcagtttccggcggtgttcgtgggcggaaagtttttcggagggctggagagactaatggccacccatatctcaggtgaattggttcctattctgaaagatgctggagccttgtggctttga

SEQ ID NO: 36335 - DNA, 324 bp, Glycine max
  Peptide Sequence Number=SeqID_153113
atggcaatcaattcatggggcttcggactcaatggtggaggattgatgaatggcaatgaattaatggggctccgaataagatttgatggtggaggatgcaccaacagtgctaggcaatcaatttgtggggctccggacttgatggatgcacgaacagcgcaaggcaatcaattcgtagggctccgaataatatttgatggtggaggatgcgtgaatggcaatgaattcatggggctccgaataatatttgatggtggaggatgcaccaacagcgctaggcaatcaatttgtggggctccggactcgatggtggaggatgcatga

SEQ ID NO: 36336 - DNA, 2739 bp, Glycine max
  Peptide Sequence Number=SeqID_153114
atggccgaggttgctgtgtcaacggtcgttaccaagctgacggggctgctggtggaacaagcagcagtggcggcggtgtctgtttcacagctggcaggggtaagagagcaagtggagaatttgaagaacgaattggggtggatgcagagctttctgagggacgcagatgcaaaacaagaaggcaacgaccgcgttcgcatgtgggtgtcggaaatccgagacgtggctttcgaagcagaggaactcatagaaacctacgtgtacaagaccaccatgcagggaagcttagacaaggtcttcagaccctttcatctctacaaggtcaggaccaggatcgacaagatcctctccaagatcaagagcatatccgacaggcgcgagacatacggcgtcgtcgtaatgacccgtgatgatggcaacaacagcaacgaaaggttgaggcactggagacagccttctccttattctgaagaagagtatgttattgagcttgaagatgacatggggttgctttttacccagttgcttgcagtggagccaacgcctcatgtggtttctattgttggtatgggtggtttggggaaaaccactttggctaagaagctctacaatcatgccagaatcactaaccattttgagtgcaaagcgtgggtttatgtctctaaggagtataggaggagggatgtgttgcaagggattctcaaggatgtggatgctctcaccagagatggaatggagagaagaataccggaggaagagttggtcaacaagctgcgcaatgtgttgagtgagaaaaggtacctggtggtgcttgatgacatttggggcatggaggtttgggatggtttaaaatcagcatttcctagagggaagatgggaagtaagatattgctcaccacaaggaattgggatgttgctttacatgttgatgcttgtagcaatccgcatcagttgaggccattgacagaagatgagagtttcagattgctctgcaacaaagcgttccctggagcgaagggcatcccgttagagttggtccagttggagagtcttgcaaaggagattgtggttaaatgtggagggttgccattggctgtggtagtggttggtggtttgctgtctaggaaactcaagtcaagtggggaatggaaacgggtgctgcaaaatatcagctggcacttgctagaagagcaagagaagatagcaagaattttggccctcagctacaatgatctgcctcctcatttgaagtcatgctttctatatttgggtcttttcccggagggtgtgaacattcagacgaaaaaattgatcagactatgggtggcagagggatttctactgcaagaaggagaagaaactgctgaaggtgttgctcagaaatatctgaacgagttgatcggtaggtgcatgattcaagtgggaacagtaagctcattaggcagagtcaaaacaattcgcatccaccatcttcttagagatctctcactctctaaaggaaaagaaggatattttctcaaaatatatcaaggtgatgtggcaggtccatcaactaaagcccggcgccattccatgcatttttgccatgacaggtatgactcattaaaacacaattctgatcattcacgttccctgctgttcttcaacagggaatataatgcagatatagtgaggaaactctggcttcctttgaatttacagcaagaaaagaaattgaatttcatcttcaggaaatttaagctacttagggtattagaattagatggtgttcgggtagttagcctgccaagcacaatagggaacttgattcaattgaggtatctaggattgagaaaaactaatctagaagaagaacttccaccttccattggaaacttgcaaaacctacagacacttgatttaaggtattgttgttttttgaagaaaatacctaacataatttggaagatggtgaacttgagacatctcctcctgtacactccatttgattctccagatagcagccatctacggttggatacattaaccaatctacaaaccctaccgcacattgaggctggaaactggataggagatggtggtttagcgaatatgatcaacctcaggcaattgggaatttgtgaattatcaggacaaatggtgaattctgtactttctactgtacaaggattacacaacctccattcactgtcactatcacttcaatcagaagaggatgaatttccaatctttatgcagctgtctcagtgcactcatcttcagaaactctctttaaatggaaagatcaagaagctacctgatccacatgagttccctccaaacctcttaaaactaactctgcataactcccacctacggaaggagtctattgccaaactggagagattgccaaaccttaaaatgctcattttgggtaaaggggcatacaactggccagaactgaactttaatgctgaagggtttccacaactgcatattttgcgacttgttcttttgaaagaattggaagagtggacagttgaggaaagtgcaatgccaaggcttgagaacatggttattgatcgctgtgagaagctgaaaaagatcccagaaggactgaaagctatcacttctctgaagaaattaaaaattataggaatgccagtagaatttgaacataaacttcggattaaagatttgttcgagtttacaaatactccagtaattgaatcaactacagacattttggcaattgattag

SEQ ID NO: 36337 - DNA, 351 bp, Glycine max
  Peptide Sequence Number=SeqID_153115
atggcggtgaaaaacagaataatgcattatgcccgaggcagagtttcactctctgcatcgcaacaatcgttcgagttagtaattaggcactcgtttatgggcgagaagctgttcaatcacagatcaggcaaatcccagtactgctcacaaattccacgtcttacggcattcacaattattggaagtcattcccaaagggtggaagggagtaagatcttgcgtgcatggaagtggaaaaacttatcaatgcttgacacttcatcaagcagtatgtacattgtcaacaataaactgaagcaggtatgctgtacaatggagtgccagaacttgaaaatgctccccattccatag

SEQ ID NO: 36338 - DNA, 1482 bp, Glycine max
  Peptide Sequence Number=SeqID_153116
atggcactgttccagacacggaagaggtcttcttcaccttcttacgtatcaacctcgacaatattagtattcatcgcactatgtgtttttggcgtgtggatgctaacctccaacccagtagtgtcacctcaaacacagagcgacgcatacacctcaactcgaaccgccatagatacctctgcaactaccaatgatgaactctcttcctccgaagaaaccgccacaaaaagcgaaagaaaaggaaaggtcaatcctgctgctgtctatggagacaaccctggccatcttcctgatgatgccattaaagccgatgataaaaattccaacaatgagcaacagaagcagcacattgccattagtgactcacagctttctgaggaaagctcgttaactcaaaaagaacaaatcacagctgtgatacatgaatccggttcagacagtgatgtgagaatttctgagcctgagaaaaaggatgaagaaatcgccgcggagcaacaagatgttcaaagttttgacactcgaggaggagggtctaaaccggaggaagatgaagcaaacaaagagcaaccaaacacgtcacaacaggattctgatacggcttcaaaggggccaaaaccagagaagaaaggtggcaagtcaaagaagccgtggtcaacacaagttgatcaatcacaacaagaaaacaagagacagacggttgaatcaaacagcgatgacaagcttgaaggtcacacctggtatctctgcaatgtcactacaggtgctgattatataccgtgtttggacaacgaaaaggctttgaaaaagttgcgtagcacaaaacactatgaacacagggaaaggcattgtcctgaggaccctcctacttgccttgtgccaatccctaaaggttacaaaacacccatcgagtggcctagcagcagagataagatatggtaccacaacgtaccacacaaactgctagcagaggtgaagggacaccagaactgggtgaaagtgaccggagagttcttgacattccctggaggtggcactcagtttattcatggagctctccactatattgattttgttcaagaggctgaacctaatattgcatggggaaagcgcactcgggtgatcttggatgttgggtgtggggttggtagttttggaggttttctatttgaaagagatgttatttcaatgtcttttgcacctaaagatgaacatgaagcacaggtgcagtttgcccttgaaagagggattcctgccatatctgctgtcatggggtctcaaaggctaccattccctagtcgtgtttttgatcttgtacattgtgcacgttgtagagtaccttggcatctagatggtggcatgttgcttttggaattgaatcgagttttgcgaccaggaggttattttgtttggtctgctactcctgtgtaccagaagcttgaagaagatgtagagatatggaagggtaggattacatatctttga

SEQ ID NO: 36339 - DNA, 363 bp, Glycine max
  Peptide Sequence Number=SeqID_153117
atgctcaagtatttcaaccgaggcagggacagccccgccgccgacgcgtcaccgccttcccccgcggcggcgacgccgtcgtactcgtcatcgtcggcgtctccggtgactggccccgcgaggcccattcgcctggtatactgcgacgagaagggaaagttccggatggatccggaagccgtcgcgacgctccaactcgtcaaggagcccatcggcgtcgtctccgtctgcggccgcgcgcgccagggcaagagttttatcctcaaccagggttttgttacgtggatggtttgttcagtggtaattattagtgtctatgccacagtgtggctttctgtgatcaatgtgtctggttttgattaa

SEQ ID NO: 36340 - DNA, 108 bp, Glycine max
  Peptide Sequence Number=SeqID_153118
atggcttctgaaagagaaaggtccgtaggaatagccagatacaggaagggaggaatggctcacattcaattgttcattattattcaattggaacccaaaaagcacttg

SEQ ID NO: 36341 - DNA, 612 bp, Glycine max
  Peptide Sequence Number=SeqID_153119
ggtgtatgaagataatgatggtgtaatatttgaaggtagtaaaaaagcgattcagattaaacgtggaattagtttcaatgctttgaagaaaaaaattggagataaggatgtggctggtggttcaatgtttcattctgccaattcgcttacatcatgtggaaattatttatctaatgatgacacacaaccggcaacaaatatgagcaatttacatattgacgaagacgatgatgatgatgatgatgattatcttgtgtctaactcatacgttgaagagtctttagacgaagatgacagtgttgatggtatatctgatacagacgatgaagtcacaaacattcctcaaccagtaagaattgttcacccagcagaaggtgcacaacgaattgaaaatccattttggaatgatgcctcacattataacaatatcaactggagttatcctgatgaggaggacatttgcggtttggagatgccgtcgacctttaatgttggccaagaattatatgttggcatggaatttgatagtaaagatgcggtcaaaaatgcagtcaaacaatatgttatgaaggtgcatcaaagtttcaaagttgttgaaagcaaatcgaacaa

SEQ ID NO: 36342 - DNA, 1914 bp, Glycine max
  Peptide Sequence Number=SeqID_153120
gattataggaaagatgcattcatggaagcagatctgcagtgctcaaatgctatacagtctatggaaaaaaggctgagggcagcttgtaatgcttctgatgcaaagattgataatgttgctaaggttcttgatgctcttttatctgaatatgaaaaaactattcaaggtccagggaaatggcaaagacttgctgttttcttacaacaaagttttgaaggccctgtgcttgaccttgtcaagaggctaatagctaccatcgaatcagagaagaggtctcatgctttacaatatcggtctattgaagaaaaagtggaccttctgacaaaacggctggaagccactgaaggtgaaaaatccaactacattaagcgatatgaggatgccatcaatgataagaagaaactcatggatgaatataagaatcgcataactgacctgcaagctaatcgtcgctcactggatgagaggtactctagtttattgaaaacactagactctaccaagcaggattccatggattggaaaagaaaatatgagcaagtcttatcgaggcagaaagctgaagaagatcaagctagttctgaaatagcagccctcaagtcccggagtggtgctgctgaagcaaggttggcagcagcaaaggaacaagctcagtctgctcaagaggaggcagaggagtggaagcggaagtatgatatcgcccgtagagaagcacaatctgctttacagaaagcagctaatgtgcaggagcgcacaaacaagcagacacaattgagggaagatgctttaagagaagaattttctggaactttggctgaaaaagaagatgaaataaaagagaaaactgcaaaaattgagcatgctgagaagtgtttaacaaccctgaatttagagttgaaggctgctgaatcaaagataaggagttatgatacagaaatatcctcactgaggattgaaattaaagagttgactgagaagttgaaagctgaaaatgctaaggctcaatcatacgaaagggaagcaatagtatttcagcaggagaagaaccatctagaacagaagtatcataccgagttcaaaagatttgatgaggtccaggaaaggtgtaaaactgctgaaaaagaagctgcaagggctactgaagtggctgataaagcgcgggctgaagcaggcatggcccagaaggagaggagtgagatgcagagactggcaatggaaagactggcacagattgagagggctgagaggagaattgaaaatttggggagggagaaagataatctggaagctgaattacggagagtaagggattcagagaaggatgcacttaccagagctgtgaaactagaggagaaggtgcaacagagagagaaggatttagaagcccttttggataaagataagacacaccggcgaaatagtgcccagattctcgaacagcttctggaaacagaacgcgaagcacatgcacaggcgaataaccgggcggaggctctctctctacagttacaatctgcacaagccaaaattgattctctccatcaagagctgactaaatttcgactgaatgaaactgcattggacagtaaactaaacactgcttcccatggtaaacgtatgagggtagatgacaacattggtgatgacatggatgtaagtcccagaattgtaaagggaaccaagagaacaaggagtacatactcacaaccagaagatggtggttccatctttgagggtgctgaagaaaatcttagtcagcgaacaagtgaggaggattatagaaagtttaccgtacaaaggcttaagcaagagctgacaaagctcaactatggtgatcagctgcttcggttgaagaatcccaacaagaaagagatcattgctctgtatgagaaatgtgttcttcagaagtcatag

SEQ ID NO: 36343 - DNA, 180 bp, Glycine max
  Peptide Sequence Number=SeqID_153121
atgactagagtaatcaaacttctagtcatcaacaagggtaccctcaaaagtgtagaagatgataaggatggtggatttggtgccggggatgctccgttggctccggaccatgacgttcgatgtgccgcagcggatgaggatgaacccttgcacttcttggatgattctaccatttggtga

SEQ ID NO: 36344 - DNA, 411 bp, Glycine max
  Peptide Sequence Number=SeqID_153122
atgtgtaacaatgagaaagaggttgatctggattactgtctcactctcttcatttcgatggatcctaggatggatattggaacattctctccaaatagaatcatagacataaagtttggtgtgggaatttgtttgtgtggaactcatggaacttttacacaagctagaaccttcatctttcctggtttactagaaccgcgtgaggctgaagcatgggaattgctagaagcgctcaagaggacaaattccatgaaccttgcgaatgtcacctacgagctagagtgtaaatcagtggtggatgagataagacacaattcaataggctctctagattttcattgtattttatcaaagtgtagagctgttcttttaactactacaaactcattggttagtctctctaggaggtaa

SEQ ID NO: 36345 - DNA, 1434 bp, Glycine max
  Peptide Sequence Number=SeqID_153123
atgtggggcccgcgtgtcctcaaagggtggccgtcgtgtttcacgcacggcgaatccgccgtgctcattgagttgccgtctgccaccacgcctagagtgctcccacccaagagggtttataagaataacggttacttgatggtgtcgtgcaatggaggactcaaccaaatgagggctgcgatatgtgacatggtggcgattgcaaggtatttaaacgtgacgcttatagtgccggaattggataaagcgtccttttgggctgaccccagtgagttccaagatatctttgatgtggaccattttattacatccttgagggatgaggtgcggatattgaaagagttgcctcctagactcaagacgagagtggaaaatggtttcctttacagcatgccaccgattagttggtctgacatatcatactataagaaccagattctacctttgatacaaaagtacaaagttgttcatttaaatcgaacagatgcccggctggccaataatgaccaacctttggagattcagcggctgcgttgcagagtcaattttagtgctcttagatttacttctcagattgaggagttaggcaaaagggtgatcaagcttctgaggcaaaatggcccatttttggtacttcatctgaggtatgagatggacatgctggcattttctggctgtacacaaggttgcaacaatgatgaagtggaagaattgacaaggatgagatatgcttatccttggtggaaagaaaaaataattaattcagatttgaaaagaaaagatggtttgtgtcctttaacaccggaggagactgccctcacacttagggcccttgacattgatcaaaacattcaaatctacattgcagctggggaaatctacggtggggataggagaatggcaagtcttgcgaagaactatccaaaattggtcagaaaggaaacactgttggaaccatctgaccttcagttcttccaaaatcattcctctcagatggcagcgttggattaccttgtctcattagagagtgatatctttgttcctacatatgatggaaatatggccaaagtagttgagggtcatcgcagatatcttgggttcaagaagacgattttattgaacagaaagctcctagttgatttgatagatcaataccatgatggaatattgaactggaacgaattctcttcagctgtgaaggaagttcatgctgatcgcatgggtggtgcaactaagagattggtgatgcctgacaggcccaaagaagaggattatttctatgccaatccagaggaatgtttagaactatcagatgatatgttgaggagtacatgtttaagatgggtctctacgcagtttagcgaagaggatgacagctatttgtatcacagaggcagtcatatagtgactgttagaatggggaggggggaatag

SEQ ID NO: 36346 - DNA, 192 bp, Glycine max
  Peptide Sequence Number=SeqID_153124
atgccaaagtggcagacaagacaatatgaaaccaacatttacgaccaccgaataagtagattaagtattgaaggattgttatcgtccaatcaagctaagtttggagacagaaggcaactagcctccaacacaatccaaagaaataagccaatccctacacataatttattcccttacgctgtaggaatctag

SEQ ID NO: 36347 - DNA, 600 bp, Glycine max
  Peptide Sequence Number=SeqID_153125
atgtctaatgtggctgccatcaagactatgctacgaagcttagagctagtttcagttcccaagaaggtggtgtctaagctggagggtctgcagcaaaggtttctttggggaggcgatgtgaagcataagaaaatcccatggatcacttgggagacaatttgtcttccaaaggagagaggaggattgggcattcgggaactgaaaaagtttaattatgctttacttggaaagtggcgatggaatttattccactaccaagagggaagatggttcaatgagaatataaaatggagtatcgggtgcagatcaaacgttagattttgggaggatggatggcttgacactggaatctgtatgatggacaaatatcagtgcctttattgtatctcagaacaaagacaacagtttaattatcagatggggcgactggtagatggtacctgggaatggaatctattatggagaagggatcagctggaaagtgaactggccttggcatcaaatttcatggtggatgtggaggctcttggggtggttgggataaggtcttttgtgggtgggatttatcatgctctacatcacagtgttttggcactctaa

SEQ ID NO: 36348 - DNA, 105 bp, Glycine max
  Peptide Sequence Number=SeqID_153126
atggatttcagcgaggtaagtgaaggaaagctaacagcataccacgtagccggagaaactgatggtggccaatgctgcggcgatgacggcgaggagagggtttga

SEQ ID NO: 36349 - DNA, 2560 bp, Glycine max
  Peptide Sequence Number=SeqID_153127
tggccaagctgctgtcatcactccccgccaggtgacttctggtctgggttcccgcagagtgatggcaattgctgcagctaagcatcatacggttatttctacccagggtggggaagtgttcacctggggatccaatagagagggacagcttggatacccttccgttgatacacaacccactcctcgtagagtatcttctttgaggtcaagaattgttgctgttgctgccgcaaacaaacacactgctgtagtttctgatttgggcgaagtttttacttggggttgcaacagggagggtcagcttggttatggcacctcaaactcagcatctaattacaccccacatgtggttgaatccttgaaggggaagactttgaccagagtttctgctgcaaaatatcacacaattgtattaggatctgacggagaggtatttacctggggtcatcgacttgttactccaaaacgtgtagtagttagtagaaacttaaagaaaagtggaagcactcctttaaaatttcaccgcaaggaacgacttaatgtggtttctatagctgctggaatggtacacagcatggctcttacagatgatggtgcattattttattgggtctcttctgatcctgatcttagatgccaacagttgtatgctatgtgtggaaggaatatggtgagcatatcagctggaaagtactggactgcagcagttacagctacaggtgatgtttacatgtgggatgggaagaaaggtaaggataagccccttgttgcaactcggttgcatggtgtaaagaaggctacatcagtttcagttggtgaaacacatttacttattgtggcttcactgtatcatcctgtctaccctcccaacatgattgagaattctcagaaatccaagctgaataacaaggatgatgtggaagagttaaatgaagacattttatttgaagatattgattccagtaacataatatctaatgtgcaaaatgatactttaagccagagatctatacccagcttaaaaagcctttgtgaaaaagtagctgccgagtgtctagtagagccacgaaatgctgtacaactgcttgagattgctgattctcttggagctgatgatttgaagaaatattgtgaggagattgtcatgcgcaaccttgattttatatttgcagtatcatcacatactgtagcaagtgcctcactagatattctggctaacctcgagaggttgttcgaccagagatcatctgagccatggagtcaccgtcggctccctactccaactgctactttccctgccatcatcaacagtgaagaggatgatagtgagatagagtttcagaggactcgtgacaaacccatgaaattggagaaagtcctcaggctagattcttttctacagccaaaggatgatcctaataaagaaatctccaaagtagtccgagctataaggaagaagttgcagcagattgagatgcttgaagataagcagtctaatgggcatcttcttgatgaccagcagattgcaaagcttcaatctaagtcagcacttgagagctcacttgcagagctaggtgttcctgttgagacatcacggtataaagaatcatcttctatgttaccagaagggaaaggtagtaagaagggtaaactatcgaaaaaacaaaggagaaagagtggcaattcaaacatagagcagacagaaatagaatctgtttactctaaaagtgaagccattcccaaatctgaggacctgttggacattgacatcatgggggttcctgattcaaaggtggaagaggatgccgtgtgtgaacagatcagcgcagacgagggtggaaaagatttagcttttgttgtgcagaagaaagatgctttagagttgttgaaagccaagggtccatcaccaaaggcttcaaagaagaagaggagcaagaagggtgggctttctatgtttctgagcggcgctcttgatgaagccccgaaggaggtggctccccctccaccaacaccaacaccaaaacacgagggtcctgcatggggtggggcgaagttcacgaagggttctgcttctcttcgtgaaatccaggatgaacaaagcaaaataaaggtaaacaaaccggctgggagcaaagataaggttgaagatctttctgattttggcagtgggggcaaaataaagttgagttcatttcttccttccagcccaatacctgttacctcgtctcgaagttcccaggtatctgatggagaaataagcacccctccttgggctgcttccggaactcctccccaaccttctcggccatcgttaaggcacatccaaatgcaacagggaaagaaacaacaaagcctttcgcacagtccaaagactacaacagctggattttccatccctacctgtcaaggctcgccgtccgaaacaaccggtgtgagtcgctggttcaagcctgaggtggaaacaccgtcctcaattcgttctattcaaattgaggaaaaggctatgaaagatctcaagcgcttctatagcagtgtcaagattgtcagaaagcaatcttga

SEQ ID NO: 36350 - DNA, 186 bp, Glycine max
  Peptide Sequence Number=SeqID_153128
atgacaagtggcttcgcggatagtggagaccttaacaatgagatcacgacgaagaagagagaacaattgacaaaaaccatgactggcaagtggtggcagacggaggagaccttaacggtgctcagctatacccattccgaatccatgatgagtcgggttgacccaacgggttcagactcactttga

SEQ ID NO: 36351 - DNA, 918 bp, Glycine max
  Peptide Sequence Number=SeqID_153129
atgcagaaactagtatcagtctcaatgaaaaattttccagcttcgtctagtatctccaaggtttttcctcagaaaaactctcacacagaggtagtcatacatgacatgggaccaatagggaagactacacatggtcgaatttgcatgtatcctccacccgaggaacgagaaaggaatacttgcaaaaggaactctaacgctcaatggaaaactcattgtccttttcatgtaactgagcccttttggacttctttgggctatgaagctggcgaaattattgaagctcaaggccatgcaagaggcatttgggttttggttgagaagagtaaattgtttcaagttgaagtattggatacttttcctcaggcagttacgttgaaaattttgaagggaacttcttgttgggtttgtactgccatttacgccaatcctcatctaactcatcatgatgatctttggccttatttgatagctcttcgtcgatgtattttgcaaccatggttgctattgggcgatttcaatgagattgtatcgccattagaggtgctactagttataaatatacctggtataggcgacaagctaatggtcgtgtggccaagtgacttcataaggctttgggagatcaaccatgagttggatctttactactctcaattgcctcgggtagttacagaacattggagctttcccaatcatcctttcatgatgctcaatgtggatggttcttggttggccgatgatgttatgggaggtaggagaggatcatttgtggttcacaagatatcaagaacaacttacaccaccatcctaatcacaaagatgttatttatgacatcaaggatttactacaacactcttgggaggtcatttccgacatactcatcgtatatagtgctaatgaagttgcagatatag

SEQ ID NO: 36352 - DNA, 201 bp, Glycine max
  Peptide Sequence Number=SeqID_153130
atggagttagatcgagctatacaaattgctttatcttttgctagtctcacccctgtcccattcgacttgtgtccatcttgtgtcattgaagactcatgcagatgcacattttccaaagggaagagcatgtggtaccttggcttagtgttggagatgtatgaacctttggctgttatgatgactttgacaatgctccaatga

SEQ ID NO: 36353 - DNA, 297 bp, Glycine max
  Peptide Sequence Number=SeqID_153131
atgcccaatggacaatgtgcgagtgaattgatcaaacaattcgagtcacaaacaaagttttaccaatctatgcatttgtgttctggtaagactactactcgtgatattgatcaacaagccactacccttgggggtcaagtaggcgcaaatggttatgctaaccaagtttttcctgcaaagataggtttagccaaaaggcctcaaaatgttattggccacattggtttgctgaatgcgactccatttatacccctttctaggggggaggggaaattaggccctaaatgtggaagttaa

SEQ ID NO: 36354 - DNA, 681 bp, Glycine max
  Peptide Sequence Number=SeqID_153132
atggaagcttttgaggatgctataagtgatagggttgatgtaatttcttgttccctagggcagcctactccaacagaattttttgaagatgggatttccataggggcctcccatgcaattgttaatgatagaataatgcttactggtggtggcaatgcaggaccagaacctggaactggagctagtctttctacaggcttgccatataagaagttctattctttgatcaattctatagatgctaaagttgctaatgcaacaattgaagatgctcaactatgtaaggctggaactattgatcctaagaaggcaaagggaaaaatcttggtttgcctcctaaaaaaggaggttgatggattaagttatgcagaggggagccccatggcttacatgaccagagcaaaaactctattaggactgaaacctgctccagtaattgcttcattatcatctaagggacctaaccccatccaactatcaatccttaagcctgacatcactgcaccaggtgtggacattctttatgcatggtccaaagtctttagtccaactggttttgcatcagataatcggcggattctgtataataagggtcgggaacttttgcatctttccctcatgtttctggcatcattggccttctcaaaagactctatcgcaattggagtcctgctgccttaa

SEQ ID NO: 36355 - DNA, 708 bp, Glycine max
  Peptide Sequence Number=SeqID_153133
atggaagtagctctttcccctcaagtacaaaagccgaatttgcagacaacaggtcgcaagatttcatgtactggatctcagaaggatctgtggcatgttgttagagaaggatctctaagcgatgtagagctggccttggcatcattgaagaagagtgggggcaatatcaatttgagaaacacttttgggctgactccccttcatattgcaacttggagaaaccacattcccattgtagggaggcttcttgctgctggtgcagatcctgatgcccgagatggagagtcaggatggagtagccttcacagggctctgcattttggttatcttgctgcggcaagcattcttcttcagcatggtgcctctattacactggaggactctaaatctcgaatacctgtagatctcttatctggctctgtatttcaggttcttcgagatgaacacagttcagtggctactgaggtttttagttggggcagtggtgcaaattatcagcttggaactggaaatgcgcatattcagaagttaccatgcaaagttgattcacttggtggttcattcataaaactaatttctgctgggaaattccatagtgtggcactcactgctcgtggagaagtgtatacttggggatttgggaggggtggccgtctagggcatcctgattttgatatacacagattgaatatagagaatttggtttga

SEQ ID NO: 36356 - DNA, 513 bp, Glycine max
  Peptide Sequence Number=SeqID_153134
atgaatgacttgctaagccgcgccatgcgcctgctgtcgcaacgcgatcatagtgaagctgaactgcgccgcaaacttgcggcgcagccgtttgtggcgaaagcccgttttggcagcaaggggccacatgcgccggcatcaccgccggtggttgaagagccggtggatcctgcgctgatcgagcaggttatcgcctactgttaccagcataactggctggacgataagcgtttcgctcacagctacatcggcagccgcagccgtaaaggttacggtgcgcagcgcatccgcagcgaactgatgcaaaagggcgtcgacaaagcgctggtgcaggacgcgctggcggattgcgatatcgactggtgcgaacaggcaaaacaggtggcgcagcgaaaatttggcgatgcgttgccaaccgactggaaagagaaagccaaagtgcagcgttatctgctctatcgcggcttcttccaggaagaaattcagtcaatttaccgtgattttgcgcaatga

SEQ ID NO: 36357 - DNA, 192 bp, Glycine max
  Peptide Sequence Number=SeqID_153135
atggaagagacccagatggcaaaacatcgagtaaagtcaagaacagaaacagaagtgaagaaaaaacggtataaaagaatgcaaagagagaagggaagacagggagagaggagaactaagaaacggtcccatctaggaggggtagtttcggaattgcgggtggtctttacgcttggacagaaaggcccatga

SEQ ID NO: 36358 - DNA, 249 bp, Glycine max
  Peptide Sequence Number=SeqID_153136
atgcagaagtccagaaaaccacaaaggaaaaagaaagaatgccagagttccatgatgatcactctttctactacgatgaggaggagtgagcagccgcagagattgcatgctacagcaatgacgacgacttcagcacggagaacaaaagagttagatgagttcttgaaggttcttagtgcctctcaagattcttcccctcagcctgaggttcttgcttctgctccttccacccaggctcctgcatattaa

SEQ ID NO: 36359 - DNA, 1830 bp, Glycine max
  Peptide Sequence Number=SeqID_153137
atggaagaagaaaccaagaagaaccaatatcacactattcagcaacaagaacgagaagacaatgcaaaatgggtgacccattattctagttatcaccaaatactgttggtgggagagggtgatttctctttctccctttccctagccaaatcttttggctctgcttccaacatggtcgcttcttctctcaactcctacggtctctctctctctctcttaccctttagctttgtgattgtgattttggcttgtgcagcacgtttcgtcttgaaagtttcgaccttggtacatggggtggctaaaataggaagtaaaagtttaacttggttctgtcttccggagtttgtggaagactctcacgttatattctgcacattgctagtatttacagaattgctagtttgtatattctattatgttaagtttttatgtttatcatactcaaggaagcataaagcccttgtacttggattcttcaagaatgcaagtggcatgcttcgagccaatggtgaaattcatgttagtcataaaactacagctccttttaacaactggaacatagagaaacttgctgcacaatgctttttgaaattgattgagtgtgctgacttcaagagagaggattacccaggttacaacaataagagaggtgatagctatagatgtgatgaaccctttccacttggtaagtgctgcacattcaagtttatctacaatcctaaagcaaaacggcaaaaccatgtgaagagaaatcaaatggtggtttctagacaacaaacatgtctcccattacaagagattgaggttgctgtggagcaattaccaacttcagctcatctcaattattatcctcaaacaagtcactttccaaaaatagaggaagtaacgtcaatatttggcttaacaaatagatgcacttcaatcactgggtgtcccttaagtaccatggctgaagtacatggaagagttactccttctggtggctattctgctcctggtatgagtctaggccctacaagaacatttcaaccaatggagccattgcaatctttgcaaccatggccaacatcaactaatgttagatactctctgacagattatgttagaacaattgataatactgttcccatatcacttgaagctagaaatgaaggctatcaggtctacgggggcaggtcaaaatatttgcaagaagaatttggcagaacaatgcatactgttcccttatcgcttggtgctagaaatgaaggctatcaggtctatggtggcaggtcaaaatatttgcaagaagaacttggcggaacaatgcgaactgttcccttatcacttggtgttaggaatgaaggttatctagtctatggtggcaggtcaaattgttttcaagaagaacttgctagaacaacaactcatagagcaagttatccttttgaggaaggtcacaatctgagagatacattgctgaaatggtcaacatcaactaatgctggatatcctatgagagatcatgttagatcaatggatactgctccttcatcacttggtgctagaaatgaaggctatttcagcaatgtctatggtggcagctcaaattattggcaagaagaacttggtagaacaacagctctcagggcaagggcaagggcaagttattcttttgaaggagtaaggtctgactttgagagatacattgcccaagtgcctgggaggttgtttgttcagatgccattgtatcctcctacgtcgcttcttcgtgttcctcttcctctgccatcttcgtcttcctcttccggtttcactgttgttgttgttcgtcttccgcttgaccattaa

SEQ ID NO: 36360 - DNA, 777 bp, Glycine max
  Peptide Sequence Number=SeqID_153138
atgcttacccttccacccccacctcctccccgactcctaaccacaaggcaaaccaaacaagtctctcctgaccaaattgtcatatcaaaactaccaatcaaacaacattctcaagaatcagatgcaccaaattatgttacaacaaagtcaattaggccgccgccaccgccaccaccaccaccaccaatactcaggcaacctccatttcaaaggactaatccaatcatatggtttgctgcagtgttgtgcctcatattcagccttctactcatcttctttggagttgtaactttgatcatcttcctaggaatcaagccaagaaacccctactttgacatccccaatgcaaacctcaatgcagtgtactttgactcaccagaatacttcaatggtgacttcaccctcgttgcaaacatcaccaaccccaacaagaagattgatgtgaggtttgaatcttttgatgtcgagcttttcttctcagacaggatcatatcaacacagtccattgagccctttacacagaggagaagggagagcaggttggagtccttgcacttcatatccagcttggtgtttttgcctaaggatcttggtgtgaaccttaaaggacaggtgcaagggaacagggttaagtacaatgtaagaggaacctttaaagtgagagtaagcatggggtttttccatttgtcttactggttgcatagcagatgccagatagagatgactggtccaccaactggtgtcttggtagctaggaagtgtatcacaaagagatga

SEQ ID NO: 36361 - DNA, 192 bp, Glycine max
  Peptide Sequence Number=SeqID_153139
atggtagacaaggttgtagctgtgggttattatgtgattgttcctgacttcttccatggtgatccctataatcctgagaatgctagcaggtccacccctatttggttaaaagatcatggcagggacaaaggatctgaagctacagaatccataattgaagctttgaaaagtaaaggtatggatggctattga

SEQ ID NO: 36362 - DNA, 304 bp, Glycine max
  Peptide Sequence Number=SeqID_153140
atggattttttcaaaatcgatgttaacgatgctatgttaacatcgttacaaactgcaaatccttgtcttctcgcgctcgcactcagtctttcacagaccctccctcacaaaccccccatactctcaggccttcctttcgccaccgtcaagaccccctactctaagtctcgcaaagccaccgtgaggccgtggtcgcgctttggttgtgtctactgggacattcaccgccgtctaccttgctccatcgctatagctttaggacttgtacttgctatttctttcatccacagaaggagcattgcag

SEQ ID NO: 36363 - DNA, 159 bp, Glycine max
  Peptide Sequence Number=SeqID_153141
atggtccagtctgttgatggtggtggtgctggtgcgctgcttatcccgccgaccaccatcaatggtaatggtgttgtcaataatagtggtgatagtgttggtggcaataataatgttagtgatgtgatagtgataaccgtgtcaggagtgcaatgttag

SEQ ID NO: 36364 - DNA, 2124 bp, Glycine max
  Peptide Sequence Number=SeqID_153142
atggagacccttcctctgaataccatctatgtccaaaacctgttagttatcatcaataggttacacatgttactccactccactgcactagccttcttgttctattacagactatgcttttttttccaaccctcagaaacaagagaaagccacttgttattaccatggttacttgtttttgcttcagagatcattctctccttcatttggatccttgatcaagcttttcgttggcgtcccgtttcgcggtccgtcttcccggaacgattgccggaggatcacaagcttcctgctattgatgtgttcatatgcactgctgatgcaactaaggaaccaactttggatgtgatgaacacagttttatcagccatggcactggattaccctcctcagaaacttcatgtgtatgtttcggatgatggagggtctccattgattcttcatggagtgagggaggcttggaagtttgctaggtggtggcttccattttgtagaaggcacaaaataaagaacaggtgtcccaaggcttacttttctgctttgaaggataatgatgatggtgattttgcaaggagtagtgtgtacatggaagataagcaaaagatcaaggaaaagtacgaggcttttaaagaggagataaagactttcagaaaagatagaaccttttccagagattacccttctgtcattgaggtgatgcaagaaactatcattgatgatgtagatgatgtcaaaatgcctctccttgtttatgtttctcgcgagaaaaagccttctcatccccaccatttcaaggctggagcactcaatgtccttcttcgcgtctcttccgtgatgagtaattctccatacattctagttctagactgtgacatgttctgtaatgatccaacttcagctcgatatgccatgtgttttcacctcgatccaaagatatcctcctccttggcttttgttcaatttcctcagaaatttcacaacattagcaagaatgacatctatgatagtcaactaagatcaatatttacactacaatggcaaggtatggatgggcttatgggaccagtgatttcaggaactgatctgctgcaacttaaagaatactttggttcatctaacgaattcatcagatcacttaatcaaaactacacaagtgatttggtatctggtcagaaatatgcattactagaagaacctcactttttggcttcttgtaactatgaaattggcactaaatggggccaagaggttggtttctcgtatgttagtgtagtagaagactacctcactggatttatcttgaattgtaatggatggacttcagttttctgtgaaccatctaggccacagtttctaggttcagctacaacaaatttgaatgatgtactaatccaaggcactagatggttttgcccccttacatatgggctttcaaagatgccacttctccagagtctatgtttagcatggctcacatatttccctctttattgtttccctctttggtgttttgctactatccctcagctctgtctactaaatggaatacccttgtaccctaaggtttcagacccatttttcattatcttttcattcatctttctatcagctcttctaaaacatttacttgaagtcttcttaactggtggaacactcaaaaagtggataaatgagcagaggatatggatgatgaaatcagttacttgccatctatatggatgtttggatgcactactaaagaaagttggcataagagaagctagtttcttgccaactaataaattagggaatgatgaacagactgtgctatatcaaatggataaatatgacttccaagcatcaaatatctttgtagtgccaatgcttgccctcatcactatcaacatatcttgcttctttggaggagtctacagagtgttattggtgggtgattgtgacaaaatgtttgtgcagcttttcctagcagtttttataattacggtcaactaccccatcattgaagggctgatgataaggaaggacaagggacgaatttctaagttagttgctatacctgttatcttggctactgttgttcttttggcattttttaaactactaggaatgcatagtatgctctactag

SEQ ID NO: 36365 - DNA, 903 bp, Glycine max
  Peptide Sequence Number=SeqID_153143
atgttatcctcccatggaaggaaggttcagaaatttgggaagcctgttgcaaagattgaagggttagttgcttccacgggattaagtcctctgatagcatgtttcttgaacactggcgatcgaggacttatatcggcttttgcagagaggtggcataaggaaaggagcagtttccatcttcctgtaggagaggtgaccatcaccctcgatgatgtggcctctttgcttcatctccctatcacatgcgcctccatagctttgagactctttatgttgacaaaggttgttacttgttggatttataagcatttttcatctgttgctgaggctattattgctgaggattatcatgaaaggaaaccacgtgcctaccgttggacctttgggaagacattaccagtgtcgatgtatcagaagtgtctagatcgattgacgtctgatggtatttgttggatgccttacagtgatcaccgtgtggttaaagagtttgagctgatttctttgttttttggacatatccgatgggatcctgttgttgtcatacaccgaccagagagggttgtgcagcagtttgggtatattcagactattcttctacactctctaggttcaagattatgcttagaaaatattgaaaacagatggatgcacttctttgagtaccttgcaccggtaggtcagatttgtgttgtgcctggacagtgtgcatcagaatacattgactggttctacatgatttcacatcccttcatgaggctggcacaacctagggatccagtcagacatccacttgtcgtgcaagatgaaacatatatggaactagatatttctcaataccttgtggcggcaacagtgatggaggaagcacctacacatgaaccttttcatgtggagcagctttga

SEQ ID NO: 36366 - DNA, 777 bp, Glycine max
  Peptide Sequence Number=SeqID_153144
atgtgggaaacacttcctcaggttttgtatttaaacctctctcataatcacatccatggtgagagtgggactacattaaagaatcccatatctatccccgttattgatctaagctcaaatcacttgtgtggtaaattaccctatctttcaagtgatgtgtctcagttagatctttcaagcaattcaatctctgaatccatgaatgactttttatgcaatgatcaggacgagccaatgcaattacaatttctgaatcttgcatcaaataatttgtcaggagagatacctgattgctggatgaattggacatttcttgtgaatgtaaatttacaaagcaaccattttgttgggaacttaccccaatccatgggttccttggcagagctgcagtctttacaaattcgtaacaacacactctcaggaatatttccaaccagtttgaagaagaataaccaattgatatccttggaccttcgggaaaataatctttcaggaagtattccaacatgggttggagaaaagctcttaaatgtgaaaatcctcctccttcgatcaaacagttttaccggccacattccaaatgaaatatgtcagatgagtcttcttcaggttttagaccttgcccaaaacaatttgtctggcaatataccgagctgtttcagtaacttgagtgccatgacactaaagaaccaaagtacagatcctcatatctattctcaagcacaattttttatgctttacacttccgagtatagcatagttagtgtgctactatga

SEQ ID NO: 36367 - DNA, 222 bp, Glycine max
  Peptide Sequence Number=SeqID_153145
atgcagcacgtgactagccagcaggcgcctaatcatagaggacagagccaggacccaggtcctttcccttggcctacccccaagcaattcaaggccacaatggcctgtattggcgatgagaccaattttgagacacgggcaggacccacaagggcccatgggggtgacgaaggagctcaggaggattacaacatggctgacgtgttggacttcttcacttga

SEQ ID NO: 36368 - DNA, 1005 bp, Glycine max
  Peptide Sequence Number=SeqID_153146
atggcgggtttattctcactaggaggtagtagaggtaacaccaatccccaagaggaaatccctcctccggataccttattctggtgtaacaagaatgatgacgtttcctcttaccaccgaggtagtagcggctttgagctatggaaccagcaacagcttcaacatcagcaacaacagctcatgggccatgaccctcctccgcagccgcgccctctctttcaccaagatctctactccgcgttgggcgttgggcccagcaggcccatctctgacgatcagtcgtcttcgagatccagtttccttcttggagcaagcggtggcggtagcgcaggaggagggattagctgtcaggactgcgggaaccaagctaagaaagactgccctcacatgcggtgcagaacttgctgcaagagccgcggcttcgattgccaaacccatgtcaagagcacttgggtccccgcttcacgtcgtcgcgaacgactacaacaactttctgcgttgcaacaacaccaacaacaacaacaaaccctcgaacctgcttcttctgctggaggagaccttcccaaaaggcacagagcgagagatcatcatcattctcctctcgcctgcactcgcttcccttctaacccctcctcctcagggttagaggaggtgaatttcccggctgtggtgaggtctgctgcggagttcagatgcgtacgtgtgagttccatggacgaggaggcggaggaggagtacgcatactcaacggctgtgaacattgcaggacatgtgttcaaaggaattttatatgactatggtccagaaggtatgaacactaattacatggatgctgttgctgctgctggggaaagctcttccaccggtgttggtgccttgaacctaaccactggtgccattgtttcggagccactcggagttgatccttcttccttgtatccggctcctcttaactccttcatgcctggtagcggtacgcaattcttccctcacccacgatcttga

SEQ ID NO: 36369 - DNA, 288 bp, Glycine max
  Peptide Sequence Number=SeqID_153147
ggcgtggtgaagactgaaaagaaaagttcagtgatgcatggtgcagttaatgggtggcattcgcaatggcatttctctgagtataaattacaccgtacggctcgaagtctctgccataaggctcatgctcatgcgctggaagataaaagggacaatgtgtcacgaaaagcagcgggttttccggtaggaaaggacgaaaggcgcagaaagctgttttgtttgacacgtggcgggatgtggaacgtaggatggggatgggaattagtatgggccgtggagatgagatga

SEQ ID NO: 36370 - DNA, 387 bp, Glycine max
  Peptide Sequence Number=SeqID_153148
atgcaaacagtttgttgcttcacaggattgaacgcttccaacagactgaagactaattggttaattaagactttcagcattaaatttgacaaaaccctcactcactcggcggcacacacaaaaccctttctcagtcactcactcggcaaaagagaagcgtcgacggtctgcacacggtgggtgcttcatcgacggcagcgacctgtggcggaggacagggttcccttcgctcttggagttcgcatcgggcagagaagcttctctgcattgcgctgggacgcaaaacccttgcagcaatcagcaccacggcacaacaatcagagtcttgagcttaaggttttgcttcgtctccgagtggttaactcatttcgaagtccgtttgattaa

SEQ ID NO: 36371 - DNA, 2052 bp, Glycine max
  Peptide Sequence Number=SeqID_153149
atgaggaagcgggatttggccattcttatgctctccgctttcgctattttcttcactcttcagcaagatggtggtatttcgttcaaagatgcgtggatgcacctaaccgatgaatatccaatcaaatatgaagccgaacgccttccgccgccgctcgtcgctgatctcaacggagacggcaaaaaggaagttcttgtggccactcacgatgctaaaattcaggttttggagccccatagtaggcgcgtcgatgaaggattcagtgaggcacgtgtgttggctgaggtgtctttgttacctgacaaagtacgtgttatgactgggagacgccctgttgccatggccaccggctatattgaccggtataaaattgggcagccacagaaacaggttttggttgtggtaacatcgggttggtctgtgatgtgttttgattccaaccttcaaaagttgtgggaaaataatttacaggaggattttccacataatgctcaccatagggaagttgcaatctctataagcaattatactctaaagcatggagatacaggattgataattgtcggtggcagaatggaaatgcagccacatctgttgattgctttctactttcagatttttatggacccttttgaagaaatgggtatgggtgcaaggtttgctgagcaacatcaaagaagtgctgctgaaaaggaggcttctggaactgtggatttacgacattttgcattttatgcatttgctggtcgatctggtgatgaacgatggagcagaaaaaatgagaacattgaagcacattcttcagatgcatcacagttacttccacagcataactacaagcttgatgttcatgctctgaatacccgtcaacctggagaggctaggagagaagatactttatttaagcttgcccacttcaggcggcacaagagaaaagcattgaagaaaacacctggaaaggctataagttacccttttcacaagcccgaggaaaaccatcctccagggaaggactcaaccaaaaaaatttcaaacataattgggaaagcagcaagctatgctggttcagcaaaatctaagaagcaccttccttatgttcctaccataaccaactacactcaagtttggtgggttcccaatgttgttgtgtctcatcagaaggagggcatagaagctcttcatctagcaactggtcgaacaatatgcaagtttcatctccaggaaggtggtctacatgctgatgttaatggtgatggagttctagatcatgtgcaggctgttggaggaaatggtgctgagcagactgtcgttagtgggtccatggaagtgctacgtccttgttgggctgttgcaacgtctggtgtaccagtacgagaacaactcttcaatgtatctatttgtcattatacccattttaacttattccaacatggagaactttatagaagctacagtcaaggttcagatactgcttctttagaggtagcaacacctattctaattcctagaagtgatggtcataggcatcggaagggaagccatggtgatgttatcttcttgacaaatcgtggagagattacatcatactcccctggcttgcatggtcatgatgctatttggcagtggcaacaatcaactggtgttacatggtcaaacctaccctccccatcaggaatgatggaaggtggtctggtgattcccacactaaagcctctttccttacggttgcatgataatcaagaaatgatccttgctgctggggaacaagaagccgtgataatatcacctggaggtagtatattagccacaattgaactacctggtccaccaacacatgtcttgatcactgaggacttttcaaatgatgggctcactgaccttattcttgtcacctctcatggagtatatggctttgttcagaccaggcaaccgggtgctctcttcttcagcatgctggttggctgtctcatagtcgtgatgggggttatatttgtcacccagcacttgaattccacaaaggggaagcctcgtccctcatctggtccacggtga

SEQ ID NO: 36372 - DNA, 615 bp, Glycine max
  Peptide Sequence Number=SeqID_153150
atgggcaccacctggcctcctaggtcctactcctgcaccttctgtagaaaggagttccgttcagcacaagccctcggcggccacatgaacgttcaccgccgcgaccgcgcccgcctccaccaagcctcagtaccccacaacaacccctctttttctcccacaccctcttttcttaacatctctcatcaggagccttttgttgcaaatgggggtttgtgcctcttgtacccctttccaagccctaataacaatgctccattttcctctctaggccacaacaataatgcatgtggtgactcaccttccactgcttattcagtttcttcttctcattcccttcagtaccctccaatgagggtgcctagttgctcagcttctacttcctttgatttctctgtggctcagcctgctcctcctgctgtagggaggaataataatggtttctcttcttcttattctgggaaagtggaacaagaaccacccacaaacgactcttcaacccatcatggtgcacctggagcagcaatttggttggaagagatggtgaagaagagaaaggagaaaggtgcacctaggacagtgaagaagaggaagaagaagacaagccatatgtga

SEQ ID NO: 36373 - DNA, 741 bp, Glycine max
  Peptide Sequence Number=SeqID_153151
atgaagtgcagatatgagagtgtgcacttcaacaggattgatggtctggctaaggtccttggagtccttgcttctgttggaggagcttcaatcattaccctttacaagggacctgttatttatactccgcgtttagcattacatcaggaacaatacttgtctgtattgggggatgccacaggaaagaactggaacttgggtggcatctatctctttggtcactccttatgttggtctggttggattgtgatgcaagcatttgttctgaaaaaatactcagccccactcacagtttctgcttttacatgcttctttggtgttgtgcagtttttgacaattgcagccttttttgagacggattccaaagcctggcagttcaattctagtggagagatcttcagtgccttgttctcgggactggtgacttcagggctggcatcagcaatacagatatggactattggcaaaggagggccagtgcttgcttcaatttatctacctttacaaacattacttgtatctgtgatggcatcttttattttcggtgaagaattcttcttgggaggcattattggagcattcttaattatatccggcttgtaccttgttgtctggggaagaagtcaagaaaccaagtatgccaaagaggtcatagtccccattgagcccaagaatcattgggaagaaaaaagtgacagttctttcctcatccaacgattgattactacacaaagctcttag

SEQ ID NO: 36374 - DNA, 471 bp, Glycine max
  Peptide Sequence Number=SeqID_153152
atggcaggctcctcggaggagggacaagtcattagctgtcacaccgttgacgcatggaacgatcaactccagaagggcaaccaatccaagaaactcagagatatgattttctcacaaccccaaggcagtgtgcgtgtgcatgtgatgggtgcagagaagagagctacaaagaggggaaaaaaggaagagagaaaaatgagagatattgttgtggattttactgcttcttggtgtggaccatgccgtttcattgcaccattcttggctgagctggctaagaagttcacaagtgtcgtattcctaaaggtggatgtggacgaattaaagagtgtttctcaagactgggctattgaggctatgcccacttttgtgtttgtgaaagagggaacacttctaagcaaagtggtgggagcaaagaaggatgagctgcagcagacaatagagaaatatgtggcttcagctagtgcttaa

SEQ ID NO: 36375 - DNA, 399 bp, Glycine max
  Peptide Sequence Number=SeqID_153153
atgggaaggagccttatcattagtgcatttatggcaacttctttggctttttcttgcttttctacggcagctttagttgcaaggcgtagggagtacctctaccttggtggtttgctttcttttggactgtccattcttcaattacactcttcaagtttgaggtttgtggttgcattcagagaggaattctataagctgtacttgccgactttgggtgacatcaaggaaatgctgctgcactttgggaatctgttcattttcccatatggttcctttttctccaattttcaacaaatatattcaagggaaatgaaacaccggaaagcgcatcgagtcatcaagtatttaaaattaaaacggagtgatccgagtatcgaactcagggaacttgcttattag

SEQ ID NO: 36376 - DNA, 652 bp, Glycine max
  Peptide Sequence Number=SeqID_153154
atgaaaacaaaaaactggcatagagactctgaagttgataatttggtgccttgttcaacgacaatagagataatcaagtatttgcagaggacacagcattcggcggcgaatccagccggtggccgtggctccttcgtgtcatcgttttcgccgtattttattggtacattcacattcctccgttcgggcaatttcgtcgttgtttcagcctcaccaggtactgctacattgcgtgcaatggatcgacagcgtcatttcgaaggaaatagatggaaacgtttcaagaaagaattcgaaattccatcacactgcaatgacgatgcaattcatggcaacatgatgcagagcattctttcggtggtgatgccaaagaaaagtcctcaaattaaccaagaggatcagcaagaacacaagaaagagaaaagggcaaataaaaaagaagaagctgaaacctcaaccaaagaggcaatagctgaagaagatatggctcatgcagaagagtaccagcagtttgaagaaaattataatcacgtggggccgttaccacaggaaactactagagaagttgccctaaaattcatgcttgtgatggttctgatattggttatagcaagttacctagcagatgtaagcaaaagcctcatggcccaag

SEQ ID NO: 36377 - DNA, 645 bp, Glycine max
  Peptide Sequence Number=SeqID_153155
atgtctgtagaacctccatccaactcggtggccgtcgcagacggacgatcaaagaatgccatgaagcccaaatattctagattctcacagcaagaacttcatgcatggcaaccaattctaacacctagttgggtggtggaagttccattccgatatgatgatgaatgccttccacctgatcataaaaatgatgcagtggcatatattaaagacttcgggtcaaacaaaacttgcaccatgaaattgactgtagttaagaatgaattgaaggcccctgtttatgtctattatcagcttaagaacttttaccaaaaccatcgccgatatgttaaaagtagagatgatagacaactgaggagtaaagcatctgagaatgatgtaggcacatgtagtcccgaagactatacaccaaatgacaagggccataaaccaattgttccatgtggccttattgcatggagtctatttaatgacacatacaaactttcaagcaataacaaggatttgatgatcaacaaaaagaacatagcatggacgagtgaccaaaagggaaatttgggtccaaagaattttcaggctggaggtttgattgggggtgctagacttaaccagagcttaccgagaggatccagcttgcgatattga

SEQ ID NO: 36378 - DNA, 302 bp, Glycine max
  Peptide Sequence Number=SeqID_153156
ggttcaattacgacaagacgaagcacaacgtggtgaaagtgaatgggacagaattccaggagtgcagcttcacggcaaacaacgaggtactttcgagcggaaaggacagcatagtgctgaaaacggaagggaagaagtggtacgtttgtggcgtaggaaaccactgcgctgctcatcaaatgaagtttgttatcaacgttgaagcccagggtcctgctcctgctcccacttcttctgctccttctctagtttcatctctatttggactcctcttccttgccatcgcagccatctttgcttga

SEQ ID NO: 36379 - DNA, 231 bp, Glycine max
  Peptide Sequence Number=SeqID_153157
atgaaagtcaaacaaaagtattatgcaacagatacactagattcaagcttacatgcaatgtggtaccatttttcagtgaaaaatctcgtcgggcgcctaggagtacatgacaagacatgtcttataatggagagaccagtcagggccactttgttttgcaagaatcctccaactatgtgggatcagcacaagcttaaaggagcacttcaaaccgggtgtatttacctctaa

SEQ ID NO: 36380 - DNA, 1005 bp, Glycine max
  Peptide Sequence Number=SeqID_153158
atggtcccagggaagtttgagaaagaatcctttgtattccctcagtatggtttgaatagtcttggttggatacgtggtgcgttgttggaatcaattcaacaagttatccaagcacgtactaagtctaatttagtcaatgcaaggtctttgccaatggatactaagtcggctgtagaattaatggagtcttccgcagaggttcatttttctggatttcacatggatggttttgagcaaagaaaggctagcatagaacaaccaacaacctcagaaactgacatgtataaacaaccttttgtcataggtgttgctgggggtgcagcatctggcaagacaacagtttgtgatatgattattcagcagcttcatgatcaacgagttgtacttgattctttttacaataacttgacggaggaggaacttacaagagtacaagattacaactttgaccatcctgatgcttttgatactgagcaattgctacgcgttatggacaagttgaagcatggcgaagctgtagatattccaaagtatgattttaagagttacaagagtgatgacatgttaagaagggtgaacccttcagatgttataattttagaaggcatccttgttttccatgatccacgtgttcgggagttgatgaatatgaagatatttgttgacacagatgctgatgttcgtttggcaagaaggattaggcgtgacactactgagaagggtcgggatattggagcagttcttgatcagtattcaaaatttgtgaagccagcttttgatgactttattcttccaacaaagaagtatgctgatataattataccccgtggaggagataatcatgtggccattgatttgattgtacagcatattcgcacaaagcttggtcagcatgacctgtgtaaaatatatcctaatttgtatgtcattcagtcaacttttcagttaagccatcttgataattgctactatgcagatacggggtatgcataccctgatacgtga

SEQ ID NO: 36381 - DNA, 166 bp, Glycine max
  Peptide Sequence Number=SeqID_153159
atggcttctgcagctcgcttgaccttctttgccgtttccatggttttgctttcttcagttgccatagcaactgacttcactgtgggtgatgggactggctggactcttgacttcaactacacagcgtgggcacaggccaaacttttccgtgttggtgacacccttt

SEQ ID NO: 36382 - DNA, 163 bp, Glycine max
  Peptide Sequence Number=SeqID_153160
atgcaagtcgcaggagtcattggtgcatttggcgacgaggtgacacctgggactggtctcgtcagtggtgttagcgcttttaggcagggtggcaactttaagcagttgaaaacgccagtgctactggcgatttgcgctgcagttggagtagccagtagcactg

SEQ ID NO: 36383 - DNA, 960 bp, Glycine max
  Peptide Sequence Number=SeqID_153161
atggactacggagtgaaccagatgctggatagccatataattagatgtaggactaggagaccaagaaagctggcacaacctagtgggaaaaaggctttggtggtggtggttgtaaatttgtgttgtgggatgaaaataagggctgatgatccagctgccatgaaagatttcattcttagtattcagaatacatcaaataagttgaaggcttcctctggagatgacaatgaaaagcaaaatagtaaaagaatggagttcatgcttgaaatcgtatgtgacatcaagaataacaaaagaaagccaaatgaggactctgcacatcacactcggattaagaagtggttacaaaagggagtgtctttgacagttgaaattcttggcttgttgaaagacagtgttgagttccattcttacgatgcgagtagtttcagaacagatgatcttgtaaaattttcaaagttgagagttgatgacattttgattagagggtttaaatggagcaagttacttgatcctgacaagaagggccaatggtggttgtctggggatgtggcttcttcaacaggtaatgttgaagaagttgccaacagaatagacaaggatgttcatgaaacccaaagaatgcttcagctcgctgctgctcaaaagatgaacacagatgcccgaagggcaatcttttgtataataatgagtggggaggactatcttgatgcatttgagaagcttctaagattggagttaccaggcaagcaggacagagatatcatgcgggttcttgtggagtgttgcttgcaagagaaagtttttaacaagtattatacagtgctggcttccaagttatgcgagcatgacaaaaatcacaagtttactctacagatgcaccttatgcaagggtttgcatgtccagtaccaaaagaaaaagcacttttctccctcctgccaaaacagcaaaacctttaa

SEQ ID NO: 36384 - DNA, 315 bp, Glycine max
  Peptide Sequence Number=SeqID_153162
atgtcattctctattgtgattcacagtatgggttcatgggtaaatgaaccacaattgtattataaggggggtgaggtgcatgtaattcatggattggatgctaataaatggtcatactttgaagctatgaggctgctaactgaactaggtgataaaggagatggtgatctggaagtgtggtggaaagggaagggaactgattttcatagtttaaaagatcttgtgttggatcaggatgctatggacttgaccaattatgttctaactcacaactgtgaagttgagatatatgtgcaaatgggttgggtgttctag

SEQ ID NO: 36385 - DNA, 192 bp, Glycine max
  Peptide Sequence Number=SeqID_153163
atgggtaataaagaggtgattgaggaaaatccttttaaaagtcatcatagagatgcagaatatgagaataggctatggactttattctcaagatgtcatggaatctccaagaatgttggagtgtctatctcagcaactatcacagtagctgatggtaacatgtcatcattcactgttgttgaaatcacttag

SEQ ID NO: 36386 - DNA, 336 bp, Glycine max
  Peptide Sequence Number=SeqID_153164
atggatttgtggaaagcatgttatgcttggcttcaagtatccactgttttgcctaattctcctaaactgcactttgcacaacatatgcagcttttaaaatctaagcaagagcaagaatggtggatggttgtatgggtggcagtcgtgtggaatctatggaaattgagaaatgaatgtatcttcaagggagaggtgtatttgatgcacagtgtagttgattctccaagagagcaactattttcatccctactctcccttaattcaacaaatttgatcacagaattgtcttccttatttatcatcgcttatgttagtaaacacaatgttagattatag

SEQ ID NO: 36387 - DNA, 1074 bp, Glycine max
  Peptide Sequence Number=SeqID_153165
atgggtactccaaacggaagagcaatgtgtaagtctgacgatgaagttccttttgactctgaaataaattttcacctgtcagaatctattctggtggatgtacgtggatcacattctggagaatctcagactgctcgtcatgaaacgttggcgggtattatttacaagagcatacgagttgtagttttttctaacaaactcaacttgcttatgccttttgggcctcttgcaattcttgtgcagaagttgactggccatcttggttgggtctttggtccgagtttgttgggtatagtgcctctggcggagcggttaggttatgctactgagcagctagcattttacaccggagatactgttgggggtcttctaaatgctacatttggaaatgcgacagaattgatcatctcaatatatgcattaaaaagtggaatgacacgagttgtccagctctctttgctgggttcaattttgtccaatatgttactggtgcttggatgcgcattcttatgtggtgggattgttaatcacaagaaggaacaagtgtttaacaaggcagctgcttccgtgaactcaggattattgctgatggcagtcatgggcatactttttcctgctgttctacactacactcacactgaggtccgtgttgggaagtcagagttgtcactttcaagactcagcagctgcattatgcttgtggcctatgttgcatacctattttttcagttaaaaagtcaaagaagtctctatgtctctgtgaacgaggatgagagtcagaatggaaacaactcaaatgatgatgaatccccagatatttctaaatgggaaacactaatctggctttcggttatgactgcttggatatcaatcctgtcagaatatttggttggcgctatggagggagcatctatggcatgggaaattccagtagcatttattagtgtcatattgcttccactagtggggaatgcagccgaacatgccagtgctataatgtttgccatgaaagataaacttgacatttccttaggagtagcaattgggtcatccacacagatatctatgtttgtg

SEQ ID NO: 36388 - DNA, 741 bp, Glycine max
  Peptide Sequence Number=SeqID_153166
atgcaagataatgcacagattgtgtctgggtcagtaatggtggatgggaatttcatagaaggggttttgtctggcagaaagagggttggatacatttctatactcttctatgcttcctggtgtcctttatcatgcagaatgcttcctgaatttgagattcttagttccatgtttcctcaagtacaacatgtagcacttgagcaatcatctgctttgcccagcttatattcaaaatatggaatccatagcttacctgcaatcttactggtgaatcagacatctagggtgagatatcatggtccaaaaattcttaacttccttgtagaattttatgagagaaacacaggattagaagccaaggacaatgctgttgttggtcaactgagcaatttgatgagtgatgaacattcaactatgaagggcttctccctcaaagaaatatttaacagggaaccttacttggcattatctatattgtttttctgtttaaggattattctatttgtattgcccacgattatgtcacgtctcaaagaattctggacttcctatgcttctcatttgaacatgcaaatatttggcgaggtgatggaacgtgttcttaatgtaattgatgtcaagaggatttggaccaagctaagactatacaagaccaggaactttcatgaaagggtgaggagtgcccgggtttgggcatcatctctggcttctgtttcccttggtgactcatcagctaggtga

SEQ ID NO: 36389 - DNA, 192 bp, Glycine max
  Peptide Sequence Number=SeqID_153167
atgactcgagaaacatggaaaatagttgtcagaattgttaatatttggagtaggaggaatacatcacgactaatactagacatgatttttatggataaagatatgcaaaaagctgttgaaatagaactcctgaccaaatttccatatggaggcatgtatttagtctgttacattgcttttgaggaggtctga

SEQ ID NO: 36390 - DNA, 732 bp, Glycine max
  Peptide Sequence Number=SeqID_153168
atgagccacaggaattatattaacttagaagaaaagttattggatcgaccaatatacagaattatgcctattacccgtcttcttcaattactcgatgaaaaaaaattaacattagttaaacctaagaagtgggatgacccttttgaaaatgcattattgagttgtgaatttgagatttcaggagaagaggtagcctccttctcagcaaaagatggagtatatggtcaatgctggacattccatcgtgaaacggatgcgatgtggagaatatattctcctgacaaaactggggtgagagtcacaactacaccaagaaaattattgactgcactacaaaattcgcaaccaacacatcatcactttacttgttttattggtaaagtgtcctacctttataaaggagatctattagagaaattacaatctattgatgtttttaatactgatggctcaggcatagcagaatcattactttacaaaagaatagaatttagacatgagagagaaattcgcttaatttattcaagcagtgaaaatgaaaacccaaatgatgtttatcaatttgatattgaaccaatggagttattagacaggattttatttgatccgagaatggataaaaatttggtcgaagcttataaattggcaatagctgctaaaggttgcaatactgagataaggagatctactttatacgatgcaccaaaaggtcttaaattcaagttggcatga

SEQ ID NO: 36391 - DNA, 276 bp, Glycine max
  Peptide Sequence Number=SeqID_153169
atgcaaactcagttttatactggttcggccatgccctatgcctacgtccagtccccaagtaacccacttgagatttccaccaactttgtaaattcctttacaacttctgaaccacccaaggaaaaaaaggaatctcatgaagacagtacaagtggaggtttcaatctcttctccgtctctttgacgtttggaaattctatcggagcagtcggaggaataactggaggatctcaggaaccgctagagatgctgctatcgctggctgaagacacgtga

SEQ ID NO: 36392 - DNA, 303 bp, Glycine max
  Peptide Sequence Number=SeqID_153170
atggaagaagaagaagaagaagaagaagaatacatctggggtgcttctggggtaatgtatagagccagaaaaaaggattctcctttggccattgatgaggatggcttttctgtcgtaggtaacgctacagtgaacctgctcaagctgaaaacccaaccacaacgccaaacaaaagaatgctgcaaattgcattttggaaaccaaggtggtttccatgttttccctaccactctcgaagaaaatggagaatggagagagagagagagagagaggaaagaaaaaagggtgttgttgctgctttga

SEQ ID NO: 36393 - DNA, 1080 bp, Glycine max
  Peptide Sequence Number=SeqID_153171
atgtttgcgaagcgcatcaaacatgtgcatgagagtggcagcatgcttggcgccactagacgcgtggttggattcattcctcggaggttacgatcggtgcggcaagtgcatggagatggggatggcgaagaggctctacgtttccacaagagcagaggccaacacattctcatcaaccctcgaattctggacaccatcgttcggagatccgcgataaaccccaccgacacggtcctcgaaatcggacccggcaccggcaacctcaccctcaagctcctcgaagccgcgcacaaggtcgtagccatcgagatcgatcaccgcatggtccaggttctcgagaagcgcgtcctccaacgtggcctcaaagataagctcagggttatagaaagagatgcaatgagagccccgttcccgcggtttgatcttgttgtggccaacattccttaccggatatcttcccctcttgtgattaaactggtgtatggagcaacgccgtttcggagtgccacgcttctgctccagaaagagttcgctcggaggttactggcttgccccggtgactccggtgggtttaaccggttgtcggcgaatgtgaagcttgtggctgacgtggagcttgtgatggatgtaagcaagagggactttctcccttcacctaaagttgattcttctgtggtcataattcgccccaagcatcaaattcccaatgtggatcttcatgaatggaggtctttcaccaggacttgttttagtagtaataggaacaagacactcggggcattgtttaagcttaaggggaaagtttttgagttgtttaaaatctccaatggaaatgatgaatgttctctccacaagggtgatgaggttcaagacgaaggagggttgacctcgttcaaggaaaagattattggagtggttagaacgggtggctttgaagataaaagacctgcaaaactttctctccaggagcttctgcatttgctctctttgttcaatcaagctggcatttattttaatcaccgtggacgtcacaagattgaagatatgcttgacgacatgatgaatagtgcaccctgctga

SEQ ID NO: 36394 - DNA, 1264 bp, Glycine max
  Peptide Sequence Number=SeqID_153172
gtacgggaatgtgtttaagacatgcattttgggaagcaatgtgatagtttccactgacccggacgtgaacaaggtggttctgcagaaccaagccaataacttcgtccccgcttatccaaaatcaattagagaattaatgggagaacaatccatactcaaaatgaacgggaccatgcataagaaagtgcatacactcatcgcagggttcctacgatccccacaactaaaagctcgaattaccagagacattgaacacactgttaaacaatgcttcgcttcttggacgccccaccaaccaatctatgttcaagatcaagtcaaaaagattacatttcctgttttgatcaaagttctgatgagcgttggtcctggtgaagatttggacttcctgtatagagaatttgcagaattcatcaaagggttgatttgcttacccctcaaatttccaggaacaagactatataaatccttgaaggctaaagataggatggtgaagatggtgaggaatatagtagaggagaggaagaagctacagaaggataataatgcagatgatcatggtgatacagtagcagtagcagtgaatgatgtggtggacgtactattaagggataaggttgactcgaactctagctcacgtttgactccagaaatgattagccaaaacataatagagatgatggtaccaggggaggagactcttcctacggctatgaccattgccctcaagttcctcagtgactcccctctcgctctatccaaacttcaggaggagaacatggaattgaagaggctgaagactaattgctcagatgattatgcatggactgattacatgtcactgccatttactcaaaacgttatcagtgaaactctcagaatggccaatattgtcaatggcatttggaggaaatcggtcaatgacatagaaattaaagggtacctaattccgaaacactggtgtgttatggcatctcttacctctgttcacatggatgggaagaactatgaaaacccttttaaatttgatccttggagatgggagaaaattggagttgtggccggtaacaactgctttaccccatttggtggtggacatagactatgccctggattagaactctccaggctagagctatctattttccttcaccatcttgttactacgtacagatgggtcgctgagagggatgaaatcatctactttccaactgttaagatgaagaggaagctcccaattagtgtgcaacccattaacgcatga

SEQ ID NO: 36395 - DNA, 150 bp, Glycine max
  Peptide Sequence Number=SeqID_153173
atggctcgcgtgaggggaccaaagcttttgatgctccgccaaccactccgtaaggtaccgatcgaaactccccaggatagattaggcatcgaacaaagcagcgctttccgcttgtcccgggctaggttaaggacgacgacctatcggtag

SEQ ID NO: 36396 - DNA, 1251 bp, Glycine max
  Peptide Sequence Number=SeqID_153174
atggctgagaggttaaaggagaagatacttgattcagacaaaatggttgatgttgtttgtgggcctgatgcttacagggatttgccgcgattactggaggaggttgactatggtcagaaagggatcaatactctcctttcgcttgaggagacttatgctgatattaatccagttcgaatctccaagaattcagttactgcatttgtctcagtgatgaggggttgcaacaatatgtgctcgttttgtattgtaccttttaccagaggcagagagcgatcacgtcctgtggagtcaattgtgagagaggtggcagagctttggaaagagggtgttaaggaagtaacacttcttggccagaatgtgaacagctacaacgatgcatctgaaattgagagaaaggttgaatcagggtccaattggaaacttagtgaaggattttccagcatggctaaggtcaagaatatgggcttaaggttctctgatctactggatcgattgtcctcagaatttcctgagatgcgattcagattcacgtctccacaccctaaagattttccagatgaattgctttatctaatgcgagaaagacataatatatgcaaactgatacatttacctgcacaaactggaagtagcccggtacttgagagaatgagaagaggatatactcgagaggcgtatttggatcttgtccaaaaaatacggagtattattccagacgtggctttgagcagtgatttcatttgtggattttgtggagaaacagaggaggagcattctgagacgttaactctagtaaaagctgttggttatgatatggcattcatgtttgcgtatagcatgagggagaaaactcatgcccacagaaattatgttgatgatgttcctgaggaaataaagcagaggaggctagctgaacttattgagactttccgtgggagcacaggacagtgttttgactctcagattggaactacacagcttgtattagttgaaggacccaataaaagagctccggatactgagcttatgggcaagagcgataagggccatcgagtgttgtttgtcaatatgccaatcccagacagggaagacattaatacgaagcgaaatcctgtggttggtgattatgttgaagtccgcataacaagatctacgagggcatcactctttggtgaagcacttgctataactaaactgacttcattttacaataatctggataaagaagctgttgcattcagcatgtag

SEQ ID NO: 36397 - DNA, 222 bp, Glycine max
  Peptide Sequence Number=SeqID_153175
atggaatggatcataggtgtttgtgtttcgatgggcatgttgttcttgatgagttggtggattcttctatgtggcaagaatgatgatgagaaaacagtggcaaagggcaaagttccaaaagggaactccggttggcctttactcggagagacccttgatttcattgcttctggatacacctcaacccctgtcagcttcttggaaaagcgcaagtctttgtaa

SEQ ID NO: 36398 - DNA, 275 bp, Glycine max
  Peptide Sequence Number=SeqID_153176
atggcttcttcactgtcttccgttatcaaccaacctcacttagctcaacgcctcaagcttcaccgtccatcctctcttaccactttcacaatcttccaccacaaacacaaacaccaacaccgacacaatgcttcgtttccacacccttatacctcattgcctcgctcacgccctctcaatctcatcatcgcctccagaaccttctctccttccaatactctccaccttcacttcattcctcaagctacactcactgcttccgaagctcaaccccg

SEQ ID NO: 36399 - DNA, 534 bp, Glycine max
  Peptide Sequence Number=SeqID_153177
atggctgggtcggttcaaaggaaccccagattctcaaagttgaatgatgatgatgttcgatactttgagggaatattgggtaccaaaaatgttgttcaagatgagggcaagcttgtcacttcaaacactgattggatgcataagtacaaaggctccagtaagctattgttacaacctaggaccgctgaccaggtttctcagattcttaaatattgtaactccagaaacttggctgttgttccccaaggtggaaatactggtcttgtaggagtgattgtttgtcttagttctatgaataagatcatatatttcgacaagattttgtcgcaaattgaaccttatgtatatgaatggacatctgagcgccgaggtagtattagcgcggagcatggtctgggactaatgaaagccaacgaaattttctacagcaaatcacgtgaaactgtgcaagtgatggcttcaatcaagaatatgctggaccctaatcacatactcaacccgtataaagttcttcctcactctctcatttcataa

SEQ ID NO: 36400 - DNA, 150 bp, Glycine max
  Peptide Sequence Number=SeqID_153178
atgaaacttgatgatcagcaacaatatattgatggctccccagaatggggaaatgtatatctattgcggaaagtcgtggcgggggactcattttttggagccatgtgcagactgaaaatgaccaaggttggactttcccatcataattaa

SEQ ID NO: 36401 - DNA, 465 bp, Glycine max
  Peptide Sequence Number=SeqID_153179
atgacgagttcctctgctgccgctcgcaagaatctgagtaagattgcctgcaataggctccagaaagagctcgtggagtggcaggtcaatccccccactggtttcaagcacaaagtcacagacaatctccagaggtaccagattcttctcaatccacaccctaaatattatcgatttcgttcttccattattcctttacattcctttgctttgtttctctctggaaggtgggtggttgaagtcactggagctcctgggacactttacgctaatgagacctaccagcttcaggttgattttcctgagaattacccaatggaggctcctcaggttcctcttttgtccctttcatacacaaaattaacctttgatttgtaccatgttttggttttcactgatgttatcgacggttttacaggtgatattcttgcatccggctccgctgcatccccatatctacagtaa

SEQ ID NO: 36402 - DNA, 741 bp, Glycine max
  Peptide Sequence Number=SeqID_153180
atgggtcgaggcaagattgagataaagttgattgagaaccccaccaacaggcaagtcacttactccaagcgaaggaatggtatcttcaagaaagctcatgaactcagtgttctctgtgatgccaaggtttcacttatcatgttctctaaaaacaacaagatgcatgaatacattagccctggcctcacgacaaaaaggatcattgatcagtatcagaagactttgggggatattgatctgtggcgttctcactatgagaaaatgcttgaaaacttgaagaagctgatagatattaacaacaagctcagaagacagatcagaaagctcattggtggagttgtcttgtgtgaattggaaaggcataggataggtgagggtttggacatggacgacatgagcttccagcaactgcgcactcttgaagaggatttggtttcttccatagggaaaatacgagaacgaaagttccacgtgatcaaaacacggactgatacctgcaggaaaaaggttaaaagcctggagcagatgaatagagatctgctgtttgaacttgaaaagtgtgcgatccatccacaatttattttgcacgatgaaggagacgaggaatcagcagttgcactggccaacggcgcctccaccctgtatgcgttctgtcatcagcaccattctcatctgaaccttccctcccaccattctcacggagaagaaccctttaaaactgatgaccttcgccttgcttaa

SEQ ID NO: 36403 - DNA, 1269 bp, Glycine max
  Peptide Sequence Number=SeqID_153181
atggggactctctgtttccctctatttgcgatcatcgcaattttttggggagtattattaggagcagcatcaaaaacacatgttggagatgcagaggttctgaaggagctgaagcaaggtctggacccagcttcggtgaagccaggctcgtgtgtgagttcctgggacttcaccgtggacccatgcgacaaccttttcggtgagaaattcacgtgcggcttcagatgtgacgtcgtcgtttcggggctgagtcgagtcacggaactcacattagaccaagctggttactctggctccctctcctccttcacttggaaccttccttatctacaaactctcgatctctccaacaactacttctccggtcaaattccatattccttctcaaacctcactcgtctgagccgactcagtctctcgttcaactcgttctccggcgagataccctcttccctaggcacactctccgacctccaagagctttatctcgacaacaacaacctgcgaggagcaatcccagaaagtttcaaccacctggccaaccttaaaagactcgaactccagtctaacaaactcaacacccaccttccaaacttggagtccctaagaaatctcaaattcctctacctcagcgacaatttcatcgccggagcgttgtcggcgtcgctccctgtttccttggttcagatttcaatcaggaacaacaacttaagcggtgtcttacttggtgaaagttttaagagcttgaggaggttgcaggtggtggatttcagctccaaccaattgagtggctctgttccctctgttttcttcgagcttccatcgttgcagcaattgacactatccttcaacaaattcacgaatctcgaggcaccttttaagggagtggaatcgcagagtggacttatagcggttgatctgagcaacaacaggcttcggggttttttgccgtcgttcatggcggtgatgcctaagctttcgtcgttgtcgttggagaataacgaattcacgggaagaataccgacccagttcggtgtgaaaacggtctttcccgaaaagggagtgtcttcgttcgggaggcttctgttgggtgggaattacttgctgggagggatacctcgacccttgttagcgctgaaacgcgattctgcgaacgtgagtttggttggtaactgcttatacaggtgccctcatagtttctttttctgccagggtggtcaacagaaatccttggcacagtgtaatagatttagccctccctcaacttaa

SEQ ID NO: 36404 - DNA, 225 bp, Glycine max
  Peptide Sequence Number=SeqID_153182
atgacagttagttctatctgcatcagtattctctcaatgctttcaagctcaaccacaaagcaacgccctgaagataatgaccgctatgtaaagaactgcagaaatggcagatcacccaaggagacaaggtggtggttccatgatgacaaaaaaagttacgagtttggaatggttaacccttattcttgcccaaaagaaaaagaatgggagacagttattcgctaa

SEQ ID NO: 36405 - DNA, 1652 bp, Glycine max
  Peptide Sequence Number=SeqID_153183
atgtgaaatcagattacatatctcagcaaagcagtattgttgcatatattgcttgggttaactggttacattgtcacatgaagagggaagctgcaagagaaactggagctctccaagctgccaaaaataagcttgaaaagcaagttgaagaccttacattgagattgcagctggaaaaacgtttgagggttgacattgaagaagcaaaagcacaagaaaatcaaagattacaatctgctttgcaagagatgcaacttcagtttaaagaaactaagttccttcttgaaaaggagaaggaggctacaaaaagagcagcagagagagtgcctgtcatacaggaagttccagttgttgacaatgctttgttggaaaagctcagaagtgagaatgagaaactcaagaacatggtgagttcattggaaaagaaaattgatgaaacggaaaaaaggtatgaagaggcaaacaaagttggtgaagaaaggttgaagcaagctttggatgcagaatcaaaagtaatccagttgaagactgctatgcaaaggcttgaagagaaattcatagacatggaatctgcaaaccatattcttcagaaacaatctcttttaaactcatctgtgaaaacaatagcagagcacttgtcttccccattggatgagaagttagaaaatggtcaccatgcagcagaagagaagaaagctgttgatacatttgttacacctgtgaaacaatttggtactgaatcagacagtaaattgagaagatcttacattgaacgacaacatgagagtgttgattcacttgtcaattgtgttatgaaaaatattggcttcaaccatggaaaacccattgctgcattcaccatttacaaatgtcttctccactggaaatcatttgaagctgaaagaactagtgtatttgatcgccttatccaaatgattggttccgaaattgagaatcaagacgacaatgatcatatggcctattggctgtcaaatacatctgcgttattgtttttacttgaacaaagcctgaaatctgggagttcagcaaatgctaccccagctagaaaaccgcctaatccgacatctctctttggaagaatgaccatgagttttctttcatcaccttcttctgccaaccttgctgcccctccagcagatgttgtacgcaaggtagaggctaaataccctgctttgcttttcaagcaacagctcacagcctattttgagaaaatatatggcatcattcgggataatttgaagaaggatttaacaccgattcttgcattatgcatccaggcaccaagaacatcaaaaggagggttacgttctaaccgatcccttgctaaggattccccaatggttcactggcagagtattattgaatccctcaatatgctcctctgtacactgaaagagaactttgtgccccccgttcttatccaaaagatctttagtcaaacattctcatatattaacgtgcaactcttcaatagcaatggggaatatgtgaaagctggattagctgaattagagttgtggtgctgccaagcaaaggaagagctccaactgatagcgttgagcacaaacttgcagtatgcagggtcatcttgggatgagcttaagcacataagacaggctgttggattcttg

SEQ ID NO: 36406 - DNA, 354 bp, Glycine max
  Peptide Sequence Number=SeqID_153184
atggaagcggtgacgcagatctggacgctacgccagagcatcctcaaactgaccggcgaagccaacagcggtattgatgcgctgcggctgcatccggcggccggccggctgcgatccagcgtctatcccgatattcaggcggtgtgtgatgccgagccgacgctggtgtggtcctgcgcgctgtcgcccggcactgagcgtttacggctgtgggagattgatgcgcagcagcagtggcagtcgctgcgcgatgtggagatgagcaaacccaacatcgggccgcgcaccctgcgcctcaccagcctgcccggcgagcgtgtcgccagtcagccggaagtcaggcatcccggataa

SEQ ID NO: 36407 - DNA, 2841 bp, Glycine max
  Peptide Sequence Number=SeqID_153185
atgacgatggggacaatcctaatgtccttctcgaagcccgtcgcacctccgacgacgaatctcaccgtcgtcgtcgtcgacacccaggaagcaacacggtcgattagccttattggcggtgacagagaaggggttgccaaaggtattggcggtgagcttcgtcggagaaggtgcgaggctgtggttgccaatcctgtagttgggtcccatatttgggtggaggatcctgatgtcgcttggatagatagtgaggtcttggaggttaaaggagaagaaattaaagtcctttgcacttcagggaagacggttgttgttaaagcttccagtatttatcataaagatacagaagtcccaccaagtggagtggatgatatgacaaagcttgcatacctgcatgaacctggagtcctagataatctgagatcaagatatgatataaatgaaatttatacttacaccgggaatatattaattgctgtgaaccctttcataaagcttcctcatttatatgatagccatatgatggcccaatataaaggagcagcttttggtgagctaaatccacatccctttgctgttgcagatgcagcatataggcttatgataaatgagggaatcagccagtcaatattggttagtggtgaaagtggagctggtaaaacagaaagtaccaagttgctcatgaggtatcttgcttacatgggtgggagagctgctgttgctgaaggtagaactgttgagcaaaaggtcttggagtccaatcctgttctagaagcctttggcaatgcaaagactgttaggaacaataattcaaggtgggaaataatttttgtggagattcaatttgaccagagtggaagaatatcaggggctgctatcaggacttatctgcttgaaagatcacgtgtttgccaggtgtcagatccagagaggaactatcattgtttctacatgctctgtgctgcacctccagaggatattaaaaagtacaaattaggagatccaagaatgtttcattatctgaatcaatcaaattgctttgagttggaagggtttgatgaatctaaagaatatagggatacaaggagagcaatggatattgttggaataagttctgaggagcaggatgcaatatttaaagttgttgctgcaattttgcatcttggcaacattgaatttgccaaagggaaggagatagactcatctgtgcccaaagatgaaaaatcttggttccatctacagactgctgctgagcttttcatgtgtgatgcaaaggcacttgaagattctctttgcaaacgtgtaattgttactcgtgatgaaacaattacaaaatggctggatccggaagctgctgcacttagccgagatgccttggctaagattgtgtatacaagattgtttgactggttggttgataaaattaataattctattggtcaagaccccgagtctaaatccttaattggcgtgctggatatttatggttttgagagtttcaaaactaacagttttgagcaattttgtattaatttgaccaatgaaaagcttcagcaacattttaatcagcatgttttcaaaatggagcaagaagaatacaaaaaagaggaaattgattggagttacattgaatttgtggacaatcaagatattctggatctcattgaaaagaaacctggtggcattattgctcttctggatgaagcttgtatgtttcctagatctacacatgaaacttttgcccaaaagctgtatcagaccttcaaaaatcacaaaaggtttagcaagcctaaattatcacgtagtgacttcacaatttgccattatgcaggagatgtcacttatcaaactgaattgttcctcgacaagaacaaggattatgttgttgcagagcaccaggcccttctttatgcttccaaatgcccctttgtatcaggcttgtttcccccttctcccgaagaatcttctaaacaatcaaagttctcttcaatcggttcacgatttaagcaacaattgcaatctttacttgaaactctcagtgccactgagccacactacattcgttgtgtaaaacccaataatcttcttaagccatcaatttttgagaataaaaatgttctgctgcaactacgttgtgggggagttatggaagcaattaggataagctgtgctgggtatcctactagaaaaacctttgatgaatttgtggatcgatttagccttctttcacctgaagcattgactggaagttctgatgaggtcactgcttgcaagaggattctaaagaatgttggactcgaaggctatcagattggtaagacaaaggtgtttcttcgagctggtcagatggcagagctagatacccgtagaagtgaaatcttaggaaggtcagcaagcattattcagagaaaagtccgttcctatttggcccgccaaagtttcatcttgcttcgtttgtctactgtgcagattcaagctgcgtgcagaggacaacttgctcggcaagtttatgagggaatgcggcaggaggcttctagtttggtgattcagaggtgcttccgcatgcatattgctcggaaggcatacaaagatttgtatacctctgctgtttctatccagactggtatgcaggggatggctgctcgttctgagctacactttagaaggcagactaaagcagcaattgccattcagagccactgccggaaatacttggcagaacttcattttgcaaaattgaagaaggcagcaattgcaacgcaatgtgcatggagaggaaaagttgctcagcgagaattgcgaaagctcaagatggtaagctcctttaatgtaactccttga

SEQ ID NO: 36408 - DNA, 414 bp, Glycine max
  Peptide Sequence Number=SeqID_153186
atggagagaacctggaggaggaatgatttgatgtgttataatgatattcaacccaaggcaaaaaatgaaaccattgagagggtctatgatagaggaacacacgcagctagggggaaacgttgttcatttgttaatggcttccttggagctgcccttctgaacctatccaggtgtatcgaagagggaggtggaggcggttttggagttggtgcagacttgcagagtggcatgagaggagtgtcattagtggatacatcttctgatgaggaagaggttggatcttctttatttccagtgaaggaaaatgcctattctttgtccccaatctttggattggccttggtagcccttgtcttgactcgtcggggaattgatgaaggaagaatggatgcacgtggttcagctacaggttga

SEQ ID NO: 36409 - DNA, 531 bp, Glycine max
  Peptide Sequence Number=SeqID_153187
atgccattgctaaagcaacaaggtgtttgcatgaggacagtacctaccaagaaggttggggagaagaactatgactctcataacctaccatttgaccttccacacatgatatatatcaacattctgaggaacctcaagggcctaggtggtctggacgacatctactatgcaaccctcattaacaagcttttatgggatcaaggagtctatcatgtgttcaacaagatggacgaggactccaagcataccttaatagttaaaggtttagtagtcgctaaacaacaaaagtttagaaaaaccaacttaaaggctatgaaggtggccttggaaaaaactttgaaggaggctctagaagtggatgtgcacgccatcaacaagccaaacaaaagagattcgccaagtccattcctattgaaggccttggtctggatagctttggcatggcaagaaaaattaagaagatcaatgttgggtagaaaaagaagaagaaaaccagaaaacaatcctaaagggatgaagaagaaaatgtga

SEQ ID NO: 36410 - DNA, 447 bp, Glycine max
  Peptide Sequence Number=SeqID_153188
atgaaagtgatgcaagagcttgaccagtttcaacagaatgatgtttggaagcttgttgaattaccgaaaggaaataaggtagttgtagcaaaatggatatttcataacaaattggacgaaaatggtgaggttgtgagaaacaaggcaatattagtctctaaagcatcatatggacttaaacaagctcctagagcttggtatgaaaaactaagttcattctttttggaaaatggttttgaacaaggaaaggttgacacaactctctttcaaaagaattataagtctcaatttatactagtacaagtatatgtggacaacattatctttggtgccactaatgaaatgctttgtgaagatttatctaagttaatatggactgagttcaaaatgagcatgatgggtgagctgaagtttagaagcaagcttcatgatgatgaatcaagttga

SEQ ID NO: 36411 - DNA, 1434 bp, Glycine max
  Peptide Sequence Number=SeqID_153189
atggacaggctgataaaagttgatccaacaaacacggtcacaataaggatggagccaggccaaaaatgtcatggccaaataaccctacgcaacgtcatgtacaccatgcccgtagcattcaggcttcaaccgttgatcaaaacgcgttacacggtgaagccacaatcgggaatcatatctccgttagccacggtaacaatagaaatactctacaatcttccacaaggatccactctaccacactcatttccacagtccgaagattccttcctcatccacagcgtggtggttcccggcgccaccgtgaaagaaccttcctccatgttcgaatccgttcccagcgactggttcaccacgaagaagaaacaagtcttcatcgacagcggcatcaagatcatcttcgtcggctcgttgatcctggcacagttagtccacgacgggtccatcgatgaaatcagacaagtgctggaacacagtgaacacacgtggaagaaagccgttgactccgttgatcaaaacggagacacgctcctccacgtggcgatttctaaaagaagacccgacctcgtgcagctcctcctcgaattcaacgccgacgtggaatcaaaaaaccgttccggcgagaccgcgttagaatcagcgtgttcctccggagaggaactaatcgtggagcttctcttagctcacaaggcaaacacagagagaacggaatcttcttcattgggagcgatacatctatcggcgagagaaggacacgtggaggtattaagattactgttgatgaaaggagccagagttgactcgttgaccaaagacggttacaccgcgttgcaccttgcggttagagaaggtttgagagattgcgtgaggctgttactggcgaacgaggggaggacagacattagagattcaagagacggtgacacgtgtctgcacgtggcggcgggtgtgggggacgagagcatggtgaagcttttgttgaataagggagctaataaggaagtgaggaattttaagggagagactgcgtatgatgttgctgtggagaaaggaaaggcgagcgtgttcgacgcgctgaggctgggggatgggttgtgtgtggcggcgaggaaaggggaggtgaggagtatcaagaggctgattgagggaggagcggcggtggacgggagggaccagcacgggtggacggcgttgcacagggcgtgttttaaggggcgcgtggaggcggtgagggcgctgttgttggagagaggggttgaggtggacgcgagggatgaggaggggtacacggcgctgcattgcgcggtggaggcggggcatggggacgtggcggaggtgctggtgaagaggggcgtggatgtggaggcgaggacgagtaagggtgtgagtgcgttgcagatcgcggaggcgttggggtatggtgggattgccagg

SEQ ID NO: 36412 - DNA, 777 bp, Glycine max
  Peptide Sequence Number=SeqID_153190
atgcaagttggaggttgcagtatatatggaggaactcatgagtctggtgcatgcatgactcaggattattcatctaaggaggttaattatatggctaattcgaatagacaaggtcaaggttggaggtcacatcctgggaatcatttcaataaagaccaagggggtccgtctaatcaacctcctaaccagggtcctaacttgtatgaatggaccaccaaattagaagacacattgactcaatttatgccagtttctatgtctaatcataaaagcacagagtcggcgattaaaaatctagagatgcaagtagggcagttggccaagcagctagatgaaaagtcctctagaaatttcggtgcaaacactgagaaaaatccaaaggaggagtgtaaagttgtgatcactaggagtcaagggagaatgctagtggaaagagggagtaagaaaggtgagggagagttagaagatgatgaaaaacaagaggaaaaagaggagcaaatgaaagaagaagaaataagtaagaagaaagaggtagaaggtgaagaaaagaacaaaaagagagacacaaaaggagttgagaggcaagagaggagagaaaaagagaatcagtccccactccaaccaaggaagccctatatcccttggtaccttcaaggaaggacaaggagcgatactttgctcacttcaagaatcaagaatcaagtctcaagattcaaagttccaagagtcaagatcaagattcaagacacaagattcaagaatcaagagaagacttaa

SEQ ID NO: 36413 - DNA, 1623 bp, Glycine max
  Peptide Sequence Number=SeqID_153191
atggccgattcaacccattccaaaaccaccctagatcgtatagaagaagttgttgccaagcttgcttctagtcaccttcatttctccgagaaacttgatgatctcattaaccgtgttgtcgccttggaaaacactccccatcactcttcgtctctgtcttcgtcatcagccaaccctgcaccacaaccacaaacacttaacccccacagactcaaactcgatgtacccagattcgatggctcggatccttctgcgatagaggctcgctttgctcaatccccttatgaggatcccacagggcaattattcaagttaacccagagaggttcagtgagggaatacttggctcagtttgaggcgctggccaatcgtatcactggcttatcaccatcttctcttctgagctactttattccaggtcttgaacccgacattcggcgcgaagttcaagcccttcaacctatgatgttggtgcatgccaccggcttggctcgcttgcaagaggagaagcttcaggagcactgcaagggtccctggagccgttccacctttaacccttcaccatcgtcctcgacccccctctcagtagccttaccaaccccacccctacccttgcttccttctcctgcgaaacctctacccttacccatcaagcgcttgagccctgacgaactcgccaacaaagacacaggggatgacaactcgaaccctaatatagtcagcttgcctttaacacctgacccgacccagcccgaaataacaaataacccatcccctacccaaacacaacccaaatcatttcaggcccaaattagcctccatgctttatccggccaaacagcctcggagacgatgcacaagaccggccagaattctcatcaaccgatggtcattctggttgacgacgggagcacacataatttcgtgcaagcacgcctcgtcaagtctcttgggttgactcctcaaccaactccaacattgtgggtgcttgtcagcaatggcaatgaagtggagtgggtgcaatggttaaaatctctcgatcccgtcctcactaattacaatgacctcaccatgaaattcatccatgggggtaaactcattgaattgaaagggaattctgacatgacttcactcgtgattagtccccctcaactaaggcgcctgctccaaaccgacagtgcaagtgaactctttcacattcaagtttgttcacaagctccaccaccatcaacacctcaccccacaatcctcaccatcattgaccaattctcagccctgtttcaacctccaacaaccctccccccatcccgcactacaaaccattccattcatttgctccccaacaccgtccctgtcaatatccgcctgtatagatatccccacttccagaaacagcaaatcaagtctcaggttttcgttatgctgcaaaatgggatcatccaccccagtacgagccccttctctttctcggtgttgtcaagaagagggatggctcatagcgcttctgcgtggattatcgcatgctcaatgcgctcaccattaaggactgatttccaattcccaccattgatgaattgttggatgaactgggtggttgatcgaggccgtacccgaatcaaataa

SEQ ID NO: 36414 - DNA, 557 bp, Glycine max
  Peptide Sequence Number=SeqID_153192
atggggacaaatcaaaacggcaaaaggttttatcaagtcaaggttaaaagtctagatttcaccagcctcaaggaattgggacgattgatgggacctctccaaaggcatgccttccgcaaagtgtacagaaagattctagatttgaccgcagctggggtatttacggaagctgtcgtattcctcgcccaatactatgaccagccgttgaggtgcttcacgtttggggacttccaaatggtatcgactattgaagagtttgaggaaatactaggatgccctcttgggggaagaaaaccgtatcttttctccgggtttcttccctccttgagcaagattgcagctgtggtcggggattcggcaaaagagttggatcgcatgaagcaaactcgcaacggcgtagtaggcctgccacggaaatacttggaaggcaaagcaagggatatgtggacggtttggtgggacttagccgcgattgatgctttcctcgcatatcaccatagcaaggaaagtccagtggtggctatcttggcagatttgtttgacacctttgaccggag

SEQ ID NO: 36415 - DNA, 411 bp, Glycine max
  Peptide Sequence Number=SeqID_153193
atggatgaccctagaaagatgaagcatatggttagtcctttgtggattattcaattatgggtaaatgcaattttggccaacaacataaccctcaaaaggaatattctagatgacattgaacttaagatcgaaggagctcaaaacaaactaacaaagtttcgtgattctatgcaagatactagcaaaatgagcaacgacttgaagatactccccttgctaaaagagctactttttccaaaatttaccatggttccaattaaaattccacatcaaagggacacaaataattgggaagacaatgatgggaaaggtacttccaaaaaggtctcatctcgaaaaaggaaaaccccttcttctattagcactggcaacaagtcctttgatccagagaattttcaagaaaggcgttaa

SEQ ID NO: 36416 - DNA, 465 bp, Glycine max
  Peptide Sequence Number=SeqID_153194
atgggaggacctctccctggacttcattgtgggccttccctcatatcgcggcaactcagttattttagtcatggtagaccgtttctcgaagggacttcacctgggtacacttccacaacatcacactgccgccagcgttgcaagactattcatggaaatctccggcaagctccacagaatgccaaagagcctagtctcagacagggaatcgttgtttatgagtcatttttagcaggaattattcaaactaagcgacaccaagctccgtatgagctcgtcgtatcacccacagtccgatgggcaaacagaggccatgaaccacgtcatcgagcaatatttatgagccttcatgcatcagaaaccatccacatggggtcatacaatacctcaacccaggggcaaaaaggagaagccataggccatgatacttggaagattacatggaaaaatgagatgagctcgtag

SEQ ID NO: 36417 - DNA, 255 bp, Glycine max
  Peptide Sequence Number=SeqID_153195
atgtcagggatcattcacaagattgaggaaacccttcatgtgggagggcacaagaaagaggaggagcacaagggtgaacaccatggtggagaacacaaaggggagcaacatggggaagaacacaaagagggtttcgcagacaagatcaaggacaaaattcatggcgagggcgagaagaagaagaaggagaaaaagaagcgtgaacatggccatgaggatggccatgacagtagcagtggcagtgatagtgattag

SEQ ID NO: 36418 - DNA, 375 bp, Glycine max
  Peptide Sequence Number=SeqID_153196
atggccttgcaaactctcaccgacaacagctttgtcctgaaactatccaaatgttcctttgcgacccaacaagtggaatacctgggtcacttggtttctgcaaaaggcgttgaaccagttcctgcgaaagttgccgtcgtgcaacaatggccgacccctcagtcgactcgagcgttgaggggattcctagggtacgcaaccatagcagcacctttcacgccattattggctaaggatcaatttcataggacttccgaagctggccaagctttttcaaaattaaaagaagccttgtgtcaagctcctgttctgggcttaccagactttaattctctgtgcaaacccataaacaacaagtttatcttgcaagattaa

SEQ ID NO: 36419 - DNA, 402 bp, Glycine max
  Peptide Sequence Number=SeqID_153197
tggtgccgatgtaatggtgatggtgacgatgacaacggtgatgagggtggaatagtggcggcgatgatggtagcaatagtggtggaatgcccaaaggtctgggcgagtcaagttgcttacctaatcgaccatgcattgaaccgatacgacctggttgggtttgtggttaaactaatggcccactgccccaggttaggtcatgttcaaaggaggaaacgcgctaggtcatgtgagtcaattaagaataatggcaacgataataacaacaacgatggaggtaatgaaatggtggtagtagtaacggtggaatggtggtgttgggggatgtggtggacacggcaacgatgttggtgtggtgatggtgacaggagcgggggtgatggtgctagtggtggtggttag

SEQ ID NO: 36420 - DNA, 561 bp, Glycine max
  Peptide Sequence Number=SeqID_153198
atgtcagttaatggtgtttgggagcttgttgagtttcttgaaaactataaggaaattggttgtaaatgggtcttcaagacaaataaagactcagatggtaacattgagagattcaaggctaaattggtggtaaagggttttatacaaaaagagggtcactttgatttggagttacacctaatggttatgaagacaaattttttgaattgtgatttgagtgagacaatatacatgcaacaacttgagggtttccatactggtggtagtgagaacttgttgtcaagattaagcaaaggtcaatgtccaaagaatgatgttgagcaagcagagatgaaagatagaccttttgggagtgctttgggctgccttacgtatgctcaagtagatactaaaaaggtgatgaggtacttgaataagaccaaggagtatatgcttaggtataggagagttggcaacctaaaggttttgggatacatagattcagatcttggtgggtgccccgatgataggaaatcaacttctagattcatcttcatcatggatggaggtgtgatatcctag

SEQ ID NO: 36421 - DNA, 114 bp, Glycine max
  Peptide Sequence Number=SeqID_153199
atggaagctttggacacagaccaagttaagttcccaagtggaagcaaatcagctttcataatcctgaagattggaaaagattttgttttagatggttcttcttggaagcactag

SEQ ID NO: 36422 - DNA, 1467 bp, Glycine max
  Peptide Sequence Number=SeqID_153200
atgaagcagttaatggacatgagatatgataatgttgggggtgtaagggaattcattatgaagatggttaacatccggaccaagcttaaatcccacaaaattgactttaataagaaattcattgttgaacatgccttaaattgcctatttgctgatttcacacaaattaaaattgcctataacactattggccaaaaatggactatgaatgaccttattaccaaatgtgtcgctgaggaagagaaacttaagaaagaaaagagtgacatagccctgttatctgtccatagcaaacccacttctggtaagggacattggaaaaacaccaagagtacatctaatgcttctaataaatatcaagattatgggaaaccaggaaagaagaaaggacataagaaagctgactgtaggatgttcaaggcctggctagagaaaaagcaggaatcaaaagattcttggtggcttgatagtggttccacaacccatattgttgtgtctttacagaggtttagaaatatgagggagcccagtttgagggaaagcaaactaagggtaggaaatgatcttgaagtgtttatggagaaagtgggagatattttgataatgtttgttcatccttggttgttgaaagttttgtcgctaaaaggtctaaaattgaagaaaaatcttgtgttgtggcacaaacgcttatgtcatatttctatggaaagagttgagagattgacaaaaacaaatattttaccttccttgaattttgatggcttaggcacttgtgtggattgtataagaggaatgttcactaaaaccaaaaagaaaggtgcaactagaagtttagatctcttagggattatttatacaaatatcagtggccccttaactcctacaatttgtgaaaaatttgaagcacttgaaaagtttaaaatttttaaaactgaagtggaaaagcaattgggaaaaattatcaaggttgtgaggtctaaccgtggtggagagtattatggtaaatatggtgccactgggcaacatatgggaccattcgctttatacttgcaagattgtggaatagtttcgcaatacaccatgcctgagacccctgaacataatggtgtagctgaaaggtgtaacaagacacttaaagatatgatgagaagcatgaaaaaaacagaccccaagacaagttgtttcttttttattggatatccagatcacgctaaaggatacaggttcttctgtcctggtagtcggagcaaaattgtagaatccatgaatgccaatgatgttgatactgagtcacctgagattgtctctttgccactacctattccagatgttggtatttataatgctattccagttgagactatagttgcgactaaagatatagttggccctcaagccaatgatgtgattgatcctcctagtgtggatgaaaacaaccagttgagcaggttcaataggttcctttga

SEQ ID NO: 36423 - DNA, 729 bp, Glycine max
  Peptide Sequence Number=SeqID_153201
atgaccggctctctcgatgagtcgatcccttgctttctcataatgatggacccttgggtactagttaccctcaccgtcagaggactacacgtcctcgccttgagaggactacacgtcctcaccaccagagggctgcacgccctcacctccagaggactatacgtcctcgccttgagagggctacacgccctcacctatggtactagttaccctcaccgtcagaggactacacgtcctcaccttgagaggactacacgtcctcaccatcagagggctgcacgccctcacctccaaaggactacatgtcctcgccttgagagggctacacgccctcacctgggactacacgtcctcaccaccagagggctgcacgccctcacctccagaggactatacgtcctctccttgagagggctacacgccctcaccttgggtactagttaccttcaccttcagaggactacacgtcctcgccttcaaagggtcatgtaccttcaacttcagaggactacacgtcctcgccgtcaggcagacgcagggcgaaacaccacagcaacattgggatggccggtagcgggcaatagacacaccgccaccacctctaaagttcacctcagctcatccataaaaaggttagagtgttgcctacgacacatggccgaccagcaggctaccaaatccaaagccaaaggtaagcaaagtattaggtccgtgaccgacaagtcataa

SEQ ID NO: 36424 - DNA, 282 bp, Glycine max
  Peptide Sequence Number=SeqID_153202
atgaaaaattgcttcgccgtattttcttcgttttcttgcgattggttagcttcggtgaaggtgaaggtgaaggtgctggtgttcattgttgcggtggttggttcttcgtcgacgacatacgagttgataagtaaaaggctcacggatcaacttgaagaagaagaagacaccaccacgtgcacaaaatcaacggggctgaagaagaacggcgcaagggctcgaaggagaagggttgctgaagaagaacgggcgaaagaaggagaaagcacaatcacggcatga

SEQ ID NO: 36425 - DNA, 823 bp, Glycine max
  Peptide Sequence Number=SeqID_153203
atgggtgacgggcgaggtgatgatggcatcaggcggcatgcgttaacgggagaaaaggatgcatcagatgatggtggtgattatggactcatttcggcggaagcgttctatcccgcttcagaccgcagcggctggctctccatcggtgtttacacgtttgcctgtcagcaggatgtaaaccgggcgctggagtccgaacaaaccaaaagggtgatggcagatgtggtgcattttaccgacgccaccacggcatcccggcagcaaaaacgggacgcgctggtgccaaatcaggacaagccaatccctgaatctgagaatttacgggttccaaagcctgggaatctcagcatattgccagctttgataacatcagcgttaaactgcactggaccgatcaaccctacaaatggcatatcaatgacaaaacaagaggtgtttgccgttatggatggttgcgttgacatgttctataagcaagcgggcgaagtgagaactcaacgattaaccgccggtgatattttttatgccagcgaaggcactgaacacgttgcacatccgcagggcgtagcccgggtgctggtgattgaacaagcgggatcgtcggcgggatcgagccgttctccccgggcagaatacacggccagttcagataacgctctccccactggcgcatcgccacgacgattgggaagacggctcgtccccgttcggtcagcaaatattccttataggcgctgccatctgacgccggacaactctcaagcacgccgacttcgaccagcagttttagccgtgacgccaggatattttttgccagcccaag

SEQ ID NO: 36426 - DNA, 608 bp, Glycine max
  Peptide Sequence Number=SeqID_153204
atggcatccaggaaaaggaaaagcgccacttccaggcctcaagctcagtatgataccaagagattccaatccttggaagcctggaaccgatacacagataacattctggactggaggatccttccggaaaagaatgttaagatctatcataccgaatttgacgagtttaaggcagagatggagaggcgtaacttacacaaacgcctcgccaatctccaagatggaagcatagatgtagctgtggtgaaggagttttatgctaacttatacagcccggaagaccagacccctaaacaagtgagggtaagaagacatttaatcaagattgatgctgacagcctgaataccttcttagagacccctgtagttttggaggaaggtgagacacaacctacctattccagatttacgaggatgaggattgatcctcaagagttttctacctgtctctacatccctggtaggggttttgttctgaatgtagagggccatccttggaagcttctgaggaaagatctcaccactcttgcacagacatggagtgttttctcctacaacaacctgactcccacttcccacacctctgatcttaatatggacagagctag

SEQ ID NO: 36427 - DNA, 171 bp, Glycine max
  Peptide Sequence Number=SeqID_153205
atgagctgtacaggttcgctaagggcactacttcatctcactaagcgcactgcttcagttcatcgtctaagcgagaaaggtgcactaagccagaaatcactaacatgcgctaagcggtccatacatctgcagagaccagagcttgaaacaagagccggtttgagagcttga

SEQ ID NO: 36428 - DNA, 416 bp, Glycine max
  Peptide Sequence Number=SeqID_153206
atggcgaatcaagaggagtgggtcccatttatagacgtattagcattgctaatctttggggttgtcctcttcccaaacgtggatggtttggtggacctagccgcaattgacgctttccttgcatatcaccatagcaaagagagcccgatggtagctatattggcagacttatttgacacatttgacgaagatgtgaaaagagtagtgcatggatcatctgttgtttacccgctctttatagtagattgggaccaacacttggctgggataggaggcagaacagtcaactggtttccacgatggaaagaaggaaaggagggagttctcttctcatgtggaagctacccaaacatcccgttgatagggatgaggggttgcattaactacaatcctgcactttccataagacagttagg

SEQ ID NO: 36429 - DNA, 317 bp, Glycine max
  Peptide Sequence Number=SeqID_153207
gccacattagtaaatattgtagactaaaaacgaagttaagaaaccttaacttagaaccagcaattgaagagcaaataaacaatttgcttatagaaacctcagaggaagaaacaaaaacttcatccttcgtgctctccgatgaaaacctaaacataatccaacaagatgaccaactatcatcaacagatgatgatgggcaaatcaatactctaacaagagacaagatctcttgtttgaagcaatcaattctatacttgaccccaggaaaagaagatttttctggaaaaactcaagaaaacattagaggtaaaacctaa

SEQ ID NO: 36430 - DNA, 742 bp, Glycine max
  Peptide Sequence Number=SeqID_153208
tatctacacccctggagatcctccaatgatgccagatgacctgtcccagtcaacattattatctgcatttgatggagcaagattagtttatttcgatggaatgtttcctgaaactgctctatttgttgcacaagaggcagctcgcaataatattcctattttagttgaggcagaatcactgagggaagggttggatgagctcttgaagctagcagattttgttacatgctctgcaaagtttccacaggcttggacgcaagcaccatctatcccaagtgcactggtttccatgcttttaagattgccaaatatcaactttgtggttgtgactttgggtgaaggtggttgtctaatgttagaaagaagtgcaaatggtaaaggcactgctgattctgacatagaagaaagggatgtggagagtttcttggaattcttatataaagggaaagatgatagcttggctatccctacctgtataccatcggcggtgacaaaattcagagcaaatggaatagggacaatttgtgggagattctatattggaacagctgagaagataccagattctgagctgattgatacaactggtgctggggatgcttttattggagccattatgtatgctatctgtgcaaacatggtaccagagaaaatgttgccacttgctgctcaagtggcagctgccaagtgtagagctttgggagctcgaactggtcttccacgtcggacagatccacatgtg

SEQ ID NO: 36431 - DNA, 729 bp, Glycine max
  Peptide Sequence Number=SeqID_153209
atgaagccagatgatcttccagagtcaaatttgctaactgcattgaacggagcaagaattgtttatttggatgggagattgcatgaaactgctctagttgttgcacatgaggcagttaagaagaatatacctatcttaatagatgcagaaaggctgagagaagggttggatgatctcataaaattagctgattatgtcgcatggacagaggcatcaacagtttctaaagcacttgtttgtatgcttttaaggttgcccaacatcaaatttgtgattgcaactttgggaaaagatggttgcataatgcttgagagatgtgttaatgaggatccttccgctgaagaagtggttgttgacaaattactggaatctctggagatgagaaagaatggaagcacacacatcccaacctgcatatcatcgacttttcatttatatccttttctcttccagccagtgacaaaattgcatgcagaaggtataggaacagtttgcagcaggttatacattggaacagccaagaacataccaccatcagagcttattgatacaactggtgctggagatgcatttattggagccgttctctatgctatctgtgccaacttcgagccagagaaaatgctgtgctttgctgctactgtggcagcttccaagtgcagagctcttggagcaagaagtggtctcccttaccgcatagatccatgcttggcatccttcatgcagtag

SEQ ID NO: 36432 - DNA, 207 bp, Glycine max
  Peptide Sequence Number=SeqID_153210
atgcggtggaagatctacacaacgcaaccggcgtgcatgggaaaagctagagagagaaagttagagcgagaaagcgagagagatctcgagagagaaagagagaggggaagaggggaagaaggaagaggggagttgagagactttaatgctggtgggagtgttgttgacagtgatacagttgatcattcttcaacggtgggagcgtga

SEQ ID NO: 36433 - DNA, 246 bp, Glycine max
  Peptide Sequence Number=SeqID_153211
atgaccgccggcggctgctctgccggaatttcgccacctgccggtcactccttcaagcctcttctctctcctgacgatgctcttcgccggtgtcgcgtgcggcgagagagaatgccggtgtcggtcgtcttcctccttgctcttctcaacttgcttttctcctgccaagttacttgccaggttcaaggtcagagtctgagactgggtatgtacatgtctgctagtgctagttctgtagcttggtag

SEQ ID NO: 36434 - DNA, 2075 bp, Glycine max
  Peptide Sequence Number=SeqID_153212
atgtggtttgttaaaccttcttctggaccatcttctgcacctgtgccatctccatcttatcatggtcctcatgtaactccaagaccaagacatcattatcatcaccgtcaccatcacagcacgagaccttatgtagcagctccaccaccttcaaaagatcaagcttgtgaccaaatctgtactgatccgctcacatcaactccctttggttcaccttgtggttgtgtatttcccatgaaaatcagacttacactggatatagctccttatgctgtttttccggtaatgactgagttagagaatgaaattgcgttgggcacttatttagagcagagtcaggtgaagataatgggtgccactgctgacagtcagaatcagggaagaactattgttgatattaacttggttccgctgggagagaaatttgacaatacaactgcatctcttacatatgagaggttttggcacaagaaagtccctctaaataggagcctttttggcgattatgctgttgtgtacattacttatccaggaatgccatcatcgccaccatatggatctttaactgggagcggtcctagtcaaagtgttgatggtattctgccagtcagtgccaactttgtcagcaagaaccagaaaatgaatctcaggaccataatcatcattgctttatcttcctttgtactcttgctggttttggtgggagcattttcgattattttgaaatggaggaagactaggagaccatcaagtgctgttggccctgcgttcacatcatctctaaacaagagatcaggcttggggtctatgttgtcaagtagtattacaagctcaacatcaatgtcacttatgtccacaatggctacttccctgctctctgttaaaacattttcactttctgagcttgagaaagcaacagataagtttagttcaaagagagtactaggtgaaggaggatttggacgtgtttatagtgggacattggaagatggggctgaagttgcagttaagctgctaacaagagataatcatcagaatggagaccgtgaatttattgcagaggttgaaatgctaagccgtttgcatcaccgtaacctagtgaaactgattggtatatgcattgaagggcgcaggcgttgcttggtgtatgagcttgttcgcaatggcagtgttgagtcccatctgcatggtgatgacaagataaagggaatgctagattgggaagcaaggatgaaaattgcactaggagctgcaagaggattggcctatcttcacgaggattccaatccccgagttattcacagagactttaaagctagcaatgtgttactagaagatgactttactcccaaagtttctgattttggcttggcaagagaagcaactgaaggaagtaatcatatttcaacacgggtgatgggcacttttgggtatgttgccccagaatatgcgatgacaggccatttacttgtcaaaagtgatgtttatagttatggtgttgtgctgcttgaacttctcacaggcagaaagccagtggatatgtctcaacctcagggacaggagaatcttgtaacttgggcacggccaatgttgacgagtagagaaggtgtagaacagttggtggatccatctttggctggaagttacaactttgatgacatggcaaaggttgctgctatcgcttcaatgtgcgttcacccggaggttacacagagaccttttatgggtgaagttgtgcaggctctcaagttaatatacaatgatacagatgaaacttgtggagattattgtagtcagaaggattcctctgctcaggagtctgattttagaggtgaccttgccccttcagatagcagttggtggaatgcgggagggctaacccctcgattaacttatgggcaagcatcttccttcatcactatggaatacagttctggtccacttgaagaaatggagaacagaccgttttcaacttcaagcttgattggcgatgaaatatctttaccggaagtcggagtgagcatggaggaccttcttccaagcgtaattggaatgatggcaactgggtttaacag

SEQ ID NO: 36435 - DNA, 2954 bp, Glycine max
  Peptide Sequence Number=SeqID_153213
ttgcaagattagaagcatctggtgttgcggtggatgtttcatcattacttctgtctccaaagatggagctgccaatcaacaattttgtgaatgataaaccgtggcattatcaggatccaacagggaaggttcaaggacctttctctttattgcagctgtataagtgggatgcatttggatattttcctccagatctcagaatatggagtgtagatgagacacaggataactctatattcttaactgatgtgctgagtgggaagtgtacaaataatgtgtcgctgccaaacaacagccaacagctgtctttgggaaccaatagtacattggaaaataaagataatggtcaggatggtggtgagaatgagaacaatctgtctaggaatgaaaattctgcaaaccatcaaattgttgagcgctgtgaggagcaaaaagtgtctgatacttgtacacaatctaatggtaaagatgaatctgttaggagcaatggttggaactctcagtctccaggtttgactatacaagcagatgggaataacaatgaggggcaaagtggaaattctgaaaggagggaggagtcccccaaatgtgaaatttcttgtcatgatgtcccccatgtatacgcttcactgccttcaactgtattttcagagaaactgaatgagaatccttctgataaattaacagaagttcataagattgaagtaaagtctgaagataatggaaattttgacttgaacaaaatttctgagggtcgaagtaacagtgggcaaagttgtcagaaacaatcagacagtgaggagaattcagggctatcttctggtcagaattggagatgccctgatgtaaccaatccagtgtgtaacatatctacatggctatcaatctttggtgaaccaaatgatttggatgagtcagtttcagatctgctggctgaagtggaggcaatggagtcacttgggggcttggaatctcccacttctatcatgaaatgtggtgaggagttgactgacggttctataactgattgtcttagttttgcagatgcgcttagcccaatgcttgacgcaggtaagggtgatgcactaagctcctcaggtgatttacacttaccatctcaaaccacaacaccagatgacccattaaagcaagcagatgtacatcatcatcctcaaaaaatatctggggagcattcaacaaagagttcagaagttgagactcacatcagggatcttttggaagtaatatggatgagattccaactgaggaaagtgacagtgctctacgagcttctctctgcttgtctatcagatttaggtgaaaataacaagaaatttagccggaggagaaagggctatgatgctcaacaacgtgtcactctgcggctgctagcaacttggctcgatatcaagtgggcaaaaatggttgagcaagaggcaagtaaagaagaaattcaatcaaatgaagacaagtgggctaaatggaagaggggtggtatcattggtgctcctgccttaacagggggaactttgatggctattactggtggattagctgccccagcaattgctgcagggcttggtgctttggctccaaccttgggtactctgattcctgtaattggagcaaatgaatttgctgcagctgctagtgctgctggaactgttgctggttctgttgccgttgctgcatcatttggagctgctggagctggactcagtggaagcaaaatggctaggagagttggggatgttgacgagtttgaactcaaagctgtaggcaaaaaccataaccaaggtaggcttgggattatgatcatggtctctggatttgtctttgaggatgacgattttataaggccgtgggaagtactggatgacaacttggagaggtatgcactgcagtgggagtccaagaatctattttccctgagcactgcaattcaggattggctttcttcaagaattgcaacggagctgatgaagcaaggggcgacgatgacggtcttgcatgctcttttaactgcattggcttggccagctgcattacttgctgcaactgaattcatagacagcacatggacaattgctatcgacagggcgagccctggtgcagcggtaaagttgtgccttggtgacttgttggtcatgggttcgaatccggaaacagcctctttgcatatgcaaggatcagacaaggcaggaaagttgcttgctgaagtattattgggaggattgcagggaaatcggcctgtcacacttgtaggtagtatagagtttttagctgaaacagaaaacagtgctgaactggtcgagagagttgttcttcttggattacccattgcaatcaaggatgagaattgggaagctgctagaaagatggtagcaggaagatttgtaaatgcttattcaagaaatgactggatgcttggagttgcttgctttccgtgccagtgcagacctttcgcaccgcttccattctttctccctcccaatttcacttgtaggccaaacgcagcgtttcggcagcatgatacgcggaggcgaaaactacgtttcttccgctccggcgttctcgaacgacgcaagcgccttctcgtttgcagcggctccaccgtgtccatcttcagcaccgccaccggctccctcgtttcctcgctcgaaggccacaccgccgtcgtggtggtcccctcctccactggcctaagctactgctggaccgcttccgtcgacggaaccatctgccactgggacttctccgttcccgaatgcgtcaagattatcgatctttgcttacccatcttctctatgacggcgaatgttattgcttacgtgtctgttcaagatataaacgcaccggacaatcaccccaagcctctttatggacagatcaggaagtgtaattttgttctttcttttggcacagtggtggggtatgaggaagatgaagcgtga

SEQ ID NO: 36436 - DNA, 1434 bp, Glycine max
  Peptide Sequence Number=SeqID_153214
atgaggttaagttgcttgaatcacgtatttcgaatgggaattgggattgaaagcattggttatctcaattcgataaagaatgtgttgggtgaaaccagggaatctactctgtttcttgtattcaaacagtgtgttatggagtatttgaattgcggcgaggatgcgttagctttaggggtgttgaggaagcaggtttctgccttggatgtggacaagtgcaaagttcacagcttggctaagtgcttgctttcgtttaataaggatagggagttaggtgcagttgatggtggtgatgttgttgttgttgtacatgacttgctaaagaagttgttagaggatttggagaagttgtttcctcctccggtttcggtgcctgaaggaaggttggagcatttggtagaaattcgtcgaatacaatttccctttatgaggaatgaggatcatcactgcagcagggatcagattcctacttcaacgactcagatattgactggacataaaaatgaagtttggtttgttcaattttctaataatggggagtacctggtctcttcatccaatgattgcacagccatcatatggaagctgtctaagggatattatggtattcaatgtgttggagataaagtgctggaggatgggaaattgacattgaaacacacactttgtggtcaccaacatgctgtatcttttgtagcatggagtcctgatgacaccaagttgcttacatgtgggaacacagaagttttgaagccgtgggatgttgaaacaggtacatgcaagcacacatttgggaatcaaggttttgttgtcagctcttgtgcctggtttcccaactcaaaacagtttgggtgtggcagctctgaccctgaaaagggtgtttgcatgtgggattgtgatggaaacgtgataaaatcatggataggaatgaggatgcccaaggtcgtcgatcttgctgttactccagatggtgagtatcttatcagcatattcatggataaagaaattcggattctgcacatgggaaccagtgccgagcaagtcatttcagaggagcacccaatcacgtccctttcagtttcaggagatagcaagttcttcattgtcaatctaaacagccaagagattcatatgtgggatgttgctgggaaatgggataagccattgaggtttatgggccacaagcaacacaaatatgtgataaggtcatgctttggtggattgaataacacgtttatcgccagtggttgtgagaattcacaggtgtacatttggaactgcaggaactctaggcctatagaagttctatctgggcactccatcactgtgaactgtgtgagctggaaccccaaaatacctcaaatgttggcatctgcaagtgatgattatacaattcgtgtatggggacccagcttacaaaaaaaagaaggctaa

SEQ ID NO: 36437 - DNA, 417 bp, Glycine max
  Peptide Sequence Number=SeqID_153215
atggaaccgcagcttcagcccaagctggaccccgcgccggaggttgttagcggtggcggtggggattcggagaagtcgcatgtcagtgatgtcaccgaggttcgcgacgttgacatggcgcaggcaaacggcgcttgttgcccttccgttttgaaacggaagcgcggtcgcccggccaagggaaaccgcgttccgaaagggattataccgccgtcgaggcagaaacaggaagaagaggatgtttgcttcatatgcttcgacggtggaagcctcgttctctgtgatcgccggggatgccctaaagcgtatcatccctcgtgtattaagcgagacgaggccttttttcgctcaaaggccaaatggaattgcgtgttttgtgtacctagtgattattgtaaactgaggagttctgattaa

SEQ ID NO: 36438 - DNA, 162 bp, Glycine max
  Peptide Sequence Number=SeqID_153216
atgggaggaatttgggaattgggatttaggcgtggtcggtctgatgaagtgagtgggcacacggaattgaaaaatggactcggtgcatatattgtgaatgaatggacaaaagcgactcttacgtctgtccgattctgcgtttctcgaactgcacgtgcttag

SEQ ID NO: 36439 - DNA, 402 bp, Glycine max
  Peptide Sequence Number=SeqID_153217
atgatttcaactaatgataaggaattagttttaaatggaccgatgagtgtgaaaaatctttgtgagttttgcatcaaattcattaggaagaatgagcgtgtagcatttaaatggaatgacattaatcaagaatttgaagtcatcatcaatcacaaatgtctttacaaaacattgaagaacaagagaaacctgaggttaaaagacaattatgcaattggtgaaaatgttgttgcattctctatggatcctaatgttgatgaagttgtggagttgtggaacatggatgatgaggaaaaagataaagaaattgatagggaagggaagacactcattataagagagatggaggtgttgtttataaaaaatataatcgatatgtttcttaagtggaagatttgttaa

SEQ ID NO: 36440 - DNA, 534 bp, Glycine max
  Peptide Sequence Number=SeqID_153218
atggagacgaaagcaaaaagagtgtattcattcatatatgctatttcaattcctattcctattcactcaccatgctcatctctctctctcgctgaaattaattttgcagcgtacgtattaaagagaaaatggaatcatctgaactccaaaattgaggagcttgaggcatctctcaagtctttctcagacaattgcgcctccgaaagacaaggccgaattagagctcaacaggccttgagaaaagaagtaacacagtcgcaacctaattctcaaaagcttaacctcacttcttatcccatgatgccaattggtgtcgtccactcgtgcttctccaccaggaacgggacgccgaggcaaccgttactcgtcccacttgctagggcgtgtttggttttcaacacaactcgcgttccaccggcgtctctggagggtttggaggaatattctcattgctggattctctatgtgtttcatttaaatacggatctcgataagctctggaagcacccgtctaaatcagggttcaaggccaag

SEQ ID NO: 36441 - DNA, 3816 bp, Glycine max
  Peptide Sequence Number=SeqID_153219
atggagcagccgcttcaaccgcagccagagactgccgcgggcggtgctagggattcggagggctcgcggttggttggagttcccgtcgcggtcgctcgcgatgctgacgtggcggagagagaggggaacagttgcgcgccgaatttgcaggtcaccgtcgtggacgtcggtgccgttttgaaacggaagcgcggccggccggccaagggagctccgaaagtggtgcctccggtgaggcaacagcaggacgaggaggatgtttgttttatttgcttcgacggtgggagcctcgttctctgtgatcgccgagataataaaggtttgtgcggaatatgcatgaggactataatgatgattgagaacagtgcccagggaaataacgaaaagtgtgaagtggattttgatgacaaaagcagctgggagtatcttttcaaggtgtattggatgtatttgaaaggaaagctatctttaacatttgatgagctccttcgagctaaaaacccatggaaaggtgctgctcctatgagttataagattcaaagtccccatgaactttatcatcttagagatgacaaaggttctggttcagagaactcctgtatagacatagaatcaaataatttgaagaacaagaagcccaagagacagccaaagcttcttggtaagggtgattgcttggataggataacttcaggtggtgacagtggtgtgtctttgcctgaatgcacaaaatgggcatcaaaggagcttctagagtttgttgcgcatatgaaaaatggtgatacatctctcatgtctcaatttgatgtccagactctcttgctggagtatgcaaataaaaataatcttcgtgatcctcaacagaagtcccaaattgtttgtgactctagacttttaaatttgtttggaaaagcacgtgttggccacattgaaatgctaaagctccttgaaccccactttcttttaaaagacaatggccctgcagaaaatacttttggagcaggaattattaatgttgttgctaatgaaggggaggccattgacaattacaataaacagttgatgttagttgatgacaagagatgtaagacacataatccagatgcatatgctgctatagatgtgcacaacattaagttgatctacatgcagagaagtctgatggagaatctaactgaagatgctgaaaagattcatgagaaggttgttggttcatttgtgcggataagaatctctagcagtgatcaaaaacaagatatgtatagacttgtccaagttgtaggtacaagcaaggttgctgaaccttacaaaattggcacaagaacaacagatattaagcttgaaattttaaacttaaacaggaaggaggccatatccatttctgaaatttctaatcaggagttctctgaggacgaatgcaagcggttgcgtcagagtataaaatatgggctctcaaagagattgactgtgggagagattctaaacaaagcagtgacacttcaagcaattagagttaatgatctactaaactctccggaggaacgtcaacgcaggctgcatgaaattccagatgtacactctgaccccaatttggattcaatgtttgagtccgatgaagatgatggagagtcagatgaaaggaagcaagatagcaacatattttcaaaatatcttgggtttgatagaaaagagaggggttctatttttccaagaatttcgaatggcatctccaacgacatgggaagcaaaacacaagacttgcctgctacccaagaaccggttgggaatacatgcacattgaagaataatatcaactctgatgatacagctattgatgatagcactaatgcagttgtgaaatcagaagtgtccagtgttgcagtggaagtttcatcatcgcttctgtctactgggatgcagcagtcatttaatgattttttgaatgatagatcatggcattatcaggatccaactgggaagattcaaggacctttttctatgttgcagctgtacaagtggaatgcaagtggatgtttccctccagatctcagaatatggagggtaggtgagaaacaagataactctatactgttaaccaatgcactaagtgagaagtgttccaaaaatgtgtcattgccattcaacagccaattgctctctctaggggtcagtgttacattggatgataaaggtaatagtcaggatgctgggaagaatgcaaagaatgaaatttctacagatggccaaattattgaacagacaaaggaacaaaagccacaggtggataatacctctacccagtctgatggcaaagatgaaccggttaggagcaatggatgttccagccagctgcctgtataccctttgctactgtcaactgccattcctgagaaattgaatgagaatacttctgataaattaaggaaaggccatgcaattgtgggaaattccgaaaatagaaataatggctcgaacaggacatctgatgtgcagagtaatagtgggcagagttatcagaagcaatcagacagtgaagagaattcagggcaatcttctggacagacctggagacaccctaatgtaaatagttcttccaattgcttggttaccacgtctgctcatgtttctagtacaaaaacatcaccacataagctgggatttgatttgcataatcctccttcccctccagcatgtaatacaacttctggactgacctggattcaccctaatgtaaatagttcttccaattgcttggttaacacatcaacccatgtttctgatacaaaaccatcaccacataagcttgggtttgatttgcaaaatcctccttcccctcctgcttgtaatacatcttctggacagacctggagacaccctgatataaatagttcttccaattgcttagttaccacatcaactcatgtttcttctacaaaaacatcaccgcataagctgggatttgatttgcataatcctccttcccctccagcatgtaatacatctacatggcaggcaatcattggtgagcccaatgattttgatgaatcagtttcagatctgttggcagaagtggaagcaatggagtcacttggtggcttggaatctcccacttcaatcatgaaatgtggcgaggatttgactgaaggttctaaaaatgattgtctcagttttgttgcagagcttagcccaattcttgatgcgggtaaaggtgatgccctgagctccactggtgatttaaacttaccatctcacccgacagcagctgaggaaccattacgacaagcagatgtgcatcaccatcatcatcaaagaatttctgcggaggattcttcaagaagttctaaagttgaggtgggtacaaagaacggtgtttcaggtaatcaatgggattcaggctcagaaaattcacccattgttccatcccctggaacattgggcctggctatagacaccacttggagacttggcttagagaatacacacttgggatggagtggaatagatcaaggaaatgcaaatgtgggttggggagtaggacagactgcagtgcaggaaaacagaagttcaaagatcggggttttcaaggtcatggtagggaatcaggttttagtagaagcagaattccatataacaggcaaccgtcatatggtgttggaaatggaggatcatataggcctctgcccaaagggcagcgagatttggtgctttagctccaattttggtaccctgatccctgtaattagagcaactggatttgccaccgctggtagtgctgctgcaggaactgttgctgctttgcttgtgcatcatatggag

SEQ ID NO: 36442 - DNA, 1279 bp, Glycine max
  Peptide Sequence Number=SeqID_153220
atgaaggttgaagttgaagtaatctccaaagaactcgtgaaaccctcctctcccacccccaaccatcttcgtcattacaatctctccttgctcgaccacctcactccccaactcaacaactccatggtctacttcttcgctgccaataatgtttcaaaccaattcttaaacacctgcaccgaaaatgcttccaaccacctcaagaaatctctctcagaagccttgacacattactaccctcttgcgggaagactcgtggacaaggctttcatagagtgcaacgacgagggtgccctctacttggaagccaaagtgaggtgcaagctcaacgatgttgtggagagtcctatccccaacgaggttacaaatttgttaccctttggaatggatgatatcgttgacacaccccttggcgttcaacttaacgtttttgaatgcggtggaatagccattggtgcatgcatgtcccacaagattgctgatgctatgtccttttttgtgttcattcaaacttgggctgctattgcacgtgattacaatgaaatcaagacacatttcgtttctgcctccttatttcccccgagggatataccttggtatgatcccaacaaaaccatcacaaaacctaacactgtgtccaggatatttgtgtttgatgcttctgttatagatggtcttaaagcaaaatatgcagaaaaaatggctctgcagaaacccccttcacgagttgaggctctatcaactttcatatggacccgctttatggcttccactcaggttgcagcatctgagagctctaaattctacgtggtggctcacactgtgaacctgcgttcgagaatggaccctccactaccagcacatgctttcgggaactactatcgggctgttaaagcgtttccatcacttgatgataaaggggaatgctatgagctggtggagaagctgagagaagaaataaggaaaattgacaatgaatatattctcaaacttcaggagggctctgagtacttgagctctcttagagaagatttgcgcagattcgagaatattaagggggaaattgtgccgtttaccttcactgctttgtgcaggtttccagtgtatgatgctgattttggctggggaaagccaatttgggcatgcccacctgcatggaaagtaaaaaatgtggtcgtttttacagataccaagtttggtggtggcattgaagcacatatcagcatgatggaggaggatatggctagatttcaaaatgacaaggagctccttctacata

SEQ ID NO: 36443 - DNA, 246 bp, Glycine max
  Peptide Sequence Number=SeqID_153221
atgagggagagccacgatgcaacagtaaggttgctaacttgtgacctagaactcatgggttcaaatcctagaaagctctccgcttgcatcctccccaaaccccgcttggtggaacttgggagccttgtgcattacggacttgaaaagaagtcactttatgcatcaccaggcgagctccaaagcttgataaagcaggttctttcatgggatatttcggtcattgagccagcgaaatcggccacatga

SEQ ID NO: 36444 - DNA, 583 bp, Glycine max
  Peptide Sequence Number=SeqID_153222
atgaggatgtcctttcaggataaggtgtgggatcaacaagtaccctttccaaggaaggaaagggggttatggaggattattggaggatacaatgtcatagacataggacacggtttcttcatggtaaaatttgacttggctcaagatagggagaaggtgattcttggagagattgacttgagcaaaccagtggtgaggaaggtctggtttaaaaatcattggttccatgttgagtatgaggggttatatttgttatgcaagacgtgtggactatatcataaggactggccgaagttgaagaagggagacatgctagttgttgggaagtcaaaatgtgggggagatagagaggatttttatggggattggctagtggttacgaaagaggaagaagggagatattctcatgggcgtgcaagtgtgacagtgtctgaacatcacatggagtcacaatggcaggaaaatgaaggtcaagggaagatgcacatggtagaggtgacgtccaaccaggatggtaggttgaaaaaggaaaagccactagatataactcagaatgaaatgatggtagagggagtgattgggg

SEQ ID NO: 36445 - DNA, 951 bp, Glycine max
  Peptide Sequence Number=SeqID_153223
atggaaggtcgacagattctttccagattctgtccaaaatcatcttcagtgtcatctattccaattgtgaagcagcaatactctctaaagttccctcttttaccttcttcatcgtcgcatctttctagtcaatctcagaatctcgatgttcctagcagagctgtccatcctatcagcattgtgcacaaagaagtgtgttctagttcttggaggaggatatggtgtagtagtagtagtagtagtagtagtagtagtagtagtgctgcagaaccaaaggagggccatgaggtaacggctcaggtcacggtgggaaggaaaaagctagcagttttcgtgtctggtggaggatccaacttcagagccattcacgaggcctccaaaaggggatcacttcatggagatgttcttgtgttggtcacaaataaaagtgattgtggaggtgcggggtatgcaagaaataacggtatcccagttatattgtaccctaaagcaaaggatgaatccaatccaagtgaccttgttgagacactaaggaaattcaaggttgattttattcttttagctggatacctcaaacttataccagtggaattgatccgagcttacgaaagatctatattcaacattcatccatcacttcttccagcttttggaggcaagggcttttatggcatgaaagtgcataaagcagtaattgcttctggagcaaggttttcaggtcctacgattcattttgttgatgaacactatgatacagggcgtatccttgcacagcgtgttgtccctgtgcttgccaatgatactgctgaagagttggctgcaagggttctcaaagaggagcaccaattatatgtggaggtggtggaggctttatgtgaagagcgtgtggtttggaggaaagatggtgttcctctcatacaaagcaaagaaaaccccaatgagtttcgctga

SEQ ID NO: 36446 - DNA, 328 bp, Glycine max
  Peptide Sequence Number=SeqID_153224
gtgtggcttaaccatacaagcttttaacatgcttccagtggggtgccttgatggtggaagagcagtgcagtttggtataggaggtaaagggaagactttgaagaataaaactctctatcttggtggacctctttcacttccttggggactttatgttttgttatgtcagagggcaccggagaaaccatgcttaaatgatgtgacagaggttggaacatggagaaaggcacttgtggcaattgctatttttcttgttgtcttgactcttgttcctgttggggatgagcttgcagaggaactgggtataggtcttgtaactgcattttga

SEQ ID NO: 36447 - DNA, 279 bp, Glycine max
  Peptide Sequence Number=SeqID_153225
atggaggttgcggtgagaagtggcgtgcggttgtgtaagggtttcgtgaggattctgacttttgaggagatcaatgcattacctaatgaccttgtaaatatgtctatccagcctatttcaaacaatattgatggattacatttggatgatgatgaacatggtgatgcacaagagaatgctatggaggatgtgaaccaaaatgaaagcaatgttagggaaagttctgatttcatggatggagagcatataagagggcctgaatttgacgatgccacttaa

SEQ ID NO: 36448 - DNA, 1071 bp, Glycine max
  Peptide Sequence Number=SeqID_153226
atggggactctaacgagttgcagtttcatgcctctgaactcggagtttcgccgcgccttcagggagaggattcagtgccacaagctcacgcgcttgaggggcacctcctgcttcttctcacgcgcgcgagtacccaaatggggcaagtcgaagctccccaatttcgatagccttaggagttttgctactaagaacgacaacagcgacggcgacaaggacaacagcaaccacgttggagccgccggagaggaaagtggcggcgacgattctaaatcaaatgttacgacgacgatggccgaagaagagagagggttcacttcggagaaatcgacgcctccttccacttctcacaggtcgtctttgtcgtcgcttggaccagcatacaacacttttcaagttgattctttcaaacttattgagctccttgggcctgagaaggttgatcctgctgatgtaaagctgatcaaggataagctttttgggtattcgaccttctgggtgacgaaagaggagccttttggagacttgggagaaggcattcttttcattgggaatttaagggggaagagagaagatgtttttgccaaactccagaatcagctagttgaggtcacgggtgataagtacaacctttttatggtggaggaacccaatgcggacagtcctgatccacgtggtgggccacgtgttagctttggtttgctgcggaaggaggtttctgagccagggccgacgacactttggcaatatgtcattgcattgctgttgtttctcctaactattggttcctcagtggagctaggaattgcatctcagatcaacagacttcctccagaagttgtgaaatatttcacagatccagatgctgttgaagctccagatatggagcttctatttccatttgttgactcggctttacctttagcatatggtgtcttgggggttcttctgtttcatgaggttggacactttctagcagcatttcctaaacaagtaaaattaagcatacctttcttcattccaaacatcacacttggcagctttggtgctattacacagatttacaagtaa

SEQ ID NO: 36449 - DNA, 1515 bp, Glycine max
  Peptide Sequence Number=SeqID_153227
atgagatccttctcttcttcttccctctttctccttttcttcttcttcttctcttcttcactctccaatccccataatacccctctcacactcaaaggtgttgatattcaaaagccggttttggagttctccccttccggtgtttcttcgggttctcaaggtgtcagggacgctctgcggtgcgagcgtgttctagtttcgggcacctcgagactgaaacttgggagctacgctaattcgtaccgtgttactttggctccctccgtttcgatcccggagaagttgcatagcaaaattcaggtttgtttccacaggaatgatacacttggatggtgtcagtgtgagaaggatgaatggaggggtgtgcagaagggggtctggaatgctgttatgtcaccttatgaaactagatatgttgatgtgaggatcaatggagaaatatcgggttctgttatagttgctattgaagaagattttcagcaatggcgccttgtttgtcttgcagtaggattgatactgctgttgttggctccaactgttagcagatgggttccgttttattatagcacttcaatggccatagggatctttcttgtcatcataatccttctttttcagggcatgaaattaatgccgactggaagaaaaaatatcttctaccttaccttgtatacttcagtggttggagttgggtcattccttttgcaccaattttctttgatcttaaattcaatttttcagagtcttgggatgagtgaagagatgcacaatccagttgctgtttttgtaatactgggcatcatcttggctggagctgctttaggctactggattgttaggaggtttgttatttctaaagaagatggttgtgtggatgctggagttgctcagtttgtgaaatgggcaatgcgcatcattggaaccactttcattttgcagagcactcttgatcctcttctagcaattggagctttgatctcttgtggtgctgcatgcaaacttatttctgccataaaatggctttgtggatggtatgaaacttcaaatgattactattcaccgcaatggatgagaggaaggcacggtcgtgcagaattccttagcaagtcaaaccctaaaggtaaacattggagtagccctaaaggaaaatcgtggaatagccctagaagatcggcatggtctgactctcctgtccgaggtgttgtatcaccattttccgggatttcgtcacaatcttctgggactcaagcagggctggattattattcaaccttccacaagacccggaacagaaagaagttcacaaagcaagagtgggatgagttcacaagagaatccactaagcaggctctagcagaatgggcagcttctccagaatttactgattggatcgttgagcatgcagaccggatacaagtccttccaagtgagagttcggatgagacaatgggaagtgaatcggattccacagatcgaggaagcagaagtggatttcggctttttaattggcagtga

SEQ ID NO: 36450 - DNA, 1191 bp, Glycine max
  Peptide Sequence Number=SeqID_153228
atggagatagtgaacgggtcacacaattttgagataaagggctactctctgacaaagggaatgggcgttgggaaatacatcagaagtgagacattcaccgtaggagggtaccagtgggccatatacttctaccctgacggaaaatacccagaatataaattcacttatgtctccattttcatcgcactcctttccaagggcaccaatgtccgcgctctatttgacctcatgttgctcgaccagagtggccaagggaaccacaaggttcactttagtccctccctccacaatgctccttacactctcaaaagttgtggcagcatgtgggggtataaacgattttatagacggagaaaacttgaggcgtcaactttcctcaaggatgattgcttgaagattaactgcactgtcggtgttctggtgtcgtccattgattctactaagttaaacccaatccaagttcctgagtctgatttgggggcagattttgcaatcttattagagaatgagcaattttctgatgtgactttcacggtcagtggagaaaggtttcatgcaaataaacttgttttggttgctcggtcaacagtgttccaaactgaatttttcaaagggatggagaaggatgaccgtggtgacatagttgttaatgatatggaacccaaggttttcaaggctttgcttcattatatttatagggacactcttatagaagatgaagagctctttatgctgcattcgtcattattgccttcgctgtctgaatcatttccagccaagttgttagctgctgcagagaagtatgagttaccaagacttaagctgatgtgcgaatctgtactttgcaaagacatatcgatagattctgttgcctatattctccctctggctgatcgttatcgtgctactgaattgaagtccatctgtctgaaattctctgctcaaaaccttcgtgctgtgatgcaatctgatggtttcaagtatcttaagcaaaattgtccatggctactagtagaactgctaaagactgtgggagggtgcgaggagaaatttagtggaaaaagaaaatatgcaactatgaggggccaatcttctggtggtgatgacaccggtgctaggagtgtaaacaaaactgaaggaagtccaagcttaagggaggatacccattctgagagtgttcaccaacaataa

SEQ ID NO: 36451 - DNA, 486 bp, Glycine max
  Peptide Sequence Number=SeqID_153229
atgggcatcgcaagcgagacgttcagagtgggaaggcaccagtgcgctctatacttctacccttacggcaaggacctcgaagataactccatttatgtctctgtcttcattgcacttgtttctgacggcaccaatgtctgtgctctgatcaaattcacattgctcgacctaagagagcaacgaaaacattttgttgctgtcgaaaaccactacgataagcttgttttggcagctcagtcaactgtgtttgaaactcgatttttcgatgggatggagaagaatgatcgagagataatagttgttactgacatggagcctaaggttttcaaggtagcatatgtactaataataaattcggccggcactcctattgaagatgaagagctctatatgtcgcgttcgtcattattgcctttgttgtctgaatcatttccagcaaagttgttagctgctgcagaaaatatgattagccaagacttaagctga

SEQ ID NO: 36452 - DNA, 771 bp, Glycine max
  Peptide Sequence Number=SeqID_153230
atggcaatgtacagcccagtggccgcgagcagaagcgttctagcggctcaggcgagttcgaggttggtgacccaaatggtgaaaggatcacacaagttcgagatagagggttactctctgacaaagggaatgggcgttggaaaattcattgcaagcaaggggtttaggcagccttacaaatggagacacctcgaggtgtcaaatttcctcaaggatgacaacttgaagtttaacttcactgttgttgttcttgtttcgtccattgattcctctaagttaaacacaatacaagttcctgaatctgatatgggggcacattttggattgttgttagagaatgaggaattcactgatgttactttctccgttggtggagaaaggtttcatgcacataagcttgttttggctgctcggtcaactgtgtttggaactgaatttatcaataagatggagaaggatgatcgtggtgacatagttgttaatatgacatggaacctaaggttttcaagagacactcttatagaagatgaagggctctttatgccgtgtacaccattcttgccttcactatctgaatcatttccagtgaagttgttagaacctgcagaaatgtatgagttgccaagacttgagctaatgtgtgaatctgtactttgcaaagacatatcaatagattctgttgcctatattctagttctggctgatcgttatcatgctgttgaatcgaatttccatctgtctaaacttttctgctcaaaacctccgtggtaa

SEQ ID NO: 36453 - DNA, 363 bp, Glycine max
  Peptide Sequence Number=SeqID_153231
atgattcaagtgttgttagaagaggagatgcttattaattattatcaagactgggctcgagcattacaagacactaagcctaatgaatttctgcagcaacatcattcgagggtttcatggattccaccggttcaaagcaggctgaaaagcaatgtggatgctgcattcttcaatgagatgaactacacaggctatgataacaaagaagtggcagataagaggcttttgtctttgaatccaacttatgctgttggttttttgaggagacatagtatggagttgctcatgctttggctaagacatctccatccttcactagtcttcaagttttctatcaaactccctatttcattgctcatttaa

SEQ ID NO: 36454 - DNA, 183 bp, Glycine max
  Peptide Sequence Number=SeqID_153232
atgggatatggtacgtcatggcggtggtgcgatctggtacaaagaggtagcattgttatgattttgagactaattgagaggtttcaagagagtgggaagtggtggcatgaggtgaggaaaattctacatccgttattcattgaactgatggagaaaactcatctaacatcggttcaagaataa

SEQ ID NO: 36455 - DNA, 576 bp, Glycine max
  Peptide Sequence Number=SeqID_153233
atggcgagtcggagcattctggcatctcgacgaggttactctctgacaaagagaataggcgttggaaaatacatcgcaagtgagacattcaccgtagaagggtgcatagccactttgtttgaactccctccctcgagaatgggccttacactctcaaaagctgtggcagcatgtggttactgggggtataaacggttttacaaacggagacaacttgaggcgtcaactttcctcaaggatgattgcttgaagattaactgcactgttggtgttctggtgtcgtccattgattctaataagttaaacacaatacaggttccagagtctgatactagggcacagtttggaatcctattagagaatgaggaatttttttatgttactttcttggtcggtggagaaaggtttcatgcaaataaccttgttttggctgctcggtcaacaatgttccaaactgaatttttcaatgggatggagaaggatgaccacggtaacataattgttaatgacatggaatctaaggttttcaagtccgcaactgcaattgcatgtggccataacataatgatattttga

SEQ ID NO: 36456 - DNA, 141 bp, Glycine max
  Peptide Sequence Number=SeqID_153234
atggcatgtgagttctacaaccagctggcagcggtagccacaaattcatggtcggaaatacattgcaagcgaggtgttcacggtgggagggcaccagtggcctatatacatcttcgtcgatggaaaggagtagaaagataa

SEQ ID NO: 36457 - DNA, 216 bp, Glycine max
  Peptide Sequence Number=SeqID_153235
atggagatagttgttagtgacattaagcctaaggttttcaaggctttgcttcattttatttatagagacactcttatggatattgaagagctctctgtgccgtgtttgtcattgttacctttgctgtctgaatcacttccaacaacgttgttagctgctgcagaaaattatgctgtgatgaaatctgatagtttcgagtatctacaggaaaaatga

SEQ ID NO: 36458 - DNA, 444 bp, Glycine max
  Peptide Sequence Number=SeqID_153236
atggaaaatggcaatgtacaattcggtgacagtgaccaagagcattctagcggctcagatgagttcgagtggtcggtgatggagatggtggaagggtcgaacaagttcgaaaaagagggttactctctgatgaagggaatgggcattagaaaattcatcatgagcgagactttcacaatgagaggcagtttttcaaacgaagacaccataaaagttcctgagtctgatatcggggcacattttggactgctgttagagaatgaagagtatctgatgttactttctcagttggtgaagaaaggctccatgcacatatgcttgttttgggtgcttggtcaactgcatatgtttgaaactgaatttttcaatggaacggagaaggatgatcctggtgacatagttgttaatgacatggaacctaaggctttgcttgactctacttag

SEQ ID NO: 36459 - DNA, 387 bp, Glycine max
  Peptide Sequence Number=SeqID_153237
atgaaccggtgttgtcttattcataaattaaaacaccaaattcttttccctcgcacactcagtttcgcaaaccctttctccctcaccgtcgtctccctcctccacgacactgcattttgtgacccgtcaccgctgtctcctcgtcaccccaggtcatttcatgtcaccatcagcgccagtgaacttgcaactggtcttgtacgtggtggcttcttttcagattgtgagcatcttggacttctgaaaactcttctgagcatcctcttcatcacttacttgaagatacattccgttgaggctgtagcaagagaactaaaagatccttcttttcgtgtaattcaaaaccactttgcaattttaggaaatctaggagaggcaacaacaaag

SEQ ID NO: 36460 - DNA, 387 bp, Glycine max
  Peptide Sequence Number=SeqID_153238
atgaagccacattttaagagtcttaagatttcttttggcgatgaacttaaggacaatgcttcaattgaaatcatagaagcaagaaatgaaagacatatttttagtttcaggtttgagttcattccaattactcaatcttctaagtcaccacctagacatgcctcgccaaatgtgggggaagggctgccactggagccatcagatcagaaaacaatggcatactttgatggtataaatgatggaggaagtcttggtcataatgcaggtggacacattgatcagaacacatccttaaagatcaaaaccaaaaagacaccctcagagagaaaacatggaaaatctgagaaatcaatttgtcttgatgttttgcaacattacttcacatga

SEQ ID NO: 36461 - DNA, 300 bp, Glycine max
  Peptide Sequence Number=SeqID_153239
atgaagatcttaaccatgaaagacacagataggaagtctacatgttttggttttgtgaattttgaaagtccagattcagcagttgctgccattgaaaggtcccgtgcatgggcgattgtgtatgtttgggcgaatgatcccactattaagggagggacctattatcccattactatcaagatgcacctcagggcgcaggagattgcagctcaatgcaaattgccctgcatatattttgttgattatgtgctagagttttttctgcctctagggatcaaaaactttaatgaacaaaaatga

SEQ ID NO: 36462 - DNA, 522 bp, Glycine max
  Peptide Sequence Number=SeqID_153240
atggcgaactcggtggtcaacaaacgctggctggaggaactgcggcgctatccggagcggtataccgtgcacgaactgcatcaggcctacccggactggcagatcgacgtcgcccaagagcagcggctgatcgaagcccatgacaacatcgtgctgcagttcccgattttctggttcagcagcccgccgctgctgaaaaaatggctggacgatgtgctgacctacggctgggcctacggttctcgcagcggctacaagatgcaaaacaagaagctggcgttggcggtcacggcgggggtgcgcgcagaggattatgcgcgcgacgggcgctatcgctactcgctggaggaaatcttccggccgtttgaagtcactgccggttacgtgcgggccgactatgcctcgttcttcgccttttacggcagggaggccgcttcggacggcacggtggagccgctgcaatcccacgaattggatcgtagcgcgcaaggctatcaggcatttctcgccgccctgaattaa

SEQ ID NO: 36463 - DNA, 141 bp, Glycine max
  Peptide Sequence Number=SeqID_153241
atgggtccgttcgacacgtgtcactcttctattggttttctccaattgttccgacgtagcgcaggaccaccaaatcttacgttgtctgctgtgagagtgaaagaaaaagaaaaacttccttctgaaattaccacggtttga

SEQ ID NO: 36464 - DNA, 987 bp, Glycine max
  Peptide Sequence Number=SeqID_153242
atggaagtatttgccgaggaaaaagaacggcaggatgccacgctggatgtgccgccggtcgtggtgaaaggcatattgccagatcgtctcgatgcagtgcctggctcctaccaggtgattgatgaaaaggcactggaagcacggcggccattttcgatccaggaagccttaaacaacgtaccaggtgtgaatgtggtcggggaaaatacctttgggttgggcgtgaatatcggcattcgcggcctgaaccccagaaggacggcgcgcacactgttgatggaagatgggatgccgctgtttctggccccttacggggaccctgccgcgcattacactactcctctcgagcgcgtacagcgtattgaagtggtcaaaggatctggccagattttatatggtccgcaaacagtgggtggcatgatcaactttgtgacgcggccagtccctacagatggcaaagtgcatggcaatgtgacagccacattgggcaacaacgactttaccagcctgtatggcaacattggcgcgggtgacgagcggggtggcctgatgattgatgccctgcataaaaaaggcgatggcattcgtgacaatcacgactttgaaatccaggaatacaccgccaagggccagttgaacctgtctgaccggcataccctgattgccaaagccagttatttccgggagagttcgcatgtctcagaaaccggtttagggctggtggaatatcacgaggacaagtatcaggcccctactggcaagaatgatgtatttgaacatgaacggaccacgtttcaattgcagcacctgtttcaggtcaatcaccaggtgaaattgagcacccaagcgtattatgccaaatccgaacgggcatcattcaggcaaatcaatgatccaggtgtaccgggttgggtgtggcgactgaagcaaatgcagcgttatgtggcggccgctggcgccctagggagtttgagtactggggcatag

SEQ ID NO: 36465 - DNA, 744 bp, Glycine max
  Peptide Sequence Number=SeqID_153243
atggtatggcttctattggcgttcgtgctcatgcaaagttacactgcaaacttgacttctatattgactttggatcagttaagacccagttttctgaacgtaaatgatctaagaaaagggggttattatgttggatatcaaaccgggtctttcgttaaagatgtgctggttcatcaatttaattttgactcgcacaagctgagggcatacaacacaagttctgagtatcatgatgctttaaaaatgggaagcgaaggtgggggtgttgcagctatattcgacgaattgccctaccttaaagtctaccttagagaatacggatccaattacatcttgtcgggcccaagatatagaaatgctgggtttggttttgcatttccttttaactccaatctcactgctgacttttcgagggccatcttgaatgtgactgaaagtgatttaatgaaagaaattgaggaaaaatattttgggaagaatgatgatattggaggagaagagacgtctactgaaatttcttctgctactctaagtctcaactttcatagttttgcagggttattcttgattacagggatttctactttattagcgctattggtctcagaaactgttatttggcaaagggcgattttgatagccaaggcatacagtcagaagtttttgttctccactccaccttccccacaaacacgagttcatccaactcaagattcaacgcacggatcaatagaggccgtttaa

SEQ ID NO: 36466 - DNA, 120 bp, Glycine max
  Peptide Sequence Number=SeqID_153244
atgatactctactttaagaaagaaaacgatgaactattagaaaagatatcaacttctgatgtccaggacaataagcctaatttctgtaattacttgacatggaaagacaagctgcagtga

SEQ ID NO: 36467 - DNA, 777 bp, Glycine max
  Peptide Sequence Number=SeqID_153245
atgcgaacgctttgtgatgcttgtgagagtgcggcggctatagttttctgcgccgctgatgaggctgcactttgtcgtgcctgtgatgagaaggttcacatgtgcaataagctagctagtaggcatgtgagggttggtcttgcaagtccaagtgatgtgccacggtgtgacatatgtgagaatgcaccagctttcttctattgcgagacagatggaagttccctttgtttgcagtgtgatatgattgttcatgttggtggtaaaagaacgcatggaagatatcttctgttcaggcaaagagttgagccttacccttgcatatgcaaagaggctgtttccggattcgaacccatgaccaacaagtcaccaagtgaaaaagaactaaagtttgcaaagtcaggaagtaaatttccaggagataaatctagtcatgctgaaaatccggcttcacaagcattggaaccaggtgaggctaaaagaggacaaaatccacttcccaagctaaaaatgggagagaaacaacaaaatcacaggatgcctatggttccaacaccaggacctgatgctgatgggcaaaccaagatggaaactaaaatgattgatttgaacatgaagcctaatagaatacatgaacaagcatcaaataaccagacttgtccaaatagttttgattgggatatgggactcattgaaacgtcatgtgatgtgattgtcaaattacttgggatcaaatgtcccgctatacttgaaggaacatcatctgatccctgcatgtaa

SEQ ID NO: 36468 - DNA, 795 bp, Glycine max
  Peptide Sequence Number=SeqID_153246
atggaacatgatgaaaatattcactatgtaggagatggagatggagatgggttaggtagtggtgctgctaaatatttcattggttcaattctactgggctggcaaggggactacaaggattccttcgtcaaaaactgctcgagatttgtgttgatggtatggcttctattggcgttcgtgcttatgcaaagttacactgcaaacttgacttctatattgaccttggatcagttaagaccccgttttctgagaaaaggggagggttattatgttggatatcaaactgggtctttcgttaaagatgtgttatttaagcaatttaaatttgacccatccaagctgaggtcatatagcaacagtgctgagtattataaggctttaaaatctggaagccaaggtggtggtgttgcagctatattcgatgaagcattccctttaaactccaatctcacggcttacttttcgagagccatattgaagaagactgaaagtgatttaatgaaagaaattgaggaaaattacttggggaagaatgatgatattggaggagaagacccgtctgcggaaatttcttccgctactccaagtctcaactttcatagcttttcagggctgttcttgatcaccggaatagctactttaataactctattagtctcggaaactgttatatgggaaaagcccattttgatagctaaagcatacagtcagaggtatttgttcaccactccaccttcagcaaaaacaagtgttcatccgactcatgactcaatacacagaatagaggtcctttaa

SEQ ID NO: 36469 - DNA, 272 bp, Glycine max
  Peptide Sequence Number=SeqID_153247
atgcgtttacaagccaatgcccaatcagttgataatcaagaaactgctagatttgcaaagtggattctagatattggagatggagttattgggaatgaaaatgatgaatatgctacagttgaaattcctgagtacctactgattactgaatataatgacccaattgatgctatagttaggtcaacattcccaaatttatatcaacaccacagtaatcctgaattcttcaaatgtagagcaatattggcttccaccaatgaaacagtgaagag

SEQ ID NO: 36470 - DNA, 320 bp, Glycine max
  Peptide Sequence Number=SeqID_153248
atgaatttggttcttgatgatgctgaagaagtgagcatcaagaagaagagcagaaagacattagagcttggtatagtccgtcaaaagcttgggctcttgcctcactcaccgccttcttggtttcatttctatcgtcggattcagaaacaggaagtaaaggaagcgttgaaaagaatgagtaatggtaaggcagtggggccagacaacatacctattgaagtgtggaaaactcttggagatagaggtcttgagtggctcaccgaactctttaacgaaattatgaggtcaaaacgcatgccggaggaatggaggagaagcac

SEQ ID NO: 36471 - DNA, 3430 bp, Glycine max
  Peptide Sequence Number=SeqID_153249
atggattctgttggaggggaagaggcaattcaagagcctacagaccatgatgagaggattcttgtttcggttcgtcttcgtccccttaatgaaaaggagcttgcaagaaatgatgtttcagattgggaatgcatcaatgacaccaccatcatatacaggagcaacctttcagctactgacaggtcactctacccaacagcatattcctttgacagtgtgtttcgaacagattcttctacaaggcaggtgtatgaaaaagcagctaaggaagttgctctttcagttgtcggtggcatcaactcaagcatttttgcatatggacaaacaagtagtgggaagacatacaccatgagtggcataactgaatacacagtggcagacatttttaactacattgaaaagcacacggaaagagaattcatgttgaagttttcggcaattgagatttataatgaatctgtaagggacctccttagtccagactgtacccctctcagacttctcgatgatccagagagagggacagttgttgagagactgactgaggaaactttaggagattggaaccattttacagaacttatttctttctgtgaagctcaaaggcagataggggagacagcactgaatgaagcaagctccagatctcatcaaattctaagactgacaattgaaagttctgcacgtgaattccttggaaatgacaagtctagctctctttctgcttcagtgaattttgttgatcttgctggtagcgagcgagcatcccaaacccattcagctggcacgagattgaaagagggttgccacataaatcgtagcttactaactctaggaactgttatccgcaaactcagccaaaagcagaacgtttgtttcacatgtaaggcacatgctacggtggtcaagtgtgtaaacttgtgtatgaccttggattgcgggaaagccttcgtcggactcggaaagaactaccctctccctttcgtccacaatctcaattctccgtcgcggaaaccaccgttaccgccatcaccgccgtcaccaccaccgaccttgaccgcgccatcatcggatttatgccaccatcgccgcctcattcctccgccaatatcttcttcgcctcccactcctgctccggcgtggcgccgacgccgtcgtgtctactgctcttctgtgactggaacattgaccagaacgacctcgccgaacggcttccgtcgttttctcgccggcgagtccctcgtgctgtcgagatccgaaagcctatctccgccgcgactgccaccgccagagaaccgtgaccgtgacaagagaaacggaatcgccatggagtgcgagcggcgaagccctaactcttgctcgatgaggttgtggacgcggccaacgaaaccgacgccatcgtcggcaccggaaaaacgcgataagaaggaggaagaggaggaggagctggggagaaatggacatattcctttcagagattcaaagctaacccgcatattgcagtcctcattaggaggcaatgctagaactgctatcatctgcaccatgagccctgcccggagccatgttgaacaaaccagaaacacactcttatttgcaagctgtgctaaagaagtgtcaactaatgcacaagtcaatgtagtggtgtctgataaagcactagtcaagcaattacaaaaagagttggctagactggaagatgaattgagaaattcagggccagcccaccttacttctgagactgcagcattgttgagagaaaaagaccgtcagatcgatatgttaaagaaagaggtaagagagctgaccttgcagcgggaccttgcacaatctcgaataagtgacatgctccgagtgcatggagaagatgtggctacaatagaactgcaaagtatggatcctcaatatccaaatttacacatgagaaattcatggaactttgaaaatcaaagagaggagccaaatgtattaagtcttgatggtgaagagagtgtcaggtcttttgatgcatctcaatattcagatggacatagttttagttctgatgaaaacttattccaactccctgaccttgaaaagaatcttctggtcagaaattctcccccagggttgccagtcaaaaggactgatgctgtaccgaatgatttggatcagaaacgcattgaagaacagcatgaagaggacaattgtaaggaagttagatgcattgagttggaagatgtaatcacaaacacacataaacactcaaatacatcagatttaagatcaaatacatacactgattctaatgcatcatctcctagtgcaaacacagctatctcaggattgattgtagttgataatagagacaaggaaaaagtagtagatttgagttcatctgggtcaaaggaagacaaaagattgaaccatttgcaccaagattttgttcttccctctccaaaagaaatttctgtgtgcatgacaggaaacagtacaagtagttctagaactttgaagttgagccgaagtagaagttgtaaagcaagtatcatgaggaatttatcttcagattggtttgaagatgtagacgtaattcagaacactcctccaatagggattgaaaaagccttccctggaagaccggagggctttccgaagaacatttatgcactaaactataatgccaatgcagaaaggctttcatgtaatggccatgggaattctgtacaaaattcttctgttgatgatgtacagaatgtgaaatcctccactaacaaggaaagagagggaacagaaaatattaacaggttgaatttactggctggccatgaggttccggggacaggattggattatgcaaagaatgtcaaagatattggcttggaccccatgcaaactgatggagaaagtctctcacactcacactggccttcaaaattccagaggctgcaaagagagatcattgaattctgggatgcttgtaatgtttcattggttcacaggacttactttttccttctattcaagggggaaccatcagattctatttatatggaggtagagttgagaagactatcatacctcaagcaaacgttttcccaaggcaatcagactgtggaagatggacgaaccctcgcacctgagttaagcatgagatatcttagaaaagagaggcagatgctgagcaagcaaatgcataagagactgtctaaatatgataggcagaacctgtacttgagatggggccttcgtttgagttcaaagcataggagtttgcagttggcccatcaattgtggagtgacacaaaagacatggaccacgttagagacagtgcatcaattgttgcaaagctggttggtttagtagagccagaacaagcatttaaggagatgtttggactcaactttaccccacaacctacgagtaggaaatcttttagttggacagcca

SEQ ID NO: 36472 - DNA, 661 bp, Glycine max
  Peptide Sequence Number=SeqID_153250
atggctaagtgcttttcattctctctctctcgttttctgatcttttcgtttgtgctgctacagacacaaacggggaatgggtcaaatgcaacaccgatcaagttgagagtaggggtacccaagaaagatggtttccgccaatttgtggatgtagtaccttcggactctcatgaaaaaaagtacaacgtatctggatattgcatggatgttttcaatgccgttgttacccgcttacctttcaaggtttctcttcatattcaacaaccttatggtattgaatcaagtgagatttctggaacatacgatgcacttctccatcagatcccagcaaagcagtacgatgttgtggtaggggatgtaacaattctggcgaaccgttcaaatttcgtagatttcacgctgccatatacaggttcgggagttaaaatgttagtaccagctcaacatgggaggcaacaagccatgtggattttcgtgaaaccattcagctgggagctttggttgagcatagtcatcatctctaccttcatagggttttccatactcatcatggaaagaaatgtaaatgctcttcctgatcacgagggttcgccaaatcgagcaaagcttagccctgcaaccatcttatggtttccaatttcacaagccattcttcctgaaa

SEQ ID NO: 36473 - DNA, 229 bp, Glycine max
  Peptide Sequence Number=SeqID_153251
tttaaggactgcaaattctctgcttctctacacatggagccggtgtcatgtgctaatttctctacacatggaacgtagacgaagaaagagtaggaggaatagaagaaaaagaagtaacaggagcaggaagaagagaagatatagcgattcagatgagagagaagacagggagagcgatgactctgatagcagtggtagaaagaagaagaaacgatcttcttgggtatga

SEQ ID NO: 36474 - DNA, 588 bp, Glycine max
  Peptide Sequence Number=SeqID_153252
atgtggcaaagacaacgatcaacctgtactaaggtcattggttcgctgctcaattggtatagagttgaagtgatggttaatcacaagggcgaacaaaccaaatttttgctctgggaccgtgaatgtgcagagttaattggtcaattagtcgatgaagtcaacaggctcaaaatagcagatggcgatgttgatttaaatgcctctcctcaagcactagatagggtactgggttgtttccttgcattcaaagtcaaggtacaatcaaggttcaggaatgttgttgttcttaaatattcagatgaattagacttgatcaatgttgtgctagatatgcttcctgatactgaggtggtcttttgtcaaccatgttgcaagatcgagagttcaatgctagactcgaccgaccctacaaagcttgaatatcaatttgtgtctgttaccgtagatcatgacccccttctcaggattccattaacaccaactaagcgcctatcctctgatgaattggatgatgaacccaaaaactttgagatttcacccgcgcaagtttcctcaaacaaattacccagacattatcaggttgaatga

SEQ ID NO: 36475 - DNA, 198 bp, Glycine max
  Peptide Sequence Number=SeqID_153253
atgcgatacagtgggatgagtgaggacaagggggtggggcccgcgaagcgtttcgcgccaaagcaacgcaacggcatcgtattggttccggcaacggagttggatgatgtagccgttaacagtgtggggtccgaggtacacactgttcccaagggtttgttaatgcagcttgaaaagacatgtactagtattcagtaa

SEQ ID NO: 36476 - DNA, 3396 bp, Glycine max
  Peptide Sequence Number=SeqID_153254
atgcctgctctttttctcctcctcatggtgctgtgcgcaccgctcttaacgtgcgccgatcgcagcgccgtaaccgtcgctgagatccaagccttgacatccttcaagctcaacctccacgatcccgccggagctctcgacagttgggatccctcgtctccggcggcgccctgcgactggcgcggagtcggctgcaccaacgaccgagtcacggagctgcgtctgccttgtcttcaactcggtggcagactcagtgagcgtatctctgagttgcgcatgctgcgtaagataaaccttcgttcaaactccttcaacggaaccattccttcgtcgctgtccaaatgcacgctcctacggtcagtgttcttgcaggataatttgttttccggcaaccttccaccggagatcgcgaacctcaccggccttcagattctcaacgtcgcgcagaaccatatctctggcagcgtccccggcgaactccctatcagtctcaaaaccctcgacctctcgtcgaacgctttctccggcgagattccgagctccattgcgaacctctctcagcttcagttgataaatctttcctacaatcagttttccggcgagattccggcgagcctcggggagcttcagcagctgcagtacctctggctggaccacaacctcctcggaggaacgcttccttcggcgctcgccaactgctctgcgcttttgcatctgagcgtggagggaaacgcgcttaccggcgtcgttccgtcggcgatttcggcacttccgaggcttcaggtgatgtcgctctctcagaacaatctcactggctccattccgggttccgttttctgcaacggttccgtccacgcgccgtcgctgcggattgttcatctcggattcaacggtttcacggatttcgtggggcctgagaccagcagcacgtgtttcagcgttcttcaggttttggatattcagcacaatcgcatacgaggcacgtttccgttgtggttgaccaacgtgaccacgttgaccgtgcttgatgtttccagcaatgcactttccggcgaggttccgccggaaatcggaagccttatcaagttggaggagttgaagatggctaagaattccttcaccggcaccattccggtggaactcaaaaaatgtgggtccctaagtgtcgttgattttgaaggcaacgggtttggcggagaagttccttcgtttttcggtgatatgattggcctcaaggtgttgtctcttggtgggaaccatttctctggttcggttccggtgagttttggtaacctttcatttcttgaaacattgagtttgagaggtaataggttgaatggaagtatgcctgagacgataatgagattgaataatttgacgatactggaccttagtggaaacaaatttactggtcaagtttatacgagtattgggaatttgaataggttaatggtgctcaatctcagtggcaatggcttctctggaaacatccctgctagtttggggagtcttttcaggctaactacacttgacttgagcaaacagaatctttctggagagttaccacttgaactctcggggttgcccagtctgcaagttgttgcacttcaggagaacaagttatctggtgaggtgcctgaagggtttagcagtttgatgagtttgcagtatgtgaatctcagttctaatgccttctctgggcatattcctgaaaactatggctttcttcgttccttgcttgttctttcgttatctgataatcacattacaggaacaatcccttcggagattggaaactgctctggtattgaaatgcttgagcttgggtcaaattctttggcaggtcacattcctgctgatctctctcgcctcacccttttgaaattgcttgatttgagtgggaacaatttaactggggatgttcctgaggaaatctccaaatgctcgtcattaaccactttgtttgtggatcacaaccatctttcaggggccatacctgggtcattgtcggatctatcaaacctaacaatgttggatctctctgctaataacttgagtggggtaattccgagtaacctttccatgatatctggtttggtgtacttcaatgtctcaggaaataacctggatggtgagataccaccaacgttgggatcctggttcagcaacccctctgtattcgcaaataatcagggtttatgtgggaagccattggacaaaaaatgtgaagatataaacggtaaaaacagaaagaggttgattgtgctggtggttgtcattgcttgtggagcttttgctctagttttattttgctgcttctacgttttcagtctgttgagatggcgtaaaagactgaaacaaggagtatcgggtgaaaagaaaaagagtcccgctagagccagttctggaacaagtgcagctcgtagcagcagtactcagagtgggggaccaaaactagtgatgttcaacaccaaaattacacttgctgagaccattgaagcaacaagacaattcgacgaagagaacgtgctgagcagaacaaggcatggattagtgttcaaggcctgctacaacgatggaatggtcctttccattcgcaggctgcaagatggatcattggatgagaacatgtttagaaaagaagccgagtcacttggcaaagtcaagaaccgaaatttaacagttctcagaggttactatgcagggccacctgacatgagactcctagtctacgattacatgcccaatggaaaccttgcaaccctcctccaagaagcttctcaccaagatggccacgttctaaattggccaatgcgtcacctcattgccctaggaattgcccgtggcttagccttcctacaccaatcctcaattgtccatggcgacgtgaagccacaaaacgtcctattcgatgcagattttgaagcccacttatcagattttgggttagacaagttaacaagagccactccaggcgaggcctccacttcaacatccgttggcacactgggttacgtttctccagaagcagtcttaaccggggaagcctcgaaggagagtgatgtctacagctttggcattgtgttgctggaactactgacaggaaaacgacctgtgatgttcacccaagacgaagacatagtgaagtgggtaaaaaaacaacttcagaggggtcaaataacggagctattagaaccaggtttactcgagttggacccagaatcatcagagtgggaagagtttttactgggtgtaaaagttgggttgctttgcacagcacctgaccttcttgatcgaccaaccatgtccgacattgttttcatgcttgaaggctgcagagttggtcctgatatcccatcctccgcagatcccacctctcaaccttctccggcataa

SEQ ID NO: 36477 - DNA, 105 bp, Glycine max
  Peptide Sequence Number=SeqID_153255
atggaaggcgacgacggagctctagatgcacaaaggagggagatgaacaatagcagcaacgcaatgaagagggaaaaaacccagttttcgattgtcaacaagtag

SEQ ID NO: 36478 - DNA, 357 bp, Glycine max
  Peptide Sequence Number=SeqID_153256
atggagcatctgagcaaattagaaaagagaaacaagggcctacctgctcggggaaacggaggtgacgatgtgcagcaagggaggcgtttggttcgcttgcgagaaatgacaaggagaagacaaagaagaaggtgcatgagaatgagaacgctgaggtgcccggctaagaaatatttgtatgctacttgttgggtcgcgtccgatcatgcgtgtccgactgtccaaccgtgtccgatgacggcggaagcacctgacaccgcatcgcaccggagtcatgtccgcattcgtgtccggtgcgagtccgacgcgggacacgccgctgaagtgccacgtccgtacttcttagatgaagactaa

SEQ ID NO: 36479 - DNA, 165 bp, Glycine max
  Peptide Sequence Number=SeqID_153257
atgatcatgccaaatttcgtcaattggaatggacttgtggacaatcatagcatggacgaaaagacaaaggagtcaaagcttactcaaaaagcttggaaggagcttaacgatggaaatgacaatcatacatatgctttacagctttccgcttctttggttagttaa

SEQ ID NO: 36480 - DNA, 892 bp, Glycine max
  Peptide Sequence Number=SeqID_153258
atgggatcctccttcagttgctgcggctcagagagggtcgaagaagtgccaacatcatttggcgtagttcacaattcatggagaatattcacatacaaggagttgcacgcggctaccaacggattcagtgatgataataagcttggtgaaggtggttttggaagtgtctattggggaaggactagtgatggtcttcagatagcggtgaagaaactgaaagcaatgaactcaaaggcagagatggaatttgctgtggaagttgaagttcttggaagggttaggcacaataatttgctgggtcttaggggctattgtgttggggatgatcaacggctcatagtctatgattacatgccaaatctcagcttgctttctcatctccatggccagtttgctgttgatgttcaactcaactggcaaaggagaatgaagattgcaattggctctgcggaaggtcttctgtacttgcaccgtgaggtgacaccccacattatccacagggacattaaagcaagtaatgtgcttctgaattcagactttgagcctctagttgcggattttgggtttgcaaagctaatcccagaaggagttagtcacatgaccacacgtgtgaagggtacattgggatatttggcacccgaatatgccatgtggggaaaagtctccgaaagctgtgatgtctatagctttggaattcttctcttagaacttgtaaccggtagaaaacccatagagaagctcacgggtgggcttaagaggacaataactgaatgggccgagcccctaataaccaacggaaggttcaaggaccttgttgatccaaaactcagagggaattttgacgaaaaccaagtcaagcaaacagtcaatgtggcagctctttgtgtccaaa

SEQ ID NO: 36481 - DNA, 258 bp, Glycine max
  Peptide Sequence Number=SeqID_153259
atggtttggcacatccaatctgtgtttctgctgcaaaatttgcttcctattctgcttcttcatgatgttgacaattttgaaagcatagtgacatggacacggacacgaacacatgaacaattcaatatttcacctgtaaccggtggtatcttgctccaaatggcacctcccagcatcccaactactgctttgaacaaatgcttgagacagatccaatcttggggctggggggtgataggtgcattttgctcactttaa

SEQ ID NO: 36482 - DNA, 225 bp, Glycine max
  Peptide Sequence Number=SeqID_153260
atgaagcaagtggttaaccttttgaaagggtatgaatctgaagagaagaaggtcactaccatgaggatagatagtgtcaagtataatgaagaattattggcacttgatcaatctagtgatgatgatcatgatgatgcaaccgctatctttggtgtttttagtgccattgaaatccaaaagatgaaggatccatacaagcaaagtgataacaagattatgggctaa

SEQ ID NO: 36483 - DNA, 1872 bp, Glycine max
  Peptide Sequence Number=SeqID_153261
atggtacttccctcccctgccaaaatactagttggcctctccttagacccagatgacaacaaggagcttctctcatgggcaataagagttttagccaatccaaatgacaccattgtggctgtgcatgttcttgttgttgcggacaagaagaagcgtgtctcggtcagaagaaggcaatcacaacttaggcaggcaaaagcttatgttatatctgtgcttggagaatttgtacaatgctgttggtctaagcaggttaatttagaggccagggtagcactcaattcctcagttggtgaaggtttagtggaggaagccaagtccatcagtgctgactatcttcttatccgtggctcgagaaaccgaacaaataagtatgaactgagtgatatcatgcatgacaaacctgatttttttcttcttcttagaattggaacttctaaaggaattaccaagtattgctttgagcatgcacatgatgggtgtacaatggtctcagttgggagacttacaaaggcaaatcaaagtgccaattcaaactcaacacgttttcaagataaaagacaaccaagttcaagatggtttaagaaggataaccaatatggcaagggtacctcccctgttctaaaggattatatatcaggaagcaaggctcagaaccgttcaccaagaacagtactaaatggtctagagggacaatcgaacagcactgaagatgataccttcagcactagggtctcaagcaccacgtataccccatcgtcatcggattctaagaggcgatccaagataagaaaaccacagttctcgttcaggttcatagcctcattccttgcttcaccatttagaagcaaaaactttagcatatccaaaaatgaaaagcgtcagcctttgttgaagtgcttcagctatgaacagatatccaatgctaccaaagacttccaccgagataatttggttggacgaggtgggtactcggaagtatacaaaggtgatctttcagatggacgaagcattgctgtgaagaggttggccaaggacaacaaggatcctaacaaggaaaaagagtttcttatggagttgggtgttattggacatgtctgccatcccaatactgcaactttagtgggctgctgcattgaaaatgggctttatctgattctcaattactctcaaaatggaaatttggctactacactccatggtaaagcaggagattcactagactggccaatcagatacaaaattgccattggtgttgcaaggggtcttcattatcttcacaaatgttgtaaacaccgaataattcaccgtgacattaaagcctctaatgttcttctgggtcctgattatgaaccacagattaccgattttgggcttgcaaagtggcttcctaacaagtggacccaccatgctgtgatccccgtagagggcacatttggatacttagcgccagagtactttatgcatggaatcgtggatgagaaaacagatgtttttgcatttggaatcctacttttggagattgtaactggacggagacctgttgattcatcgaagcaaaaccttctcttatgggcaaagcctcttatggaatcagggaatattgctgagctagctgatccaagaatggaaggaaaatatgatggagagcaactgcatagggtagttctaacggcttcatactgtgtgagacaaactgccacgtggcgtcccccaatgagtgaggtattagagctgctaaccagtggccaagagagtgagattggaaagagctggaggatcccaaagttcatttctgaagaattggatgattactctatggttttcggatatgatgtaccctcagacatatcattggaggattatttgtga

SEQ ID NO: 36484 - DNA, 285 bp, Glycine max
  Peptide Sequence Number=SeqID_153262
atggaaggttcccaacaaaacactcactatcctaaggaaaaattgcctaaaattattacacacaaatggaagtttggtaacctattagaggctcccaacacacttccaatgaaaggcctttttgttacaaaacttgaaagcaatgaagtgcttcttagtccaatagctcttaaggtggttggcccctttcttcttgactcaaattcttcaagggatggcagcaatcctccttcctattccctatatggcaacccacaagcaaggaaacaaagagacaagcaataa

SEQ ID NO: 36485 - DNA, 123 bp, Glycine max
  Peptide Sequence Number=SeqID_153263
atgtatgtatgtgagaggggactcgtcattccttctaacgatttaggaggggactcgccattccttctggcgatttggcatgtctatatcgccattaggtctggcgatttggctttgacgtaa

SEQ ID NO: 36486 - DNA, 411 bp, Glycine max
  Peptide Sequence Number=SeqID_153264
atgcctggtttcagcggcgatgaaactgctccgttcttcggcttcctgggcgcggcggccgccctagtattctcctgtatgggagcggcgtacggcacggccaagagcggggtcggcgttgcgtcgatgggcgtcatgagaccggagctggtcatgaaatccatcgtcccggttgttatggccggagtgttgggaatctacggcttgatcatcgccgtcatcatcagcaccggtattaaccctaaggccaaatcctattacctcttcgacggctacgctcacctctcctccggcctcgcttgcggcctcgctggcctctccgctggcatggccattggcattgttggcgatgccggtgttagatttatacctagatgtaatgtgtgcttcactgaacggtttcaaacttga

SEQ ID NO: 36487 - DNA, 222 bp, Glycine max
  Peptide Sequence Number=SeqID_153265
atgcagccttcatcaagatttagtgttcccatgagattgacatcaagaagaagcaccacaaacacgtgctttggaagcagcacatcgacaaggccaacattgtccactacgttcttcatagcttcaaagtcccacacgttcgttgtgatcgttgtcacctcgttccccatggcaagccacatcatgttttgcgtctcctctagcttcttcgacgatgcatga

SEQ ID NO: 36488 - DNA, 228 bp, Glycine max
  Peptide Sequence Number=SeqID_153266
atggtgacacgactggcaaaagaggcacaatgctacatgggggagggagggagaaacgaacaacgaggagaaaaggtaggtgatgacaacaatgagggagagaaggaagacacatatatggagacaaagtccaactgctttcggtgctcgtcatttagaatcgatgttcttgatcaaaatgaggtagtgacgacgatgatggagtatccacagagcgaggaagcgtga

SEQ ID NO: 36489 - DNA, 969 bp, Glycine max
  Peptide Sequence Number=SeqID_153267
atggagaaacagagcagttttcgggcatctacaatggaaaaacagaagagttttcgtggatttatggaaaaacagaaaagttttcgcattgttatggagaagcagctcagcttcatgggaagtgaaaggaagaagaacaaggaatcacctgggaaacgtggtgacttaccaattcatttagcagctcgggcagggaacttgagtagagtgaaagagataattcaaaactattctaataatgagacaaaagatttgttggcaaagcagaacctagagggggagacccctctttatgtcgcttcagagaatgggcatgctttggttgttagtgagatacttaactacttggacctgcaaactgcttctattgcagccagaaatggctatgatccattccatattgctgcaaagcagggtcatcttgaggtgctgagagaactactgcactcctttcccaacttggccatgaccacagatttgtccaactcaactgctttacacacagctgcaactcaaggtcatattgatgtggttaagctccttctggaatcagattctaaccttgctaaaatagccaggaataatggtaaaactgtccttcactctgcggctagaatggggcatttggaagttgtgaaagccttactaaacaaggatccaagcactggatttaggactgataagaaaggtcaaactgccctacacatggctgtgaaagggcaaaatgaagaaattttgctggaattggtaaaacctgacccagcagttttgagtctggaagataataaaggaaatacagcattgcatattgccacaaagaagggccgtactcaggaaatagacaagttagccacatttttggctactgcacagctgttagcggccatattggccactaagctaaacaaggttttaaattgcagctgcagtttcattgcggtccttgatattgcagacaaatgtggctga

SEQ ID NO: 36490 - DNA, 1131 bp, Glycine max
  Peptide Sequence Number=SeqID_153268
atggttattggtggattttatcctccaaagtgtactttcctcattctagaggagcaaaatcctggcgatggtaaagtggagtattatttcagtgatttaaacttagctactaccgatcatttgatgaggttcatcaacaaagatccagaaggttttgtgcctatatctgttgttgcatctttcaagaagattaaggccctcatagccagtcactcccaacttgcaactgttttaaggaactcgtcaaagctcgtggtcagtgaagacggaaagaaaatcaaacgccagtatcccctgactgagtctgatatagaagagctacaatctcgcattgttgtagctgaaaacctacctgaggatcactgccatcagaatcttatgaaggttttctcagcagttgggagtgtgaagactatccgtacctgtccacctcaaacttccaatagtggggcttctgctacttcaagattgggaaaagttgatgggatgcctttatctaacaagtgcatgcatttgttgaatatggatctgttgagctggctgagagagctgctaactgttgacagctgttataacagctgtagacaattgtatcaactaactgacaacttctcccaacagagcttgtactctgaattcaaggacagagggcctccaatagaacgagataagaatagagagaggaatggtctaatttctcattaccctgttttagctttgccagacttcccccaacagtttgtgtctaaacctgctcaaggacggggaaagaagggacttgatgttgaagttggctgtgatgaggattatacttctgtgcctgagccacaggcaagtgagaaacaattagaagatgcttcctttcctgatactttgctgcttgaacatgcgggagaagagcatggttatgacaaagagagtgggcaaaggaaaggtcgtagccggggccggggtaagggacgtggccgagttcattgtcatcagaataatcgtgtgggaacacccccttcaaataatacaattttcactgatcaagtcattgccaagcaaccccctgggccccgaatgccggatggtacaagaggattttcaatgggtagggggaagccggttgctgttaatatagcgtaa

SEQ ID NO: 36491 - DNA, 1842 bp, Glycine max
  Peptide Sequence Number=SeqID_153269
atgctgcacaaaaatcttgttacttggactttgatgattaccagatatgtgcaactgggcctgctgggtgatgctgttgatttattctgccgtatgatagtaagtgagtatacacctgatgtgtttactctgacaagtctcttatcggcctgcgttgagatggaattcttctcacttgggaagcaattacattcttgcgttatcaggtctagattggcttcagatgtatttgtcggttgtactctggtggacatgtatgcaaaatctgcagcagtagaaaactctaggaaaatatttaataccatgctgcgccataatgttatgtcttggactgctctcatctctggatatgtgcaaagcagacaagaacaggaagccatcaaattgttttgtaacatgcttcatggtcatgttgcaccaaatagcttcacattctccagcgtcctcaaggcttgtgcaagtcttcctgattttggcatcggcaaacaacttcatggccagacaattaagctaggactttccactattaattgtgtggggaattctcttattaacatgtatgcaaggtctggaacaatggaatgtgctcgaaaagctttcaacatcttatttgagaagaatttgatttcgtacaatacagctgttgatgcaaatgcaaaagccttggattctgatgaatcctttaaccatgaagttgaacacactggtgttggagctagttcttatacatatgcatgcctcttaagtggcgctgcttgtataggcacaattgttaagggtgaacaaatccatgccctcattgtgaagtccgggtttggaaccaatctatgcattaataatgctttaatctctatgtattccaagtgtggaaacaaagaagctgctttgcaggtctttaatgacatggggtatcgcaatgtcataacttggacatctattataagtggttttgcaaaacatggatttgctacaaaagccttagaattgttctatgaaatgcttgaaataggtgtaaagcctaatgaggtcacttatattgctgttttatcagcctgcagtcacgttggtttgattgatgaggcatggaaacacttcaattccatgcattataaccatagtatcagtccaaggatggaacattatgcatgtatggttgatttgcttggtcgatctggattgcttttagaagccattgaatttattaactcgatgccttttgatgctgatgcattggtgtggcgtacgtttcttggttcttgtcgggttcatggtaacaccaagcttggggagcatgctgcaaaaaagattcttgagagggaacctcatgatccagctacctatatattattgtcaaacttgtatgcgtcagaagggaggtgggatgatgtggcagccttaagaaaaagcatgaaacagaaaaaattaataaaagaaacaggttatagctggattgaagttgacaatcaggtgcacaaattccatgtaggggatacttcacacccccaggctcgaaagatatatgatgaacttgatgaattggctttaaaaataaagaacttgggttatatcccaaatacagattttgttcttcatgatgtggaggatgaacagaaggaacagtatctgttccaacacagtgaaaaaattgcagtggcatatgctcttattagtaccccgaaaccaaaacctattagagtatttaagaatcttcgggtttgtggggactgccatacggcaataaagtatatatcaatagtcactggaagagagattgtggtgagagatgcaaaccgatttcatcatatcaaggatgggaaatgctcttgcaatgattattggtaa

SEQ ID NO: 36492 - DNA, 513 bp, Glycine max
  Peptide Sequence Number=SeqID_153270
atgagagtggagccatgtctgattggctctgtccgatttcttggaacaaaattcgttgatagtgatagtgatgtcctagttattgataagtcatttggttttgacactgctgttgaagaggcacaaggagccataaactttgctcatgtggaagcacaaagcactgagaatggtatcgatattgtcaagcttatgggtcgttacagtgtggtgtggattcttgaacatagaacaaacgatgagtttcgagggtcaccgagggaacatatagttacaattctttggtttagtttgtcaaccatgttctttgcgcacaagaaaacacacttagtccacttggttgagttgtgtccatccatgtcttgcatttacatactcacttccctcacatgcatctcacccccgaaagtgacagacatgttgaattgggccacatttgttgttgatccccctcatcgtcgctccaccgacaccactctcacactcgatgtgtttagcatgcaatttccttaa

SEQ ID NO: 36493 - DNA, 873 bp, Glycine max
  Peptide Sequence Number=SeqID_153271
atgtcacaggtgcctaatggtattcggaaacctgatttcccgcctcaacttatacaacacacaagtagtgagacacacataacatctgacattgtggaatctgaagtgaaaggaaaagaaaaaatgatctttgcatcaaaccctaatcctaaaaatgtgtatctcatcggaggtttgcaattggagtttccctacgaacgatatggatctcagtttgcgtttatggctagagtgatttccacccttaatctaactcagaaagaaggtcattgtcacgcgttgcttgagtctccaagcggtactggcaagtccctttcgcttctttgttcctctctcgcttggcagcaccactacaaatctcaacatcaccatctcaagcccgcgtcggaggcaaccaacgatcctctggctctggtggcggatttgttctcgaggaggagaacgcactcacaaatttctcaagtggttcgtgaattgcggaaaactgcatacagggtgcctatggttgtgttggcatggcagaaacactactgcacaactaaaaatataattggcaaagagaacatctatgacgaatgtaaactattattgaaagatcaggcaacagggtgtccagaattcaaaaatgctcataaagtcaaaggtcattcttcccttcagaaaggaggatgcaatgtggtgcatgacatagaagatcttgtaaaagttggacaattggttgctgttattatggtgctcgttctatgtcaaatgatgctcaattggtattttgtccatataactacatcaataatccagtcattcgggcaccaatataatatatggatttcggatgtctttcacaaaccatcagttgtatgctatccaatgtag

SEQ ID NO: 36494 - DNA, 225 bp, Glycine max
  Peptide Sequence Number=SeqID_153272
atggggagtgacgtgatcacaaaatgtgcacgcgtttgtcgaaagagagaaaaggggttgggaggcaaaaagagaggcaccgttgtattggatcaaggtcagagactgagagcgatgataaaaactaaaaagcagcaaaggcgcggaaactggggctctgacttttttgtctctttgtcgagaatttccatggcacttctgaccccttctcttgacggactttga

SEQ ID NO: 36495 - DNA, 915 bp, Glycine max
  Peptide Sequence Number=SeqID_153273
atggcggcagccgccacaaagctcattggaaaaggaaaaagggtcgttagaagacaggcaatgagtagaaagaatgttcgctgcttgttatcaatggagtgtatcaacatcaatgctacaaacaaggctggagagactcctcttgatgttgcagaaaaatttggaagtccagaactcgtctccatattgagggatgctggggctgccaattctactgaccaaaggaaacctccaaatccatcaaagcaactcaagcagactgtcagtgacataaagcatgacgtacaatcccaactccaacagacacgtcagactggcatgagggtccagaaaattgcaaagaagctgaaaaagctccacattagtggcctgaacaatgcgataaactctgctactgttgttgccgttcttattgctacagttgcttttgcagccatcttcacagtccctggtcaatacgttgaagacaaaacacatggattttcacttggacaagcaaatatagcaaacaatgcagctttcctaatattttttgtgtttgacagcctggcattgttcatctctctggcagttgtggtggttcaaacctctgtcgttgtgattgagcaaaaggcaaagaagcagctcgtttttgtcattaacaagctcatgtggatggcttgccttttcatttccattgccttcatttctcttacatacgtggtggtgggatcacactccagatggcttgcaatatatgctactgtgattggaagcttgataatgctctctacaattggctccatgtgctattgtgtaattttgcataggatggaggagacaaaattgagggccgagagtcgatcgttctctatgtctcatgcatcagaccaagagattttaaacagtgaatacaagagaatgtacgcactgtag

SEQ ID NO: 36496 - DNA, 543 bp, Glycine max
  Peptide Sequence Number=SeqID_153274
atgggtgtggtcaagccagagaaaggaagactcaacaatggtgaactgaagcccacagcgctttgtgttactgttcacgcgaacgctgaaagaaagaaaggaaagttgtttggggtgcgacgacggcagcagtggtcgccagaaaagtcattggaaaaagagaaagggttgctggaatatgggcagcaagcaaaaaggtccaccggggacaaatccaattccaaagtttgggacttgagtcccacattgaaagtatgggattctaatgtggggcttataggccttaggctctccaagactccaactacaaaagctagcatttgtggtgtggttctcccaaggttcttattaggtgctgatggtgcatcttcagaattggactcgccttggtggcattcatgttcatacattaaagaatttcccaagaagagggcgttgaacccactgaatggctccacacatgaagcaattctttcaatgccagggaacaccggtagatcaagaagtgcctctaactttctttcacgtgaaaggggaggctga

SEQ ID NO: 36497 - DNA, 861 bp, Glycine max
  Peptide Sequence Number=SeqID_153275
atgatgaattcctcacctcctccagcaaaaatgctttccaagtatgctcctctgattcatgttatgaaggtaagaccggatagaataaatcttataattggttctggtgggaaaaaagtgaagagcattattgaggaatctggagtagacactattgatacagaagatgatggcacttgggaagatggctggaaagaagatggggtcccattgctggaaaaatatcctagactgtactgtatctcaaagcagcaacagcattatattcagcagatgggattggtgtcaagtggggtgtgggaatggcagctcaagtggaggagactgctaatggagggagagatggatgtggcagcacatttcctggaggatattgacgggatggcagttcaggtccaacatcaagatagcgggtcatgggagggagatccgggaggggagtactcagtgggaagtgcatatcgggcacttaatgaatatgcaattgaagaagatgatgagagggcattttctatcctttggaaactaaaaattcccagcaaggtaaatgaaaaggggcagctgcgccttagtcaccgagcactgcttcctgatacagaagcttcaccaaaagatggtttagtggaagaaaagactgaacagtctaaggataagtctagcactcccaatgtcacagcctcttctaaaagaagttcagaggatgattctgtacttccttctaaaaagtttgtcaggagattggtaagctcttcccaggataagcctttcactaacaaagacaagagaaagaagagtagcaacaaagcagttggtagtgtgtctggcgaagatgaaagcagtttggttagtggagaagcctaa

SEQ ID NO: 36498 - DNA, 462 bp, Glycine max
  Peptide Sequence Number=SeqID_153276
atgtgttgtttccatgaaagagggaatctacaagggagaggaaaatattttaaaaggaaaggttatttaagagaatataaaaaggtagcagtgtatatcatcaaatcgaacatcaatacatactttagggctgcagtttcgtgctttcccgccgccgctacactgccaccgtcttccccgccgtctccgccagagatggcagaagaggattcaaagcctctgaactacatctccgaggtcattctcaagaagaggaagaacaccgaagcatgggctttaaggaaaaaagaacagttccagcaaaagaaataccaatccatcaagaagccggaggatttcatccacgagtatcgcaacaaggaagtggaccttataagaatgaagcggagggtgaagaggaaagtgcctgaagctaactccaacactctaataatcattcggattcaggggtgtgtaaagtaa

SEQ ID NO: 36499 - DNA, 213 bp, Glycine max
  Peptide Sequence Number=SeqID_153277
atgataggcagcgctaatgatgttgttgtcgtgatcttcaacggtgagaagtttctacggaatctgcggagtgaggatgttgaacttgagaacgccatagaagcatgtcagaacgagacagggagtgcggcgccggcgttggaaccggcggctgaggtggtgggggagaagaattgttgtttgtggaagccatttgtagaagcaaggatctaa

SEQ ID NO: 36500 - DNA, 402 bp, Glycine max
  Peptide Sequence Number=SeqID_153278
atgataaagctgttgacagctggggggaaaaggagtgatgggcgaacacctgacggaatacgtccaattaactcgagatgtggcctattacctagagcacatggaagtactctttttacaagaggcgagacacaggcactagcagttgttacacttggagataaacaaatggcgcaaagaattgacacccttgatggtgttgatgaattcaagaggttctatctgcagttcattattagagttgcagatgccaaaagccaagataaacacactgagcttccattcagcaggtccaaacagttctcagttgatgacttggcactggctgcatcaaatgctccatgtcaccatcaaaataaatgcctaagtgaggaggaatcaaatcttgtttcctttagttaa

SEQ ID NO: 36501 - DNA, 403 bp, Glycine max
  Peptide Sequence Number=SeqID_153279
gcaatgatgtggatggatcgatttgcccttactttgaacgtgagtcaagaacttccccgattgctggccaaggccaaagcaatggcagacgcctactctgcccccaaggagatccacggactcctcagctattgcttgtgcaatccgtgaaattccgtaatgtggcggaagtcgaaaaaaggcccacttgggccttccagaaggctgttgcttctggaggaagcaacctggctcgcctgggcgagctgggcggcaagcacctcccctattttgctataaataggggaggaaccgaggcgcttccgaaacgtttccgtaacgttttccgtgaggaatctcgcaaaggttttgaccgctcttcgacgttcttcattcgtcttcatcgttcttcgatcttcaacgg

SEQ ID NO: 36502 - DNA, 162 bp, Glycine max
  Peptide Sequence Number=SeqID_153280
atggagagaaggagaaagtgctgccgttatccgctttgctatttgaatctttgtatggctcatgttaatccaatggatcagagtatccttgtaaggctaggtaaccttgacgctccatcgacagtcccatctcagttgaaagtatggtgtcagatcttgtga

SEQ ID NO: 36503 - DNA, 357 bp, Glycine max
  Peptide Sequence Number=SeqID_153281
atggaagtgggatgggacttactctctttgacctctcactgctctctaggtgatagggtaatagggatgtgggggcaaatggctaggatggtgaaacttccttcaacaaggaatcttctaccaagcattaaggctgattcagcaaaagatgtgcggtgtcaggccatgctgcttaatcgccacatttgcagcttgttccccaggagacaaaaaatattgaaccatgtgttggaggcgtacagggaggtggtaggcaagagggagattaatagtgatggatcaaatgggaggtcaaatggggttgatgtcatttgctgcatcaagcatcagctaaagggatgcctcagaacactatag

SEQ ID NO: 36504 - DNA, 1062 bp, Glycine max
  Peptide Sequence Number=SeqID_153282
atggtgccgttggactcaacagcatccttggaggccacacatctcatctatggaggggacaaaatgattaatgaaaggcaataccaatactctgatgatgagtcatcatcatcatcactagaagctagcatacctttgttaggctacgttgatgaagagaaacaaagtttggcagagatagtggtggtggttgaagagaaggaccaaaaccaaaaccaaaagcaagatagtcatagtagtagtactttttttgggggtaacaattcattgtttgattgtatttacttgggaaagatcctacaagtgctagaactaccacttggcttaccaagaaggcttacaatcccagtggtgagtgaggagaaatggtcaaagccatatgcagtaatatctgtcacactagcacctgttttgttggcaattcttttcaacacacaaagtgaaaacgtgggttcaaggagtggtattgtcacatacatagtagctgcattgattgggatagttttgggcaacatggcatgtgtgacaactgaaaggtgcaacccacccagaaagtccttgttcccttggcttgctggtggctttgcaatgagtgtaacatggacttacataattgctgaggagcttgtttctctcttggtatcaattgggagcatcataggggttagcccttcaattctaggactaactgtcctagcttggggtaactcacttggtgacttgatagccaatggtgccatggcaatgaatggtgggcctgatggggtccaaatggcaatttctggctgctatgctggcccaatgtttaacaccttgatgggcttgggcttgccacttgttctctcagcttggtccgagcatccagaaccttatgtcactcctaaggacacttcactctatgagacacttttgttcttgatgggaggggtgctttgggcacttgtgattttgcctaagaagaatatgaggcttgataaatccttgggagcagggctattgagtgtgtacatgtgttttttggtcataaggatagctatggcagttggaattgtgaaattttag

SEQ ID NO: 36505 - DNA, 1521 bp, Glycine max
  Peptide Sequence Number=SeqID_153283
atggccaccgaagactaccctctcctcgactctccctcccacgggcagcctcacctccacgcgtccacgcgccaccacttcccttcctcctcctcctccagtcccaccactctccccgccaccgccgcctccggcaccgccaccgccgactactacccccacccctccttctccgacgactcagccaaatccaactccaaacgcgcctccgccgccggcagcccctactaccacaacaagaggctcaaatccgccgccgatccggatccggccaccgattaccggaaggaccgcgaagaatggagcgacacagcgatcgcgtatctgttggaggcgtacacggagaagttcaaccagctgaaccgcggcaacctccgcggccgcgactgggaggaggtggcagaggcggtgctggaacgatgcggcggagaggggaagcatcagaagagcgtggagcagtgtaagaataagattgataatttgaagaagaggtataaggtggagcttcagagaattgggagtggtggcattgccactagtcactggcattggtttaagaagattgaagctattgttggcaactctctgtctgtgaaaactgtttctgatgatgataaggctggcagtagtggtggtggtgctaattctccttctatggctagacaaactaagaacaggtctttgtttttgataaaatcacctgtttgttatctaacttcgcctactgagacaagatatgcacctagcaatgctaccgtggcaaccaacctcaaaccaaagccagcgtcaaatctaaaatggcatagagttttgtttaaaattagtggctctgcattggctggaaactgccagaacattgaccccaaggtggcaatgcagattgctagggaagtggcaacagcttgccgccttggggtggaggtggccattgttgttggtggtcgtaacttcttttgtggagatgcatgggtgtctgctaccgggttagatagacctacggcataccaaataggtatgatggcaacagttatgaattctattttgcttcaatctgctttggaaaagctgggtgttcaagcacgtgttcagagtacattctcgatgccagaggttgctgaaccatatagcaggcaacgagctattagacatcttgagaaaggaagggttgtcatatttggtggtgttggtgctggcactggaaatccactttttaccactgatacagctgcagctctcagagcttctgagcttaatgctgatgcggttctgaaaggtactaatgtgaatggcgtctttgactgccatccccgtaatgataatataacactcgatcacatttcctttagggaagttgtttctaggggcgtcacctccatggacatgatggcgctggcatattgtgaagagaatggaatacctgttgtagtcttcaacgtgcttgaaccggggaatgtttcaagagcattatgtggagatcaagttggcactttgattgatcaaactggtagagtggagcattag

SEQ ID NO: 36506 - DNA, 1026 bp, Glycine max
  Peptide Sequence Number=SeqID_153284
atgttgcttccaaaaacagaaatatactcagaattcaagatccttgacctgggaaatggtgttgttcttgttaatacagatgatgcgggcacgctgatggtaacaaatttccgtcttatttttctgagcgagggaactagaaaagttattgcccttggaacaatacctttaacaaccattgagaagtttaacaagacatttaatctgagcattctcttagtctgcctcacatgttgtgaaggttcactcaaatactcgctatgtagacaagacaccagcacagagactgctccaggaaaagatatgagaattttagtcttcagtttcaggccacgtacaaaacagagacgtgtggtttacgaagcgctactgaggtgtacaaagccaacaagactatgggatctttatgcttttgcatcaggaccttctagatttaagaacactactccactgactgctgagccactatttgttaccttgcatggtcttaatgctgctagtgatgatgaagtgctccaggctagtagcttccgtgcaagatgtcgactacctgtagtttcatggtgccatcctttgactggagcagttgttgcacgatcttctcaacccttagtaggtcttatgatgaacatgaggagcaacatggatgaaaaacttgtggctgcactttgcagcaaactagataatggttctaggagaaagctgtatattgttgatgcacggcctaggaaaaatgcattggctaatggtgccatgggaggtggttcagaatcatcatcaaactattttcaatctgagatagtctttttggggatagacaacatccatgcgatgagagagagctttgttcggctccgagaatacatggacactcatggcagaacgtcatcagatggaatgtcctcttttttgtttttggctgattttaaaaagttgaatgtggagcatggtgtatgcataaaagtgcttctcttattcctctacaaatcatccagcatggttaatctaggactttggttcaaatga

SEQ ID NO: 36507 - DNA, 243 bp, Glycine max
  Peptide Sequence Number=SeqID_153285
atgccgaagaaccgcgccactcgagcaacgtctctcagagacgcctccgactcctctaaattggaaggcaccggtagctgggacgccatcgaatggaccaagattgagccaatttcccggttcgtctcgcacgccaatctcgatttcttactcgagtcggagcaagttgtagccgaatctgcgaaagtgaggaatgaggatagggcagagaatggtagggtgatttaccaaaaatacatgtag

SEQ ID NO: 36508 - DNA, 1392 bp, Glycine max
  Peptide Sequence Number=SeqID_153286
atgggaactgttactcgcagctcctctgaagtgtatacaagcgacagtgaaaaggggtttgcgatgaaccactctacttctacttccccagagctagatgctggggcaaagtttgttcttgtatctcgaggatcatggttgcactgtgggtaccatttgactacatctattgtggctcctgtgcttcttactcttcctttctccttcactttgttgggttgggttggaggagtgctttggttgacccttgcagcagttatcacattctattcatacaaccttttatctgtggtcttggaatatcatgcacagcttggtcggcgccagcttcgattcagggacatggctagagatattttaggacctggatgggcaagatactatgtaggtcctcttcaatttgccatatgctttggcacagtgattggtggtcctttagtgggaggaaagagcctcaagttcatttaccagctctacaacccagagggatcaatgaagctttatcaatttattattatatgtggggtcataacactgcttttggctcaacttccatcctttcactccctgaggcacgttaacatgatttctctgattcttagtgtgttgtatgccacatgtgtcacgatcggttctatatacattggtcattccaaaaatgcgccaccaaggcattattctgtgagaggttctgatgctgatcaactctttggtgtcttcaatggtatctcaatcattgctaccacatatgctagtggaatcattccagaaatacaggcaactttggcgcctcctgtgaagggaaaaatgttgaaaggactttgtgtctgttattctgttatagccaccacctattttagtgttgccatctcaggttattgggcatttggtaatgaatccggtgcatcaattcttgctaacttcattggtgagacgaagcctttgcttcccaaatggtttttcttgatgactaacatattcatccttctacaagtgatggcactgactgcggtttatctgcaacctacaaatgaaatgtttgaagcaacttttggagacccaaaaatgggacaattctccatgcgcaatgttgtgccaagggtggtacttcggtcactatcagtggcagcagccacggttttagcagccatgttgccattctttccagacataatggccttgtttggggcatttggatgcattcctcttgatttcattttgcctatggttttttacaatatgactttcaagccctcaaagaacacaataatgttttgggtgaacaatgtgatagcagtagcatcctcaattttagttgtgattggaggaatagcatctattagacaaatagttcttgatgccaaaacatacaatttgtttgcagatatgtaa

SEQ ID NO: 36509 - DNA, 420 bp, Glycine max
  Peptide Sequence Number=SeqID_153287
atgcgtcccaagctaggaatgatcgcgccatcgatgatgctttcattgtcccaagagagaatcaacgggtcagaaatggaccacgatgatttggacatttgggagagtcaggttctattaattgcaagcctacgtgtagactgtgcagagacagcttcaagagataacaaaataacagaaaagtcaaatcccttttcttccctcttctttgccggaaactcctttctccctcccgaagcctttccttcttcttcttctcttctatcattccactccctcgccgccccgctcactcccccagacgctgacaccaatgctctccacgcgctcatggaagtcaagatcagagcgaggtcgagaaccatggcggtggctccaagctcgaggtcgaggatggcagaggcgcgctcctcactctga

SEQ ID NO: 36510 - DNA, 474 bp, Glycine max
  Peptide Sequence Number=SeqID_153288
atgatttgctgcagatttcctctcccatctttacaaataatctggttcctatgtatccaaatcatccaaattgttgcagcccaagtcatccaccacaccaatcttaccttgttgcctttgaaaccaagagcgtgttccagaagtgtggaatgcaggagtcagggagtggttgctgtctccctatccaagcgtaacattccatccaaatctgataagagaaccagcaggagaagaacaaatggttattgcgtatttggcaatgaatccagtgcatcagttcttgctaacttcattggagagactaagcctttgcttccacaacattgtgtggatgccaaaggtgagggcccttcatttcaacatggatttgggctaggtagaatgagaggaagggtcgagggaggtgtcccattgatgacagggcttgaaggaagacattctgatgatggtactcaatcgagcttcaggggatga

SEQ ID NO: 36511 - DNA, 342 bp, Glycine max
  Peptide Sequence Number=SeqID_153289
atgaattcatctgtgtctcctccaaccagactcgtggttcgtgcaaaaccccggaagagcacaatgacgggaacgaggatggagcccatggaaacacttccagttaagtgcttgattgtgtcacaaactgccactctagtgtccatgtcaactcctcctgcaaaatgcatgtacttgacccttgaaatagtgacatacattgcattcttcagaaactgcatagtccaccctaggctcagcaagatcaagaagatgaaaaattctgctagttgggttctgttttcaattgctctagcccctccaatcccagccaacagaaaacagcataaaggattcccatga

SEQ ID NO: 36512 - DNA, 369 bp, Glycine max
  Peptide Sequence Number=SeqID_153290
atgggggtagcatctcttcttgtggtccgtgggaaccggtggggttttgtgcatgttggagtttataacaaagggtttgtgcaggcatcttgtgatacttgggagatgttcattagagttggattggagcaactcatagacttggatctcacaggggcattctgtttccttagtggtgttggaacaggtgcaatatgtagtctgtgtcgattggctattgcatgggtacaagcttgtgtttcagcttactatgttgcctacgcagaaaatccacagagcactcagtttgattccactattccaatacgcttggagcagcttaatagatctcaagctttgcaaatattcagagctaataatttgagctga

SEQ ID NO: 36513 - DNA, 555 bp, Glycine max
  Peptide Sequence Number=SeqID_153291
atgggttcagctactgtgcaaatagcgacgtcaaaatttgttctttgcccgaatgcttcagcggcgaaggttgcgagtcccaagaagaatgccgtcatcaatttctcttccaacttcaaaggaagtgtcaccaaaatccatgccattccccctaatggctctgtctctatctgctcttcgcgtgtgtttgagactgctgtgattgatcaggggatcgttggggtagaagatcccattatggcggcagatgagaacaagcgcagaagtaatcttgaatccctgttttgttatgataaggctattccagaagaaataattgagaaacctgttgggttatctttggaagagaaagctattggtaacaatacccgatgcactgattgccaggccaaaggtgctgtgctttgtgccacttgtgctggttctggtctatatgttgactccataatggaaagccagggcataattgttaaagttcgttgcttaggttgcggcggaacaggaaatataatgtgtgcagaatgtggtggacgaggtcatctgggacccaaatga

SEQ ID NO: 36514 - DNA, 812 bp, Glycine max
  Peptide Sequence Number=SeqID_153292
atggcgttccagcacagcgcggagatgattattctgtgccgcttcctggtcggaatcgttcctgtcggtgccgacggtagcgctgatgtcatggtggctggtaccgcaaaccctgcttggcctcgaaggctggcgctgggtcgtgatcgccggggcggcatcaggacgcgcaccggggtgctgagcgagatggaaaaacgctgtggcattgcgccgggagacgatttctctcagcgtgatgcgacggcacagctgccgaaaaaagggcgctttagcgaaatctgggcaccggcttatcgccagcgtacgctgatgctggtggtgatgaacttcttccaggcgattggcttcttcggcttcggtaactggctgccggcgctgctgtccggcaagggggccaccccgctacgccgaccggctggaaaacaaatggcagatcgttttttcatcgctgatgacggtggtgttcggcacgctgttcgcgctgaccagcaacccgctgctgatggtggtgtgcggtttcctgatcacctacagcaacgcctggctgaccttcagctatcacgcttatcagaccgagatcttcccgacgcacattcgagcgcgcgccgtcggcttctgctattcgttcagccggctgtcgaccgctttcagcagtattctgattggcctgattctgcagtatgccggcagtcagggggtgatcgtatttatcgtgctgagtatgctgatggtgatgctgtcggtcgggatttacgggccgaagacgcgggggctggatctggagaacatttaaaccggatgggcgcagg

SEQ ID NO: 36515 - DNA, 662 bp, Glycine max
  Peptide Sequence Number=SeqID_153293
ttggccttgaggttgatcttcacgtggcttcttccatcacagacatgtattgtaaatgtggaaacattaaagatgcctgcaagtttttcaatactatcagtgaccataatttagtaacgtggacggctatgatatatggatatgcttatcatgggcttggtagagaagctattgacctgttcaacaaagctaaagaagctggattggaacctgatggtgtcaccttcactggggttttagctgcatgtagccatgctggactggtggaggaaggttgcgaatattttcggtacatgagaagtaaatacaacagtgaagtaactataaaccattacgcctgcatggtcgatcttctaggtcgagcagcaaaattggaggaagcagaggctttgataaaggaagctccatttcagtcaaaatctcttctgtggaagaccttcctaggtgcttgctctaaacatgagaatgctgaaatgcaagacagaatatcaaacatccttgctgatatagaactgaatgaaccctcaacctatgttctactatctaacatttatgcatcacaatcaatgtggattaattgcatagagttgagaaacaaaatggtagaagggagtgttgctaagcaacctggtagtagttggattcagttggcaggaggttaa

SEQ ID NO: 36516 - DNA, 174 bp, Glycine max
  Peptide Sequence Number=SeqID_153294
atggcctgtggaccggcccgtttgacccgtggggtcaaacgggccggggacagaccaatttatttgatccgtataagaatgcgaagcggactggccagtccactgtcaatgcgagcttatgcagacagaccttatgtggagcgggtcggcccgcttacccaccccttaatctaa

SEQ ID NO: 36517 - DNA, 1607 bp, Glycine max
  Peptide Sequence Number=SeqID_153295
ggaccacaaagacctcaactttggcacagctcttcactctcttttcgttaaaactgcccttgacaaggatgtctttgtacaaaacaatatgattagattttatggggacattggacaagttcagaatgcacataaactgtttgatgaaattcctcaaccgagtttggtctcttggaccagcttgatctcttgttatgtccacgtcgggaaacatgaaatgggtctgagtttgtttcgtggcttgtgtcggtccgggatgtgccccaacgagtttggtttctctgtggtactcaagtcttgcagggtcatgtgtgatcctgtgatgggaaaggtcattcatgggttgatactcaaaagtggttttgattcacatagcttttgcagtgcttcgattcttcacatgtatgctgattgtggggatattgagaattcgaggaaggtttttgatggggtttgttttggtgaaaggtgtgaggcattgtggaatactttgctgaatgcttacgtggaggagtctgatgtgaagggttctctcaagttgtttcgtgagatggggcactcggttgtgtcgcggaatcactttacttatacaatcattgttaaactctgtgctgatgtgttggatgttgaacttggaaggtctgttcatggccagactgtgaagattgggattgaaaatgatgttgttgtgggtggggctcttattgactgctatgttaaactgcaatttttagatgatgctcgaaaagtttttcaaattcttgatgagaaggataatgtggcaatatgtgctttacttgccgggtttaatcatattggaaaatctaaggaaggacttgcattatatgttgattttcttggtgaaggtaataaaccggatccatttactttcgctactgttgtcagtttgtgctcaaatatggagacagagctttctggtattcaaattcactgtggtgtgatcaaacttggctttaagatggattcatatcttggcagtgcctttatcaacatgtatggaaatttggggatgatatctgatgcttataaatgttttcttgacatttgcaataagaatgaaatatgcgtaaatgtcatgatcaacagtttaattttcaattcagatgatttgaaagctttagagctgttttgtgggatgagggaagttggtattgcacaaagaagttcttcaatcagttatgctctgcgggcttgtgggaacctttttatgcttaaagaaggaagatcatttcattcttacatgattaaaaatcctttggaagatgactgtagattgggcgtagaaaatgctcttcttgaaatgtatgttagatgtagagctattgatgatgcaaaattaattttagaaaggatgccgatacaaaatgagttttcctggactactatcatatctggatatggtgaatcagggcacttcgtagaagcactggggatcttccgtgatatgcttcgatattcaaaacccagtcagttcacattaattagtgttatccaggcttgtgcagaaataaaggcacttgatgtaggaaaacaagcccaatcttacatcatcaaagtaggatttgaacatcatccttttgttggaa

SEQ ID NO: 36518 - DNA, 1887 bp, Glycine max
  Peptide Sequence Number=SeqID_153296
atggtaaacctacaaaaggttgaacaacatgttacaacagaaggtcaaaggaaaaagaataagaggaagaagcaagttttggttcctcgtcctgcatgctcatgggtgtattttagtaaagagtttatcaaggagtacattgcttcccatcctgagtcaccaggccttaaagctgcaacaaaggctgcctcaaatgcgtggaaatcaatgagccttgaagagaaggaaaagtatgctaggcatgcacgtgaagtgtgggatggctacttgagttcaggtgctgcccccaaccccaagccaaggaaacagactaaactggtaacaagatgctctcctggtcgcttattcaaagtgttacagcgcctcacacctgagcagaaggaggcagttaagagcatgggctttggcagcctccttggccttagatgccgaacgcttcgacgcagtttgtgtctttggttattggagagatttgacactactaattgcagcttagagatctgcaatgtggacgtgccattaactccaaatgatgtagagatggtattgggattatcagccagtggtaaagaagtggtgaactctggtccagaagacatgatttcagatttacgtaacagttacaacgcgataaatcatggaatttcagtgcgacttttagaggagcagttggcaactgcagagtctggagatgattttaagaggtcatttgtactctatgtgctgggaacgcttctgtgcccaacagctaggctggatgttagcccgtcattcctccactttttgacaaatatggatcttgtacatcagtataactggggtaaattcttgcttgataggctggttcgagaggtattgcgcttccatcaagggaagcaaagaactgttggtggttgtcttttatttttgcagcttttctactatgagaacatatctcttgaagggtcttctgctccagttccaacgattgttccatatctgttttcttggggagaggaggagattgctgagagagaaaagcgagaaaaggaacttggcggctatggttctggggagatattaaggtatgcttttactttgcagctagcaagcaagaagaagtgccatcatatggagttccctgagtatagagatcatccagatggcccactgatcaccacagaaatcagtagaattgggcatggtcctcttagaccagaatcaaatgaggtgatgatgccattgtcattcattactagcctcttagcatgtccacaaaagcatgaagacatccgtggttttcctaggaatagaaccgtgttgagtggagatgtggatttagtagttgaatcaattgaagctccttgtcggaacaaagaatatggttgcaatgaaactgtggattgcatgactagcaatgaccatgaagtgacatgcatctattctccatgtgtctgtccatttcaagactgtaactatgttgggccatttgaacagttggcattgcatttcagcagtaaacactgggattccggaagacaattcaaatataatcatccattggctatctctttacagatggatgaacaattccttgttctccaggcagaagaagatggggttctttttctcctcaacaagggcacagaaactaatgggaatacagtgatgataacctgtattggtccaaattcatcaaaagaaggatttatttatgagattgtttcatgtagggggagaagttctctcagattaaagtctgtagctgagaattttcctggtcgaatggaggatttccccccagtagattttcttttgattcctttcaattttcttgtgtcttctagggagctcaatgtagatatttgtatatggaattctactgagcataatgtagattgctcttga

SEQ ID NO: 36519 - DNA, 1026 bp, Glycine max
  Peptide Sequence Number=SeqID_153297
atggagacatgcagatcagcatgcaagttcggaggaaaaactctccggataataaaaagcttacagaatgagctgcctcacttagacttggagatggaagaagccgttaatgctgatgaatgcttaatgacaagaatgcaagagatgtcattggattatcatttccttgtggagcaggaagttgggtcctcaacctatgccttcttcggtttcaatggcacagctggtgtgtggagaatttcagcattaaatgaagctggtggatggaaggaccgcacaacagtggaagacatggatctggctgtccgtgctggtctcaaaggcgggaaatttgtgtatcttagcgatctcaaggtgaaaagtgaattgccaagtaccttcaaagcctatcgttatcagcagcacaggtggtcatgtggcccagctaatcttttcaagaaaatggcaatggaaataatgagaaacaagaaagtctccatgtggaagaagttatatgtgatttatagtttcttctttgtccggaaaattgttgctcatgtggtcacatttgtattctactgtgtgattatgccagcaactgttctatttccagaagtggaagtccccaagtggggtgctgtgtatataccttctatcatcacactccttaatgcagttggaactccaaggtcaatccacttgctggtattctggatactctttgaaaatgttatgtcaatgcataggaccaaggctacacttacaggtttgttagaggcagggagagtaaatgaatgggtagttactgagaaattgggagatgctcttaaaacaaaatcaggtggtaaagcagctaggaagtctcgtatcaggattggtgaaaggcttcatttcctggaacttcttgtgggggcctatctctttttctgtgcatgctatgatcttaaatatgggaagaaccactacttcatatatctttttctgcaatctatggccttctttgttgcgggggttggctatgttggcacctttgttccaaattcatag

SEQ ID NO: 36520 - DNA, 234 bp, Glycine max
  Peptide Sequence Number=SeqID_153298
atgacgtctgaagaacccttaaaggtaacaaaaatctttaacaagattaactgtagactggtgaagctagctgaacaagaagccacaacatggatctttccttcaagatatagagttatggagtggcaaccttgcaacaaagtatggaaggaaaaaggtgacattggaactctcactcttcatctagatatgcaaaaattagagttggagaagctcaatctcaccaagctctag

SEQ ID NO: 36521 - DNA, 234 bp, Glycine max
  Peptide Sequence Number=SeqID_153299
atggagataagtggacctatgaataaggagttccctccaagacagactgttgctcccaatcctcatagtctgatattcgagcattatagaaagaaagtcgtgtcctcctattgccagtgtctggaaaacatttcaaataggaatccctcttcaagagtaaaaattcagatataccctccttattacccattaccccattatcctcttaatgctccttcaagttacatgctataa

SEQ ID NO: 36522 - DNA, 375 bp, Glycine max
  Peptide Sequence Number=SeqID_153300
atggaaaaggaaaagaagagggtttccccatcaaaggattatttggtcgtgttggatagaccaaattcctcgagaacgtattcatggtattatggtccatatgccttgttctggggaactgtaaggcaaaatggtgtcaacatcaaaggcactgttaaggggaaggaagtggtgatctcagcaatgactattttgttgtgtctggttgtgctgaagaagatggaagaactagaaaaagttcaatttgcagcagaacttgcagcacaaattttctctttggatgctgctcaacgacaacttgaactagacgttgtcactgttcctaatgacatggaccctactgaaaggggatcacttgaagaggccatgctttag

SEQ ID NO: 36523 - DNA, 285 bp, Glycine max
  Peptide Sequence Number=SeqID_153301
atgattaaccaagagcagattcagaacaacaattgcgacgtgaatcagatactattgaagaatccaaaaactggccaggacatgccatcatgtgtgaggaggacggcagcgcatgaaagaaccatgtctacacaagaacagcgtgtgagcatgcataaaatcgcctatgaggaggctctgcagaaaagcagcgctgtagtggatgaaaacagagatctgaacctatcagaaagatgtatgacagatcaaaacccggagcaaaactccgagcctaaaattgtctaa

SEQ ID NO: 36524 - DNA, 333 bp, Glycine max
  Peptide Sequence Number=SeqID_153302
atggttggttttcttttgttactcaatcaacttatctgcaaattcaatactttggtgcgtgacattttggaggaaatatttccatctatcgccgagcggatattcagtgttattcctagaaatggattaccttcttctggttctgatgcaatcactgaggaaattcgtgaattgcaagaacttcagcgaacattgtatacatttcttcatgtgattactacacatgacctgtctcctgtatttctttccccaaaatgtaaagcatacctggatccagtgatgcagttgcttttgtactcttcttgtaatcataatgatattcttgtaagaaag

SEQ ID NO: 36525 - DNA, 2409 bp, Glycine max
  Peptide Sequence Number=SeqID_153303
atggatgatctggagagagcgattcttgttatgtttgatgaatcgggagccctcgacgatgacttgaagaaacaggctaaagtttactgtaacgatattaaggagaagccattaatttgtagattgtgcattgaaaaattatgcttttcaaatcttgttcaagtccagttttggtgcctacagaccttgcatgaggtcattcgaacgcgatacttgacaatgaccccagatgagaggcacatgatcaggggctccgtcttttcaattgtgtgcctcgaagacaagaacctcacaagggttttggaaggccctgcatttataaagaacaagcttgcacaggttttgataactttgatttacttcgagtaccctttggtttggtcctccgtctttgttgatttttttccacatttgagcaaaggaaacgtggtcatagacatgttctgtagagttttgaatgccctagatgatgagctcattagtttggactaccctagaacccctgaggagttggcagttgctggccgggttaaggatgcaatgagacagcagtgcgtgcctcagatagttagagcttggtatgacattgtttctatgtaccggaattctgatcatgagctatgcactagtgtgttagattccatgaggagatatatttcttggatagacattgggttgatagtcaatgatgctttcatccctttgttgtttgatttgattttggttggtcctctgtctgatcagcttcgtggtgcttcagtcagatgcttattagcagttgtttctaagcgaatggagcccgaatcaaaactgtcattgttgcaaagccttcaaattagtcgtgtacttaggttagtgaccgaggatgtcgatgttgagctggtctctgatatagctgcattgctttctgggtatgctgtggaggccttggattgctttaaacgcataaattctgaggatgctaaaggaatctctatggagcttttgagtgaagttttaccctccattttctatgtaatgaagaattttgaggtagatgttacattcaacatcattcagtttctttcaggttatgttgccatttttaagagctttgttcctttgccggagaagcagctacttcacctgggacagatattggaagttatccttgtgctaatccgttatgacccagtgcaccgcaccaatcttgatgtgatggacaaaattggtaaagaggaggaagataggatggtggagttcagaaaggatttatttgttctgcttcgcaatgtgggtcgtgtagcgcctgatgtaactcagttgtttatcagaaattcgttagcaagtgctgtttcaagatcttcagatagcaatgtggaggaggtggaaggtgcactttctcttttgtatgcacttggagaatccataagtgaggaagccataagaactgggagtgggttgttgagtgagctggtgcttatgcttctatcgacaaagtttccttgtcactctaataggcttgttgctcttgtttatttggagacagtgacaagatatattaagtttattcaggataatactcaatatattcccatggttctggctgcctttctcgatgaaagaggcatacatcattcaaacatcaatagcctgcaagatacagttgctcaattcactattatgaattatacgacagaagagctatcagggtcagaagatggtagccacatttttgaggcaattggtttattgattggaacagaagatgtcctgcctgaaaagcaatctgattatctatcttctttgctcagtcctctttgtcaacaggttgaggcactgctcataaatgccaagttattgaatgctgaggagactaatgccaaaattgctgtaatccagcaaattattatggcaattaattctctcagtaagggctttagcgagcgtcttgtaaccgctagtcgccctgcaattggtatcatgtttaagcagacattggatgtacttcttcaagttcttgttatatttccaaaagttgaacctctgcgaaacaaggtcacatcttttatacaccgcatggtggatacactaggagcatctgtctttccttaccttccaaaggcattggagcagttgcttgaagaaatcgaaattgattttgcagatgtttatgttttggggttgcaaggggcatttgaatgtgatggcattgagaataatatccctctaacatatagtcctgtaaccttgctgctgctttattctatcgtgaatactttctggcatttaagaatattgctttggctgcagggtgtcagtctgtctgccatattttttgttgtcattagtagattttatgtcaagcatgccacattggtacttggtgaatttgtcagcaacaaagggtatagtctctttagaggatag

SEQ ID NO: 36526 - DNA, 363 bp, Glycine max
  Peptide Sequence Number=SeqID_153304
atggatattgcaggttttaagctctggtacatgggaaaagtttggggaaagaatggagtaggtattatggtagacaaggattttctccctccaatgacaggttgccagctcggcatccctggtccaagtttgttatgcagtccctccagtattgaggacgtgtgctgtgcctttttatcctcaggtgagtacttgtctccccttggtctggtttgcaaagaaagtgtggtggatgtaaaaagaattggagacagaatcttagccttaaaattaatgatggtacaagagactatgaatatcatcagtgcttatgcaccacaaataggatcagaggcacttgtgaaggaaattgggaagacttag

SEQ ID NO: 36527 - DNA, 1036 bp, Glycine max
  Peptide Sequence Number=SeqID_153305
taccagtaattgctatcatggagtcgatggagtcatgtgtcccaccagggtttcggttccacccaacagatgaagagcttgttggttattatctcaggaagaaagtcgcttctcagaaaattgaccttgatgttatcagagagatcgatctatatcgtattgaaccatgggatctccaagagagatgcaggatagggtatgaagagcagaatgagtggtatttcttcagccacaaagataaaaagtatccaacagggacaagaactaatagagctaccatggctgggttttggaaggcgacaggaagagacaaagcagtgtatgaaagagcaaaacttattgggatgaggaagacccttgttttctacaaaggaagagcccctaatggacagaaaagtgattggatcatgcacgagtataggcttgaatctgatgagaatggacctccacaggcaagcatattggttcagtttgaagtgttacgttcaaactttgctttagatggccgcccagccttcaagaagaaaaccactgggcaaacgaagactataaatattgaaggatgggagtcaagctacttctatgacgaagcaagtggggcaacaagcactttggtcgatccaattgaactcatttcaaggcaatctcagagctttctggctcaaaatttcatgtgcaagcaagagctagaagcagataacttgacttgcatgcatcaagatccgtttgtgcaacttcctcagctagaaagcccgtctttgccactagtaaagaagccaagcacagtgtccctagtatcagacaataataacgaaggtgaagacaatcaaaacaggttgttattcaacaacaacaacacaaagaaagtcactactgattggagagcccttgacaagtttgtagcctctcaactaagtcaagaagtaaacacgcatgaaactaatgttggagtactctcatcaagctttgaaccccatgatgataaccacgacatggcactgctgctactgcagagtagtagggatgaagggaacag

SEQ ID NO: 36528 - DNA, 342 bp, Glycine max
  Peptide Sequence Number=SeqID_153306
atggggtacagggagcatactaggtattatgaacagctatcatggggtacttggagcatactaggtgcattgaaggaacatgccaaattaatgattagttatctgtttgttttgtttggagaaattgtgctggcacagaaggtaatgtatgaaaaatttggggatgattttctcgtaaattttgtatcgaaaggattttcttctgcacattgcccaccagatcaggcagagcaatatcgtcaaaaattgcagggtggtgatttcaaggcactaaaatctttctatcagtcactagtggaaaatttgagagtgcagcagaatggaagccttgtgttcagatag

SEQ ID NO: 36529 - DNA, 343 bp, Glycine max
  Peptide Sequence Number=SeqID_153307
gaacttaccggttgaagaccgaagaacgacgaagaacgatgaagaacggtggaaaaccttcgcgaaatcgcccacagaaacggaggtggttgccacacagctcgcccaggcgagctgggttgcttccaccagaaggcaccgccttctgttgggacatcctggaaggcccaaaatattacgaaactttacggattgcgcattaacatttcctttcaactcccgacatgtcgcggaacttcacggattgcctaacgatgggtgtcaagtacctcgaagtggtcaagcgaaggttgcatcccaccaaacagatggtccccggacgaaattagggtatgacatagag

SEQ ID NO: 36530 - DNA, 1347 bp, Glycine max
  Peptide Sequence Number=SeqID_153308
atgtcaatagggtcttcagatgattttcctcctggttttgaagacaatcatttgcgaaatcaatcaaaggctaaactctctcacatccctcagattaaatgggaatgcccttctttgttcactttgagtaatgattggcgcgttgcagctggtgaagacagtacggagacatgtgatcagaagttaagagaaatgagagtgcctgaagcaatttatcctcgtatttctgccattcctgatggaccttctgaatcggagaaggaattttatgatgataatgaaagcctcattcctctcatccctctcattcctgttgaggaggaagaagagtcagcagaggatattgaacctgactcttccatcaaaaaattgcataaacaaaactctcagcagcaatatataccaccggcaatatctcttgttaacccagaatgcagcaatgttaattcacattgcagtggaaagccattaggtgcaacatcttctgaggcagatataattgcagcagcttcttctgctgctgttgcttccatcataaaaaggaatgagcaaggaaccttgattgatatggatttgctcgttaaattatttactgacccaacaatgattgagaaattaattgagcaaaatagaactgctaccaccactgtcagtgtcagtgccccctcaagtattttgagtataccaacttcttattctaaacctgcagctgtagcatctgagactacaccaacaaccacaaggccatcaattacatctgttccatctgtttcattgcctaagcctgtacctcctcaaacagtaacaaggcataaacctccatcaatacctacacctcatatgcacaggcctgtcaagaaaaatattccccatatggcaaatagagtgcttccctctttaaacactcactctccacaacaagggctaaagagagcagcaccatcattggcttctgtttcttccagtgaattgaaaacagtgacagtgtcttctgcttctgcaaacatgcatgcagttgaaaaacaggtgcagtccaccacaactggtgccgttaaggatgtcaattattacctaaacctggttaaagaacatggtactcataagcaagctggcaacaagagtcttaagaacttacaaggtttgaaaccgtcacagggagaagtgaaattcaaaagtaagaaaccatgcatatactttagaactaaaaggggttgccgtaatggttctgactgcccttatcagcatgatatgtcaaatcggggggaagctggtaaagtcctaatggctcaacaaaatgctaaaagattgaaagtaggaccagaaattaaggggaggctatatacttaa

SEQ ID NO: 36531 - DNA, 201 bp, Glycine max
  Peptide Sequence Number=SeqID_153309
atggggttgggaaaagttaagagtgggatggttaaaacttcaagaaaacttagaattgaaatggttagtggttgctggcaaattttggcagcagataagttgtcttgcggaagttcatgtgttaaggtttcaatgcctattatgcagattattttttggcacaactgttgttttggcttaaatggtcgaggtgtgacttaa

SEQ ID NO: 36532 - DNA, 374 bp, Glycine max
  Peptide Sequence Number=SeqID_153310
atggatcgatcaaagaattcgaagacagtacgctgggctcaagaatctagtcttcgtgaggtgcatgttttctcacctgataaagattgttcttcaatggttggcaaaaaatgtcaagaacatcttcaagcaaaatcatcatcaatatcgccttcaactacggatgataataatgatttaccacctggttttagacccattattgatgtctctagaattcctcaaattaaatggaaatgtcctccttcggttgttttgaattctgggtggcgtatggcagctggtgaagaaagtacagagaaagataatcagaagcaaagagaactgaaaaagcttgaagcagtttatcctcgtgattctcacattcctgctga

SEQ ID NO: 36533 - DNA, 225 bp, Glycine max
  Peptide Sequence Number=SeqID_153311
atggtgagaggaacattgttgggatacaaatcaaggtgcgagagagtgggcagaagaattggaaaaacgaccttggcaaatgactatcgccatggtagctatcaggctcaatttttttgtggcgtggtagttggcaaccaccactcgagctccactgcaactgccaaagtaaggggtggaaagagtgggaaaccatgtaagaatagcacaacccctccttcctag

SEQ ID NO: 36534 - DNA, 315 bp, Glycine max
  Peptide Sequence Number=SeqID_153312
atgaagcacgagaagcctaccatagtgccatatacactaggaggatctcaaggggagtggctatttgactttgctaaattctggggtcctagggatccccctcgtgttttgcttttagcctttaagagaaggcatccaacaattcaaatgcacatgcacagggatgttatctttgatattaagggccttcttcgccagccttgggaggttgctgacaaacttgctggtttaggagctcgtatgcagtcggtatctgaatttgcagtttcgcctgctgctgctttagatcttgctgacttaactagtttagactag

SEQ ID NO: 36535 - DNA, 1078 bp, Glycine max
  Peptide Sequence Number=SeqID_153313
tccttttgtttcttcggatgtggagaatgaattaggttacgatgatagcgacactcctctggtccctcttgagtccgaagaggatgtggagaatgaattaggttacgatgatagcgacagtactcctctggtccctcttgagtccaaagaggatattgctatttcaacagtacccccgtcaaatctgggggaggcagatgttgctacagctttggctactgtaatggccatcgtaaaacacaatgaggaaccagggaactccattattgatgcgaatttcatccttcgattggccaatgacccgaaaatgttgaaagaattgactgattcaaacaataataatcctgaaaatgcatctctcactatgcctgcacctcctcaaattacagcaacagcacaaacatctccaccaccttctctgaaacgaggaacaaagcgagcaataccatctgggagcgaaaggaaaagttgctccgaacaggcgtggccctctggtggttcagtgtcttcgtctcaaccacgtgttgtgaagaaagatgtggattattataggaaccaagtaacaaaaaatgactctggcaaggttaataaacaatgcaaattctacaacacttcgaagggttgccgcaatggctctcgttgtcgctttcagcatacctcagtttggaagattgatgcaaatcaccgacccaaacggtcttgttctcggcgctggatcccaggtggtgcgcttgcggcacctgctgctgctggtactggtggtaggccatgtagggctgcggcggcgcgtaatgttgaggcggcatcatgtggtgctgcattaccatcgtcgtcgtcgggtattgcatcggcatccactgcggcggcatggccactggctgaggcggcgacgtctaagaagatgatgatggattcatgggttggcttcgtgaacgcggttgtcttttccaccgttggatcaagggtgggaattgtgtctaggagtgtgtctgatcactgtgttgtggtattgagggagaaggaagtagcagaaggatataagagtttagggatggaaaacgtatatgttggaggataa

SEQ ID NO: 36536 - DNA, 372 bp, Glycine max
  Peptide Sequence Number=SeqID_153314
atggcctcacaacacttacccccagttgaggcaccggatacacacgtattagctgcatgtgtcaacactaaaggaagttgtgctgaagctgctgaaaatcctttagttgaagagccttctgctgaaaatcatagttgtgccgccaccatacacaatgtaccttacgcaaatgatgtggttagggtcaatgttgcaatatgttacgatgttgacgctccggtcccttttccgatgtttgtggatgactggggtacaagcttaggtcatggttcagtgtgtggtttgaagaatgaatggaacatgttttctgatggaacaacgttagatgtcgaggccatcacaacactttgcaagaaatgggaagcatattag

SEQ ID NO: 36537 - DNA, 891 bp, Glycine max
  Peptide Sequence Number=SeqID_153315
atggaagtctatgatcttgatcctaagttgttacaagagattataaaccttggacaactaaggcatccgcatcttgtcatgttaattgggtactgttatgaggatgaacataggctttttatacacaggtcaatgacaatgattctacaatgcaaggatgattctatgggtggtggaaatggtaatcactcttactacgaggtagtttgggagaagaaagttaatgtgggaagttggatgttcaaacataagctcaagacttcaaacaaatatccatggttgatgttgtatctaagagctaatgcaaccagagggttgtttctggagcttctagaatcaccaaattttagagtcagatggaggttagatataaaaaatggaggacctaagagtcggttctaccttttatacatgagtagctgctggaagaacaatggtgctccttatgatggagatgtgctaattgaccttggtgcagccccactggtttggggaaccgtccacccgccatttcatatcactccagaggacagaaaaatttatagaaatgacaccgccaatttcccctacttggcttatcactattactgtgctcccggtaatgccaaacatttggagcaacttgtaagcacttgtgatccttacaacaatcctcaggcacaagagatatttcaattattgcttgaccctatatggggtgcttatggctatcccacccaaaaagaagatggttgggttggggatccaaggatttgggaacttgatgttggtggaacgtctattagactctacttctatcaggaccctagcactcctcctactaaaagaatatggacttctattgataatggaactaagatattttttagcgcacaagatgaagtagcataa

SEQ ID NO: 36538 - DNA, 201 bp, Glycine max
  Peptide Sequence Number=SeqID_153316
atggttcccgcatgtcattgggctcgcctcctctggatgaccaaagtaaaaagtgcgggaccaaatggttcccgtatgtcatccggcccgccgcctctggatgacaaaaggagtttaagggaagagagattgcaaactcagatctatactggttcggtcacacccttgttcatacgtccagtccccaagcaacctgcttga

SEQ ID NO: 36539 - DNA, 306 bp, Glycine max
  Peptide Sequence Number=SeqID_153317
atgttatttggcaaaaatgctgagatgcagcatccaccaggggcaagaaaagatgggaagttgaattgtgagcaagtgaaaattttccaacatgagaatagagacaaagtgatgggaaattttagaattaagagaagaagtgggccacatttttgtctattggggaaggagcaggcaagcaaacgttcactggtgttggaacttgcgttccccggtaaacaagtttcgcctaaaacactttggtctgctcctagtccccacacccacatgactctggttctctttttccactatactaactcatga

SEQ ID NO: 36540 - DNA, 2268 bp, Glycine max
  Peptide Sequence Number=SeqID_153318
atggaccgccggggttggctctggaagaaaaaatcatctgataaaaacataaaggttgagaatgagaaaccaatgcctacatctgaatctgttggccctaccttgtcttctgtggcacatgcaggagatcagcaagacaacatcaaaaataagaattatgttcaaatatcaatggaatcatacgcacatatgtctggattggaagatcaagttgtaaacttggaggatcaagtaaaagctttggaagaaaagctatctgcagtttattcagaattaaataacaaggataatctagttaaacagcatgcaaaagttgctgaggaagcagtctcaggttgggagaaagctgatgcagaagttgtttccttaagacgtcaacttgaatctttgtctctctctaagctcactgttgatgagaaagcagctcacctagatgaagccttaaaagagtgcatgaagcagataagaactgtaaaggaagaaagtgagcagaaactgcaggaggtgattcttatgaaatctcatcagtgggagaaaatcaagttagaacttgaagcacaaatagacaatttggatgaaggacttcgtgagttagccagtgaaaatgctgcccttctaagatcagttcaagaaagttcgaacaaaatagtgaaactaaaagaagagaagtctgaagcagaggcagaggtagagcatctagagaagaatattcagtcaaaggaaaaagaaataacctcactaaagtatgagctgcacatgatttctaaggagatggatatccgtaatgaagagaagaatatgatcatgagatcagcagaagtggcaaacaagcaacacactgaggatggcaagaacattgacaagctagaaagtgagtgtcaacgactccgtggtcttttgagaaagaagctacctgggcctgctgcattggcacaaatgaagctagaagttgagagttcacaccatgtcatcagtgcaccccatctgagaaaaactagttcaaaaactgatggcctgcaagcatctgagtttcttaccaaacaattgaaggtgttggaagaagaaacaaagacattgaaagaagcattggcctcaagtaatgctgagctgcaggcttctaggaacttgtatgctaaaacggttggcagacttaagcgcttggaagcagagatacatcaagaaagaaactcccagaaagcaatgttggcaaccaattatggaaaccccttcagtagagtttatagctatccaccaagcatcacttctatctctgacaatgggcatgaagattcagaaagtcatgttgagtcatgtgcaacatcaattcctgaccattctgatatcaggaggattggaagtgtaggtaaattagagaatcataagagtgaaactatctcagaactgatggatgactttctggaagtggagaagatggcatgtttatcagacaatggtggtgtacctcttggcatcattagtaaagctaatgatgatgctgaagataaaaaggagactagctgtttatcttcaaataaaaattgttttgacaggataaaccaatcaatagaacctgaggcagctgaacatgtcgagcatatgcaagatcttaaggaaaaaaagatgatgttactggaaaacatgcagcttctagaagaacttaaagctcaattggcatcgtctaataaatcatgtagtttaggtgagattcaactgaaatgcatgactgagtcttacaggtcacttcaaacacgtgtagaggtgttagaagctgaaaataagtatttaaaggaaaagatggatgagctaaagaatgatcttgcagaggaaaaacaaagtcatcatgatgctttggtgaggtacaaagaaattgaagagaaaatgcaaagggacaagtgcttggtgtgtgcatcaaactcagcagcaaattctgggaaggataaagaactagcagctgcagagaaaaagctggcagaatgtcaggagactctgtctatacttggtaggcagttgcaagctatgtgccctcagataggtgtaaccatgactcatcatagtaaaaggcttcaaatgaatgaaaagttcgccaaaccaacttatggctggtcaaattcttatggttcatgtaactcaaatgaaattgatcgtgctgaggcatgtagcgtagtgtctgacattcaaggagtgactgatgagttatcatcgcataataactctggtgccacatcatgtctttcagacaccgaagggaactattggttaaacccttga

SEQ ID NO: 36541 - DNA, 222 bp, Glycine max
  Peptide Sequence Number=SeqID_153319
atggggtgtgttggcttggctcctgaagtgtttgacttggactgtgaagagaagatagacagacaaacgaggaaaggagcgggggttaaggtttgtattgattccatattttgggcaaaaaaccaattcaaaatttctaaagacaaatcagtgattaagtacttcggtgtgttgggtgggagtgagtatggctggctattggctaaggtacaccacttttag

SEQ ID NO: 36542 - DNA, 231 bp, Glycine max
  Peptide Sequence Number=SeqID_153320
atggttctagaaaaagggtttccccttttaaagatactcatgcttttggtgtattcaataaaaaactctgagtctaggtttaaggtagctaagcacgcctttctaggcttagcgggtatgacggtgatcacgcgcttagcacgacgatgtcttcttcacgctaagcttggactggccactgagcgaggtgtcgcgttagacctgtcttgcatgctaagcgagatgttttag

SEQ ID NO: 36543 - DNA, 590 bp, Glycine max
  Peptide Sequence Number=SeqID_153321
atgtattgtacgaattccaatgcaagttatacatataaaaaagaaaaattagaaaatcaaaaggatacatgccttttagcgagacaagtaactgagaaatcagccaatcagattcagaattgtgttccctgcaaaaactacagaatgtctgaacgtccgacgccctgcgctgaagaattgggcattaaggaacttctgccagcatatttggatccaaatcttcaacccagcgatctcgtcactggtgtctgctttgcatccggtggttcagggtacgatcctctcacatctaaactagcgtcagctatatcgttgaccggtcaaatagacttgttcaaagaatacataagaaaactaaaaggactcgttggagaggacaaaacaaacttcatcctagccaatggtattgttcttgttgtggaaggcagcaacgacatttccaacacatactttttgagtcatgctagagaagtagaatatgatattcctgcttacactgacttaatggtcaagtcagcttctaatttcttaaaggaaatatatcaactaggtggtcggaggataggggtattcagtgctccaccaattgg

SEQ ID NO: 36544 - DNA, 858 bp, Glycine max
  Peptide Sequence Number=SeqID_153322
atggaaattcaattccaacaaccaaacctgcagcaacagaaatcaggtattgcaatcaccaaaggaggaaagttgaaagggagaagcagaagcaacaacaccaacaaatttgttggagtgagacaaaggccttcagggagatgggttgctgagatcaaagacacaactcagaagataagaatgtggcttggcacatttgagacagctgaggaagcagcaagagcctacgatgaagctgcgtgccttcttcgcggatcaaacactcgcaccaacttcatcactcatgtgtccttggattcccctcttgcttctcgaattcgaaatcttcttaacaacagaaaaggtgtaaaaaaacaggaagatactaatgctaatgcaaataatgcacctgctccaaaagttaccactactagaagtgctagcacttgtactagtactagtactagtactagtactagtactagtagtaattcaagcaatggcaatgacaagaatgataagtctctttctaccgcaaatactcgaagttcgaatctgtttgatgatgcttataaaccagatttgagcaattgcagggaggagtttgagtcaggtcatcaatccaatgcttcatggggctttggaactgtctttgatcgttttcctattgctcaaatattggatataccaaagattgatgatggcctcctcactaatgcagctgacttggagctttcagaatttgaaagaatgaaagttgaaagacaaatatcagcttcactctatgcaattaatggggtgcaagagtacatggaaactgttcaggactccaatgatactctctgggatcttccacccttatgctcaatgttctgttaa

SEQ ID NO: 36545 - DNA, 228 bp, Glycine max
  Peptide Sequence Number=SeqID_153323
atggattacttaatccgtatgtgttatacggattccaaagaagacaaagcaaccattaaagaagggaagaagaaaccttacctcgacgatggaaacgtcctcaaagctagcaatggaagcagtcaacgatggcagcacaacacaaaacaaagaagaggatgcaagaagacgaagaaagaagaagtggcgtacggacaaagaataggagggaagctttttaaaatttaa

SEQ ID NO: 36546 - DNA, 423 bp, Glycine max
  Peptide Sequence Number=SeqID_153324
atgctttcgggcgctaatgttgagtatgatttacctatacctataaaagatgaatcagaaactctctctgatattgatgatgcagagcttgatgtgtacattcacaatgaggaggagaagaatatgaagaagacactctgggaaagagcttaccgagagtatcttgaggtacagaaaattttatctgctgcatattttatagttttaatagtgctagataaagttgcttgcttatctcactcaagctttatcgtttctttcaggagctgctggcagctgaaaaagcagctgcggctgcagcaggaattgggacagatcgatatggcctctggccaaacgactaacgaaacaaggcgttatggctgtcatggcagtgtttttgccaacagccataggcaatttgtgaaggaaggtcagctatga

SEQ ID NO: 36547 - DNA, 420 bp, Glycine max
  Peptide Sequence Number=SeqID_153325
atgaacagacgagtggaaaaggaactcaaaagtgaactgttgctccctagggtccatttggacgatagaactatcatttggaactctaatttcaaatccttgagaattcagaatttgcagggtctcaaatctaaagtcaattttgaactcctgaatgaattgtttgatgaaatggatacgcaggaaaataccgatggtctcaagaaacagaagaaagtacgatttgattcgcccctagataaacatgacaatttaccgtccaagattgagaacaaaaatgaagatgagatgggatcagtggatgaattcgaagatgaaggtgatatgggggagatgtatcaaaatactgaaaatatggctgataaatatttccctgaggatgacggtttcagctataatgactataatgattattactga

SEQ ID NO: 36548 - DNA, 105 bp, Glycine max
  Peptide Sequence Number=SeqID_153326
agaacaagagtgacaagtatgttgtttagtgcaatcaatatggtaatagatgttattggaggacaagagcatccttcagcaaaatacgcagaaggtgggagttga

SEQ ID NO: 36549 - DNA, 153 bp, Glycine max
  Peptide Sequence Number=SeqID_153327
atgggggtggccaacacaacgtcgatcttgactggctcgatacagattttaaccgatgcgatctgggggccattagcaaatgggattgggaccagtagcaaccccaagattggattaagcccaacccacaacaacactctattaaatgtatag

SEQ ID NO: 36550 - DNA, 501 bp, Glycine max
  Peptide Sequence Number=SeqID_153328
atgggaagaaattccataacaaggacgacaagttttagaaatagttgcgacttgtgccctaccatcaacaaaggggaacattgcaaggaggttaggactgacagaagtgtcggatgtcagaggtgtgggttgattcatggagatcacttgtgtcccacggtgttgacctacaaatgtaggaaagtaggacactatgccagaagttgcaggagtgaggggcaatcacaaccaaggccacaaaaccatgggagagtctttacactcaaaggggaaaaggtgaaagagtctgatggttcgattcaagtgtgtgaattccaatatgtttttcctaaggaagtctctagtttacctccaaatagggatgttgagtttggcatagtgatgcaatcctaccccgcaagggcattggatggaagactccaagaagattgggccagagatgcaagagaagaccctagggttctcatgagccttagggtagatttcgggcccatgggctaa

SEQ ID NO: 36551 - DNA, 2716 bp, Glycine max
  Peptide Sequence Number=SeqID_153329
atggtttcatttcaacagcaactgcttagaaaaccagaagggaatgaagcttttttagcttatcaagcaggaattcagggcgtatttgggagtaacaatttctcatctcctagtgccatgcaactgcctcagcagcctcgaaaattgcatcttggttccaaccaggatatccagctaaggggtcaaggtgttgagcagcaaatgctaaatcctgtccatcaagcataccttcaatatgctctccatgctgcgcaacaaaggcctactttaggaattcagtcacagcagcaaactaaaatgggaatgttaagctctgcatctctgcaggatcaggagatgcgtatgggaaatttgaaaatgcaggacattatgtctatgcaggcagcaaatcaaggtcaaggatcatcctctaggaattcatctgagcgtggtgctcgtggtgacaagcaaatggaccaaggacaacaaatgacacctgatcagaagagtgaaggaaagccttcaactcagggaccaaccattggacatttaattcctggaaatatgataagacccatgcaaggaccggaaacacagcagggcatccaaaatgttgtaaacacccagattgcagtatctgctcaattgcaggctatgcaggcatgggcacgtgaacgtaatatagacttatcacatcctgcaaatgcacacttaatggcgcagctcattccactgatgcagtcaaggatggtctcacaatcaaaggtcaatgagagcaacattggtgctccgtcatcacctgttcctgtttcaaagcagcaggttacttctccagcagttgcaagtgagagctcagcacatgctaattcatccagtgacatgtctgggcagtcaggctcttcaaaagccaggcagacagctccatccagccatcttggctcaataacgaatgctggtatagctggtaactctagtgacatggcaacacagcaattcaatgttcatggcagagagtctcaagctcctccgaggcaaccagtagtagttggaaatggtatgccctctatgcattctcagcagtcttctgctaacacaaacttaggtgcagaccatcctctgaatgcaaaaacttcatcatctggtccagaacctcctcaaatgcagtacacgaggcagttaaaccaatctgctcctcaggctggaggtccaacaaatgaagggggtttgggtaatcctgcaaaatctcaaggacgaccagctcagatgcctcagcaacgaaccaattttacaaagcaacaactacatgttctgaaagcacagatactagcatttaggcggctgaagaaaggagaaggtactctgcctcaagaacttcttcgggctattgttccaccacctcttgagatgcaggcgcaacagccaaatcattctgcaagaggacaaaaccaagacaaacctgctggaaatattgcggcagaacaaataagcccaattgagtccagtgccaaggagccacagtctatccctagtattaatggtcagagttctttaaagcatgaatcctttgccagagatgagaaatccattgtacccccagttcatgttcaagctgttgcaccacctgtgtcaaaggaatctgctccaacgttatctgctggaaagaaagaccagaaatcaattggatgctctgttaagtctaaccaggatggtgaatgtgtaaataatactactgttagaaacgagttagcattagataggggaaaggctattgcaccgcaggctcctgtatccgacacaatgcaaattaagaaaccttcacaaacgagcactggtccccagccaaaggatgtgggaccaaccagaaaatatcatggacctctatttgattttcctttctttactaggaaacatgactcctttgggtcatcaatgatgctaaacaacaacaataacttatcactggcatatgatgtcaaagatcttctttttgaggaaggcatggaagtacttaacaagaaaaggacagaaaatttaaaaaagattgaaggtttattggcagtaaacttagagaggaaaagaattaggccagatcttgtgctgaggctccaaattgaagagaaaaagcttcgcctagtagatcttcaggcacgtttaagggatgagattgatcaacagcaacaagagataatggcaatgccagataggccatatcgcaagtttgttaggctgtgtgaacgtcagcgcatggaacttgctagacaagtgcaggcatctcagagagcagtaagggagaagcaactcaaatctatatttcagtggcgtaagaagcttcttgaggctcactgggccattcgtgatgcccgtacagcccgcaacaggggagttgccaaatatcatgagaagatgttgcgggagttctcaaaacgtaaagatgatgacagaaacaaaaggctggaagccttaaaaaacaatgatgttgacagatatagggagatgttgctggagcagcagactagcatccctggtgatgctgcagagagatatgctgttctttcaactttcttaacccagactgaagagtatctacacaaattaggaagtaagataacggctgctaaaaatcaacaagaagtggaggaagcagcaaaggccgctgcagccgctgctcgattgcaggcatgcttcataaaattgcctcccccctcccccctcctcttcttccaatgttttgagaaaa

SEQ ID NO: 36552 - DNA, 396 bp, Glycine max
  Peptide Sequence Number=SeqID_153330
atgtttgtgcttgtcattgcctatctctatatccctgcttctagtgctcttccttgtcatccaacttggtgtggtgtatgctattcatcatcatcatcatctaagatgcagagaaatttcatgaggctgctgatgttctttctgtgtttctcatatgttctctctgtctctgctattcctgcaacaagaacccaaaatttgaaaggtgaagaagaagaagatttttcagccctgccttctttaactagggtggatcatgcacttggaaatggtgaggtggtgctcatagacatgaatgaaggattcatagagaggagggttgatttggaaacccaagactatgaagggactggagcaaataaagatcatgatccaaaatcccccggaggaccttaa

SEQ ID NO: 36553 - DNA, 273 bp, Glycine max
  Peptide Sequence Number=SeqID_153331
atgaaggcgaggaccttgagtcctctaaaggaaacaactttgagtcctatgaaggcgaagactttgagccttctgaaggcgaggaccttgagtcctctaaaggcaagtagtctgagtcctatgaaggcgaggactttgagccctctgaaggcaaggactttgagtcctatgaaagatcaagggaggaatttgggttctatgaaaatgctaatagtaaatgcaggctttgtatgcaacaatgcaatgcaatggaaagttgtacaaggttcatga

SEQ ID NO: 36554 - DNA, 1899 bp, Glycine max
  Peptide Sequence Number=SeqID_153332
ggtctttctgaagaagaagtccgagcagctgcagcttgtgctggagaggaagtgatgattagaaatcgttttctggagatgaatgctcctagagacagttcatctgtcaacaagtattacaaccttgcccatgctgtgaatgaaacagtcataaggcagccatcaatgttacgtgctggaacattgagagactatcagcttgttggtttgcaatggatgctttctttgtataacaacaagttaaatggaattttggcggatgagatgggtcttggcaaaactgtacaggttatggcattgattgcttacttgatggaatttaaaggaaactatggcccacatcttataatagtcccaaatgctgttttgagtgagttttataattggttgccatctgtttcatgcattttttatgttggaagcaaggatcatcgatcaaaattattttcccaagaggtttgtgctatgaaatttaatgtccttgtgactacttatgagttcatcatgtatgaccggtcaaaactttcaaaaattgactggaagtatatcataattgatgaagcacagagaatgaaggatagagattcagttttagctcgtgatcttgatagatatcgttgtcaaagacgtcttcttttgacaggaacaccattacagaatgatttgaaggaactctggtctctcttaaatttacttcttcctgaagtttttgataataagaaagccttcaatgattggttttcgaaaccatttcaaaaggaaggtcccactcaaaatgtagaggatgattggcttgagacagagaagaaagtcattattatccatcgacttcatcagattcttgagcctttcatgctcaggcgtcgtgttgaagatgttgaaggctcacttcctcctaaggtcagcatagttctgaaatgtaaaatgtcagctgtccagagtgccatttatgattgggtcaaatcaactggtacccttcgtcttgatcctgaggatgagaaacacaagcttcataggaatccagcataccaggtgaagcaatataaaactttaaacaacagatgcatggagctgcgcaagacttgcaatcatccattgcttaattacccattcttcagtgatctatctaaggaattcattgtaagatcttgtgggaaattgtggatcctggataggatcctaataaaacttcaaagaactggacatcgagttctacttttcagtaccatgacaaaacttctagacatcttggaagaatatctacagtggcgaagacttgtttacagaagaattgatgggactactagtttggaagaccgtgaatcagcaatagtggacttcaatagccctgattcagattgtttcattttcctgctcagtattcgagctgccggacgaggccttaaccttcagtctgctgacacggttgtcatttatgatcctgatccaaaccctaaaaatgaggagcaggctgtggccagagctcatcgtattggacagaaaagagaagtcaaagttatatacatggaagctgttgttgacaaaatcgctagtcatcagaaggaagatgaactgagaagtggaggcactgttgatatggaggatgaacttgcaggtaaggatcgctacatggggtccattgagagcctcataaggaacaatattcaacaatataagatagatatggctgatgaggttattaatgctggacggtttgatcaaagaacaacacatgaagagaggcgtttgactttggagacattattacatgatgaagaaaggtatcaagaaactgtccatgatgttccctcactacaggaggtaaatcgcatgattgccaggagtaaagaggaaattgaactgtttgatcaaatggatgatgaacttgattggatttag

SEQ ID NO: 36555 - DNA, 237 bp, Glycine max
  Peptide Sequence Number=SeqID_153333
atggagtgggaagagtttgaaatgggcaaaaaactgaagcttttgggtcacctttgctcacaacctatacgatttgaggaacctaataagcgaaggacaaatgtgaatgatccaattgcaacgcccttgtctcaaatgagcagagttatgaacgatccaccatttttccatagcaacacagatcccgtggaagcagaagaatggctcaacaagctagagaaatttttagagtcatga

SEQ ID NO: 36556 - DNA, 888 bp, Glycine max
  Peptide Sequence Number=SeqID_153334
atggaagtaattgagactaaagacttgggtttagactttagattacttattttgtggaagttcctactgtgcacaattatggtgggatggtatagtgatcaaaccaaggcaaagataagtgattcactgagacgtgtttggcatgagcggctgaagtcaaaaagattggtggaacaattttttctttcatgggcacaaagcatagcaaatgcagccaggaaaggagggattggtcaggaagagctagattgggatagctacaataagataaaacaacagttggagctccatcatcttctgcagtctaagaaaaagggaaaagaaaagctgatggcagttgctggagcaaagaatattatccagtcatggaaggaaagcatagccaaagcagcgaagaaaggagggagtggggaacaagaacttgattgggatagctatgaaaagatacaagaagaaatggttcacctccgtcaacttcagcgtactacagaaaaggcaaaggaaaaagagatggcaagggtaaaagcagagaaagaagcacagataaaagcaattaaaagggtaatcctcactcaaaagaaaaaagatcatctagagagggctaaattaaaacggaatataaagagtcatccctgtggaaatgcaaaggaaggcaaaggttccttggaagttactaaagagttcaaactttgcactgaagtaactaagattcatataagtaagaacttcaatggtgaagtacctagagaacaagacgtctttaattccatttttccaactcacaataaattggatctagagcttatcaagagagaaaaaatgcagaaagaagtatcacttgcagaacagatccaagctgctagagacaaaaaaggcaaactccactga

SEQ ID NO: 36557 - DNA, 1680 bp, Glycine max
  Peptide Sequence Number=SeqID_153335
atgggagaatttgatgatgatgggtatagcatggctgatggagtgcagaccattgataaagatcaattggaagatggtctgctttgtgatgctggatatgaatttcctcaatctttagaaagtgccagaaacaatcagatggttgaagaagctggcacctcaggatcgtcctcagacagtcaaagagtgagacagatagtatctccatcagtctcctctcagaaatttggatccctctctgcattagatgctaggccaagttccatttcaaaaaggatgacagatgagttagaggaaggggaaattgcagtatctggtgattctcacatggaccatcaacagtctggaagttggattcatgatcgtgatgaaggtgaggatgaacaagttttgcagaaaccgaagattaaacgtaaacgcagtcttcgtgttcgacctcgccatgccactgaaagacctgaagaaaaatctggtagtgaaatggcatctcatttggcagtccaagcagaccacaaatatcaagcgcaactaaggactgacccagaatccaaactatttggtgactccaatgccagcaggcatgaacaaaacacaccagcgttaaaaaataagcgaaccttaccttcaaggagagttgccaatacatccaaattacatggatctccaaagtcaagccgtttgaattgcatgtctgtgccttcacaagatgctggtgaccactccagagaaagctgggaaggaaaacctatcaattcaagtggatcttcagcacatggcactaagatgactgaaattatccagagaaggtgcaaaaatgtaattagcaagctccaaaggagaatagacaaggaaggccatgagattgtgcctttgttaatggatttgtggaagaggattgaaaattctggatctggaaacagcctgttagatctgcgaaagattgatcagcggattgataaatttgagtataatggagcaacggagcttgtatttgatgtgcagttcatgttgaagagtgcaatgcatttttatggtttttcacatgaggtaagaactgaagcaaggaaggttcatgatctcttttttgagatcttgaaaatcgcatttcctgacacggacttccgagatgcaagaagtgcactttctttctccagtcaagctgctgctggtacagtaacatccccaaggcaagcggctgttagccaaagcaagaggcacaggctgataaacgagatggaaaccgagtcatacccttcacagaggtcactgcaacgtggatcagcttctagtggtgaaaacaacagaattaaagttcatttgccacagagggaatcaagaactggaagcggtgggggcagcagcaccagggagcaacagcaggaagattcttcactgctcgcgcatccgggtgaacttgttgtatgcaagaagagaagaaatgacagggagaaatctgctgtgaaacctaaaactggtcctgtttcaccatctagcatgagaactccaggtccatcttcagtccccaaagaagctaggttaactcaacagggttcccatgcacaagggtgggctggccagccatctcaacaaccaaatggatctggtgggtcagttggctgggcaaaccctgtaaaaaggctaagaacagattctgggaagagaagaccaagccatacatag

SEQ ID NO: 36558 - DNA, 1680 bp, Glycine max
  Peptide Sequence Number=SeqID_153336
atggatttgacaacatttatctcaaccttattcctaggcacactagcctctagaatcattcgacattggctcataggaaggtctctttcttctcacaagaacaagcttcctccgggcccaccaaggtggcccattgttggtaacctcctccaattagggcaacttccacatagagacttagcatctttatgtgacaaatatggacccttagtttatctaaaattgggtaaaattgatgccatcaccaccaatgatcctgatattatacgtgaaattcttcttagtcaagatgatgtttttgcctctcgcccacatacttttgctgctgttcatttagcatatgggtgtggtgatgttgcattggcccctctaggccctcattggaagcgcatgagaagaatttgcatggaacatttgttaacaacaaagaggcttgagtctttctcaaaccaccgtctagatgaagctcaacatcttgtcaaggatgttatggcctgggcccaagataaaaagcccattaacttgagggaggttttgggtgctttctcaatgaacaatgtcactagaatgctgttgggaaaacaatattttgggtctgaatcttcaggcccacaagaggctatggagttcatgcacataacccatgagttgttttggttgctgggtgtcatatatttgggtgactacttgccaatttggaggtgggtggatccttatgggtgtgaaaagaaaatgagggaagtggaaaaaagagtggatgattttcattctaacattattgaagagcatagaaaagcaaggaaagataggaagggtaaaagaaaggagggtgatggagatatggattttgtggatgttttactatctttgcctggtgaagatggaaaagagcacatggatgatgtagaaatcaaagccttgattcaggatatgatagctgcagcaactgatacttcagccgttaccaatgaatgggcaatggcagaggtaatgaaacacccacacgttctccacaaaatccaagaagaacttgacacaatagttggcccaaacagaatggtgctagaatccgacctaccccatcttaattacctgcgatgcgtcgtacgcgaaaccttccgcatgcacccagcagggcccttcctcattccacatgaatctctccgtgccaccaccatcaacggctaccacatacccgccaagacacgtgtcttcatcaacacgcacggattgggccgcaacaccaagatttgggacaatgtggatgagtttaggcctgagaggcattggcctagtaatgggaatggtactagggttgagattagtcatggggttgacttcaagatattgccttttagtgctggcaagcgcaagtgccctggtgcaccactcggggtgactttggttttgatggctttggctagattatttcattgctttgactgggaaccaccaaaaggattgagttgtggagatgttgatactagggaagtttatgggatgactatgcctaaggctgagcccttgattgctattgctaaaccaagtaatgcacgtggcgatggtgggtggtcgggtggcggcgtagtggcttggtgtggtgtggaggtggcattgggtgttggggtggtagtgtttgggtgtggcaatggtgttggtggaagtagggtgttgtggtaa

SEQ ID NO: 36559 - DNA, 240 bp, Glycine max
  Peptide Sequence Number=SeqID_153337
atggtttctagagatatcattccctttgatctcaacgttgtggcggtagggactaccagcgacaacatatcatcaaagagaaaaactctagacgaggtttcactgtcatcaagcaacttgctaagcgaggtggttgtctcttctacactaagcgcaagattggcgctaagccaaatatcacttactcgcgctaagcgcgcctttgagaaaacagaggaaaagctgagcaaggaagcaaag

SEQ ID NO: 36560 - DNA, 186 bp, Glycine max
  Peptide Sequence Number=SeqID_153338
atgtctgttatccacatgtaccaattgttcactcaagttcataccttatccatagagtactgtgagaagtatgctaaacctgaagacataggagctgccacagaagagaactccagtgatgaagagctaagtgaagatgaatatgattctagtgatgaacaggttgctggtaaggcagacccctag

SEQ ID NO: 36561 - DNA, 198 bp, Glycine max
  Peptide Sequence Number=SeqID_153339
atgagggcacttggtggacttggagctcgcccaggcgagctggttacttcaactctaagccatttgggggcccaggctagcctgggcgagccagggcctagaaaattgcctgaaatgacccttttgcccctccccttggaaaaagtattacatgaaactaggtcctacctttgcaaccctgacaaaagaggagattaa

SEQ ID NO: 36562 - DNA, 180 bp, Glycine max
  Peptide Sequence Number=SeqID_153340
atggttcaagttggtgaccggctcagacgagtatacaagtgccgcaggtggccagaatggctagcggcacagcgtgccccgcaggtgtacccctcgaatctccccaacaccaacaagttgagtgtcgttctatttcaggctgatcatgtcgccaccacaagggttcagtatgacaattaa

SEQ ID NO: 36563 - DNA, 225 bp, Glycine max
  Peptide Sequence Number=SeqID_153341
ggacgtgtcgcctttcgaaaggcgagggagtgtagtcctatgatggcaaggacgtgcaatcctctgaaggtgagggcatgtagccctacaaaggtgaaggcacatgaccctttgacggcgaggacgtgtagtcctctgaagttgaaggtacatgaccctttgaaggcgaggacgtgtagtcctctgaaggtgaaggtaactagtacccaaggtgagggcgtgtag

SEQ ID NO: 36564 - DNA, 342 bp, Glycine max
  Peptide Sequence Number=SeqID_153342
atggaagaaggatatgttaccaataatccacctttgttcaaaggagtcaagtatgactattggaaggaaatgatgattacacactttgagtccatacacattgattttttgaaaccaccaagtttggtaaaaaagtcccaaggaggcccaaaaagagcaaagcttggagatgcactacaaggacttggggaacccatgacaaggtcaagagcaaaaaaagtcaaggaaggattgtctaaagaagttactaaccttcttttcttccagctaaatctagaaggagaagcattcaagatggtccaaatgattcaggttgatgaaggacccattgtgggggcatga

SEQ ID NO: 36565 - DNA, 462 bp, Glycine max
  Peptide Sequence Number=SeqID_153343
atggctaagattggtgccggactcatatttgatagcaatacatccagggaagtgagagaagtcactgaaaaacacgccggaaaggaacaatgtcagaataggcaaccgaaaagttctttctcggaaaataagcggcaagctgaaggggtaggtgcaagaggaagggacgtcgagggaggtggaagtatgccgacaaagcggtggttggcagaaaaagaaacactggaaaacagagaaaaaggtcgctggaacaggggacgagataaggggctactagtagaagggtccactggaatgcggaaaaaggaaaaaggtcgcgggtatagagaagctgggagaaatgtgaaagaagttgctagaaaaggagatagggtttatcggaagagggtagcgagcaaaagggctcatcaaggacccactgtccttggtgagggatggtttttccttattccttcaacctag

SEQ ID NO: 36566 - DNA, 249 bp, Glycine max
  Peptide Sequence Number=SeqID_153344
atgaatgtgacagatgctgcaatgaaggcagcaaaaaaagggcagaatgaaggagcacaaaacatgaaagtgccaaatgttgcaataaatgcaacaaaaaaaagcggcacatcgaacaaaaagtcagaaatcgaggcagcagccagacaacagtcaacaggtgaatcttttgaaagaaaaattcaaagatcaaagataaaaatagatcagcagtgtacattaatttacgagaggcagaaattcaagtaa

SEQ ID NO: 36567 - DNA, 564 bp, Glycine max
  Peptide Sequence Number=SeqID_153345
atgtctgatgattctcctattgtttgtgatcataataaggctttggatcttggaagaggtgccaatcccaagggctatatggtagaagaaatatggcaagagcttgcaaaggcaaaataccttgagtgggagcgatcatcgtccaaacgatcatgggaattgcagagcttgaaagaagcttgtgagtcggctttgaaggaaaaacattttcttgattactcccaaatggaaggatttgtggatgacgctactacttcccattcagaacaattagaggctttagaaagagtcttcaatacagctgcagaagctgacatacctactgaggtgccagattatttgtgctgtagaatcacactcgacatttttcatgatcctgttatcactccaagtggacttacatatgagagagctgtgattcttgaacatcttcagaaggttggtaaattcgacccaatcacacgagaaccccttgatccatcacagttagtgccaaacttggccattaaggaagcggtggaggcattcttggacaaacatggatgggcctacaagatagattaa

SEQ ID NO: 36568 - DNA, 231 bp, Glycine max
  Peptide Sequence Number=SeqID_153346
atgggggttggaggagtggcaggaggccatgatggcatgatagtgctactaccactaatgtgcacaattaactacaatgctgacttggggatgaaaagtgtgataactgctaaagaggataaattctcaatgtccggctggtatttggatccagcatacgaattccatccaaaccaatctgagcagacagaggtcaacgaagttcagatcaacagcaataacataatgtga

SEQ ID NO: 36569 - DNA, 474 bp, Glycine max
  Peptide Sequence Number=SeqID_153347
atgggtggaggcaggaggcctgctgaagctgtgaaaacaaatgaacagtcttcagaaagaaagaaaggttttggtgattggatgaatcttatcaaacctgccaatgaagagaaggatcattgggtaccggatgaagccgtctcaaaatgtacagcatgtggcactgattttggggcttttgttcgcaggcatcactgtaggaactgtggtgatattttctgtgacaaatgtacccatggtagaattgctctgactgctgatgagaatgctcagcctgtacgagtttgtgaccgttgcatggctgaagtgactcagcggctgactagtgcgaaagagtcatcaagtaaacctgcattgcagagtcatgaggatcttgcaaagaaacttcaggaggaactagagagaaatcaaaaggcatcagattttgaattttatctctgcagctctgttaagtggtgtggttcaggtgcctag

SEQ ID NO: 36570 - DNA, 336 bp, Glycine max
  Peptide Sequence Number=SeqID_153348
atgaagctaaacttagaagtagctaaaattatcactgccatggattctttaatggcttctcctctaccccttggtattcttgttctacgttgtttcatgttactgttaatggtttcttgcaaagcgaagggtttggtggaacttccaccaaatgttacggttccagcagtgttggtgttcggagattcaataatggatacggggaacaacaacaacaacatgcaaactcttgctaagtgcaacttcccaccatatgggagagatttcgaaggaggcatcccaactggtcgatttggtaatggaaaggttccatcagaccttgtagcatatgcttga

SEQ ID NO: 36571 - DNA, 654 bp, Glycine max
  Peptide Sequence Number=SeqID_153349
atggtcaatgaaattaaaaaacaagacaaaatcagaacagtgcacaaaggatggcatgcccactacatgttggggcttgcattgctacagagacaagaatctgccaagggaatcaaagaattggagaaggctttggatcttggaagaggtgccaatcccaagggctatatggtagaagaaatatggcaagagcttgcaaaggcaaaataccttgagtgggagcgatcattgtccaaacgatcatgggaattgcagagcttgaaagaagcttgtgagtcggctttgaaggaaaaacattttcttgattactcccaaatggaaggatttgtggatgacgctactacttcccattcagaacaattagaggctttagaaagagtcttcaatacagctgcagaagctgacacacctactgaggtgccagattatttgtgctgtagaatcacactcgacatttttcatgatcctgttatcactccaagtggacttacatatgagagagctgtgattcttgaacatcttcagaaggttggtaaattcgacccaatcacacgagaaccccttgatccatcacagttagtgccaaacttggccattaaggaagcggtggaggcattcttggacaaacatggatgggcctacaagatagattaa

SEQ ID NO: 36572 - DNA, 744 bp, Glycine max
  Peptide Sequence Number=SeqID_153350
atgcttatcaataagaaccaaaacattaaaacaacagtcattcctccttttggtaacaaggttttggagttgaagccaacattgctcggttggattggttcacacccttttgctggaatggatcatgaagatccatacatatatttgtctaccttcatggagttatgtagtaccatgggagcttttgatgaagatgttgaagttgtctacctcagagctttctcattctccttgacaggtgccaatcccaagggctatatggtagaagaaatatggcaagagcttgcaaaggcaaaacaccttgagtgggaacgatcatcgtccaaacgatcatgggaattgcagagcttgaaagaagcttgtgagtcggctttgaaggaaaaacattttcttgattactcccaaatggaaggatttgtggatgacgctactacttcccattcagaacaattagaggctttagaaaaagtcttcaatacaactgcagaggctgacacacctaccgaggtgccagattatttgtgctgtagaatcacactcgacatttttcttgatcttgtaatcactcgaagtggacttacatatgagagagctgtgattcttgaacatcttcagaaggttggtaaattcaacccaatcacacgagaaccccttgatccatcacagttagtgccaaacttggccattaaggaagcggtcgaggcattcttggacaaacatggatgggcctgcaagattgattaa

SEQ ID NO: 36573 - DNA, 147 bp, Glycine max
  Peptide Sequence Number=SeqID_153351
atgaaagtactggaaagaaggcaatgtgagcagtcagagaaaaaattggaggaatctcagggaaccgctagagatgccactatcactgtcggaagacacatgagcccgcttagaggtaaggatgtgttattcacaattggggattag

SEQ ID NO: 36574 - DNA, 858 bp, Glycine max
  Peptide Sequence Number=SeqID_153352
caacaacaacaagggagccaacaacaacaacaaaacgaggatgcaggtggcagtggaaaaggggggtttctgagcaggcaaagtagtacacggtggactcccacaaacgaccagatacgaatactgaaggacctttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttttgatcataataacaataacgtccccatgcaacaaagaccaccaactcatcctaatccttctgcttctgcttggaaacctgatcccattcacaccaagtattctaacatctcttctactgcagggatctcttcggcatcttcttcttctgttgagatggttactgtgggacatatggggaattatgggtatggttctgcgcccatggagaaaagttttagggactgctcaatatcagctgggggtagcagtggccatgttggaataaaccacaacttggggtgggtcggtgtggacccatattcctcaacctatgccaacttctttgacaaaataaggccaactgatcaggaagaagaagcagagaattttggtgctactaagattgaaaccctccctttattccctatgcacggtgaggacatccatggctattgcaacctcaagtctaattcctataactatgatggaaatggctggtatcatactgaagaagggttcaagaatgcttcccgtgcttccttggagctcagtctcaattcctacactcgcaggtctccagattatgattaa

SEQ ID NO: 36575 - DNA, 231 bp, Glycine max
  Peptide Sequence Number=SeqID_153353
atggaggaggaaacaaaatggtttgacgggaggttggtgtggaggattggtgagaggaagcaagcaaggttttggtttgattgttggatagggaagaatagtcttggggacaaaatttccaagattatttctcatttcaacccaacaaaatcaccttaccaaggacatgtgccagtgggtgagattggttgggaatggtgtttggcttggaggatggaactatttagttag

SEQ ID NO: 36576 - DNA, 384 bp, Glycine max
  Peptide Sequence Number=SeqID_153354
atggagagcggagagaataatggtgatggcgcgcacgcacacggccatgcaaaaccacctgacgggggaaagtctccacctatcgcaacacgcaaccttttgcaagacggaaacatgaagttggactatgaaggagggaaccgcttgcttcccaaattcacgattgacgctaaggtttttgagcaactatgtattccctggaagaaatgcttggtagtgaagctgttgggcaagagtatcggatatttgatcatgaaggaaaaacttcaatcaacatggaagccagatgaagggtttgatttaattgatgtttcttatggatacttcatggtgaattttgatttggatgcggatagagagaaggcagttaatgggagaccatga

SEQ ID NO: 36577 - DNA, 525 bp, Glycine max
  misc_feature (171)..(171): n is a, c, g, or t
  Peptide Sequence Number=SeqID_153355
atgagtgcatcgaggttcattaagtgcgtcaccgtcggcgacggcgctgtcggcaaaacctgcttgttgatttcctacaccagcaacacttttcccacggactacgtgcccacggtttttgacaatttcagtgctaatgttgtggtggatggaagcaccgtaaacctgggnttgtgggatactgctggtcaggaggattataataggcttagacccttgagttatcgaggagctgatgtatttatacttgccttttctctcataagcaaggctagctatgaaaatattgcaaagaagtggatccctgaactaaggcattatgcccctggtgttccaataattctcgttggaacaaagttagatcttcgagaagataagcaattttttatagaccaccctggtgcagtaccaataactacaacacagggagaagaattaagaaaactgattggtgctcctgcttacatcgagtgtagttcaaaaacacagcaggtgcaattctctctcttaacacatatgcagtga

SEQ ID NO: 36578 - DNA, 525 bp, Glycine max
  Peptide Sequence Number=SeqID_153356
atgacgagaatgctgctcgaaattctgaacaggactcatgttggcggtgtagaagtgggagggaaatcagaaaaagctcaaaccctaaatctaagcacgaaatccagatttagcaccattgttgtagatgaaggagttgcagaaatagggaagaccgataagcctcagaaaaggtcacaatccaaactcgctcctccgtcagataaggttgatttcgacaaggatctaggatgtgagggttcacacttcctccgtgaccgctccgctccccagatctgtgagcacattgagtatgaaggtctgatggttctcaaactcggcgccacccccttcgcagtcgtcgttccaatccgcatgattcttatcatctctgatcataatgcgatgaggttgtttccggttaccatgccagcgcaacaactgtttcgattcgattttgtacatgttttggacagagaagatgaagatggagaaacaaaggttgcttatgggttcagttctactattgttggtggtggtgcttaa

SEQ ID NO: 36579 - DNA, 990 bp, Glycine max
  Peptide Sequence Number=SeqID_153357
atggtgatggaggttagggatagtcttgagatagctcacactgctgagtacttaaattttctgaagtgctacttcagggcattttctgcaattctgctgcaaattacgaagccacagtttgtggacaatcaggagcacaagcttcggaatattgtggttgagatattgaacagacttccgcacagtgaagttctccgcccctttgtacaagacctcttgaaggttgccatgcaagtgcttaccaccgataatgaagagaacggcttaatttgtatccgtataatctttgaccttttgaggaactttaggccaactctagaaaatgaagtccagccgtttctggacttcgtctgcaagatttaccaaaattttaaactaactgttagccatttctttgacaacatggcaatgactggggaagatgtcaaacccatggagacttcactttctgatcaaggtataaacaacaccactgcaactggttcactgcttaatccaagtactcgctcattcaagattgttacggagagtccattggtggtgatgtttttgtttcaattatatagtcgtcttgtgcaagcaaatattcctcaattgttgccattgatggttgctgctatatcagttcctggcccagaaagggttcctcctcatttgaaaactcacttcattgagctcaagggtgcacaagttaaggtaggtgcttatgggcggagcggatcggcacccatccgcgacggacacgtgtgtagcggcacggttttgggtcgcggcggagcggtgcgggttgcggagctgtttttcgcgccactacttcgaagcactggaggttctgttctgtgttgtttcgtctgctttgttcttccaaagagaaagagggaagagagagagggagggagggaggacgagagagagagagagggctctgtgttgcggcgcagttttaatataccattaggggattcaggaaaaaaacatatataccactag

SEQ ID NO: 36580 - DNA, 645 bp, Glycine max
  Peptide Sequence Number=SeqID_153358
atggacaagaaaggtggtggaatggtgatcatggaacgtgcagagattgacactcgtgccccattcaagtctgttaaagaagcagttatgttgttcggagaaaaagtactagttggggaaatttatgccaacaagctcaaagagatgcaagttgaagcgaatggaagtgggagtgcacaaaccagaggtggagcattggcaactgagctggaagaaacaaagcaaagtcttgagggagcaagagaagaagctagcaatttggttcaacgcatcaagtccctgaaaaaggaactggaacaaacgcagaaagaactagaagacacaaaagcaagagagcaaaggttgctgcagcgacgggacgatccggagattgaagacctcaagttcattgcaaatgcaacaacaaccaatatggaaatcaaaactcaaagcagtgatgaggagaaagcagaagagttccaaaaaagaagatatgtgaaattcgctagtcctcatgcacttgctcaagttatccctaacaagggtgaattgcttgggagacctccttctgttaagaagccaaagaggaagccgttgatgcctttgataggatggcttttctctaaaaagaaagggagccatgaagttgactctcccagagcctaa

SEQ ID NO: 36581 - DNA, 414 bp, Glycine max
  Peptide Sequence Number=SeqID_153359
atgaatgcacagaagaacacaaacacaataatctctcaaactccagaagaagaaagaaagagaaagcaaactaaggaagctgtaccaagccttcattcacgtgaacataggtgcaggcttttcagaaaaaggtgcagaccaagccttcattcatgtaacccacacaagcctatcccgccagctcgaaaggcgggatcctctctccccctgtcccgcaaccgccagtggcggtaccgccctctctcacctgtcccgccagctccaagggcgggaccaccccctctctcctatcccgccatctccaagggtgggacacctctgcacccctccccctctctcctagtcagcccctatcccgccattgccactggcggttcaagcttcccgccagtgccaatggcggcacccacgtag

SEQ ID NO: 36582 - DNA, 1218 bp, Glycine max
  Peptide Sequence Number=SeqID_153360
atgaagaccatcatatggagcatcacccatgcacattccccaagacctcaggctcttgtctcaccgtcttctaatttatcaccacctcaaggagtgaggggcatgagagaagatgaggtttgcaaagcttctggtgttttaaaaagtggtgttcattgcttagcacttttcaaggagaaagatgaggagagggagatgctgcatctcttctcacagattttggccatcatggaacctcgagatcttatggacatgttctctctgtgtatgcctgagctttttgagtgcatgatctccaacactcaacttgttcatatattctctacccttctagcagcacagaaagtgtaccggccattcgcagatgtgcttgttaattttcttgtgagcagcaaacttgatgtcttgaagcaaccagattcacctgcagcaaaactggttttgcatctctttcggtttatatttggtgccgtggctaaagcaccatctgattttgaacgaattttgcagcctcatgcgcctgtaataatggaattttgcatgaaaaatgctactgaagttgaaagacctcttggctacatgcagttgcttcgtacaatgttcaaggcactttcagggtgtaaatatgaacttttgctccgggatttggtccccatgttgcagccctgccttaatatgctgctggctatgttggaagggccaactgctgaagatatgcgagaccttttattggagctatgcttaaccttacctgcccgtttgagctctctgttaccatacctttctcgtcttatgaaacctttggtattatgtcttacgggaagtgacgaattagtgagtcttggtttacgaacacttgagttttgggttgatagtttaaatcccgatttcctcgaacccattatggctagtgtaatgtctgaggtgattcttgctttgtggtctcacttaagaccagctccctatccctggggtgcaaaagcgttgcagcttcttggcaagttaggaggccgaaacagacgattcctcaaagagcctctagcacttgagtgtaaggagaatcctgagcatgggcttcgcctgattttgacatttgagcctgcaaccccattcttggtgccacttgatcgatgcataaatcttgctgtggaagctgtaatgaacaaaaattgtggcatggatgctttctatcggaagcaagctctaaaattccttcga

SEQ ID NO: 36583 - DNA, 358 bp, Glycine max
  Peptide Sequence Number=SeqID_153361
atggacggtgcaacggctcaaaaacaatcgtttgctcccaacaggaatatcagaatgaaaaccccgaagaaaaatggacgaggtctcttgaatcctcctcctcctcctccttcacgcgccatgtccttctcctactctcatccgctctcagcttcttcactcatctacatgcaacaacaaccacctctgcttcctctgccccatgttgttaataaaaagaaaaacaggagcagagaggaagcgaagaaaagaccgggaacacaatctattctttctgataaccgctggggacctgatcccaaagaccttcccaaagtggtgctagggatgggaaacatcgacgacgtcgtcgtttcgg

SEQ ID NO: 36584 - DNA, 1932 bp, Glycine max
  Peptide Sequence Number=SeqID_153362
atggatccgaacacttcaccacggtgccccggcacaatcaccgttcgtcggaaccctccccggagagctcgcgccaccccccaaacgacgccgcaaagcttccacttacccgaaatcgcgccattcccaaacgatgacgttttgtccgcagcacaaacaccagaaatcccgccaacgcctctccccaaaccggaaaacaaaaacctaaaagttttcctccgaatccgacccctcccttcgtcgccggttcaagctccgcgcgtgagacctaagagcgcgtggcctcagaaccccgtaaaaaagaacgcgcctccgccaggtgctaaaatttccaagaacaagaaccccgccgcgtgcttaacggtcaacgactcacagtcggtgaccctatcaactcccgtaagctcgaaagaatcgaagcgaatcaaatcagaaacttatggaggcttctcgcacgttttctcttccgactcatctcagtttcaagtgtatgagagaatgatgaaacctctggtggaggagtttcttagaggtagaagtggaatgttggctgcattgggacccagtgggtctgggaagactcataccgtgtttggaaccccaagggatcctgggatggtacctcttgccctacgacatattttcgaggacactgagccacatgccatacaagcatctagaaccttttacatgtcgatatttgagatatgttctgaacggggtaaagcagagaagctgtttgatttgttatcagatggcagtgaaataagcatgcagcaatcgactgtgaagggattgaaagaggttatcatctccaatactgaactggcagaatccttaatagcacaagcaacactgaaacgtgcgactgcaatgacaaacactaacagccaatcgagtcggtcacaatgcatcattaacattcgtgatgttcccccaaaatgtaaaggggtgatcaatcctaagtcaaatggtgcttctttgactatcattgaccttgcaggggctgaaagagaaaaaagaacaggaaatcaggggacaagattgcttgaaagcaattttatcaataacacattaatggtgtttggcttatgcttaagatcattattggagcaccaaaaaaatcgcaagaagccattgcagaagcacttccaaagttccatgttaaccaggtacctgcgagattatttggagggcaagaagcgcatgtccttgattttaacagcaaagtcaggagaagaagattatcttgatacttcttacctactgagacaagcttctccttacatgcagatcaagtataatgaagttgaaccatcaaacatagtttccaaaaagaggcattaccaagcttcatccataatggataatacaaaactatcacctttatcggaacatttaaagagaatgagacttgttactgaacatactgaccagaatgatgaaaagaatgttgaagaaaggaagactgttatggaagatgcttcaacactctgcaaattagaatctagtagttctgtcactttcaagccagagtgtgatagccaggtccagagcgagagaggccacattatcatgcagaattttgctaaagttatatggaatgtcttgaagcaatataattccaaactaaaggttgcagaaatggaaatagaaagtctcaaagaaagcattgggtatgaaaagaaaaaatacttggaactggaaacacacttgaatgagtttaaggcatgttgtacttgctgcaaaagaggaaaaataaaaaatgatcctgaagattgctcatcagtggatcttgatcaaccacataattgggagcaagaggttgagtacagtattcctagattcctactctctagtatgaagattagtaagattttcatagatgcaccttcatctttaatatattcatcaagaattgatactctgtaa

SEQ ID NO: 36585 - DNA, 288 bp, Glycine max
  Peptide Sequence Number=SeqID_153363
atgaaccacaaaggaatcccctcctttgtgttcaatgattacaaccaagaggttatgcttgcaatgaacccaaaagcggttagtcttttgagtctagtgataacaaccaagaagttgtacccacttcttgcaatgaacccaaaagcggttagtcttttggatccagtgatcaaccaagaagcaaatccacttcttgcaatgaacccaaaagcaattagtcttttgagtctagtgtttaaccaagaagaccttctcttgaaaaatagtcaccaagagtgggtttattga

SEQ ID NO: 36586 - DNA, 1041 bp, Glycine max
  Peptide Sequence Number=SeqID_153364
atggagaccccatcgtccaccagaagagtaataacaagatcacagactttatctgcttccaatgatgctctcatcacagttttcagaaatattgaagattccgaaaagaacacatcaaagtcaaaaacaagggtgcaacaacaacaagatcaatcagcactaatagacataacaaatgattctccaatcgcggggcttgcgaatggggtaattcttggtaccccattggcgaagcagagaagaagcaaaatgaagaacactccagggtctggggaagccttgctgaggggacaagtgaagacccttttgcttaaggtggaagaagaggtcgagctttccaagttctcgcttgaaagcatggaacttgttgcaccaatgcccgtgaatacgcctcaatttcagaatctttctggtttggcttcagttaccaacccttctgttgttctcaaaaacccactaattcctcaggtggtgaatcatgtatttgatggttctgaatctgaaaagagtgtaataagcaggtcccttttatttgacttctcagagaaatctcaactttcgaatgcatcagaagaatttttctctgcgctgagttatgaggaactagtacaagctggaaaggaaattagtagctgctgcatagaaggtgatgatgcttctatctggtcaatgcaggtcaatgcaagcacccatgatgaagaagaagatgatgaggttacaactgcatacgaagaagattgttgtgaggatgttgaaggagaagaagaaaaggaagagtatgatgaaggaggtttgctgcttgatgaactgtgtgaagggttgaacaacattagcatgaatgaaaggatagctccaaaatttgaaggaaagcacacaagatttgtttacaacagtgatgatgagattgtgaaagaagaggtggaagagaactttggtgagagtgcttcttcaactaagatattgcgtttgaaaggattgccgactccaaaagggaaacacttacgcttttatgaggaagaggatggaaaatctgctttgtga

SEQ ID NO: 36587 - DNA, 432 bp, Glycine max
  Peptide Sequence Number=SeqID_153365
atgactgaggatgttcctgacatgactgaggatgtccctcatatggctgaggatgcacctgagatgactgcggacgtacagactgatgatggtgctgaggggtcacatgctgatgatcctgagggattcccaggtgggctacgtgacccgtcagtgctgacttcatttgcgagccatgttgcacatgccatttggagtggacaagaacgtcctgagttgaagttggtgtcggatgggaggaatgtgacattaattgggaggccagtgcctgagattgaaggactggttgctgccgcaggattaagtccattgatcgggtgttttgttgttaccggcgatcctgaacttatatccgcatttgtggagaggtggcacagggagaccaacaccttcccccttccagtagaagagttgacgatcacactggatgat

SEQ ID NO: 36588 - DNA, 654 bp, Glycine max
  Peptide Sequence Number=SeqID_153366
gagcatctaccaaagcagtccagagtcagaggtcatttggtgaaaattgatgctgacagtctgaacacattcttagagacacctgtggtattagctgaaggggagaccttacccgcttactctagatactgcaggttgcctatagactacagagagatagagactgccttatgcatacctggccgagggttcatcttgaactcagaaggccatcctgggaagattctcaggaaggatctgactacattagctcagatgacctctatagcccagtctaatacttctagacttggattccctgctttaatcaccgcattatgtagagccagaggggttgtctctgatagcctcacttttgagcgcttgagcccggtcattaacttggcctacatcaggaagaactgttggaaccccgaggatctaacagtttctatccgaggggctaggggggcgagggcaaggctagcagagcttccttctacttctgcagctcctactccagcatccacttcagtagccccttctgtcccagttcagatagattctcagcacttggaagccatgcttcagagcattcatcagggacatatcattttactacaaagtttacagatgatggcacctctaaactcttccttcagtaaagcaatttaa

SEQ ID NO: 36589 - DNA, 2946 bp, Glycine max
  Peptide Sequence Number=SeqID_153367
caagaaatctcgctcttgatattcgctcaattggctcattacatcggccaaaccctactccctcaaatttccactctccactccgtcttcctccgctccctccactcctccaccccctccgacgtccgcatcgccgccctcgctgccgccatcaacttcatccaatgcctcaccaactcctccgacagagaccgcttccaggacctcctccctctcatgatgcagaccctcacggaggcactgaactccggccaggaggccgtcgctcaggaggctctcgagcttctcatcgagctcgccggcactgagccgcgcttcctccggcgacaaatcgccgatgtcgtcggttccatgctgcaggtggcagaggccgaggccttggaggaaggaacacggcacttggcgattgaatttgtcgttactctcgctgaggcgagggagcgtgctcctggaatgatgaggaagctgccacagtttgtgagaaagctttttggtgtgttgatgaatttgttgcttgatatcgaggatgatcctgcgtggcacggtgcagaggatgaggaagaggacgcgggcgagacgagtaactatggctttgggcaggagtgcttggataggctctcgatttcactcggcgggaacaccattgtgccggttgcctctgagctgttgcccacctacttgtctgctcctgagtgggagaagcaccatgctgccctcattgcgcttgcccaaattgcagagggttgttcgaaggtgatgataacagtatgtgattcgtggagaagacttcctttaacctggaatgcagcacgtggtatggtgaatttggttatgataaagaatctggagcaggtattgtcaatgattttaaattcatttcacgatcctcaccctcgagtgcaatgggcagctataaatgcaattgggcagttgtccacggatttggggccagacttgcaggttaaatttcaccacttagtgctgccggctttggctggagctatggatgattttcaaaatccaagagtacaggctcatgctgcttctgcagtgctaaatttcactgagaattgtacctcagatatcctaacaccttacttagatgggattgtgagcaaacttttggtactcctgcagaatgggaagcaaatggttcaagaaggagcattgacagccttagcatctgttgctgattcttcacaggagcaatttcagaagtattatgatgctgtgatgccatatttaaaagctattctggtgaatgcaaacgataagtctaatcgtatgcttcgagccaaagcaatggagtgcattagtttggtaggaatggctgttggaaaggagaagttcagggatgatgccaaacaggtcatggatgtcttgatgtcactgcaacaatctcaactggatgctgatgatccaactgcaagttacatgctacaagcatgggcgcggctttgcaagtgccttgggcaggattttctcccatacatgggttttgtcatgcctcctttgctccagtctgcgcaacttaagcccgatgtgaccattacatcagcggattctgatactgaatttgatgaagaagatgacagcattgaaacaatcacacttggggataaaaggattggcattaagactagtgtcttggaggagaaggctaccgcttgtaacatgctatgttgctatgctgatgagttgaaggaaggatttttcccttggattgaccaggttgctttcacattggttcctcttcttaaattttacttccacgaagaagttaggaaggctgcagtttcagccatgccagaactgttgtcctcggcaaaatcagctgtagagaagggacagtcgcaaggtcgtgataagacttacgtaaaacagttgtctgattatataataccaaatttggtggaggctttacacaaggagccagaagtagaaatttgtgcaagcatgttggacgcattgaatgaatgcatacaggtctctgaatcacatctagatgaaaagcaagttcggagcattgttgatgagattaaacaagtccttacggccagttcatcaagaaaacatgaaagagcagagagggccaaagaagaggactttgatgctgaagaaagagaactactcaaagaagaaaatgagcaagaagaggaactttttgatcaagttggtgattgcttgggaactttgataaagacattcagggcatctttcttgcctttctttgatgatctgtcctcatacctaactcctatgtttggtaaagacaaaacctcagaggaaaggagaattgccatttgtatatttgatgatgttgctgagcatggtcgtgaagctgctcttaaatattatgattcttttcttccattcttactagaagcttgcaatgatgaatatccagatgttcgacaggctgctgtttatggtgttggtgtttgtgctgagtttggtggatctgttttcaaaccccttgttggagaggcactttcaaggttagatgctgtgataaggcatccaaatgcactacattctgataacataatggcatatgacaatgctgtttcagctcttggaaaaatatgccaattccatcgtgatagcataaatgcagcacaggttgttcctgcctggctaaattgcttgcctataaaaggtgatttaattgaagccaaggttgtgcatgaccaactttgttcaatggttgaaagatcggatagagaacttataggtcccaacaatcaatatctttccaaaattgttgcagtttttgccgagattttatgtgcgggaaataatctggcaaacgaacagactgttagtcggatgattaatttattgaggcagcttcaacagactttaccaccttctacacttgcttcaacctggtcatccttgcagcctcagcagcagcttgcacttcagtccatcctatcatcctag

SEQ ID NO: 36590 - DNA, 1479 bp, Glycine max
  Peptide Sequence Number=SeqID_153368
atgacgctctcactcgagaccccgacaaaacttttccttttcgttgaaatgaaaaccgcttcatcgatatttccttgtatacgcgtcaatgcgtgtgtaaccgacacgtcactaaatgtcgcactcaatggatccggaaaatgctataaatacctcagacacaagccagtagtactaagtcaccaacgttccagtagctgctcctcagtttctccaaacccaaactttcacgacagggacctgtcagatttagttaaggtttttgcatcatcactgtgtgaagataatatagatatggaaatctcccatgacatcaagatcaaggatgacaagctaggtgatgtaaaggaagagaagattaaggcagaagcggaactgaagcataaatcagttgagaaagagcatacaaaaagtaaggaagagaagattaaggtagaagcggaactgaagaataaatcagttgagaaagagcatacaaaaagtaaggaagagaagaaacataaagatgaagataaatcaaagaaaaagaagaaagagaaggtggaagaggaagatgaagagagagagaaaaaagaaaaagatttgaaagctaaaggggacgatggtgaagagaaaaaggagaaggataagaaggagaagaagaaaaaagaaaacaaagacaagggtgacaaaactgatgtagagaaggtcaaggggaaagaaaatgatggggaggatgatgaagagaagaaggaaaagaagaaaaaggagaagaaagacaaggatggcaaaactgatgcagagaagatcaagaagaaagaagatgatgggaaggatgatgaagagaagaaggaaaagaagaaaaagtatgacaaaattgatgcagagaaagtcaaggggaaagaagatgatgggaaagatgaagggaataaggaaaagaaggacaaagaaaaaggagacggtgatggtgaagagaagaaggaaaagaaagataaagagaaggagaagaaaaaggaaaagaaggataaagatgaagaaacagacacattaaaggaaaagggaaaaaatgatgaaggtgaggatgatgaaggaaataagaaaaagaaaaaggataagaaggagaaagagaaggatcacaaaaaggaaaagaaggataaagaggagggtgagaaagaggatagcaaggttgaagtttctgttagggatattgatatagaagaaataaaaaaagaaggtgaaaaagaagataaaggaaaggatggtgggaaggaagtgaaagagaagaagaaaaaagaagacaaagacaagaaggagaagaagaaaaaagttactggaaaggacaagaccaaggatcttagcactctgaagcagaagcttgaaaaaattaacggaaaaatacaaccactccttgaaaagaaggctgatatagaaaggcagattaaagaagttgaagctgaaggtcatgtggtcaatgaggagaacaagaatgaggtacagtag

SEQ ID NO: 36591 - DNA, 1329 bp, Glycine max
  Peptide Sequence Number=SeqID_153369
gcggcggcgtcgtcggggagggtggcggcggcaagctctgagacggtgtcgcagagcttcttggggccagaggaaggagtcgtggtggcgcgtgaggtggcggcggaggaggatggcggacatggtgcggctctcgggaggttgaataaggactccgcctgggagcggtggtggttggacgaagacatcaattgggagattagggattccagctgggctgagtccgggcccaggattagggccacttgttgcatcggatcactcgccatcgcttgctctctctctgaagaaagcgagggaagaccaaaactgcaaggggaagatgattcttttgcaaacgtgcttttgcctgttgaatctaaacctggtggcaattatgccagtgaaagttacttcaaaaaggtacctatgaagagccatttcattacaaaagacccaacagaagcagatcttttctttctgcccttttccatagcaagactgcggcacaatcgtagagttggtgtgggaggtaaacaagacttcattagagactacattcagaatatcagtcacaagtatccatattggaaccgcacaggtggtgccgatcacttttatgttgcttgtcattcaattggaaggtctgccatggacaaagcaccagatgtgaaattcaatgccattcaagttgtatgctcatctagttatttcctaactgggaatattgctcataaggatacatgcctaccacaaatttggccaagaaaaggaaatccccctatccttgtttcatcaaagaggaaaaggctagctttctttgctggaggagtaaattccccggtacgtgtaaagcttctcgagacatggaaaaatgattcagaaatctttgtgcaccatggaagacttaaaacaccatatgcagatgaactgctaggaagcaatgttaattatcaacagtggtatcaaaaagttgatttcccaacacatgttaagggctttgaagtgaacacaactcgcattggagtgatcattgccaactactatgaccttccatttgcagatgtgttaaactggaagagcttttcagttgttgtcactaccttagacattcagcttggagaagatatgaaggagcttcaacaatggagcttcaacaatggtagcttgccgcgacatgtggtgatgaagaaggttaccatgcaagggaggattatgagtggcgacaatggtggtgttaagaaagatgatggaagtgttgagaaggatgacagaggtgtttgtgatgacaatgagggatttgctggcgtcaaaagtgttgttagtgatgacaaaggtggtccactgtag

SEQ ID NO: 36592 - DNA, 420 bp, Glycine max
  Peptide Sequence Number=SeqID_153370
atggatgaagttggtagtagctctgagtggagcaaagaacaggataaagcatttgaaaatgccttggcaattcatcctgaggatgcttcagaccgatgggagaagattatggctgatgtaccagggaaaaccttggaagagattaaacaccactatgagctcttgcatcttataattcttctccagagggctcaacaagccatgctagtgatgaaggagctggcaagaagggaggccactcttggaatagtaacaatgaatcaaatcatggaactaaggcttcaagatcagatcaggaacggcaaaagggtattgcatggacagaggatgaacacagcacaaggaaggttcgattgtactgtggaagaggcaattctgataggaagcttacttgttacctcttttgttcatgcttcatga

SEQ ID NO: 36593 - DNA, 2003 bp, Glycine max
  Peptide Sequence Number=SeqID_153371
atgactgatgacaacggcataggctctcagacgggttttctatttggtccatctgttctgggacgttggaatgcttttatcaaaaacgcatttcctttcagtaacatgataccatttgaaaccgtgggagggatggtccttgtttactacgtgttctttgtaggtctagagatagacttgaaaccaataacgggatttcacaagaaggccatggttattgtcatttcctgcacaatcttcaccttaccaatagggtttggcttgtactacatgcttgtcaccgacatgtggcgcaaacctttgccccttgtcaatgctaggccaaagggtgcaatattatggggaattaccctttcttgcagcagtgagtttcctgagattgcaaagatcctttcagaccttaagcttctcctcacagaaaacggacaactgactctcactgcttctctcatcaatgacttgttttcatggactcttcttgtgttagctctatctaatttctattatgcttctgggatatcttttttcataacgatcatgcttgtgttggtgtgttttgtggtacttcacccctttttcaagtggctattcaacaatgcgggtacccgggatcgtgagttccttgagtcacaagttatctttgtgttgcatatagttttggttattgggttgttaactgatgggttgggtatgcattccattattggggctttctttttgggtgttgtgatccctcaaggtgcgcttaacaacgcggtgcaggacaaggcacatgattttgtggcttcgttcatgatgcctttgttctttgtgactgttggagagagaattaggatccaagacttggccttggacactcattttacaactatggtggtggttgttttgttggcttttgtggcgaaaattgtgtgcactatggcggtttcttggttctgcctgatgccaaacatggaaggattatcccttgcactgatcatgaatactaaaggaataatgccattgatcgttctcagcatcggcagggacagacgcgaactggacaaccaaacctatggggtgatgctagtagcatgctggctaatgacaatcctagtgggaccagtctcattcgctttaacaaaagccttgaaaacaagaaacattctaggaggcaaccgcaggagcatgcaaaacacacaaccagactcaccccttagactactagcttgcatccacacaaagcgcgatgccaacgtgattattgacctattaaaagcctcgtgcccctcggtgagaaccccaattcaagtcctggcagtggaactaaacaaaatgaacacccgccccaccgcatcactcatcataagggatgccaaaaaaccatccttcacctcaaaatccccgaaactcgacaccgaagataccctcaacagcttcgacaacctcaaccaagccatcttcacggagaagatgagaataatctcagactacaactccatgcacaaagacatcttaaaccttgcaaggcgtagaggagtggcgcttatactaaccacactatacaagcaaccaacttacgacggtttgggagccggtgccgccaccgcaagagcagttaacataattaaccgcgaccaagcaagcaaagacgagaagaaagtggtgttggagaacctagttagggatgcaccatgctgtgtggcgatatttgtggatagggggttgagtggtcataataaggagcaacatgtggcgatgttctacatctctggtgcagatgaccgagaagcgctctcatacgcgtggagaatgagtagaaggcaggaggtgaagttaacggtggtgaggctggtttgggagaaccctaatgacgagttcgacgagaaggacaaggagttcataagggggtttgtggggcaagcgagggagatgggtagggttaggtatttggagaagaaggtgagggatgagaaggagacggtgaaggtgttggataagatagggaataaagggtttgattt

SEQ ID NO: 36594 - DNA, 348 bp, Glycine max
  Peptide Sequence Number=SeqID_153372
atgcttcactccatgctccagagcatccatagagggcaatccatcatcatgcagagccttcagggcttgggcttgccctccattatgagcatggaggagtttgatgcacaagtggcttggccaggagaccagccttcttcctctggagggggtggggcctccacagcccaggagcctgtgactgaggagccaccatcaccagcaccatcaccagcagcagcagaggaggagaccactccagctcagaccctacaaccatctccaccatttgcacctgctcctgaggagactcaaccattaccactggatcttaatgaaaaccagccacaggaggagcaggacgtttaa

SEQ ID NO: 36595 - DNA, 333 bp, Glycine max
  Peptide Sequence Number=SeqID_153373
atgtttgaacataaattgcaagaggatggggacaatgtggcatgccccattgcttcagaatacaacctaggcctaaggccttctcatccaaatcctcaacccaggaaaacaaggatcaaagcaaaccgaaactgcctcacaaatataagcatgttctcacaatttagagtaccaaaagatgaagaaaacacatcaatgggaagcaaaaacatcaaggatggaatacttacttgttggagtgaatggggttgctcgcccaggcgagctaacctgctacttttttttttttttgaggggaacattaaccatgtcccctccttcttcatgggttag

SEQ ID NO: 36596 - DNA, 747 bp, Glycine max
  Peptide Sequence Number=SeqID_153374
atggatatgaacctgggttatattatttcagctcaaatttctctgatcgcccaacatgactcttctaggctcgggtttctagccttaatcactgctctatgcaaggctaggggagtcatttctgattcattgatattggagagcctcggtccagcaattaatgtggcttatgtaaagagaaactactggaacctagataacctctcaattaccttcagagggccacgcaaggccaaggggaagaggtctgaggctcccccatcttctgagattcccctttcctcagctccagcaccaactccatctgccccatctgcatccacatctattcttctagtccctttatctgcaggaccatcagattttatatttacaccacagatgctacactccatgctcgagagcttccacagggggcatcccattatcatgcagagccttcagggcttgggcttgccatccatcatgagcatggaggagtttgatgcgcaagtggcctggccaggagcccagccttctccttctggagagggtagggcctttgcagcccaggagcctgctcctgaggagccaacagcagcagcaacagagggggagaatgagttcaccccttctgagcctttttattttgaagcaggtgtacacatggctcaggaggagacttctacagaccaaatcccagagccatccccagcacccatacctgatgatgccatagcatctgagttagagcagcctatctcttag

SEQ ID NO: 36597 - DNA, 288 bp, Glycine max
  Peptide Sequence Number=SeqID_153375
atggctccaaagaaacttgcaactaagagggctcgaaaaaccactgcaggagaaggatctagcacatctccacctgcagattttgttttctatggacacaaattttgcaaggagatcactagaagcaactggagacaacatgcagaaccaatgcccaaatatgaccctgaagttgtgttagaattctatgctaatgcttggcctactgaggaaggagttctttttaagcgttccaaagtttggggccaatggatcccttatgacagagatgtgagcaaccaattttag

SEQ ID NO: 36598 - DNA, 330 bp, Glycine max
  Peptide Sequence Number=SeqID_153376
atggcacttatcaatctctccatggaaaatggtcatcttagactcaagatacccactataagccatttctctttggcagagagggatctcaacatagcaaaattgactaataaaggtgaagcactctctgcctgtaagctcgctctggcaaagagggatcttgcacgagcgagagcttttagctcctatagagcttgtttgccttggattttcttcatcaatggagtcatttgcttcgtaaagtttgatggaagcagaatggagaaggagaaggatgattggagacgtcacttcaaggagaagatgagtctagaagaagctcactgttag

SEQ ID NO: 36599 - DNA, 285 bp, Glycine max
  Peptide Sequence Number=SeqID_153377
atggcagttcgcccaggcgagctaatgcttagtcctgaagaaattggcttgcccaggcgagttggttccttcagccctaagcaatttgggggcctaggtgagtcagaggctaggctaggcgagccaggggtagtgatcaaattgcctgagctagtgaaattacttcaacttgaaggaactaactcgcttggggagaagcacgaacaaggtgagagaagagagaaaaagtggagatggagctgcaaagatgtgaacgtggatcacatccttatgtacctcttttga

SEQ ID NO: 36600 - DNA, 870 bp, Glycine max
  Peptide Sequence Number=SeqID_153378
atgcaggttcagtctaaactgtgcctgctgagtgatttgggcttgtgtgcatctgtacttgtaaagattgtcaattgtaggccacggtttttccggtctcggattaatagttgcttagaagagaggatggcgcatcttacatcattgtttgagacgaaagaagtgcttcagaaggcaattgtgaggaacccttcgttgctgctatctgcgggtcgctataatgtgaaggcaacagttgagctctatgagaagttgggtgttaagaaagaggacttgattcagatgctccttttgcggcccacggttatttcgaggacttcctttgatgctgagaagctggaatatttaagcaagactgggcttactaaggattccaagatgtataaatatgtggtgacattaataggagtctctcgcgtggaaacgattcgggataaggtggcaaatttcgtgaaatttgggttttccgaagaggagatatttggtcttgtggggaagtctcctaatgtgttgacattgtcaacggaaaaggttcagaggaacatgactttcattttgggaacgatgaagcttgatgctaagatggttctaaagctgccgtatctcttatatgccaatgtggatactgttttgaagccaagagtgcttctagcattgaagatgcaagatatggatgcagagttgcaaatcatgggaccaacgatcgtaagctcactgaggatgccagagcagagatttttaaagttgtttatccaatgccatgacgaggatgttgcaaatcaattgatggaattctataaaaggacaaaagaggtgaagagattaggagagtcatcaaagaagtacagtaagagtggattccctttctga

SEQ ID NO: 36601 - DNA, 138 bp, Glycine max
  Peptide Sequence Number=SeqID_153379
atgtttgactcagttgggagaaaccgaagcatgagagtgagaccgttaatactagccgctaagaatgcagagactggtgctgctaaagaaacggagtttgacttggagattcagcaattgctacttgcaagtgagtaa

SEQ ID NO: 36602 - DNA, 1773 bp, Glycine max
  Peptide Sequence Number=SeqID_153380
atgggcatctgtttctctgccaccaaggtcagcggctctagcagcaacaacgccgccgcatccaaccgtaaccgcaaaggtctggccgcgccggccccggcgccgccagcgcagccggagctggagccggtgacggggaagcagaagaagcaaccgtcgcaggctaaacggcggcaagtgccggaggattcgcagaagaacccacgctccaaagacaaagcgggtgcgcgtcggcaagggacgcatgttccgtgcggaaagcgaacggatttcgggtacgagaaagacttcgagaatagattctcgctcgggaaattgttgggacatggacaattcggttacacctacgttggaatagacaaaacaaatggggatcgtgtcgccgttaagagactcgagaagagcaagatggttctccccatagcggttgaggatgttaagcgagaagtcaagatattgaaagaacttacaggccatgaaaatgtggttcagttccataatgcttttgatgatgaatcatacgtgtacatagttatggagctatgtgagggtggagaattgctagatcggatattggccaagaaggacagtcgttatactgaaaaagatgcagctgtggttgtaaggcaaatgcttaaggttgcggctgagtgtcatttacatgggttggtacaccgggacatgaaaccagagaattttcttttcaagtcaaccaaagaagattcacctttaaaggctaccgattttggtttgtctgattttataaaacctggaaagaggtttcaagatattgttggcagtgcttactatgttgcaccagaagtgttaaaacgaaagtcaggtcccgagtcagatgtatggagtattggtgtgattacatacatattgctttgtgggagacgcccattttgggataagacggaggatggtatcttcaaggaggtcttacggaacaagccggatttccggcggaaaccatggcctaccataagcaatgctgcaaaagattttgtgaagaaattgttggtaaaagatcctcgtgcaagatatactgctgctcaggctctatgtatgtatccaactcctgtgacctctaggccaataggcaacaaccctaccattgcaggaaaggcttgcccttttactggtgcaacacatccatgggttagagaaggaggagaggcattagagattcctattgatatatctgtcctgaacaacatgcgacagtttgtgaaatatagtcggttgaaacaatttgcactaagggcattggctagcacacttaatgaaggagagttgtctgatctaaaagatcagtttgatgcaattgatgtggacaaaaatggttctattagtcttgaggagatgagacaggctctcgctaaagatcaaccttggaagttgaaagaatcacgtgtgctggagatattgcaagcgatagacagcaacacagatgggctagtggatttcaccgagtttgtggcagctacattacatgtacatcaattggaggaacatgattctgacaagtggcagcagcggtcacaggctgcttttgagaaatttgacttggataaggatggctttattactccagatgaacttagaatgcatacgggtttgagaggctccattgatccattgcttgaggaagccgatatagataaagatggaaaaatcagcttaccagaatttcgtagacttctaagaactgcaagcatgggttctcgacccataatgagcccaagtcaccgccatcgaaagatttaa

SEQ ID NO: 36603 - DNA, 585 bp, Glycine max
  Peptide Sequence Number=SeqID_153381
atgtccaagttgagccaatctcttgatgaaaatggtagtggaagcaatattgatttggttggaggaagtttaactgatttgactttgaatgcatttgatattgataatttggttttgaatcacaatgttgaagatcacattttgaggaagagcttgaaagatgatggaaatgaagatgatggtagtggttgtgcctctaagcttccgtcttttgtccccttcaaccacccctctttcttcgacaccatctacgatgtcccctcccccctccctcctcccttcccccctttacccgtggtccaactctcccacgtgctgcaacgcggcttgtacctggaacacacacctaaacgccttgtcatctacccccttgtgagtcctaaccacatgcaccagcttgtatttggctcttgctctgtcagaacttttgttagagagaagaatcgcgaccccaccaacgcggaaaaggcaattgggtatgagcatggccttgttgttcccgaagtaccaattctaggctatgtacttggtactaacgacgacggcataggtgttggggtgaacctgaagcatgtcttttgcgag

SEQ ID NO: 36604 - DNA, 814 bp, Glycine max
  Peptide Sequence Number=SeqID_153382
atgtgctcttcagatagtttatatgtttgcagttattgtctagataagttccatacagaagatgatgggacacttatctggagatgtgaggactgtgctccaaattatcccaaaaaatgtgaatccaaagaattgagaaaaagcaagcgcataagtcatgctgctgaagccaaatataaaaggatgaaaatgaaaaaggagagtgttgcagttagaaaactgaaatctgttagatcatctgaaggttttcatgctgaatgccttaggagaaatgacattgaaaagagacagccgatccttgaagataaaaacatcctttataaggagcctgaatcacctaaaggtcctttaaatacttcatctgacaagcaagcattggagcatgagaaatatgaagccttgacaactccgcaccttaaatatcctgaatttgaccagcatagtcgtgctcacccacttagtgatccagtttggacgggacaatttatattgaacaaagcaacagattttggtctagttgcttatgcatcaagcaaagcttgctcaaaagtgctttcagccgtaacagtgcttcctacactgcttgatgtagagatattatcgaggtttgctatttggcccaagagtttcgacatgtttcctcctaatagtgacaatattggtctctattttttccccctgtatgaaagggatgagttgagctttgatcgtgtgctgaatgatataattgaacaagaatttgctctcaaggcagtcattaacaatgtggagctcctcattttttcttcacatctattacctccaaatgatagga

SEQ ID NO: 36605 - DNA, 608 bp, Glycine max
  Peptide Sequence Number=SeqID_153383
ccccgccgccgaaaaaagaggttcagctccagggcccgcggccgccgcctctcaaagtgagcaaagattcgcacaagatcaagaagccgccgccgcacccggcgcaccaccaccataaccacccccacgcgccgccggagcagaacctacaacagcgggaaccggtgataatctactccgtctcccccaaagtcatccacgtcacccccggcgacttcatggacgtggtccagcgcctcaccggagcttcctccggcgagtacccgccggcgggtcgcggcgatgtgtcgccggcggcaaggctggcctcgatcgagaaaacgagcccgtcggagagagaaagggttttgcactacaaagacgacgacatcgcgtggatgttggaggagggagtggaagtaggtcaatttccggggatactgacgccagagccgggaaccttgccgccgattccggcggaggtgttttctccgccaatttccggggaggacttttcgccgtcatattggtcggcgagcagcttcttggcgagtccgtcggggtttctttccgtcgccgtggcgtcgccgcagccgtcgccgaacctcttcagtctcttcgacttgtaa

SEQ ID NO: 36606 - DNA, 1927 bp, Glycine max
  Peptide Sequence Number=SeqID_153384
atgggtgatatagtgaaacaaatattggcgaagccgatccagctggcggaccaagtaaccaaagccgccgacgaagccagctccttcaagcaggaatgcggcgagctgaaggcgaagacggagaagctggcggcgctgctgcgtcaggcggctcgtgcgagttccgatctctacgagcgtcccacgcgccgcatcatcgacgaaacagaacacgtcctcgacaaggccctcgccttggccctcaagtgccgcggcaacgccctcatgaagcgcgtcttcaccctcaaccccggcgccgcgttccgcaaggtctccttgctcctcgagaactccatcggcgacgtctcctggctcctccgggtctccgccggagacggcggcggagactacatcggcgggctccctccgatagcgacgaacgagccgatcctctgcttcatctgggagcagatcgccgtcctccacacgggtaccttggaggaccgctccgacgccgccgcgcagctggtctccctggccagcaacagcgaccgctacgggaagctcataatcgaagaaggcggggtgggcccactcctgaagcttctgaaggaaggaaaagccgaagggcaggaacacgcggcacgtgccatcgggcttctggggcgtgatcccgagagcgttgataacatgattcacgtgggcgcgtgttccgtgttcgcgaagatcctgaaagaaagtcctatgaaagtgcaagctgtcgtggcctgggctgtgtcggaactcgctgccaattaccctaagtgtcaggaccttttcgcccagcacaacatcataaggttactcgtcggtcaccttgctttcgaaaccgtcgaggaacacagtaagtacactattgtcagcaccaaacccacttccatccacgccgtcgtcatcgccaacaacaacgtcaagaaggaagatcattttcacgacaatgaaaagaaagcacgaatgcctcatcccttgggtgataatagaccacgaaatctacatagagtaatcacaagtacaatcgcaatgcacgctgccaccaagcaaggaaacgaaccaaatcataatcatcagaccaatggcaatggagttgataatgatgccaagcaagggaatcagaatcaccagcgaaactattcacattcggggataaacatgaaaggaagggatcatgaggatcctcagactaaggctaacatgaaggaaatggcagcgagagctctctggcatttagccaaaggtaactcgccaatttgtcgtagcattactgaatcaagagccctgttgtgtttttctgttcttcttgaaaaaggaacagaggctgtgcagtacaattcagctatggcggtgatggagattacatcagtggcagagaaagatgccgaattaagaaaatccgcgttcaaacccaactctcctgcttgtaaagccgttgttgatcaagttgttaagataattgaaaaagcggattcggatcttttgattccgtgcatcaagacgattgggaatctggcgaggaccttcaaggcgacggagacgaggatgatagggccattggtgaagcttctcgacgaaagggaagcggaggtgtcaagggaagcatctattgcgctaacgaaattcgcgtgcacggagaactaccttcacgtggatcattccaaggccattataagtgccggtggagcgaagcacttgattcagctagtgtattttggagaagagatggttaagattcctgcgctggttttgctctcatacactgcaatgcacgtgccggatagcgaggaacttgctcaggctgaggtgctgggagtcattgattgggcatccaagcaatcttccattgccaacgacccagcaatcgaggcgttgttgttggagtccaagagcaggttggagctttaccagtctagag

SEQ ID NO: 36607 - DNA, 357 bp, Glycine max
  Peptide Sequence Number=SeqID_153385
atgagcgaaatagaggaggtgcaagagcagatgaaggcccacatggaggccatgaaagagcaaatggacacaatgatggaagccatgatgagtatgaaaagaatggtggaggtcaacacggctatagtcattgccgcaagtaccgccacagaggtggaccagactcacccgtctagaatcaatcaagcaagtcgtccagtcccggatatgaacaagcattacttcccaccatatggcttgcctcccaactatacaccacccgatgttgcacacgctcttgatgagaatgtcaataactccactctcatactcattgagagccaacaaccccaatttgatcatgcacatgtctcttaa

SEQ ID NO: 36608 - DNA, 1701 bp, Glycine max
  Peptide Sequence Number=SeqID_153386
atgtcaatgggaacttctcctcttgccgttgaagctagacaccgtttgcctgcatccatgtggatatggggtggttcagatcctcgttacatgtccaatgtagccactgactgggatgacatactgaaaattacggagaaactgacaggggaagatgaacttgaaggaattgggctagtaaatttcaacaagactgaactagcacaatgggagcatcttattcctgatgcaacacatgttgttctgcctctggagtatgctgcaagaaatgtgacgtgggagtccttgtacccggaatggatcgacgaggaagaagaaaccgaagttcctgtttgtccttctcttccaagtctaagatcccctggcataagacttaacctcatttctgtgaagcttccttgtaggaatggagggaactggtctagagacgttgctcgtttgcaccttcagcttgcagctgctgcacttgcaacctctttcaaaggcaactaccccgtttatgtgctcttcattaccaactgctttccaataccaaatttgttctcatgtaaagaactagttgcacgtgaagggaatgtgtggctatacaaaccaaacttgagtgtcttgagagaaaaggtccagcttcctgtagggtcttgtgaacttgcacttcctatgagaggcaaagaactggtatacaatggaaatgctcccagagaagcctatgcaacaattctgcattcggctcatgtctatgtttgtggggctatagctgctgcgcaaagcatccgcatgtctggatcaactcgagaccttgtaatacttgttgatgagacaatcagcagctatcacagaagtggtttggaagcagcaggttggaaggttagaacaatacaaaggatcagaaaccccaaagctgaaaaagatgcttacaatgaatggaactacagcaagttcaggctatggcagctgacagattatgacaagataatattcattgatgcagatttgctcatactaagaaacatcgatttcctatttggaatgccagaaatcactgccactggaaacaatgccactctctttaactcgggtgtcatggtggttgagccatcaaattgcacattccagctcctgatggatcatatcaatgagattgagtcctacaatggaggagaccagggatatttgaacgaaatatttacgtggtggcacaggataccaagacacatgaacttcttgaagcatttttggattggcgatgaggaagagaagaaacaaatgaaaactctgttgtttggtgcagaacctccaattttgtatgtccttcactatctaggtgtgaagccatggttatgcttccgggactatgattgcaactggaatgatgatatctttcatgaatttgcaagtgatgttgcacatgcaaagtggtggaaggtgcatgatgcaatgcctgagcttttgcagcagttttgcctgttgaagtcaaagcagaaggcacagttggagtgggatcgtaagcaggctgaaatagcaaactacacggatgggcattggcgaattaaagttaaagataggcgcttgaagaaatgtatagataatttgtgcaactggaaaagcatgttgcggcactggggagagacaaattggacagatgatgagttttatactccaacaccacctacagttatcacagcatctctttctgctttatga

SEQ ID NO: 36609 - DNA, 2511 bp, Glycine max
  Peptide Sequence Number=SeqID_153387
atgagtggaagtggcaaaaagcgctcttcaaagtgggatttgagagacgatcctgatttttcacctgatgatagtcagcaattgcggtctgggtggtcctctgcaggtgataaattaaagcctggtatgggattttcatccaaggaacctttttctggaggcagaggttcaaataaggacgatattatgaataaagactatagagttttggatgcaacaatggaatgggatgaggatggaagttacaacaatgaaatgtctcctgggttggagggatggaaacataataagagacatagtcaatcccccaaaaatggttggagcaggtcagtcaggagtagtcgaagcaggagccctcctcatggttttaggtgggattcaggagtcaatgacagaaatagaatgcgggctggaggatcgacacaaccatgtagagattttgctgctggtaaatgcagaagaggcagccactgccattttcttcatgataatcaaaatcatgaggatagttgggaagataagtacagggaagatggagctcccagatattctgctccccacgagggtagagactattctcttaagagtggtagatctaatgaagcctgtattaattttccaaaaggaaggtgtagaatgggagcatcatgcaagtttgtgcatcataacaattctgatggacacagtaaagtttctgtggatgaattagctagagagagggaaattgatagaaggcacagagacagttcttttgagcagggtggagggcatgggccaaaccgtagtggtgatactctttgcaaattttttgctaatggacattgtcgtaatggtaaatattgtaggttttctcatgataggcaagcatgtagaagccctaatagaagatcaagagatgataggtgggcaagcaatcctggaggagattatcatatgctggatagaccgaaattgagtgattcagttagtcctaatagaaggccaagggatgataggtggggttcagatggtaacagggctgatgcagataaagtttgggacagtccaaagcggaatgatacagttgctgtctctgatacagcaaagctggttgaggacaaaagtgaaaatgtggttgccgcagagcaaggattcacccctttggctacgagggatggatggggtcatagtttggataagagcagagtgcatggtgaacaaccattttctagtgataagaaggaagctgacagttggataacaggaaataatgctgccaacatgcatggttcccagtcaataggtacagacatttggttgggtgatgatgcaaaaatgtctccagattgggattacagggtgagatcttccagctgtattgaagaaaagcatgaacagaataagcatgggataacgcagggttttatgtatttagacacctctgaacatgacagaatacaaattgctccaggacaaggttttaatcagaatgcagtgagttttaattctttgcattcttcaagctgccaagcagttggacaaagtcaagtagcagttcccattctaccttcaaagggtggaattgttgatggtatgctgaaacaggaagtctccactgagaaaaagtacactgctgaaccaaatatcatggatgctggcttatcacaagttagttcaagaaatcctcctccaaccgcgaacgtggtaggcaaagaacagcttgctcagcttaccaatctctcagcctcgctggctcatatcctcgggacagggcaacagctgccacaactttatgctgctttaaattctcatgatgcaaaggacatatcctccctagcaaaaactgaggtgcctgctatgcctgtttccaacacattcatcaggccagatcctactgttggactcctgaagcaatatgatccaatgtgtgacagtgttgagccaaagggtgctgttgcaagtggggtacccccagccattcctccaagtcaaaaagttgcagatgtagtggaaattccgtcacagtccaacacaggaagacaaaattgtggtgattcttccaaggctgctggctcagaagaacttgtcaagagtgatcctctaatccagttgcagccaggtcaaaacactggggttaataaggataataacaaggaaatgttacctgaggaaactctaaaatctaaagatgatcctaaaagtaccaaagagagtggtccttttgaaaacatggagcaaactgatggtcctgatgaggcaaagaaaataaagggtatgaaggggaatcgtgcatttaaatttgcattggttgagtttgttaaggagcttctaaaaccaacatggaaagatggtcaaatcaccaaagaagattataaaacaattgtgaagaaagttgttgataaagtaactggttccatgcagggggtcaatattcctcagacacaggagaaaattgatcactatttgtcattttcaaaaccaaagcttaacaaacttgtacaggcgtatgtggaaaaggttcagaaggcttag

SEQ ID NO: 36610 - DNA, 357 bp, Glycine max
  Peptide Sequence Number=SeqID_153388
atgggaaaggatgtgccaccttatgtattaagtttcactagatacacttgtgcccaatttacatcaagaacaagcatcgaagagaatcaatgcaatactcattgtagatttgatctactttttgggtggccaattgttgagtgttttcttgaaaaatttatgagatgcgttgaatcctataaatgttatgatgaagagtctatcttatttgaggcttgcaggccggtggcattgttaaaaggaagacctgatagtataagcaaacagtatcaagccttactaggtgtttggcacatcaaagtgacaggaatgcatgcatccccaaattccccgactggcagttacaatgttctttaa

SEQ ID NO: 36611 - DNA, 732 bp, Glycine max
  Peptide Sequence Number=SeqID_153389
atggatatcaacgaaagcatcacttctacattcagcaatgttgttaacagcacttggaatcacgagaagatgggaacagaagaacataacatcatcctccatgatcatcaccaaattccaaagggtgttggaatttggccccactacaactaccctcttcacaatattcaaccctcatcctcatcaaatgtggcaccctcttcgagtaatttcctcactgatattctaggagtccactttgaagaagaagaagatgaagaagaagaagagctaggagccatgaaggagatgatgtacaaaatggcagtgatgcaaccggtggacatagaccctgcaagcgtgagaaaaccaaagaggagaaacgtgcgcataagcgatgaccctcagagtgttgctgcgagacacagaagagagaggatcagcgagaaaattcgcatactgcaaagactggtccctggtggaacaaaaatggacactgcttccatgctcgatgaagccattcgctatgttaagttcttgaagaggcaaatcaggtttcttcaatcaacaccaccaccaccaattaattgcaatgttggtgctgctcctaatagtgaatattattggccttttgcaccaaatatgttgcatagttccaccaccacctttattgacatgccggttattggaatggaattcaacaccagaagccatggtcatgccggtgattcgatccaccttagacaatcatga

SEQ ID NO: 36612 - DNA, 345 bp, Glycine max
  Peptide Sequence Number=SeqID_153390
atggatgaaaagagggtcaaagactctttagatttagagatagtagaagactctatggatgttgagagagttgaagactctttcgatttaaaagactttgtggatgttaagagagttgaagactctttagatttaaagagagttgaagactccatagatgcggagagggttgaaaattctttagatttagagagagttgatgactctttagatttaaatatagttgaagacatggatgctgaaagagttaaagactctttaaatttagaaagagttaaagattctttggatgaaattgctaatgctctatattgttctacaattttgtttatttcaaacttctaa

SEQ ID NO: 36613 - DNA, 915 bp, Glycine max
  Peptide Sequence Number=SeqID_153391
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcacccacaggaaggagcctgggctttggagttacgcagggtcatggggggggccaccatctgacctgccagtgctgttgggatcctcaagacatagtactgagagggagagtcctgactcctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 36614 - DNA, 342 bp, Glycine max
  Peptide Sequence Number=SeqID_153392
atggtacaactcatcattggcatgcctcatgttcctactttggcatcagaagaaagggttgagctcacaaaaccaatatctttagtctacattacagataacattttcgatatttatgggaatctggatgaattaattcttttcacagcagctgttagcaggaaaggacaagtctccctaaccgcacccccttctgtgtgtgtgaaagtgaagcaacgcaacacagtcgtgttctacttcaaagtgcgaccccaagccgatgacttcaccatcttcaagggccttgacaagtacaagaacgaggaactcatcaaatacggttttctcgaagacatctggtaa

SEQ ID NO: 36615 - DNA, 255 bp, Glycine max
  Peptide Sequence Number=SeqID_153393
atgggtaatgaatttccttcaagtgatgggtcaaagttgtgcgttgcttataaggcagttgaatcttggttagtggataaagttgttctacccatccaaagttcagttggttggagcatccaccgtaattatgatttacttcttggacacaagctacacataattggggaggtgcagttgctaattaaccactacctcttaggattgcctggtgtgaggaaaaaggatctcagagctgtaatgagccacccttag

SEQ ID NO: 36616 - DNA, 267 bp, Glycine max
  Peptide Sequence Number=SeqID_153394
atggtgtcaggagctatgcaaaacttgttagacctcaaagttgtgccagagggtaagagtcatcatcaactcatacaacaagctttgcaagtattgcaagagggtttaacaactaggtgcaactcaggcacacaaagacctttggatcgcttgatacaagctacaaagttttggacgacgccacttcctgatagggaagataagtcaggtagatgccacaagaattaccttgataagtccgagattggttcagcgaggaacccatag

SEQ ID NO: 36617 - DNA, 273 bp, Glycine max
  Peptide Sequence Number=SeqID_153395
atggaagacgcacctgtgagccctcgcgtcgccctcccgccgaagggaatttttccttggcttacaaatgaagcaaacaagcaacggatatacattcaccaaaccaagtatgtgaaagaacttctaaagaagttcaacatggataatgctaaggaaatgaaaacaccaatgcatctaaccacatatcttacactgaatgaggaactaaagaaggtggacaacactcaatacaaagcaatgattggatcattatgtgaatgtatgtatacatga

SEQ ID NO: 36618 - DNA, 726 bp, Glycine max
  Peptide Sequence Number=SeqID_153396
atgattcatgtaatcctttggcatcatcaaaacattcagcttgatcctttgtctacactcatttatctgatgaacacacgcccaaacatagctcatgctgttcaacaacttagtcaatacatggcaaacccaaccactgctcattctcaagcttctttttgtgttctgcgttatctcaaaggcactcctagcttcggtatactctttgcagctcatggaactcctcaactcaaagccttcagtgactcagattgggcaggatgtcgtgattccagatgttccatcacgagattttcggtctatcttggcacctctcttatctcctggcagtcgaagaaacaatccatagtttctcgcagctcttccgaggcagaatatcgcgctttagcatcaactatgtgtgaacttcaatggctcacatatctcattcatgattttcgcgttccattcatccaacctgcaaccctttattgcgacaatcagtctacaatccagatagcatccaaccctgtcttccacgaacgaactaaacacattgaaattgattgccatattgttcgggacaaagtaaatagctatatcatcaagctccttcctgtttcgtcttccatgcagctcgctgacattttcaccaaacctctatctccaaccatcttccaaggtctttgctccaagctgggaatgatgaacatccattcccagcttgcggggggctctcaacagtaa

SEQ ID NO: 36619 - DNA, 129 bp, Glycine max
  Peptide Sequence Number=SeqID_153397
atggaagcccccagtttaggaaagacaatgttgtttacttgtgaggagatggggattgacgagatcaaaactaagtggagagcttttcaagtcccttttaccgttttccctttactatttttgagttag

SEQ ID NO: 36620 - DNA, 162 bp, Glycine max
  Peptide Sequence Number=SeqID_153398
atgaaaaacactaagcgaggtaacattgtagaatgtctttacacttacgatggtggttttccacccgtctttgaatgtgacacatctaagatggttatgacgccaaaatcatctttgaatgatgccaattttaagatgattttggcgctgaaactgtcttaa

SEQ ID NO: 36621 - DNA, 288 bp, Glycine max
  Peptide Sequence Number=SeqID_153399
atggaaggtctatggtctaagagaaggcaaaaagaaaagaagcaggggcaaaaccaacgcgaaggcagtcatagaacagaaggtgaacaagggaggaagagtacactatatgttgaaaaaaaggagtggttgtaccagagcttggttggcactttgaaggatctgtctaattttgacaagctacaaaacatttgtgttcatgggggaggagaggtaattaaactcaactacctggagatgacagggttctttttagaggattggatttggagaaggcacaacagctaa

SEQ ID NO: 36622 - DNA, 325 bp, Glycine max
  Peptide Sequence Number=SeqID_153400
atgttggaaagttttaaacaacaagaccaaatgtcagttctggaattgtacattgaaaaggatgtggctggtggttcaatgtttcattctgcaaattcgcttacatcatgtggaaattatttatctaatgatgagacacaactgccaacaaatatgagcaatttacatattgacgaagttgatgatgatgatgatgattatcttatgtctaactcatacgttgaagagtctttagacgaagatgacagtgttgacggtatatttgatacagacaatgaagtcaccgacattcctcaaccagtaagaattgtttacccagcagaag

SEQ ID NO: 36623 - DNA, 492 bp, Glycine max
  Peptide Sequence Number=SeqID_153401
atgaattccctcagttataccagatttctcaacagaaatcttgctcgtttgctgatatgggggtttggggggaggatggttagaggtggaattggcaatggagacgttgggtcatttgtttgggaagatttgcgtttgactcgtttggtgaacatggatcatgaagagttggaggtgtttataaaaaatgtttatatattatcactctataactggtgcggttttcgggtggttcaacattacatgcagcagcatggagggatgtcttgggaaagaagttcagacggatttggtatcttatttggcatgctacgtgtttgtgcttctggtaaagttttcgaacaaccacttcggtttcctcgggagctacttgacggtttggcaaagcttagttgtgaagctcaccttttttgtcaagacattcacatgaagacagttttcgaacaacaaccacctcagttcaatgaatttgttacatcggttttggaatag

SEQ ID NO: 36624 - DNA, 846 bp, Glycine max
  Peptide Sequence Number=SeqID_153402
atggaggggaaggagcaggatgtgtcgctgggagcgaacaagttcccggagagacagccgattgggacggcggcgcagagccaagacgacggcaaggactaccaggagccggcgccggcgccactggttgacccgacggagtttacgtcatggtccttttacagagcagggatagcagagtttgtggccacttttctgtttctatacatcactgtcttaaccgtcatgggagtcgccggggctaagtctaagtgcagtaccgttgggattcaaggaatcgcttgggccttcggtggcatgatcttcgccctcgtttactgcaccgctggcatctcagggggacacataaacccggcggtgacatttgggctgtttttggcgaggaagttgtcgttgcccagggcgattttctacattgtaatgcaatgcttgggtgctatttgtggcgctggcgtggtgaagggtttcgaggggaaaacaaaatacggtacgttgaatggtggtgccaactttgttgcccctggttacaccaagggtgatggtcttggtgctgagattgttggcactttcgtccttgtttacaccgttttctccgccaccgatgccaaacgtaacgccagagactctcacgtccccattttggcacctttgcctattgggttcgcggtgttcttggttcacttggcaaccatccctatcaccggcactggtatcaaccctgctcgtagtcttggtgctgctatcatcttcaacaaggaccttggttgggatgatcacatttttcgggaaaacgaatctggtccgtctgattctgatgcttattgtttgtcgttttctgtgcagtga

SEQ ID NO: 36625 - DNA, 1449 bp, Glycine max
  Peptide Sequence Number=SeqID_153403
atggcttcaagggtctctcccagtctcaaatgttggcagttcagaaccccttattattgtgattcatggaagacacctcgtgcagttccttcttcaatacttaggcatgtgactgagaggaacaatgttatgccaccatgtgggttgttggtccatagatcaaggaagaatttgagggtgcaaagaggaaaacgtgtttactcttcgctttttgatgactttcgccaagaggaaaggatgaatcttgttcaggatggttgttgggatgaaaatggcaatgaaatagcttgtgccgtctctgataatgaattcgaaaatgactcctcagccaaaggttgttcctctgaggagtttgggacaatgaagcctgaagttttggagccttctcttttgggaatccagcctgagccaccaagctggccagagagagatgagattttgagacttacctttgagaggaaagtgaacagtgtgggaattcccttgtccattaggatgatcaagaagaagctacaattggaagagggtctcaaagaggctggtgagttgaatgaattaaccaactgttctgtgaacaagaccttctcctctatgatgtttataatgcatgagcttcaaagtcgtgccttgcaaacaagggagagtttatttggtgaagacttgcaaagtgtcatgaccaagctagagagagaaatggatgcttcatttgtttggctcttccagcaggttttctggaagaccccagctctcatggtctttgtgatggtcctcttagctaactttttagtgttctctatgaatgacaacactgtcaaggcaatcactccttcttccatgatcacaaaggctctaaccttgaccggcaatgagagtaaagtacgacattctcaagttgatactgatgttgatcaaggagagtatgtgaataaggagttgaacgaagaggaggaaatgttgtggaactcttttctagaggaggcttcaatgttgcaaaaggaattgagtggtgaggttttggaccacgagacaaggcaaaggttagttgccccagtgtctgtggagcttgaaggggatcagtacgaggaatatgtcaaaactgagctttattacaaaaagcatttgctccggacacctcattgttcccttctgctgtctaactatgcacagtttctcttccttgtccttcatgatattgatggggcagaagagtactacaagcgatcagtgctagcggaatcaccggaagctgaggcattcagtcgctatgccgacttcttgttgatggtaagaaaggatgtttgggcagcagaactgagatatctgcaagcattggaagcagatcctggcaacacttattatttatcaaagtacgccagtttcctttggaacaccggtggacaagatgctaatagctttcctatagaagaattggacaacttgcagctatga

SEQ ID NO: 36626 - DNA, 180 bp, Glycine max
  Peptide Sequence Number=SeqID_153404
atgacagctatagctgaaagtaaaatattcgagattggatcgactggaatcagtagtttgggaggtcacagtgaaagaagaacagaatgcgtcaacagatttgctgccgtgtatgggcggatgcccttggtatctacttcagttaaggctgttgatagccgcaatatctggttttggtga

SEQ ID NO: 36627 - DNA, 339 bp, Glycine max
  Peptide Sequence Number=SeqID_153405
atgatagctaataaacatttggacctggaatcggggaagcgaggaggtggaggcggcgtttggttgttgatccataggacgaaggaagaagcgcttgtggaaaacgcgagaagcgtgaaggcgacgcagcaacagaggagaagcttgatcttgagtgatttaacggtggagatcgcgagtaggcggaagcgctgctctgtccgacggttccaccagcagctccctctcatgaccgccgcaatgcgtgtctccgagggttcagcgggcagccatcccgagccgaacgagaatcttaatgataatggctttgtttctttgacgtgtgaaagtgaaagttag

SEQ ID NO: 36628 - DNA, 350 bp, Glycine max
  Peptide Sequence Number=SeqID_153406
atggctgggctcaaccctgaaatgaagcaactcagcacaaacgcttgcacaacaaacccgtgggatcctcatatgttgacgaagcaaaatgggaatgtaacgaatggagaaacgctgaccacgaggagagctgcgcattgcgtggtactcaaagaattgcgtgatcttgaaggtccaaccagttggatcagaaccatcaaaccttgggacgtcgagcttcatacgatgcactggattgtgcgatgggcggcgtctgtcctgtcgatgaagatggtggcgtttgcggtggttgctggttcacttcgagttgcgacatacgatgaaggagatcatcaatcttcgaattcatg

SEQ ID NO: 36629 - DNA, 171 bp, Glycine max
  Peptide Sequence Number=SeqID_153407
atgaggaagcttgcagggaagaggagtgtgtttttcctcgatttggatgacgaaatgcaagttggaattcatcaagttgaagaagatgctatggatggaggagctgctagtatatcaacttggaatcaaaagcggaagcgcttgggggattcaaagcccaacattccctag

SEQ ID NO: 36630 - DNA, 420 bp, Glycine max
  Peptide Sequence Number=SeqID_153408
atgatacaaggtcatgacacaagggaaactagtggaaaatcattcggtgtagttttgaaaggacaacacgggtacagcttgaaaagggacaaaagagaaatcaatttccttggtttggaggatatccctaatggtgactggttttgtccatcatgtcgttgcaggatttgcggccaaaggaaaattaatggagatgagagcttggcttccgaggcccaagtaacctccctagagagaatagacgaaagcgagaatagaggaaatgcttattcttcttccttcttattcacagaggcttttcatacatttatagttgctactccacagctccttatcgctattcgtatcattcccgcgggcttcaaacgccactttgtcctcaaggtgacgaaggaaagggccgcattaccgtttgcctaa

SEQ ID NO: 36631 - DNA, 1599 bp, Glycine max
  Peptide Sequence Number=SeqID_153409
atgacgatgaagcaccaaaccaaacccagcaacaacaagaagaagaagaacgcattgattcatgtgctcaaagcgtgtgcccagttatcgcgcttcggaagtggaaggggtgttcacaaagacgttgttgtgttcggggaagagtccaatttgcaagttcgtaactctgtgttggatatgtattcaaaatgtggggatgttgggagcgcacgccaagtgtttgatgaaatgtctgagagagatgttttttcgtggaattcgatgatgtcgggttatgtgtggaatgggttgccgcataaggctgtggaggtgttgggggttatgaagaaagatgggtgtggttgtgaaccggatgttgtcacgtggaacacggtcatggatgcttattgtaggatgggacaatgctgtgaggcgtcaagggtttttggagagattgaggatccgaatgtgatttcgtggacgattttgatctcgggttatgctggtgttgggaggcatgatgtttctttggggatttttaggcagatggtgaatgttgggatggtttcaccggatgtggatgctctttctggtgtgcttgtgtcgtgcaggcatttgggggctttggctagtggaaaggagattcatggatatggcctcaaaatcatgtgtggggatgtgttttataggtctgctggagctgccttgttgatgttgtatgccggttggggcagacttgattgtgctgataacgtgttttggaggatggataagagtgatgttgttacatggaatgctatgatttttggtttggttgacgtggggttggtagatttggcgcttgattgtttcagagaaatgcagggaagaggagtggggattgatggtagaactatatctagtatactgcctgtttgtgatttgagatgtggaaaagagatacatgcttatgttaggaaatgcaatttcagtggtgtgattccggtttataatgcgcttattcatatgtactcgatccgtggatgtattgcatatgcatattctgtgttttccaccatggttgcgagggacttggtttcttggaacacgattattggaggatttggaacacacgggcttggccaaacagctctggagcttttgcaggagatgagtggttcaggtgttagacctgatttggtgactttttcttgtgcactttcggcttgtagtcattcaggacttgtgaatgaagggattgaacttttctacagaatgacgaaggattttagcatgacaccagcaagggaacacttttcttgtgttgttgacatgttggcccgtgctggtaggcttgaagatgcttttcatttcattaaccaaatgccccaggaaccaaataatcatgtttggggagctttacttgctgcatgccaagagcatcaaaatattagtgttggaaagctggctgcagaaaaattgatcagtttggaaccacatgaagctggtcactatgtgacactgtcaaatatatactcaagagctggaagatgggatgatgctgcaagagtaaggaagatgatggatggccatggattgctgaagccatcaggacatagtttggtcggtactggaagttag

SEQ ID NO: 36632 - DNA, 333 bp, Glycine max
  Peptide Sequence Number=SeqID_153410
atggcaaggcatatggagtggagtaatttaccttttgagttcaaaggatattctgattattctcctatcatacaaaattatatgcacttgttgttccctccactcaaccttgatgtcttaaaaacattctcccttattggtttcaactattgccaaaggtctcaaggggtgaggtattgtgatgtagctggagaatctgttgttgtagttgctacaacagtgtattccactgctgctatttcccaagctcatgcgcaattaggggtggagtggcttgttttgcctgttgttcccagtgtgctagaaacatggactctgctttgcaaagactaa

SEQ ID NO: 36633 - DNA, 423 bp, Glycine max
  Peptide Sequence Number=SeqID_153411
atgcatgaatgttttgagcccttaaaggtatcatgcacaagcagagatctcatggaagatgtgatattcagcaaatggttagaaattgttatccttcaagatgtggtcaaagctaaaccgattgaatttctagggtttctatatgtgctacttgagagaaatgcagaactgattagtgtggcaactgataggaagaaggttgctgaagtacctcttattggtactggattacaatattgccgacatggaatgtgtcgcattttaataaaagagcttgaaaatggagaccagtcagggtcatgctgttttgcgagaatgctccagcgatgtgagatcgacacagacttaaagaaacactcaaaccgggtgacccccaaggcctacactcagaagggtccatcggggcttctccctcctgattag

SEQ ID NO: 36634 - DNA, 366 bp, Glycine max
  Peptide Sequence Number=SeqID_153412
atgcctcaagggtccaaaattcaacttgtgtttcattgtttattgttgaaacttcaccaaggtcaccaaggtcctttacctgtgcccccaacctctttcccccctctcgccactaacaaccatcctttggtcgcaccattatccatactggactccaagatgaatgattccactaaacctcgtactaaacttgtttcggtacaatggcttggtctttctcctgaggacactagctgggaagaatgggacgacacttatcaccttgaggataagatgtctttcccaacagagggtgattatagcaatgtgacccataatactagacccatgagaaccacgcccaccaccttcaaggactacgtatga

SEQ ID NO: 36635 - DNA, 168 bp, Glycine max
  Peptide Sequence Number=SeqID_153413
atgactgtcgtcatcgttgttgtcaccaccactggtgacagcgatgacgacaatcatgtggtggtggcgccgacaattataatggtggctgcaacattagttatgctggtggtgattgataatggtggtgctagcggcaattatggtgatggttgtagtggtggttaa

SEQ ID NO: 36636 - DNA, 273 bp, Glycine max
  Peptide Sequence Number=SeqID_153414
atgtattggcacgagagctacgaatgcgatgcattgacaaaagtcaagaggatagaagagagaatatacactgtgatatattgggtgaagaggttcaagaacttggagaaattagcgagtggtaactatccgacatttggtgcactcatttggcacggttcgaagcttggggattggtgtacgttgtatccgtatgtggcgatcactcccgactattatccacataaatgtataagaccatcaagactcggaaagattggtggcataggttag

SEQ ID NO: 36637 - DNA, 507 bp, Glycine max
  Peptide Sequence Number=SeqID_153415
atgactgttgctaccaccgttacaaccatcaccatgatcatcgccatcatgacaaccagcattgtttcctccaccattgtcagtggtgatggctatggcaacaatgacagtcatggcaacaacaatggtgatgtggtgacgacggtcatggcaacgacaatggtgataacaacaatcatgatggtggtggtggtgaaattattacatctaaaggaaggtgatagttgtacatacataactcaaccaaaacgtgctagctctccgcgccgccatcggaaactggtggagactgagcctcctggcgaagagtccactgatgatctgcccctacggtctggaaaaggacatgacaaaggcgtttgggatcaccttcggagaaccgtggtggaggaaggtggcagacatggaaaggatatcgaagtggtcatggaaagtgacagtggcgccggcaagagtgaaagaaggttgatggagagtgacgttggcgacaatttcaaaatcgattaa

SEQ ID NO: 36638 - DNA, 255 bp, Glycine max
  Peptide Sequence Number=SeqID_153416
atgaccatatttgcctctgtgtgtcaatcgatagtcattgagtcctctaaaggcgaggacttagagtccaatgaaggtgaggactttgagtcctttgaaggtgaggacgttgagtcctccaaaggtgacgactttgagtcctctgaaggtgaggatgttgagttctctaaaggcgaggactttgagtcctctgaaggcttggactttgagtcctatgaatgcgaggactatgagtcctctgaaagatgccaatag

SEQ ID NO: 36639 - DNA, 177 bp, Glycine max
  Peptide Sequence Number=SeqID_153417
aggaacttagatcaattggaagacttactcaacaaggttaaattgaagaccataaggactgaaccaccttctgcatctattgctggcacaagttggtgtatctttggtgtttctgtagattctgtagttgctgcgttacaatttgtggctccctctgcaaagggattctttttgtaa

SEQ ID NO: 36640 - DNA, 401 bp, Glycine max
  Peptide Sequence Number=SeqID_153418
ggtacatctacttgggtttgactaagaacaagagagggtacatctcttgtggatcagttctagtagagggtacatccactaggttcaaagagaacaagggagggtacatcccttgtggatatttgcttgtaaaaggatttttacaagacccgtatgcacatctagccacttatattgagatttgcaacactgtcagactggctggtaatagtcttaagacttgggatgaagtggttgaaaaattcttgaagaaatacttcccagagtccaagactgctgaaggaaaagctgctatctcatcctttcatcaatttgtagacgagtccttgagtgaggctttggaaagatttcatgggttgctaagaaagacgcctaatcatggattttcagaactgatctag

SEQ ID NO: 36641 - DNA, 246 bp, Glycine max
  Peptide Sequence Number=SeqID_153419
atgtttctggtgctctctaaagctcctcctccggttgctctgttaggattcccaaacgttagagaaaaagagaagagactgaagcctctattccatggtcctacgtgtgatgcatctttgttcttccgcagacattattttgcaaatcccaatggtttggtggtatgtggaaaaagagagggttttgggaagatgagaggggaaaacgaaattgagaggaagaggaggcgtagaagatatcgttag

SEQ ID NO: 36642 - DNA, 189 bp, Glycine max
  Peptide Sequence Number=SeqID_153420
atgaatgaaagaataacctgtggagcgaatgagggaaagaagataaggagtgagccgacaaagagaatgtttgatacaagaacggtttcgaagttcggtcccttgccgtcaacgaccactatgggcgctagattgggttgtttctcttcgttttggatcacaaatctagttgtttggttcttctcttag

SEQ ID NO: 36643 - DNA, 180 bp, Glycine max
  Peptide Sequence Number=SeqID_153421
atgacaaaggggaagtatgtgggagaagacatcaaggaggttcctaggaagaatcagaaactagtaatagatctcttgtatttactatttggacaagtaacccagtttgaatcactaaatcctttgagtgtcagggatgaaatggaggagaaaaataaccttgtcatagactgcctttga

SEQ ID NO: 36644 - DNA, 279 bp, Glycine max
  Peptide Sequence Number=SeqID_153422
atggataaatttttcaataggcttcatattgcttattgttggaagctatctggtgaaaatgcgtctactgcatatgtgacttatcgggatgcttatgccctggaaactgcattattgctaaatgagatgtgtctgactgacacaatgacaatgtgttcaatgcaaatcaagaacacacacatacaaagttgttcatttcaccccccctatcctctcctccctgaaacagagttggtggatgtcatcttggccgatggtgacgacaacaatggtggatag

SEQ ID NO: 36645 - DNA, 1395 bp, Glycine max
  Peptide Sequence Number=SeqID_153423
atgggttgtgcaagttcaaagcaaaagaaatgtcggcgatgcaatgctccttattctcctgctcctagaagctattcaatgcacgttcatcacccacctctagcagaaggtgatagctaccatgttgtggcactcacttccacaacattgggcactctcaaactcaattcccctgctccaactcaaaattttgcaaattgtgaccatgatttcaagctttccaatggcaaggttggaaacgctgaaagtttcaggtttgatagtgagagctttgtgcaaaggcttgaggagaaggagaaggagaagaagagtgaggtattggagaaagataagaaagaagagttctcaatggggctaattgaggccaagacttggtctaacatgattgagcaaaagttgccaaaagtttttcccaagaccccaattagaacaccacctggtgagcctgagacaatcaacacatgggaactcatggaaggccttgaagacaccaccacgcctttccggtcgccgagccacttccggagtttctcttttgatttcaatggtggtgatgatgttggtgttggtgatggtggtgttgatgttgatgttgatgttgatccacccaagatgagtgttgttgcttctccaaaacccatgtggcttctcatgaccgaggaggagtcaagactcaaccctgaaatctcagattttgatcctgaagtgatttcctcattcagaaagtccttgcaacagctctctccggatagccccttccaccttcaaccggcgccgccgggcgatgaagaagacaagcatgggactaaaaaggggtccccatttgaggaaaatgaatttgttgtggatgatgtcaaggttgatgatccatgtgggaaggacaaggtggtgttgtatttcactagcttacgcggcgtgcgaaagacttacgaggcttgctgccaagtgaggatgattctgaagggattgggagtaagagtggatgagagggatgtgtcaatgcattcagggttcaaggaagagcttaaagagctattgggtgatggctatggtagtttaggattgccaagagtgtttcttggggggaattacattggtggagctgaggaaattcagaggctgcatgaggatgggaagcttgagaagcttttggtttgttgtgagaagattgaggacagtgttggaggtgatggaggagggggagtgtgtgaggcttgtggggatataaggtttgttccttgtgaaacatgttgtggaagctgtaaaatttactatacaggtgatgaagaagatgaagaagaatatgttgatggtgaagtgggggagtgtggattccagcgttgccctgattgcaatgaaaatggactaattcgttgccccatgtgttgctgttag

SEQ ID NO: 36646 - DNA, 1744 bp, Glycine max
  Peptide Sequence Number=SeqID_153424
atggctctaactctaatcatccttctccacagcgttgtttcacaaaccttgagttcagagagtgataaggtggctttacttgctttgaagcagaagcttaccaatggagagcctaatgctcttccatcatggaacgagtctctgcatttaacgctcgttcttttcaacatccacttgcatggcgaaattctcccacaagttcttgacttgagccacaacaatctccatggtcagattcctatccaacttacaaattgctctaaacttgaggtagttaacttcttgtgcaataaactcactggaaaagttccctcatggtttggaactggatccatgacaaagcttagtaagttgcttcttggtgccaaagatctagttggtactatcccaccttccttggggagtcttacgtccctccacaattttacacttgctagaaatcatttggaaggaagtatacctcatgctttggctcagttatcaaatttcaaagagttgtatcttggtttaaatggtactctcccatcaaatatggcacttgcttttccaaatcttcgaaattttttggttggagggaactacttcaatggaactttcccgtcttcaatatccaacatcaccggattgcaaaagtttgatatctcctcaaatggttttaatgggccaattcctcctactttgggaagcttaaacaaacttcagatttttcaatcatttagcgtttctgacaactacttgagtggtgatatccccaatcaaacatttggcaatctaaaagaacttagcgcttgtactgcattaacagagcttgtggtagagagaaacttcttccatgggagcataccttctttcttgggctctttaatgtcccttgaaatcctagacccttctaacaacaacttgtcaggcgtaatccctggtgaactacaaaatctgagttttttgaatacattgaacttgtcttttaaccatctttatggtgaggttcctataggaagtgtctttaataacatcacagaaatttcactcattggaaataagacacttagaaagaatctcaatatctggactttttgttcaagtgttgattgcaatggggatgatttcaaggcaatagtttttgagttcatgcctcatgggagtctagatagtttgctgcacagcagtaaagagctcgagtctggaaatttcaatctcacccttcaacttgtgctaaatattgctcttgatgttgctaatgcattggattatcttcatcatggacattccagcagagatcagattagttcgtctgcaattaaaggaaccattggatatgttcccccagcgcttggcggagttgttgttgctatcgtaatcgacgatctcggaatcggtgacggatctggagtgctggacgatggagcggccaatagagttgatccaatcctccttctccttctcggaatcggcgatgaagtacatggtgtcggagcgcgtggagagctcgaaggcgttgggcttgttgaggatgtcttcggcgcctttgactgtgagacacgtggcgacggggacgacgccgcgtgggcgagacgcgcgcgtgacggaggattccttgaaccagaagagcttgccttgcttgaggacgaaccagcggcggcgccaggtcttgatgtactcgccctgcttggtgagccagccggtgcgctcggggttggaccagaactcgacgccgtcgtaatcggtggcgttttccgtcatgccg

SEQ ID NO: 36647 - DNA, 1149 bp, Glycine max
  Peptide Sequence Number=SeqID_153425
atgccgttgttggaacatcctcttgaaggagagcatgattgccgccttggtctaccactagaagtaggctcgacagatgaggaccgtggattagatgctccaggcctccccctagttgttgacagtggcctttctggaagcgatgtcctcaaattgggtggagcatcaagtgaaaagccaggcatttcagatggcttccatgatcttgatttcacagttggtgaagtgccacgggatggtactggctgccttgacatcacaggagctgacttggagactgaagaagtcttaactgaaggagaagatacagtgggtacattagatggtgttgacggttgccgagctggggttgatgcccttgttgtaggtctggatgcaggtaaggtaggcttggctgttggtgttgaagatcttgcagtagatcttgacaatggtgtagaggatctagatgtaattgtggttttagctgcagatactgtagtagttttagtgacagaaactgcagtcttaggagcagaaaccatgggcttggctgaggaacccgaggtctgggtggaagctacggtcgtcctcgttgaagctgtggttgtccgagaagtaggtgttgaaggtctggatgattttgaaacagtggtaggtgttgaaggtctggatgattttgaaacagtggtaggtgttgaaggtctacacgattttgaaactgtggtagctgttgaaggtctagatgattttgaaactgtggtcaatgtagatcgtcgagcaggagttgcagatcgtgacccaatattccctgatgatgagtgcctcctagttataccacctgaagaggtcaacccaggggaggaggctgattgtttagatactaagttgctccttccactatgttctgacagatttcctgatgatgagggcctcctaattccaccacctgaagaggtccacccaggggaggaggctggttgtttaattactgagttgctccttccagtaagttctgacagattcccagctgatgagggcctcctaattccaccacctgaagaggtcaacccaggggaggaggctggttgtttagatactaagttgctccttccagcatgttctgacggagaattagcaaactacaaccacaagaaaacaaatacataa

SEQ ID NO: 36648 - DNA, 1392 bp, Glycine max
  Peptide Sequence Number=SeqID_153426
atgtcgacttcctttaccttcacttgtattacagtttttttttccttcttcttgtctttcaacaactatgctaaaggagatctcattccatcacctacttgcaagcgtacctctattcaaggtggggtcaatagaaaagcatcattggagttggtgcatatagatggaccatgttcccatataaagcgtgacaatgttgataatgagaacaattttacgagggactatgaaagggtgaagtacattcaatcccgaatttctaagaataatagtttcaatgatttggattcatttactaccataccaactaacccaggtcctccactttcgactttgaattacattattgatattcgtcttgggacgccggagaaaaccttgcaaatggtatttgatacgggcagtcatctcacatggacccaatgttatcaatgcaagtcatgctataaacaagccaatgcaagatttaatccattaaattcttcaacatatgaggcttcagattgcttagatgatacatgcgaagaactcataagcagtggacaaggtctgagttgtagtaagaatgtacatctatgccactaccgtatctattatggtgacagatcctctagcaggggcttctttggcaaggatcgtctcgccctatacagcaacctctaccctaccaagcccggcatcactgatgaattctacttcggttgcggcatattgatgaagggaaattttggtcgcactgcaggcatttttggccttggccgcggagagctctcctttatgtctcagacttcgtcacagtacatggaaaccttctcctactgcatccccaacattgataacgtgggctacatcacctttggccctgaccctgatgctgaccgcgacgagagaatccaatacacccctttagtcaaccctcaagctggcctatcacattacgctctcaacatcactggcatcgccatcgatggtgatatactcatgggccttgacttcaaccaaatcgaccacggcggcttcatcatcgactccggctgcgtcctcacccgcttacccccctccatctatgccaagctccgctcagtgtatcaacaacgtatgtcctattatccctccgcgcccaagtacattccatttgatacgtgttatgatcttagtggatttcattatccgattcctgaaatgtcattcgtgtttcccggtgtcacagtggaccttccgcgggaagccactttccatgagatcaaaccaaagcaatattgtttggcatttatgcccaatgaatatgatagtcaaactagcatatttgggaacctccaacaaaagacccttgagattgtgcatgataacctgggtaataaagtaggatttcgtcctaatggttgtggttga

SEQ ID NO: 36649 - DNA, 213 bp, Glycine max
  Peptide Sequence Number=SeqID_153427
atggatgtttccgttattccttattgtttcatgggtgcgtgtaggcttctaaccccacctgggactcccctttttccttctttggagatggaaacatcaaaaactgttatgagtcagcttggggctccaactgtccgtcccacaccattaaaagctagaatgtcttttgcatctggttttcattcattaatgaaattttacatctccttgtaa

SEQ ID NO: 36650 - DNA, 492 bp, Glycine max
  Peptide Sequence Number=SeqID_153428
atgccagcagttaatcgtgcgtattccaaggcaaatgacaatgtgagtcctgttgtaatgggcaccaaaatggttgagagggtaataaatatgcgaaaattagctccaccaaggatggatgacaagaactctttccataatctttctggcaagtcatcttcatctccagatagctcaggcttcggaagatcactctcgaagaaatccttggatatggctattaggcatatggatataaggcgaagggctccaggcaatttacggccatcgttgatgacaaaaattcctgcatcttcaatgtatagtgtgaggtccgggcctcagcgtagccgaactgctagtatctccggctctcctcatgcttctggcagtaatgctagttctgaggtgagtgtaaacgaaaatggtctttgtatagataatagtgaaatagatgatgatattgttagcgtgagaagtggtcaatcttctgccactgtgcagggtaggtaa

SEQ ID NO: 36651 - DNA, 108 bp, Glycine max
  Peptide Sequence Number=SeqID_153429
ggtcgaggaaagaatctcttgttagtaacggtttcttcggcttctgaactatggaatctgtttgatggtttggaccgtcttgtcagtgagatttttcccacaaacttg

SEQ ID NO: 36652 - DNA, 741 bp, Glycine max
  Peptide Sequence Number=SeqID_153430
atggcctcatcaaactttctatttctcgaaggaaaatctattaataggcctcctatattcgatggagtgggttaccattactggaaaattagtatgcaaatattcatagaggttatggatttaaacatcaaggaagccattgaaatcggtccttacatccctacaatggtagtaggaaacacaactatagaaaaacccagggaacaatgggatgaagaaagaagaagggaacacaaaatagaacttatgagactaaatcaacatgaagaaaatggcaagaaaaagaaaggaatcgcacttaaagccttatcttcaattctagaagaaagtgacaaagaggacttgaatgaaatagaagaagatgatgattttagtttctttgtaaagagatttaataaattcctaagaaacaaaggaaatcaaagaagatcaaacttcaaaccaaagaaaagaggagaagattcatcttctattccaaagtgttatgaatgtaaccaacctggacatttgagagttgattaccctagtttcaagaaaagaatggaaaaatctgacacgaaaaccttcaatgataagaaagaaatgaaagcttacatcacttgggaagataacgatatggattcattcagagactcaaaaaatgaagtcatgaatctaagtctcatggccaaaaattatgaaagtgaagaagagatgcattcaatgacttgcataaagaatcagtcaaacttgcaaaactag

SEQ ID NO: 36653 - DNA, 179 bp, Glycine max
  Peptide Sequence Number=SeqID_153431
caacacgcctaacaacccttctaccacaaccacaaaaaagaacaacttgtgatgaaactcttgttcgaaatgatgatgcattgctcctctgcgacattgttgatagtaagagagaacaaaatggtgcgatttttgagggttatgttaaagaagaagaagaagaagaggaggatatatga

SEQ ID NO: 36654 - DNA, 423 bp, Glycine max
  Peptide Sequence Number=SeqID_153432
atgtcgcagaggagcaatgcatcatcatttcgaacaagagtttcatcacaagttgttcttttttgtggttgtggtagaagggttgttaggcgtgttgctggaacaaatattaacagaggaagggcatttttcacttgttcaattaataaggcttttcaggatgaagttggatattgtgggtactttatttgggttgatcaattgattgaagcacttggagttgatgattcacttgggacattttccatggaacaaagaagacaatttggaagagaggaagataagacaatgtggaaggctcaagttaactcaaagcttgattgtatggggattgaaatgaagatgtttagaacaattgtctatggaatgttcttaatccaattgttgtcaatggtggtgtttgtatgtattcacaagtactag

SEQ ID NO: 36655 - DNA, 285 bp, Glycine max
  Peptide Sequence Number=SeqID_153433
atggagaaggtcgatgtcttgcacgttccaactatcacatcatcacctacccttggggccatcgcttctggtgggactgcatttttcatgttggaccggaagggcatgccctgtttgcctaaacttcaacttatcccttttaagggtactaagccactagatttgatctttcaaggagaacaatacatcgacttgtatcgaatcccttctagatcaacgtttacctatggtttccttttacatgaaaagggaggcatcgtcatagttcaagtggttgccctttaa

SEQ ID NO: 36656 - DNA, 393 bp, Glycine max
  Peptide Sequence Number=SeqID_153434
atgagaggaaaccatttgcctgctattggaagtctaggaaggcattatcagtatcgatgtaacataagcgtttggaccattcctccacaccctgttgctccttctctatgtatagaagatattgatgatagatggattcagttttctaaataccttgcatcggtgggtcagatatgtgttgctcttggacagtgtgcagcagactacatgaaggatcctcctagacatccacatgtagtgcacaatgacacatttgttgaactagatcttcctcagcagtcgatggcggcagcagctatggacgaagcacctgttgatgtagagcagcctcgacatgcagtgcggaatgtctacgttcgatcgagacgaaggtggcgtatggaagacgcatga

SEQ ID NO: 36657 - DNA, 1935 bp, Glycine max
  Peptide Sequence Number=SeqID_153435
atggaagcttctagaatagagaatttgattagagccaagaaatcattgaagataagcttagagaaatcaaaatcggcagtgcggccgattcgcgccgagaaggacgccctcgcggcggtcggcggccacatcaaccgtgcggtgggccccgcagcagcggtgctcaaggttgtcgacgccgtccacggcctcgaaaagtcactcctgtcggatccccggaccgacctggccggatacttgtcggtgctgaagcgcctccaggaggctctgaggttcctgggagacaattgtgggctggccatacagtggttggaagatatagttgagtatttggaggacaattctgttgctgataaggtttatcttgcgaatttgaagaaggagttgaagattcttcgcgagtcgcagcacggggagcttgatggagggttgctggatgctgcattgggtaaattggaggatgagtttaggttgctgttgagtgagaatagtgtgccgttgcctatggcgtccgcgagcggggatcaggcgtgcattgcgccatcaccattgccggtgtcggttgttcacaagctgcaggcgattctcgggaggttgattgccaatgacaggctggataggtgtgtggggatttatgttgaggtgaggagttcgaatgtgagggcgagtttgcaggcgctgaatttggattaccttgagatttctttgtcggagtttaatgatgtgcagagcattgaggggtatattgctcagtgggggaagcatttggagttcgcagtgaagcacttgtttgaggccgagtataagctttgcaatgatgtgtttgagaggattgggttggatgtgtggatgggttgcttttcaaagattgctgcacaggctggtatactcgcttttcttcagtttgggaagacggtcacggagagtaagaaggaccctattaagcttttgaagttgttggatattttcgcgtcgttgaataagttgaggctggatttcaaccggctttttggtggtgcgccgtgtgttgagatacagaatttgacaagggatcttattaagagcgtgattgatggggctgcggagattttttgggagcttttggttcaggtggagttgcaaaggccgaatccacccccaatggatggtaatgtgccgagattggtgagctttatcactgattactgtaacaagctccttggggatgactataaaccaatactgactcaggtcctgatcattcacagaagttggaagcgccaaagctttcaggagaaactccttgtcaacgagattttgaacatagtgaaggctgttgaacagaatgtggagacttggatcaaggcttatgatgatcctatactgtccaacttttttgctatgaacaatcactggcatctgtgcaagcatttgaaggggacaaaacttggggagctcttgggggattcttggttaagggagcatgaacagtataaggactattactctaccatcttcttgagggacagttggggaaagcttcctggacatttgagtagggaagggttgattcttttctcgggagggcgtgccactgcccgtgacctggtcaagaaaaggttgaagaagttcaatgaagttttcgatgagatgtatgcgaagcagacaagttggatcatgccagaacgagatctgagggagaagacatgccagcttatagtgcaagcggtggtgcctgtttaccgcagttacatgcagaattatggtcctttggttgagcaagatgctagctctacaaaatatgcaaagtacacagtgcagaagctggaggaaatgcttttgtgtctatatcggccaagacctgtaagacatggcagcttgagaagttcaacatttagtgcaaaatatgggaatggagtacccgatcttcgcagaacagcatctgcagttgtgtaa

SEQ ID NO: 36658 - DNA, 112 bp, Glycine max
  Peptide Sequence Number=SeqID_153436
gaagagagacgcttacggcaatggcgaacgcgtgacgacagtggcagcgcctggcttaacggcgagaatgaatgcaaacgacaacaacggcacagtaggaagcaaaaaatga

SEQ ID NO: 36659 - DNA, 653 bp, Glycine max
  Peptide Sequence Number=SeqID_153437
atggggaaagaggtagggaggggaatggggatgcgtagccatcggtggtgcgtagagggaaagctatcaaagcctaaaaataagttgggtttagaatcttcaatcttgtttgggagagagatgtacatagcttccatgggaaggtctttcaaggactccttgaaactgcttgaagctgatattcaccatgccaataccctggcgtcagattttccaagggaatatgatggtgcgtgccttcagatgagaatgtcatatagtccagcagcacacctgtttctctttttggtgcaatggacagactgcaatcttgccggagcccttggactgttaagaatcctaatatacaaggtgtatgcggatgggacaactaccatgtctacccatgaaagaaaagcaagtatcagggaattctatgcggtcatatatccctctttattgcaactgcaaaaaggtgtaacagatacagaggatacaaaacagaaggctgtatgcatggagaggtatcgcaagagagatgatgaggagcacagacaaccttcagacatagacattgaaagagaagaagaatgtggaatatgcatggagatgaatagtaagattgtgttgcccgactgcaaccatgtcatgtgcctgaaatgttatcacgaatg

SEQ ID NO: 36660 - DNA, 1566 bp, Glycine max
  Peptide Sequence Number=SeqID_153438
atggatcagctgttgtggagggtgttgcctttgctaacaatccttgtctcctttggagtgttcttctacttgcaggattcttacacagcacagttttatgctctcataaagttaccacgggataagtgcagccttcttccccatcgccacttctggatatccagcaaacgcattgtgaccccacaagggatcatttctggttcagtggagataaatgatgggaaaataatatctgttgtcgagggacatgctaaccaggggaagcctaagcaagaagaagtaattgattatggagatgctgttatcatgcctggcttgattgatgtgcacgtacatcttgatgagccaggaagaactgagtgggaaggatttgatactggtaccagagctgctgctgctggtggcgtaaccacagtggttgacatgcctctgaacaattatcctacaaccgtgtcaaaggaaaaactaaaacttaagcttgatgctgcagaggataaaatctatgttgatgttggattttggggaggcctaatccctgaaaatgcacttaatacaagtattcttgaggggctcttaagtgctggtgttcttggtatgaagtcttttatgtgtccttcaggaataaatgacttccctatgactactattgaccatatcaaggcgggattgcctgtgttagcaaaatataaaaggccgatagttgtgcatgctgaggttcaacaagattttgaaaaccatttggagcttaatgaggataaccttgatccacgtgcttacttgacctatctcaatgccaggccaccttcatgggaggaggcagccattaaacaacttgtaggtgttacgaaggacacaagaaaaggtggtcctttagaaggagctcatgttcacattgttcacttgtctgattcaagtgcttccttggatctgattaaggtgttttgtgcattgagttgcctggaagcaaaaagtcgtggtgacagcataagtgttgagacttgtccccattacttagctttctcatctgaagagataccaaatggagatactcgttttaagtgttccccgcccattcgtgatgcttataacagagaaaaattatggggggctgtattagagggacacattgacctattaagttctgatcattcaccaactgttcctgaactcaagcttatggaggaaggtgacttcttaaaggcttgggggggcatatcttctttgcagtttaatcttccagtgacgtggtcatatggtaagaaatatggactaactctggaacaattgtcgttattgtggagcaagaaacctgcaacattggcggggttagaatcaaagggggccattgcagttggaaaccatgcagatattgtagtttggcaaccagagctggagtttgacctggatgatgattatcctgttttcatcaaacattctgagctctctgcttacatgggaagaaggttatctggaaaagttttggagacttttgttagaggaaaccttgtgtttaaggatgggaagcatgctcctgcaccgtgtggtgttcaaatactagccaaatga

SEQ ID NO: 36661 - DNA, 1334 bp, Glycine max
  Peptide Sequence Number=SeqID_153439
tggagataaatgaagggaaaataatatctgtcatcgagggatatagtaagcaggggaagtctaagcaagaaaaaataattgattatggagatgctgttgtcatgcctggcttgattgatgtgcacgtacatcttgatgagccaggaagaactgcatgggaaggatttgatactggtaccagagctgcttctgctggtggtgtaacaacagtggttgacatgcctctaaacaatcaccctacgactgtgtctaaggaaacactgaaacttaagcttgaagctgcagagaataaaatctatgttgatgttggattttggggaggcctaatccctgaaaatgcacataatacaagtattcttgaaggtctcctaagtgccggtgttctcggtttgaagtcttttatgtgttcttcgggaattagtgactttcctttgactactattcaccatatcaaggagggattgtctgtgttagcaaaatatagaaggcctttacttgtgcattctgagattcaacaacattctaaaaaacatttggagcttaatgataaaggtggtccgcgtgcttacttgacctatctccacactaggccaccttcatgggaggaagcagccattaaagaacttgtaggtgttacgaaggacacaagaaaaggtggtcctttagaaggagcacatgttcacattgtccacttgtctgattcaagtgcttccttggatctgattaaggaagcaaaaagtcgtggtgacagcataagtgttgagacttgtccccattacttagctttctcatctgaagagataccaaatggagatactcgttttaagtgttccccgcccattcgtgatgcttataacagagaaaaattatggggggctgtattagagggacacattgacctattaagttctgatcattcaccaactgtgcctcaactcaagcttctggaggagggtgacttcttgaaggcttggggtggtgtaacatctttgcagtttgatcttccagtgacgtggtcttatgggaagaaacatggactaactctagaacagttgtcgttattgtggagcaagaaacctgcaacacttgcggggttagaatcaaaaggggccattgcagttggaaaccatgcagatattgtagtttggaaaccagaggtggagtttgacctgaatgaagattatcctgttttccttaaacatcctagcctctctgcttacatgggaagaaggttatcaggaaaagttttggagacttttgttagaggaaaccttgtgtttaagaaaggaaagcatgctcatgcagcctgtggtgttccaattctagccaaatga

SEQ ID NO: 36662 - DNA, 129 bp, Glycine max
  Peptide Sequence Number=SeqID_153440
atgtcgtggtcaaggacgatagcaatgataatagccggagaatcactcatgcaagtggttgatgccccagttccgcgtgatgactgcaatagtactggaactgacaaagagaagcaaaagcaagattag

SEQ ID NO: 36663 - DNA, 837 bp, Glycine max
  Peptide Sequence Number=SeqID_153441
atggcttcaggcaaaaggacagctgttcttggtgattcagctggtagagagcctcctgaaagaattgtgaaggatttgaataagaaatcacgatatgagcatgtggtttttgaacctcccaaagatttcccagaagaaatcgagtttggcatggacttctcacgaccagaaaatatagatgatccagaggacgaggaagaatacaagaacgtgcgtagagctgtgaaggagttccgagtggcaatgaatgaatattataaagcagaagagagaacagaggagcaagaactgaagtacctggaattcgtgcaattcgcgaccatacaggctctgatgcgctgcgccatcctctactcatacgccaaggagcgcgcgggtcctctgaagcccggtgtcgacaccgtggaggaggccgtgaagaccgtcgtggctccggtctacgataggttccaccttgtccccggcgaggtcctcaaatacgcggatcggaaggttgccgagttagacagccacgttccctccaacgtgaagaaggtctcctcccaggcctgctccgtcgtctctgaagtccgccgcgatggcgtctccgcctacgccaagaccgtttactccaagtacgagcctacggcggagcagtgcgcagtgtctgcatggcggaagctcaaccagcttccgctcttccctcaggtggccaatgttgtgttgcccaaggctgcctattgcaccgagaagtacaacgaggcggttgtttcctctgctgagaaaggttacagggtttctgcttatcttcctttggtgcctactgagaagatcgccaaagtcttcggtggaaactga

SEQ ID NO: 36664 - DNA, 1461 bp, Glycine max
  Peptide Sequence Number=SeqID_153442
atgattcgcagaatcatcgcagtggtgagcagatcatactacacgagcaggtcgaagaaaccgagcctgtactcgaaaatcagccccctcgggaatcccaacactagtgtggtaccggtgctcgacgattgggtgttcaaggggaacaagcttcgtgtcgcagaacttcaacgcatcattcgtgaccttcgcaaacgcagtaggttctcccaagccctccagatatctgagtggatgcacaacaaaggtgtgtgcatattttctccaacggaatatgccgtgcatttggatctgattggcaaggttcatggattctcttctgcagaaacctattttgatgccttgaaggatcaacacaaaaccaataagacctacggtgctctcttgaattgctatgttcgccagcgccaaaccgataaggcgctgtcccatttgcagaaaatgaaggacttggggtttgcttcatcgcctctgacttataatgacattatgtgtctatatacaaatattggacagcatgagaaggttccggatgtgcttcgtgagatgaaacaaaaccaagtcttgccagacaacttcagctacaggatctgtataaattcttatggtgtgaggtctgattttggtggagtggaaagagtattgaaagagatggagactcagccaaacattgtcatggactggaatacttattctattgcggccaatttttacataaaagcaggacttacaagggatgcggtttgtgccctaaggaaatctgaggaaaggctggacaacaaagatggccagggttacaatcatctcatctctctttatgcccaacttggactgaagaatgaggtcatgagaatatgggatctggagaaaaatgcttgcaagaggtgcataaacagggatttcacgaccttgttagaatctcttgtaaagcttggggagctcgatgaagctgagaaaatactcaaggaatgggaatcctctgacaattgttatgattttggaatcccaagtattgtaatcattgggtattcacaaaaaggtttgcacgagaaagccttagccatgcttgaagagttacaaaacaaggaaaaggtcaccaccccaaactgttggtctatagtggcaggtggatacattcacaagggtgagatggagaaagcatttaagtgctttaaaacagccctctctttgtacgttgaaaataaaggatggaagccaaacgcaaaggtgattgcagaactattgcgttggattggtgataatggcagtgttgaagatgcagaagttttggtcagcttattaagaaatgccgtcccagtgaatagacaaatgtatcacaccctaatcaagacttatatacgaggtggaaaagaagtggacgaccttttgggccgcatggaaaaagatggcatcgatgaaaacaaagaaactaagaaaatcattaacaagaagaatgcttaa

SEQ ID NO: 36665 - DNA, 591 bp, Glycine max
  Peptide Sequence Number=SeqID_153443
atgtctttgccaggaattctaatcttctacaatttcaccatttgtcttccccaacaggggcttggcaaatcgctctggttgatgcagggtatgttcagggcaaatggaggctgtggttatgtaaagaagcctcaatttctaatgcagaagtatcactgtgacaatgagtttgatcctacaaggatacagtcagtgaagaagaagacatttaaggtaaaagtatacatgggacatgggtggagctcagatttgagtcctacacactttgataagtgctctccgccagacttctacactaaggtttgtattgttggaatgccagatgatgttgcaaagaagaaaacaaaggttatgatggacaattggtttcctgtttgggatgaagaatttgaattctctttaattgttccagagcttgcattgcttctcatacaagtaaaggacaaagatcctggaaaggatgattttgctggacagacatgtttgccagtttcggagctaaaacatggatttcattcagtccctttatataacaaaaagggagagaaatttaaatctgtaaagccattgatgcagtttcagtttgaatga

SEQ ID NO: 36666 - DNA, 525 bp, Glycine max
  Peptide Sequence Number=SeqID_153444
ttcaattacccgcacacctcgttgcaaagcctttatgattggcacatcactgcaaacgctgctcagctgattcccagtcagggaaagcaagagagagacctgggatttgaggggatcgttgaaatcgagaaggaacaagaaacggaagaactcgtcgagggtgagcccattcttgttgttgtcggggtggtggtggcgttcggagttggtgtcgttggtttgtttgcgcgattgaatgatgctgtcgaggatgcggttggaatcctctgcggtgcagtcggtttcacgctggtggtcgtgcaggaagcggaggagctggtgggcggacatggaggaggcggcgccgtgggagaaggcggagaaggcctccttgacgtccggcggaggggcctgctcggagacgtcgaattttctgttgaagtacttgaacattttgtagctgtaggtgacggtgcccattgttattggacacagaggaatgaagaagaagaagaaagcgatgggtatgaaataaataatatatga

SEQ ID NO: 36667 - DNA, 162 bp, Glycine max
  Peptide Sequence Number=SeqID_153445
atgccagggcacaattcctacctgactgggaatcagctgagcagcgtttgcagtgatgtgccaatcataaaggctttgcaacgaggtgtgcgggtaattgaactagatttatggccaaattcaactaaagatgatattgacgtagttcatggaaggtgctga

SEQ ID NO: 36668 - DNA, 717 bp, Glycine max
  Peptide Sequence Number=SeqID_153446
atggggagagcttcaagggataagagggatatctattaccggaaagcaaaagaagaaggttggcgagctcgaagtgcgtttaaactccttcagatagacgaggaattcaacctttttgatggagtgaagcgtgttgtagatttatgtgctgccccaggtagctggagtcaggttttgagtcgtaaattgtatctcccagccaagcttgcacctgatgcaaaggatgaaaatcttcctcttattgtagctattgatttgcaaccaatggctccaattgaaggtgtcatccaggtgcagggtgatataactaacgctcggacagctgaagtggtcattagacattttgatggttgcaaggctgacctagttgtgtgtgatggtgcgcctgatgaggcatttgcagtttgtgaaaactattcccctcctgaaggattcaatccaaaagatcttcatcgccttcttgagaaggttggaagtccctcaggggtagatgatacaggccctaataaggtgtatatcccatttctagcttgtggtgacctcagtgggtatgattctgatcgctcatatccactacctaaagttgccgggggaacatatcagagcttggatcctgtgcagccccctattgccccaccttacaagagagctttggagttaaaaaaagcttccagtcaaggattccgtgaacttgaaaacctctcattggattcttga

SEQ ID NO: 36669 - DNA, 1566 bp, Glycine max
  Peptide Sequence Number=SeqID_153447
atgaaagttcagaatctgaatcaaatagcaattcgtgctcaacaacaactaatcacaaaccctaacccccaattcttgaaccccttactgtcacaactcacgaattcacaaaatgctttctttgatctttacaaccagatactctcacaccctttctcccacaaccactacaccttcacccacgccctcagggcctgctactcccaccactcgcgctccaaagcgcttgaaatccacgcgcacctcgtaaaatcggggcactaccttgacctcttcctccagaactcgctcctccacttttacctcgcccacaacgacgtcgtctccgcctcaaacctcttccgatccattccctcccccgacgtcgtttcatggacctcactcgtttcgggcctcgccaagtccggcttcgaggcccaagcccttcaccattttaccaacatgaacgcgaagcccaaaatcgtcaggcccaatgcagccaccctcgttgccgcgttgtgcgcgtgttcctctctcggggctctgggactcggcaagtctgctcacgcttatggactgaggatgttaatcttcgatgggaatgttatctttgataacgctgtgttggagttgtacgccaagtgtggggcgttgaagaatgcacagaacctgttcgataaagtttttgcaagagacgtggtttcttggaccacgttgttgatgggttacgcgcgtggtggttattgcgaagaggcttttgctgtgtttaaacgaatggtgcttaatgcagaagctgagcctaatgaagcaactgttgtaactgtgttatcagccagtgcctctattggagccttgagtttggggcagtgggtgcattcgtatattgactcaagatatgaccttgtggttgatggaaatattgagaacgcgttgcttaacatgtatgtcaagtgtggagacatgcaaatggggttaagggtttttgatatgatagtgcacaaggatgctatctcgtggggcactgttatttgtggacttgccatgaacggctatgagaaaaaaacattggagctattttcacgcatgttggttgaagtggttgagcctgatgatgttacgtttattggggtgttatctgcatgcagccatgcaggtttggtgaatgaaggggttatgtttttcaaagcaatgagggatttttatggcattgtgccgcagatgaggcattatggttgcatggtggacatgtatggacgtgctggtttgcttgaggaggctgaggctttccttagaagcatgcctgttgaagctgaagggcccatttggggggctcttcttcaggcatgcaaaattcatggtaatgagaagatgtctgaatggattatgggacacctcaaggggaaaagtgttggtgttggtactcttgctttgctgtctaatatgtatgcgagttctgaaagatgggatgatgctaataaggttcggaagagtatgagaggcactagattgaagaaagtagcgggatgtagctgggttgagcttgagatgttcaacaacagattggattcaaatttatgtgctgcctag

SEQ ID NO: 36670 - DNA, 750 bp, Glycine max
  Peptide Sequence Number=SeqID_153448
atggctaatcgaggaggagaaggaaatagaccaccaaggaggactcttggtgactatgcttatcaacaaggaccaaagcattacaacagcatagtcattcctccttttagcaacaaggttgtgggattaaagccaacaatgctcagtctaattggctcacacccctttgctggaatggatcatgaggatccatacacacgtttgtctaccttcatggagctatgcaataccatggagcttctaacgaagatgctgaagctatctaccttagtgctttcccattctccttggagagattcaaagcgttattgcggaggtgcgcaaaccataattttgatgatgctgaacaactacagtagtttgaaacctcaaacaaaaatgattattgatgcctcagctggaggtactatgacaccaaagagtccggaggaagcaattgtaatcattgactccattgcagccagtgattatcagagtcaccatgatagaactctgattcaaaagaaaagctcagaacaaactcttgactcaacaaatagaggccttaaccatgtagataggccaacttcctcaacaatatcaccaagttggaccccagaaaccacaccaagctcatcaagttcaacaaacactgttcagcacctggtgattgtcaacaagaagatgaggcccattatctgtagaatcaagctagacctcaacaaaacttccaaggaaactaccaaggctacagaggtggctcaggtttaa

SEQ ID NO: 36671 - DNA, 951 bp, Glycine max
  Peptide Sequence Number=SeqID_153449
aaatttgatttggaaatcaaggataagaagggaagtgaaaatatagtagttgatcatctttccaagctgactattgatgaggtgaccacacaaggacttgagattcgagaagagtttcctgatgagaagctattcaacattgtaataaggccatggtttgctgagatggctaattttaaagaaaccgacaatctcctaaggaggtgtgtaactcggggggaggcaagaagcatattgtggcattgccatagttcatcttgcggaggccattacaatggagagaggactgatgtcaaggttctccaatatagtttttattggcctaccttgtgcaaagatgctcatgaatacgtccaaagtgttggtttaaagccagactatgtaatgttcatcggggttctgacagcatgtaaccatgttggaatggttgatcttggtttctactattttatgttaatgactaatgtgtactggatcagtccttcaaaagaacactatggttgcctcattgatcttctatgcagagcagagcgattgactgaagttgagcacataatacgaacatgtagagtgcatggggatgttgaccgtggaagatggacaatagaacaattacttcaattggatccaaattctgctggaactcatattactctggctaacatatatgctgccaaggggagatggaaggaagctgcacatataagaaagtcaatgaagtcaaagggagtgataaaggagcgaggatggtcttgggttaatgtcaatgatcaattaaatgcatttgttgctggggatcaggctcatccacaaagtgaacatatcacaaccattttggaattattgagcgcaaatataggagatgctcagcaagaaataagagctcttcatgaagatgttgaggatttagcatatggctacattccatctcatgggaatgctagaaaatag

SEQ ID NO: 36672 - DNA, 1214 bp, Glycine max
  Peptide Sequence Number=SeqID_153450
gtgttgctgggatatgcactgcgatttattgtttgtggactggggtttgttttgggaagaagaaagttcacaattctgtgcagccgacaatcactagaggtggcagtgtaaatggtgtgggtggttctaataatagcattagtcctccttcaagatcatccactattaggcgtcaagggtcacggataatgaggcgtcaaaggagtggaacatcatccacaaagcatcctgagagggctgaggagttcactttggctgagcttgttgctgccaccaataatttcgcccttgagaataagattggtgctggaagctatggtgttgtttataaaggcaaactcttggatggtcgcgaggtggcaatcaaaaggggtgacactagtaccaagatgaagaagtttcaagagaaagagactgcgtttgagtcagaattggccttcttatcccggttacaccacaagcacttggttaggttggtggggttctgtgaagagaaagatgagaggctgttggtgtatgagtacatgaagaatggggcattgtatgatcatttgcatgacaagaacaatgtggacaagagtagtagtgtcttgaattcttggagaatgaggatcaaagtggcgctggatgcttcacgagggattgagtatctccataattatgcagttccatctataattcacagagatatcaagtcttccaacattctcattgatgcgacttggacggcaagagtatccgattttggattgtcattgatgagtccagaatccaaccatgatttccgaccaatgaaggcagcgggaacagttggatacattgatcccgaatattatggtctaaatgtactgacagcaaagagtgatgtctatgggcttggagtggtgctgctagaactattaacaggaaagagggctatattcaagaatgatgaaaatggtggcaccccagtgagtgtggtagactttgcagtgccactaattatggcgggagagttggcaaaaattttggaccccagggttgaaccaccagagatgaatgaaacagaagcagtggagctagtgggatacactgctatgcattgtgtaaatttggaggggaaggacagaccaacaatggctgatattgtggcaaatttggagcgtgctttggctctctgtgatagtagtcatggcagcatttccagtggtacaatctccattgtatctgactga

SEQ ID NO: 36673 - DNA, 234 bp, Glycine max
  Peptide Sequence Number=SeqID_153451
atgcaactaatagggagaatttctaggcctttcaatcgaggccagcgaccattgctcaacaccttcaagggtcctcaaacactgacaaggcaagatgaaggtgtggagaaaaaggctcttgatgccaaggctttggacgaacttaataaggaggaggtggcaaggttggaagttgtgttggccaccaccgagaaggagaggaatgctgaggaggagaggcttcagattgagtag

SEQ ID NO: 36674 - DNA, 441 bp, Glycine max
  Peptide Sequence Number=SeqID_153452
atgggaggtgtcctccaacatgtccatttcgttcatagtttcctcaagttcttgtctagaaagggattctcttttactagcagtggggagttgagtgacttctctgccttcttgaatcaacttccaaagagggtggctgatatcataggaaaggttccaaacataggagttactgccgctgacaagactcaaaggcccccttctttggcaacggattcccttgacgcttccgtcgaggtggggatcatggatcaagttggtgcaaacatggtggcattccaccttgctaacaagaattgtgttccccctgctgctagcaatgccgctctcatggcccctattaaccaaactcccagtttaagggaccctcctgtggacaccccccaagatgctaaggagcccaaggaaaagacaatcacaagaacaagaaacggagcatga

SEQ ID NO: 36675 - DNA, 264 bp, Glycine max
  Peptide Sequence Number=SeqID_153453
atggagctccagatgcacacttacatgcatcatttggttgatcagcaggcaacaaatcacaagtgccaattgcagttgaatgacaacttctactactacacgctgcaccagcatcgccaagacccaaacccttacccttggcctactcctgagcaatttagagctgttgctgcatggtctagagacaggcttattttttcaggaggaggaagatcttgtagatgcctaggaagctgcccaatgcgatggaggaagagcagatga

SEQ ID NO: 36676 - DNA, 501 bp, Glycine max
  Peptide Sequence Number=SeqID_153454
atgcgggggtaccttatggttgcccgcacctttcgtcaaccaggggctaatgagcccgttgacgcacagagactaacatcgtcttctgtaccttctatcatcctgacccgtgaagtctgggacagcgagtcaggtggcaggcaaagataccttatggttacccgaacctttagtcaaccaggggcaaacgagcccgttgacgcccagagactaacattgtcttctgcaccttttgccatccagggacagcgagtcaggtggcaagtggagataccttatggtcatctgcacctttcgtcaaccgaggggaacgaattcgacggtttttaccctcgtcgtccagagacattcaagcccgacgacgcacgagattcttctctgctgggcgggggcgatcgagttcgatggcgtggggaagtgtcatggttgtccaactttatcgctttaaagacactgaagtttgttgatgcttctgatgccttttcttttctttctaaatga

SEQ ID NO: 36677 - DNA, 267 bp, Glycine max
  Peptide Sequence Number=SeqID_153455
atggtgcaggagtacgcagaagtgcagaaccaaagtcagaacagaacggaggaacaaaatagaacaggtgtcgcaggtgtaggagtaagcagaagtgcagaacattggagcagagcaacaacgacagcgctaggaacagacagtggccgaaaggcagagcagcaacgacgccggaacggacggtggatggaacgcagagcagcaacaacagtgctagggttttcgcaatgttttccagcgcaacaatggagccccgataaatcatga

SEQ ID NO: 36678 - DNA, 237 bp, Glycine max
  Peptide Sequence Number=SeqID_153456
atgcaaaatcagttacttcataaaagagttaccaggctttacttcatttatattgcatcctgtgagactaacacaaaggatgaggagaatggaaatgattcgagtcctgtgagactgagaaaggaagaaagacttcaaatggtagtcgtcgtgagaggttgcaatgccgacggcgatggagtttcagtgccccaagacgttgcaaatgagagtgcgaaagcttttgagtgtgagtga

SEQ ID NO: 36679 - DNA, 957 bp, Glycine max
  Peptide Sequence Number=SeqID_153457
atgtatgatacactagaaagtgattcaaagaagcctttgtatcggggatgcaagaaatatttgaccccattgttagtggcgttaagtttgtttaatgttaaggctagatatgggtggagtgacaaaagcttcccttcattgcttcagataatgcaagatatgcttttagaggaaaacacattgccaaaaaagttattatcaagcgaagaagatattgtgtccaataaacaagagtatgaagaaatgcataaatgccccaggtgtggggtatcatggtacaaagtaaaggatggcgacgagtgtagcagtgatgaaagcataatgaaagatcccccagcgaaggtgttatggtatctttcgatcattccaaggttcaagcatttgtttgctaatgtagatgacacaaaagaccttacatggcatgcaaatgagagaaattgtgatggaatgctccgtcatccggctgatttctcccagtggaagaagattgatcgtttgtatccgaatttcggcaaagaggcaagaaatcttaggcttggacttgccacttatggaatgaatccctatggaaatttgagcaatcaacatagtttgtggcctgttttgctagtaatttacaacttgcctccttggttgtacatgaagcgaaaatacattatgttttctattatgatatcgggcctaagacaaccaggaaatgacatcgatgtttatctcaatcccttgattgaagacttgacaaatttatgggatgagggggttgttgtgtttgatgggtatagaaatgaggcattcaagttgcatgcaatgctattttgtaccattaatgactttccaacatatgaaaatttgaatggatacagtgttaagggccatcgtgcatgccctatctttgaagaatacacaagctacgtacaactaaaacatggaagaaaaatagtatacactcgacattga

SEQ ID NO: 36680 - DNA, 957 bp, Glycine max
  Peptide Sequence Number=SeqID_153458
atgtatgatacactagaaagtgattcaaagaagcctttgtatcggggatgcaagaaatatttgaccccattgttagtggcgttaagtttgtttaatgttaaggctagatatgggtggagtgacaaaagcttcccttcattgcttcagataatgcaagatatgcttttagaggaaaacacattgccaaaaaagttattatcaagcgaagaagatattgtgtccaataaacaagagtatgaagaaatgcataaatgccccaggtgtggggtatcatggtacaaagtaaaggatggcgacgagtgtagcagtgatgaaagcataatgaaagatcccccagcgaaggtgttatggtatctttcgatcattccaaggttcaagcatttgtttgctaatgtagatgacacaaaagaccttacatggcatgcaaatgagagaaattgtgatggaatgctccgtcatccggctgatttctcccagtggaagaagattgatcgtttgtatccgaatttcggcaaagaggcaagaaatcttaggcttggacttgccacttatggaatgaatccctatggaaatttgagcaatcaacatagtttgtggcctgttttgctagtaatttacaacttgcctccttggttgtacatgaagcgaaaatacattatgttttctattatgatatcgggcctaagacaaccaggaaatgacatcgatgtttatctcaatcccttgattgaagacttgacaaatttatgggatgagggggttgttgtgtttgatgggtatagaaatgaggcattcaagttgcatgcaatgctattttgtaccattaatgactttccaacatatgaaaatttgaatggatacagtgttaagggccatcgtgcatgccctatctttgaagaatacacaagctacgtacaactaaaacatggaagaaacatagtatacactcgacattga

SEQ ID NO: 36681 - DNA, 378 bp, Glycine max
  Peptide Sequence Number=SeqID_153459
atgaagaaagatactaatgaatatagtaaggatggtggaacttacgaggagagcttaaaacttattaagatggtctctcatttgtcagcgagtgaggtttgtgagcctccaattgatcacgcgcattatgatgaggaggcaatggcttttgttctagggaaaagagaccttggttccttactacaggatgtggtgctcctcaatatgctaggcaataaacattgtgggatgaccacagagattttaacagtagctttgatgcaatcctatcccccaagggcattggatagaagactccaagaagattgggccaaagatgcaagagaaggcccaagggttctcatgaaccttagggtagattttgagcccaagggctaa

SEQ ID NO: 36682 - DNA, 1427 bp, Glycine max
  Peptide Sequence Number=SeqID_153460
atgaggaagaaaacctactccgacttgtctctctttttttttcctctcttgctcattctagtttcacactctctctgtgcctccgcattctcgcacaatggacctctcacagactcccaagtgtctttcatcaagcagcgtcagcttctgtattacaaggactacttcggtgacagaggtgaaaaggtaaccctcgatccctccttcgtcttcgaaaacgaccgtttgagaaacgcttatatagcgttacaggcgtggaaggaagccattctctccgatcccaagaacctcacgcaggactgggtgggacccaatgtttgcaactactcctacgttttctgcgctccggctcctgacaaccataagatccgcaccgtcgccggcatcgacctcaaccacggcgacattgccggataccttcctgaggagctaggtttgctcaccgacctcgctcttctccacatcaacaccaaccgtttctgcggcactttgccgcacaagttcgacaggctgaaactcctcttcgagttagatctcagcaacaaccgtttcgccgggaagttccccgacgtggtgctgcgtttgccgcagctcaagtttctagatctgagattcaacgaattcgaaggcacggttccgaaggagctcttcgacaaggacctggacgcgattttcatcaatgacaaccgcttcgtcttcgacttgccggaaaatttcggaaactcgccggtgtcggtgatcgtgctggcgaacaaccgcttccacggatgcgtgccggcgggaatcggcaacatgaagaggctgaacgagattattttgatgaacaacgcgttcaggtcgtgcttccctgcggagatagggttgctgcagaacttgacggtgttcgatgtaagcttcaaccagttgttggggcctttgcctgatgctattggaggtgcggtgagtttggagcagttgaatgtggcgcataacttgctgtcagggaagattccagagagcatttgtaagcttccgaatctgcagaactttacttactcttataacttcttcactggcgagccgccaaggtgtctcgctttgccggcgtttgatgaccgccgcaactgcctcccggctaggccggcccagcgctccgccgggcaatgtaagtcgtttttgtcgcaccctgtcgattgtaattcgtttaggtgtaagccttttgttccttcattgcctcctcctcctcctccctcaccaccattgccatcgccgccgccaccgccgtcgccagtttacattcctcattcccctccaccgccaccaccgccggtgtattcaccgcctcctccaccgccaccaccgccggtgtattcaccgcctcctccaccaccagtgtattctccgccgccaccaccaccagtgtattctccgccgccaccacctccagt

SEQ ID NO: 36683 - DNA, 225 bp, Glycine max
  Peptide Sequence Number=SeqID_153461
atgaggctaaatcttgaagtgctaaaagtgcgttcatccattgctaagcatagcttcagtgcgctgagcgcggcagaagaatttggcagagcatcaatatcaaggtcgcgcgctaagcgcgagatcagtgcgctaagtgcaacggttgtcttcagccaggctcagtgcatgactggcgctaagctcaaatccacttactcgcccttagcgcgagggtggcgctaa

SEQ ID NO: 36684 - DNA, 426 bp, Glycine max
  Peptide Sequence Number=SeqID_153462
atggcaatggggcgggtcaaggtcaggttttgcttaccctacccccggccccgactccccattcccctccccgccccagcccccgaaacccaacggggatgtatatttaccccccatccccatccccatccccgacgagcggagcaggttcgagataagcttaacccgaatcctgatcaactcaaattttttcatcaaaatcgggacaaattcagggtggattccacgggttcagataaaagagaagaaaggaaagggaaagatgcgacgagcgccgacgatccaggcgggcaagacgtgacacgtagggcccaattaggatgtggctttctccatcagctcttgtgttttgcgggacccactccctcagccgcatcaatgctaatacggacgcgtaacatggaaatgtcagtggttgcaagctaa

SEQ ID NO: 36685 - DNA, 261 bp, Glycine max
  Peptide Sequence Number=SeqID_153463
atgaaagatcaagaaggaggaatagattgtttccaaatcaagcccgcccaagcaagatattccactgcccatgcaagagaaagtcacaagcacatgcagaaaaaggaagttttaagatgggtcggattaatattggccatatcagagacaataccatctaaccctatcccaccaaaaggaaattgcaacaccaccaccaagcttccatttagtattttcctacaaatcaaaccagcaatgcctgatcccaggccaaattga

SEQ ID NO: 36686 - DNA, 318 bp, Glycine max
  Peptide Sequence Number=SeqID_153464
atggtttctagtatagaggagttctttattctcaagctttttaagattgatgaaaatgctagaaaggctcatgtcatcaaacctgttatttggtgcactcctcagattggtcggattaagatttttgtagctttgatggccattgagatagccagggataagcaatggttgtctcttttggttggagacaaactcaactttggtggtagaagttttcaagattccttctttggtaccttggagcctttcacaacagatgaaaaatgctatttcttgcacaaaatctatgcatttttagatatctcatgtctttcatga

SEQ ID NO: 36687 - DNA, 258 bp, Glycine max
  Peptide Sequence Number=SeqID_153465
atggcatatgaatgcattaaacaatataaaccaaggtggagatcatgcacgtcagagcctttcgacgttcgtcccaaggggaaaatgaagagtgcttccgaggatgatctgggcacaatggattgtttcttactcttccaagatattaaggaggtacctaagaagaagcataaacttgttatggatcttcgggtgtcaagacaagctctccaatccgagtcactgaagccagttaaagaagtggaagatgaagagtag

SEQ ID NO: 36688 - DNA, 255 bp, Glycine max
  Peptide Sequence Number=SeqID_153466
atgactcaaaatgctgacccaattgagaacaatgctattgtcaataatgcagctcttacaaacttgttgaatccctattatactcctccaaatgagaatcccggtgtggtgactgttgctcaggttctcaatggtgaaaattaccactcattgtcgcgtgctatgctccttgctttgaaaaccaagaaaaaggtcaaatttgtggatggttctttgcctcgtcccactcttaatgatcccaatttcactctatag

SEQ ID NO: 36689 - DNA, 192 bp, Glycine max
  Peptide Sequence Number=SeqID_153467
atggccatgaatttaccttgcaaaatttctatgattcccaaggctatccaatctgaattatcttctcttattaaggctaacacttggcagcttactcctttacctcccaataaaaagctaattggctgcaaatgggtttcaaaatcaagttcaaagctgatggatccattgacaagcacaaggctagattag

SEQ ID NO: 36690 - DNA, 342 bp, Glycine max
  Peptide Sequence Number=SeqID_153468
atgatgatggaccccctccctgatttagacaaagttttttctatccttattcaacaagaaaggcaattggtttttcaatttgatgattctagagttttctctcaattggataccaacaatggtacttatggcagaggcagaggttgtggaggccatacatctggtggaagaggtaaaggcaaaagcacaaaaatgtgcaattattgtaacaaatcaggtcatatggtagacacttgctacaagaaacatggttatcctcctcacttacatagaggaggtgctatcaaccagtattctatagatgatcaagaaattcaagatgatctacaatctctaggataa

SEQ ID NO: 36691 - DNA, 162 bp, Glycine max
  Peptide Sequence Number=SeqID_153469
atggattgggcagggggagcagaatttgtggaatgtagcaacttcttggctagactagaaggcattgatggtgttgacactgaacatgctgtatcagatgttggtcatatgcatgttcaatatgttgcggagattcacgtcatgcacgagaacaaggaataa

SEQ ID NO: 36692 - DNA, 387 bp, Glycine max
  Peptide Sequence Number=SeqID_153470
atggattataatatcgcctgtaatctgtttgtgatcggaaaagagatcatgatggaaaaaaaggacgtaccaacggtaatcccacggactcaagtgaagcaaatgcccaaggccccaacccaagcacacgaaactatgtctgagctggttgagattgccaattctggaatttgtccacctcgtcatcctcatgcaaccattgtgcagagaattatggagttcaggaaccgtgactggcatatttcgttttcttatgttgctagagatgccaactgcatagctcattctttagttggtattggagtgcgtcagctctatagtatttgcatttgggattcccctctcccttctctcaacaatattcttcgtagagatagtgtcaattag

SEQ ID NO: 36693 - DNA, 738 bp, Glycine max
  Peptide Sequence Number=SeqID_153471
atgtctttacatttacccttggcacacacttgcaaatgcgcaaatttggcatgcaaaacataccggtttgaaatgttttttgttagtcagaaaagaagaaaggaaaagtggtataaggtggtgctggacttagatgaaacactggtatgtgcatacgagacatcaagtttgccagctgctctacggactcaagcaatcgaaggtggtttgaattggtttgagctggaatgtgtatcgatagacaaggaaggagaaggcaaaccaaaaatcaattatgttacagtatttgaacgccctgggttgaaggaattcttaaagcaactcagtgaatttgctgacatggtgctgtttacagctggtcttgaaggctatgctagaccccttgttgacagaatagatgtggaaaatcgattctgtctacgactttatcggccctcaacaattagcacggaatatcgggaacatgtcaaggatcttacctgcatctcaaaggatctatgccgcattgttattgtagacaataatcccttcagctttgtattgcaaccagtgaatggaattccatgcattccattttctgctggacaaccacatgacacccagcttctagatgtcattcttccacttctcaagcaactttctgagcggaatgatataagacctttgctctatgaaaagttccacatgcctgattggttccagaaacaagggattccagcttccagttgggctttgtag

SEQ ID NO: 36694 - DNA, 2292 bp, Glycine max
  Peptide Sequence Number=SeqID_153472
atggaagaaacatttgtaccctttgaaggaatcaagaatgatctgagaggaaggttgatgtgctacaagcaagattggtcgggtggaatcaaagcaggtttaaggatttgggcccccaccacatacatattctttgcttccgcaataccagtcatttcattcggggaacaactagaacgagatactgatggtgttctaactgctgttcaaacattggcatccacttcaatatgtggcattatacactcaatccttggaggtcaacctttattgattttaggagtggcagagcctacggtgatcatgtacacgttcatgttcaattttgcgaaagagagaccagagttgggccgggatttgtttctggcatggactggatgggtatgtgtctggactgcactgttgctattcttgtttgccatcttaggggcttgctctataatcaacaggtttacccgtattgcaggagagttgtttggcatgcttattgcaatgctcttcatgcagcaagctatcaaaggactcgtggatgagtttcgcataccagagagacaaaattcaaaatcaatcgagtttataccttcatggaggtttgctaatgggatgtttgctttagtcctttcgtttggccttcttctcactgcattaagaagcagaaaggctagatcatggcgttatggtaccggttggcttcgcagcctaatagctgactatggtgtgcctcttatggtcctagtttggacaggtgtatcctacataccagctggaagtgttccacatggtattccaaggcgtctgtttagcccaaatccatggtcaccgggtgcatatgagaattggactgttattaaggcatgtaaattgcaagatatggttcatgttcctgttgtgtacataatcggagcatttatcccagcaaccatgattgcagtactttattactttgaccatagtgtggcttcccagcttgcccagcagaaagagttcaatttgagaaagccatcttcttaccattatgacttgctccttttgggatttttgaccttaatgtgtggcctgattggaattcctcctgcaaatggagtcataccacagtctccaatgcacacaaaaagtctggcaactcttaaacatcagttgcttcgtaacaaactggtggtaaccgcacgaaaaagtatgggaaagaatgctagtttaggacagttatatggcaacatgctagaagcctacaatcaaatgcagacccctcttgtttaccaggacccctctgctcgaaacaattcctgcttaggtcagagtgaaccttattatttgtacctcaagtcatcagcatatgacttcttgctatttatgccacatattattatgaccattgttcaggcacaaggactaagagaacttaaagaatcaaccattcaagcagctaccagtatgggaaacgtggatgccccagtagatgagactatatttgatgttgagaaagaaatagacgacctgcttcctgttgaggtaaaggaacagcgtctcagtaacttgcttcaatcaacaatggtgggaggatgcgttgcggccatgcctttactcaagaagatcccaacctcagtcctttggggttactttgccttcatggccattgaaagtttgccaggaaaccagttttgggaaagaatcctattactcttcactgcaccaagcagaagatacaaggtgcttgaggattaccatgctactttcgtagaaacagttcctttcaagacaatagcaacattcaccattttccaaaccatttatcttcttatatgttttggactaacatgggttcctattgccggggtcatgtttcctatgatgatcatgctcttagttccggttagacagtactttctccccaagtttttcaaaggggtacaccttcaagatttggatgcagcagcatatgaagagcaaacagctctaccattcaaccttgcaacacactcggagtttggagctggtgcttctcaagttggagaaggtgaaatcctagatgaagttattactagaagccgtggagagtttaggcacactagcagtccaaagatcacaagctccaccccaacaccaagaactgatcctaaaagccatttaagcccacgcctctcatttagtgctcgcgtgggtgagttcaaaactgagcagagtccacgatctggtgcaagaggtcccctcagtccaaaggcaggagaagtgagattatcaaatctgggaagaagtccacttaatccagattcaaaacagcaggaccaaaactaa

SEQ ID NO: 36695 - DNA, 2040 bp, Glycine max
  Peptide Sequence Number=SeqID_153473
atggctgtgtccaacggcgtcgaagctgtgttagagtttctaaggaagaatggattgtcggaagctgagtccgctctccgagaagacatcatcgagaacaccgacctcggaacctttgactacgagaagttcttcttccccatggtcccgccgccgccgccggtcagagtccgatctttctcccggccgtcggggctctccgccgccggcaactgctccatatccagctccgatgagttcgtcagcatcggtggttctcccacttctcgtgtttcttcttcagaattcataaatccatatggaatccattcctcgtctcagactcagaatgactctgaatcttcttcgtctgaaagattatctcaatttggcactgcacgtgattatcacgattttgatatgcagaatgaaccgtattggtataatgaaaaagatgatgactatttcatgactcctagttttgaagggccggacttctttgcgtgtcaaagtgaagataagtttgtcatgacagcagaaaaggataatcaacatgacaattctcgggaccttgattacaatcataaagaatttcaatcagaggaaaatagtaatggtggtttcatggacaaggcatgcctttataatagtaatccttcctctgtggaagatggaactgtgacatattcaaaagggtattgtcatgttgataacaacaaccagtttgaaggagaattagagggcaaggttgagaaacaaactgttgcctgtagttgtgaagttccattttgcaaaagcagtccaggttcaggaggttcttgcagtttggatcctacaaacttcggctaccctaatttgaaggaaatccatctgaatggttttcctttgaaggttgttggggacattaactcttttgactctacttcagagctaactgtgaatcaaagtttcgattactacactaaaaatgacagcagtaaggagtacaatggtccctatgacttaactatcaaagttactgaaaaagatctaccaaatggacttgacacctataaagcacgagatggtggagaattagctgaagagtgcctggatccagagattactgcagatggagaggatactactgatgatgagctcttaaagtatactcaagaggaagaatatgaagtatttgatctgagaattatacatagaaagaacaggactggatttgaagaaaacaaggaactgcccattgtgctaaatacagtcttggctggaaggtattatgtaacagaatatcttgggtcagctgccttcagtagggttgttcaggcacatgatcttcagacaggaatagatttttgcttaaagattattaaaaatgataaagacttttttgatcaaagcttagatgaaatcaagcttctgaaacttgtcaataagcatgacccagcagataaacaccacattttgcgcctttatgactatttctaccatcaggagcatttattcattgtaactgaacttctgcgagcaaacttgtacgaatttcagaaattcaaccaagaatctggaggggaagcatattttacattgaacagattgcagctcattactcgccaatgtttggaagcattgcaatacttacatagcttgggaattgttcactgtgacctgaagccagaaaacattctaatcaaaagttacagaagatgtgagataaaggttattgatcttggaagcagttgcttccaaacagacaatctgtgtctatatgtacaatcccggtcctatagagctcctgaagtgatgttaggccttcaatatgatgaaaagattgatctatggtctctaggctgtatcttggcagagctatgctccggtgaagtgctgtttccaaatgatgcagttgtgatgattctggcacgcatgattggaatgcttggctctattgatatggagatgttggtgaaagggcaagaaacgcacaagtacttcaccaaagaatatgatatttattatgtaaatgaggtgaaaaaacattttcttctcacttctgaatacaggttgtattga

SEQ ID NO: 36696 - DNA, 663 bp, Glycine max
  Peptide Sequence Number=SeqID_153474
atggggctgtctttcacgaagctgttcagccggctctttgcgaagaaggagatgcgtattcttatggtgggtctcgacgccgccggtaagaccaccattctctacaaactcaagctaggagagatcgtcacaaccattcccaccattgggtttaatgttgaaactgtggaatacaagaacatcagcttcactgtctgggatgttggtggccaggacaagatccgtcctctgtggagacactacttccaaaatacccaagggcttatctttgtggttgatagcaatgaccgggatcgtgtggttgaagctagggatgagctgcacaggatgttgaatgaggatgagttgagagatgctgtgcttctagtttttgcaaacaagcaagatcttccaaatgctatgaatgctgctgaaataactgataagcttggtcttcattctcttcgtcagcgtcactggtatatccagagcacatgtgccacatctggtgaagggctttatgaagggcttgactggctctcaaacaacattgcaaacaagcctaccaatttgaattcctctattgatgataaacccaacaatgccaagaaggacaaacttcaatgcacaaactatggaggggagttacttggtgcacccagcattggtgcatccaacacgtag

SEQ ID NO: 36697 - DNA, 372 bp, Glycine max
  Peptide Sequence Number=SeqID_153475
atgagtgaattggtgtacagaatcagtacgacgaatgagtgggaggagttacagagcaatgggtccagtttgggtggggaccttgacaagtcttctggtttcatccatctcagcaagctcgaccaggttcggtcaacattggagaactttttcttgaactgcaaggaggaactctacctgcttcgaattgatgctaaaaagcttggtgatggtttggtgtatgaaattgtggatggttcaaatagcttccctcatttctatgggccatctagaagctttattcctctccctcttgatgcagtaacaaaagcagaaaagctaacactatcagatggtcgatttagttgtagtttgcttgatttattctgctga

SEQ ID NO: 36698 - DNA, 249 bp, Glycine max
  Peptide Sequence Number=SeqID_153476
atgtgtttttatgcacaaacacatgccaaaaaagtgtacctctcacaaaggacaagaagacaaataaataaggtagcgggaaaaaatggtaaaggaagtgaagtaggagatgagggtgtgaagaaaatagagaaggagaaagagaacaagatggcagcatgtgagaagagaagggggaggggtgggggcgtagggaaactgctaacaggggtaccttcatcctttaaactgaatctaaaagtagggtag

SEQ ID NO: 36699 - DNA, 372 bp, Glycine max
  Peptide Sequence Number=SeqID_153477
atggaaaataagaagagaaagggaaaagacgatggggtactggaagaagaagaagaagagatgatgaacaagttttacacgctgttgcggaggttccgagacgcgcgcgatggacgacgaaaggagcttgaggaactacagaagagtgagaggaagaagaagaggagtaaagtggggacagagcaacaccatgtttgggtgccatcgtttgaattggaagatttcataaacgaggctgaattcagaggacaacaacctctgcgattcccaacttcatctgcatctccttcgccacgtggcggtggcacagacaaacaacgtaagaacgacgaccaacactctcactctctggatctcaacctctctctctag

SEQ ID NO: 36700 - DNA, 192 bp, Glycine max
  Peptide Sequence Number=SeqID_153478
atggaggatggaaacttggaacatgcctcaactgagaaccaaaacctttggttgcaagatttgtatgatcaggttgatgaaacagtgattttaaaaccttctaattttgttacacttgtggatagtggtgaaagtgatcacaagagggcactgaagccttacatcatcatcaacaatgtcaacaagatgtga

SEQ ID NO: 36701 - DNA, 1794 bp, Glycine max
  Peptide Sequence Number=SeqID_153479
atggttgggatccacagattaccaagccagtctacaaaccattttttaaaacctaatattgctcttaagttgcatatccgagacaaagcaaaaattctaagtgttaaggtagatacacatgaagcaaagaaggagaatgtccaagcaaaggtggctattgtcaccggtggagccaccagaataggcgcagaagcagtgaagatatttgtggaaaacggagcatccgcagatcatagcagacatcaaggacgaattgggtcacaacttggctacttcatttggctagagaaagtgagttaccgccactgtgatgcgagagaagaaaaacaagttgaagaaacagtttctttcaccttagagaaatatggtagcttagacatccaaggccctttatcaagcattctagacttcgacaacgccatggccgtgaaccttcgcgggatgcgccggcaatgcatgattacaccgcatccaaacacggccttattggccttgttcgatatggagcctggtgaagtagaagctatggagtatgctttggcgaacttaattgcatggaatcaccggttgatccagcgcgcgctggatcgagaacaagatcttgccatagacgaggttcgcgttgaagtggtagagatggaaggagaggtacgggaacgtcgcggtgatgatgcggcgaaactcagtgctgcagtgcatggtggcgatgaagtggaacacgacgttctccggacaagacacatgctgcagcatggagaacacgccagcgaaggagacgcggaggtaggtcacgtcatcgcgatgtggatcacggagtcactttcgcatgcagttgcaacattctcttctattgcggaatgccagtacctcgtggaacgttggaagctagtaggtcgccgaaaaatgcgcatccacaacagcgaaaaacagcaccaccacacactagtgagcgggtattttcaacccttcacacagattttgctggtacaaattttgcttgacgcaacagtgattaggcgttcatggtacattccatctctcaggttggagggtaaggtggctcttatcactggagcagcaagtgggattggtgaagagacagtgagattgttcgctgaacatggagcacttattgttgcaacagatattcaagatgaacaaggtcaccgagttgctgcttcaatagggtcagagagagtgacttaccatcattgtgatgtgagagatgaaaaccaagttgaagaaacaatcaatttcactttggaaaaacatggtcgcatagatgttttgttcagcaacgctggagtaataggttccttatctgggatccttgaccttgatctgaatgagtttgacaacaccatggccacaaatgttcgtggtgtagctgccacaattaagcacacggcacgtgccatggttgctaaaagcacccgtggatccatcatatgcaccactagtgtggctgctactattggtggaacaggtcctcatggttataccacatcaaaacatgctcttctggggttggtgaaatcagcttgtagtgaacttggtgcttatggaataagagttaatagcatatcccctttcggagttgcaacacctcttgcatgcaaagctttcaactttgagcctgagcaagttgaagctaatagctgctcacaggctaatctgaagggtgttgtgttgaaggctaggcatatagctgaagcagctttgtttcttgcttctgatgatgctgctgtttacatcagtggtcacaacttggtggtggatggtgggttctctgtg

SEQ ID NO: 36702 - DNA, 2328 bp, Glycine max
  Peptide Sequence Number=SeqID_153480
atggacgactgttgtgccgtttgtgctgagcctttggaatgggttgcgtacggaccctgcttgcaccgggaggtgtgttccacgtgcgtcgctcgtctccgtttcatctgcgacgatcgcctttgctgcatctgcaagaccgaatgcaaccttgttttcgccaccaaggctctaggtgattatacaaggatgatcaatgatttttcgacccttccttcagaggtgagggagggcaaggttggatcatattggtaccatgaggatacaaatacattttttgatgatatggaccattacaggatgatcaaggctatgtgcagactttcgtgcagtgtatgtgacaagattgaggatcaaccacaggatgctgcatcaaggcggcgagcgaagtttaggaatatagggcagttgaagggtcatttattccaccgtcacaagttgcatatgtgcaatttgtgtttagaaggaaggaagatccacttccgtcaagagcacttcttatgtgaagatgaggcttgccttactaagaagtttgttgtttttcaatctgaagcagagatgaagaggcataatgctattgaacatggagggcggatgtcacggtccaagcgtaatgctgctcttcaggcaactttcattcctcccttacagataccaactagcttccgatacagacatggtaatgaacatgagcaacgccgtggaagaggtcgtacgtttcgtcgtgatactgaaaatcaactttctatggccattgaagctagtttggaaacagctaatgcagagcgaacatttcgtgatcaatcgacatcaagtattgggcaaattgctgttgatgatgggaatgatgatattgattctctcattcagccatttgaatcattagctgctggaggttctgaatcatctgcaagataccttcaagccttggggcatagctctagaaatgggcctctggaagattcttcctttccacctctacccataacttccagcaatggccagcaaaggtccaaacatgaactggaaggttcatctagtaacactatggctgcacgtctgcgtcggcatggcaacagaactgtatccgttgtcaattctggtaatgcttggccagcagcaggccgtggactggtacaaacatcaagtaatccttcacaatctaaaccgtcaacaaataatgttcttggactgtctcgtaacactgggcagatgaaaacagtaattaacagtggaccttcatcatcaacttatgcaggttctattcaggctacacaaagaactactcacggacaattacctgctggttcatcgaggaacacacgcgacaatgtcagaattgttcactctgcatctgctccaaatctcatggagaacaactctgttgaaatttcaatttctgattttcctccagtttctgctgcacaagtgagtaagttacctgccagcagccagtctaaattaaacgtggaaaattttcaatctgctaacaagtctttggttgaaaagattcgtggtgctcttgattttgatgaagaaagatacagtatatttaaagacatatctgcccaatatcgccaaggcacaatagatacaggtacatatgtggactatgtgcagcagtttggcttgtctcatcttgtgcttgagttggcaagactatgcccggatactcagaaacaaaaagagcttattgaggctcacaacgctagtttgcaaagagatgctttcccagaaattaacttagttcgaggcactgctagcacccatcacaaagacggtaatttaaacaagaaaggtaaaggtaagtctgtagatagtagggggagtaactccacagagaaattagcagatagctttttaagcactgtacatcagctacaggcaaattataaatcttcagaagagaaagtggaggtgctatcaaggggtgattaccgcactgacaggggcaaattaaaaatcaagcagcagattgattcaaatcctggtagtcaacctacaatgaagcttggtgggcagactgaaacatcaaatggcagtttatccgatcaaagtaaagaggatgggggtggtgggaacaagcaacgcaagaaaacttcaaagttcctgagagtgcgccttggtgatggttctgtttcatcccttcttgatcaatcagatcctggaacaacagacagctcagaaggtaacaatgatgacgttggaggagggcctcctgtgcgaggtgtttggcgaaaagggggagccatggttgaactgcaatataaacatgaatttggttttcggcttagggagtggtattggattatatcggatttaagttag

SEQ ID NO: 36703 - DNA, 1845 bp, Glycine max
  Peptide Sequence Number=SeqID_153481
atgtaccctagtgtccagaggccccttgctatgcgaagtatggtgaatggtcattgtatgcagccttgccattgcatatgcaaagagactgttttcggatttgaacccacgaccaaatgcactcaacatacatctaatcatcctgataaagttgtattgcctattgaaaagaaaagaagaaaacaggttctgagcattgattggtcctgtgggattgaaaatcttaagtgtactgactgcatagatgttacacttcacggttcttttgctgatatgactttgttatctactgattgccatacagaaggagcttgtaatatgctatttatattgaccagtcctggacaactggatctttatgacaatgattgtttgtcctctacaatttctcagcaagaaaagaaggcttctgttcccccagtgctgtatcccatcctcatacccactcttgaaccacacatgacaacagcaaggcttgatgtggtatgtcaagatgtgaagtcatttagagccctgttcgagattcttgtagctgcaaagcatcgttcaatacaaaataaaaaaagtattggtataaagtggcctttgactggtggtgttctaggtcagcctttcaaagaaaaccatcctatcattcaagtatacatagcaggttaccaagatggatctgttcggatatgggatgctacatatcctgctttttcacttgtttatgacataaaatctgaggttaatgatattaacattggcaatgcaagtgctcctgtgtcagcattgggtttttgccctgatactctacatcttgctgtgggcgatgaaagtggtgttgttcgtctatatgggctaataaggagttcagatgactccactttgcacttcgtgacagaaaatggaactgaagttcataatacgcataaaggggatggacctcattgcaaagctgtgttttcccttcaaaattctgctgtatacagcctacagtttgcaaactttggagggaagcttgttgtcggatatgaacatgggcaggtggctatgcttgatatcagttcatcatcagttctgtttgttacgaaaactgaatctaacacttcttcggcagttgtttctatgcatgcaaatttttcagacagcagcttaaacaaaccactggaatctgtatctgatatttctgaaaatcctggaatgggactagtctatgttatgacaagggatgaacactttgttgcaatagataccatgacagggaatatggcttgcagtagaacaatgagccccagcgtaaaatcaaatgtaatttcaatgcacattataggcaatacttctgacctatctgctgaaaaactgacatccacctcacctcagaagagtgattcaggaatgcaagctaacatccaatctgaaaatgcacaagttgaagatgaaagtgctgttactgtagaaaattcatattttggacagataatatcaaactcactcattttactttgttatgagaatgaattgagcctacactctttaaattttgtgattgagggtagcagtaagtacatacgaaaggtgaaccttgtacaacgatgctgctggactacaactttcaagaaagatgagaaagagtgtgttttggttcttctgtatcaaagtggagacattgaattaagtagcactattcagttcatgagtggagccacatttactttatactctgcagaagaaatcatgtccttgccagctttggaagtgttgggagaaagctctttaatgtcgatcctcagatggaacttggaaaccaacatggtgaagacgatatgttcttcatcaaatggaaaaattattctggtttga

SEQ ID NO: 36704 - DNA, 501 bp, Glycine max
  Peptide Sequence Number=SeqID_153482
atgaagtttcaccttgatgatttttatagcaaaaggagggcaaagttggggaccattgtatctgctcatggatgttggcggtgctttaataaacccctcattcacaatggagcaaaggctgagtttctgagaagggatgtagaagagacaatgtctacaaacttaatcgcttccaacaagttggaaagccaatatgttgaagaggactttcaacaaagagcagggttttggggtttcatcatgcaaactatatatcagacttgtgcaggggctgccatcctaacagacattgtattttgggtttggggtgttatagtcccattcttacaaaatcctcacttaagactaagcccattgacgggttgcatgcatgcgttgaatgcatttttcctccttttggatacatctctcaataatctgattaccgaagtgaaacgttggagaacagaatcaaaagtacttaaagaaactgcatccaaagttttttccaaagttgtttaa

SEQ ID NO: 36705 - DNA, 3996 bp, Glycine max
  Peptide Sequence Number=SeqID_153483
atggattcggcgaacggaacaactgcggtggaggaacaacggttaactgaacggagcatgcaccgtggcccctatctcggtgacatctcagctctctgttttcttcgcattcccaatctctctcttccttttcttctcgccggtctgggttcggaaattacgttgtacgatttagaactgagtaagagagtaagatccttctctgtattcgaaggagttcgcgtccacggaatcgcttctagtttccctcaagagaatgtaattgctgtgtttggggaaacgagagtgaaactgtttagcttcgcatttgatagcgcttctcggagtccagagttgacgttcgttcatttgttgcccaagtttggtcactgggttttggatgtttccttcctcaagggatccttacctcattccaatgtggagagtgagtttcttgctgtaggatgtagcgacaattcagttcacgtttgggatatttctaactctaaaatggttcttaaggttcaatctccaggttgtgtttgtcgatggatcatagtgcggtgccttctgtactcaatgcgattatggggtcacaatcttgaagttttccgaattgcgtctggtacaatatttaatgaggatcaactgtatgaggctattcatgtatgtaaacttattggacatgaaggttcaatattccgaatagcatggtcgtcttgtggatctaaactgatatctgtctctgatgaccggagtgcacgtgtctgggctgttgctactgaaagggagcattcattgtgccatgatcctgttgcccttgtcttatttggacattatgctcgggtttgggactgctgtatgtatgataacttgattgtcactgtcagtgaggattgtacatgtcgtatatggggagttgatggtaaacaactgcaagttattaaggagcacatgggtatatggagatgtttgtacgacccaaattcatcacttcttataactgctggctttgactctgctattaaagtacatcaacctcgtgcttctctgcccaggggcttggaagcagcacaagggtcccctggtaggacagagatgttttccatttgcatccctaatgtgttgaatcatagtggatttatggacagcaagagtgaatatgttcgatgtttgcgcttttcctgtcaggattctctttatgttgctaccaatcatggttatctctaccttgctaaattatgtgatactggtggtgctcagtggaatcaacttgtccaggtcagcaatggagcaccaattatctgcatggatttattgtccaaggactcttttgaacttgactgtggtgctgaggattggattgctattggagatggtaaaggaaatatgacagttattggagtttctaacgatgattgtactcctactgtgagattgtgctttacttggcctgctgaaatggagagacagctcttgggtacttattggtgtaaatctctgggatgtaggtatgtcttcacagctgatcctagaggaacattgaaactctggaggttgcctgacccttcacaatctgatcttccgagctccatgaggagtaacaacgtatcatgtatagcagagttcacatcaaattatggaatgcggataatgtgtttggatgcatgcatggaggaagaggtcctagcatgtggagatgtacgtggcaatatggtcctgttccctttgctaaagaatctggtgctgggcatatctgctgcacaagaaatgaagatacctccagtaaatcatttcaaaggagttcatgggatttcaagtgtctccagtgtttctgtgactaagcttggttataatcagattgagatatgttcaactggagcagatggctgtatatgctatctggaatttgataaagaaatgcagaatttgcaatttacggggatgaaacaagtgaaagggttatctttgattgaatatgtttctgtggataacaactccggtgataaattgtcaagcagttatgctgctggttttgcatcagtggatttcatagtatggaacttagctaatgagaataaggtggtgaacattccatgtggtggatggcgacgtcctcattcctattatctaggtgatataccagagatgaagaactgctttgcctttatcaaggatgaaatgataaatatacatagacactggattcataatagagatgggaaggtatatcctcaaagtttgcacatgcagttccacggtagagagatacattccttgtgctttatctctgatgatgtgcttgttggagataattataagtgtgccttattttctaaatcaagttggattgcaactggatgtgaagatggaactgtgaggttgacatggtactctccaggtattgaaaattggtctacatcaaaactgcttggtgaacatgttggaggatcggcggtaagatcaatttgttgtgtgtcaaaagtatacaccatttcatcagatacgggcaatgtacctgatgggaggattgaactgaatgctgctgttgagaacaatgataacccaacattactaatatcagtgggtgcaaagcgtgtcttaacttcttggatattaaaaaataggaggctggacaacaaaaatgacttcgtaactgatcatcagtgtaattcagaaggagttgatgatcagtttttgtcaaatttttcctcatcaatgacgttccagtggctttccactgatatgcccgccaaatattcaattacacacaatactcccgaaaataatgtggagaaaatagttggtattgctgaaaatgtttctaatacaaatagtgatgctagaatgggatctctggtttctgagagcagaacggcaaacttgatcagagataagcatgaagatgactggagatatcttgcagtcactgcttttcttgttaaatgttctggttccaggtttggggttgctttactggttcctttattggcacctgttttatcattgcagcatataatctttcccatgtgtaggcctcataaagaaaacattcaagttggaaatgtttatattgtgattagtgggtctactgatggaagtgttgctttttgggacctaactgatagtgttgaagcttttatgcagcaagtttcagtttgtaatgttgaaaatttttttgattgccaaaaacgaccacgcacaggcagaggaagtcagggtggaagacagtggagatctttaagcagagacttatcaaagaaaagacaagacggcaaactggtcactttgaaagccgaagacaggacccaaagcatcagttatgctacacaggggacctcttacatgccaagcagttctgctgactgtgagatggtttgttctcaatctacacatatggttcccccagagttagaaagcaagactgataatttgtcagtggaaatatgtgaaatacggcctctatgccgtttgcaaaatattcaccaatctggtgtcaactgtctccatgtttcagagataaagggtgggcaaattactgataattgtcatgtgtacagcatagttaccgggggtgatgatcaagcacttcatcatctcatggttgaattatcacctaaatcaataaattcaagtgaaggaattttgatcccagacatcatacatttcgtctctgtacctgaacatggaaaggacatcaatttacaaagtcagagcaagaattataagattaaattcttaaattaccaaaaattaccctctgcccacagctcttctgtcaaaggtgtctggacagatggatcttgggtgttttcgactggacttgatcagcggatcagatgctggcatcttctgcagagcaaactaattgagcattcatatctaatagttagtgtgccagagccagaagcgttatctgctagggcttgtggcaggaaccattatcaaattgctgttgctggaagagggatgcaaataattgaattttctgaatctttaaagaagattggtgactag

SEQ ID NO: 36706 - DNA, 294 bp, Glycine max
  Peptide Sequence Number=SeqID_153484
atgccgattgttttgcgtcataagtgtgcgaataattctaaccggtataaagcgcttcaacggaggggaagaggttttataggaaagagggacgtgcctgggccaccactagtggacgtgcctgacaggctaccactagtggtcgcgcctagggccccaccactactggtagcgcctgacaggccaccgctagtggtcgcgtctggcaggccaccacttccacccctgtctcatcgtcctgtcaagtcacgccacgtgtcgcgttctgctggaacacgcctctcaggttcttag

SEQ ID NO: 36707 - DNA, 501 bp, Glycine max
  Peptide Sequence Number=SeqID_153485
atggggacaatgaagggtcgcaagaacaacaacctctccatcttcgtggtggtgttctccatcttcctctttgggctcttcatgtacaacgaggatgttaagtccattgctgaattcccattctcgagtcccaaagcgcatgagacacaagaaggaggagaacctaataaacatgttgattctgttcaagacagtgttgttgttcaaagggagagtgagaagaaggatgtggaagacactgccacggtaaaagtttcttctaagaggagtacttcaagggctcagctagagaagagtggtgctgaggatgaggattctgatgagcgtgttgatttgaaaactgttgtggagaaggagaagaagattgaaatgccacgtgcggaggaagaggaagaggtggaagaagaagaagaggaaaaagaagaagaagaagaagaggagaaagttgagttgccaccagaagattgtgacttgttcactggggagtgggttttggataac

SEQ ID NO: 36708 - DNA, 294 bp, Glycine max
  Peptide Sequence Number=SeqID_153486
atgtcgcaacctacctcacgacgggacggtgaaggcaaaatagataagccaaagcattcatctccaagggagaaaacgagcggagtcgccaccaacatttattcgaggaaaacgttagaaaaaccaaaaagaggtctgcaaattttgaaaagaaggattcggaagttgtttacgcatggggaagggtcacaactgttcaagcaaaacaactgtgtaatcgattacactaattctgtaatcgattaccagagaggatttcaaggaatatcgccaacagtcacatcttttcattag

SEQ ID NO: 36709 - DNA, 270 bp, Glycine max
  Peptide Sequence Number=SeqID_153487
tcgttccctctacactccaccaaaaactgaagttcgtagtggaggggcatttggtcattgtatcaggggaggaagacatcttggtattgtcgcaacctgcccttcggcgggagggcgacgcgtgactcgcgggatgcgtgttccacgaaaggaatacgcgcggagtcgccaccaacatttatttgaggaaaacgtcggaaaaaccggaaaagacccgatctacgaactttttagtgaaaggttcgggagttgtatttacgcacgtggaag

SEQ ID NO: 36710 - DNA, 342 bp, Glycine max
  Peptide Sequence Number=SeqID_153488
atgtttctcagatctaccccttccccctcttcttcaccctccctacaattactctttcaactccatgacctcctcacccttctccccacgacaatttccctcttcctcgttccaacccatggcagaatcaatgccattgaagaccatctcaaatttgaattcaaaagtacttggatgggactcaagcgaaggagatggagttgttcctatcgtgcgatgatggccacaagggctttgccaatgttagaatcggaatcctgggtggagaggaggattgaaacaaagggattctcatccctttctctgtcattgtgggtggtgaggagggaaagtcataattag

SEQ ID NO: 36711 - DNA, 1161 bp, Glycine max
  Peptide Sequence Number=SeqID_153489
atggtgtcatgtggtctgtggacggtggcaaggcttgggggtcttgagccactggacacccaaaaccacattggcaccacacaggggcaagacatgaaggtccaccacaaattggatgcgcttgatagtaatggtgactgcttcacagagttggtcacaatgaagatgttgaccattcccgaccatgacgcaaagcgaaggagtggtgcgagtagtgaggcccaatttctacaccaatggttcctgaataaagttgtgggtgctgcccccatcaagcaggttaaccaattggtgagtggcgatgtggcccaacagacacaagtcgggttagtggcatcaagtgggtcgggtggtagctccaactgggtcgggtcttctaggtttgcgtcttcctcatctgctattaagaggaacattcgagagacacatttgtgccctcgatggaattgtttgtcacaattgaaacacagaccgcgttccctacgcaaagccaattcctccggggagaggcacttcagaggcattggtggtggggttttcggtggggctggaagcaatggggtcacgactgccggcaagggcggcagaggtggcgcggtgagagggggtggacgtgcgcggctcaaggaaccgaatctccagagtcaacctcgatataaagcaactcaaaaggaacaatgcaggcaagccgacaatacgattcgcaagatcttcgaattccgaaaggcatttgcatctacactaaccattattggacatccattggaaccaggccaatgcacgcccctccatgtagaaggaggcgatgatcaacctctcgtgctctggcgtggcacggtgggcataggtggagtggaattggacgcgaacaaagatggagaggaggtctcaggctgggctaatttctggattaattcgtcgagtttcagggtcattgtgtgtactgtttctatcaaggaaagagcaccaaaattgatagactattctggtatagaggaccagaaacctcccaagaagagaagaagaggaaactcaaggcatcatcctaacggaaaatacagaatccaaggaaatgacagacaagctaaggaaaatgttgattctgttgctggaagggaagattttgatgcctactcagcaatatccactctgtctcagtga

SEQ ID NO: 36712 - DNA, 1578 bp, Glycine max
  Peptide Sequence Number=SeqID_153490
atgaattcgattttccggccatacctccgccgctttgtcatcgtcttcttcgatgacatcctcatatacagtcgtactcttgaagggaacttatcccacttggcaactgtgtttcaagtccttgtagagggccagttcattctcaaacgagcgaaatgctccttcaaacagactcaggtggagtatctgggtcatgtggtattagtcatgggagtcgtgccggtatctttgaaggtacaggccattcaagactggcccgtgcctcagtctatcagggccattcgtaacttcttgggcttggcgggtttctaccgtcgatttgcccgtggatatgcttcaattgttgcacctctcatcaaggccaccactatggattcgtttaagttaaaggacgcccttatgacagcccctgtgttgtctctcccagactttgaagttcctttcaccatcgaaacagatgcatctggcagtgggatgggtgcagtcttgtcacagaaggggcaccctattgccttcttcaggcaccgcttcactattctgaccgatcatcacagcttgaaggaattgctcactcaggtgattcaaacaccagagcaacaaatgtatttggcccatctaatggggtatgactactgcatcaagtatcattccgacagctccaacacagtcaccgacgcgctctcacgggcttcggaacgatgtggaaagctttgtcactctgcccttgctgttgcgacactattcattgagatcgtaaaaaagatacacggaatgcatcggagtttggtgtccgacagggatccacttttcctgagtcatttttggcaagagttgttccgcttgagtgggactcgcctaaggatcagcttttcttatcaccctcagagtgatggccaaattgaggctggctccactccttttgaaatcacttttgggagaaaaccttttaactttccagagtacctcgccggaacatccaaaatttatgccgtggatgaccttctctgtcatagaactgagactttcactaaatttcgaaagaaacttctgaaagctcaggagacaatgaagcttgttgctgattcgaagtgcagggatgttgagttcaaggttggggttatggtcaggttgcgaccttcccgacaatccacagtcacagggattaaaggagctcactccaaattggaaaagaaattctatggctcatttgtaattgtggagaggattggcccagttgcttacaagcttcgcctacctgaaggagcctgtgttcatcccatcttccactgttccttgcttaagccatgtcatggtgctcaaggtgacgaccaacaacctctgccaaccaccgccatcaataatcaacctattattactcctcttgtcattgtagattcccggtgcttgccagactcatctccaccaaaatgggaggacaaggtgtttccacaagtggcagggaatgttagcaatcaaggggagcaaacagagggtaacaggcaaggggtgcaaacagtgagaaacaagcctaggaggattagcaccatacctacgtatttggaggatttcatccactga

SEQ ID NO: 36713 - DNA, 1380 bp, Glycine max
  Peptide Sequence Number=SeqID_153491
atgtggttggttttggtgcagattttggatgaggttgaggttgcgaataagcatttcgggaagctgaacacgattgtgatgaacgcggtggtggaggcttgtgttcgatgcggtgacatcgattcggcgattagaatatttgatgggatgaaaaaacgcgatggttgtggtgtggatactggattaggcgaggcacgaagagttgacgaggcttttgaattgcttgaaactgtggaaaatggtactgtcatgggaagtccaaacttgtcagctccattgatctttggtctgctaaatgccttgatcaaaacaggagacttgcgtcgtgcaaatggtctccttgcctgttatggttttgtgcttcgtgaaggtgacaactttccagtctcagtatacaacatactaatgaagggctacataaactcaggttgtccacacactgcaataaacatgctcaatgaaattttacgtcaaggcataatgcctgataggctcacatataacacactaattttagcatgtgtcgagagtggaaagttggatgctgcaatgcaattttttggggaaatgaagggcgaagcacagaagttcgtcaatgatgatctatttccagatattgttacatatacaacaatgcttaagggttttgggcggatgaaggatcttgcttcagttctgaaaatagtgctggaaatgaaatcttgtcgtgaattatacattgatagaactgcttacactgaaatagttgatgtttttctaaaatgtggctcagttaaggaaatattgaagcaggctggtctgaatccagagttgaggccaaagcctcacctctatctttccatgatgcgtgcctttgcttttcttggagattatgatctagttaaaaaattgcataaacggatttggccagattcagcaggaaccatattattagttgctcaagaagaagctgatcaccttctcatggaagcagcactgaatgctggccaggttaatgttgccattaaaactcttactgagattgtttcaagatggaagggcatatcctggacaagtcgtgggggcatggttgcttattgtattgaggcgatgttgggattctcaaagtccttattcagtcctcacttacttccccaggtttcaccttctgaaccggttgagaattatatgatacaatttgaagcaacacggccactacaaggtaccataaaactgaggaaagtagttatgcgtttttttcatgaagcagttgttcctattgtagatgaatgggaaagttgtacagggctgttccatcgtgaagactgcaaccagctgacggctgctctaattcaagaatctgagtcgcaattttgtattgcactaattgtggctgaatag

SEQ ID NO: 36714 - DNA, 420 bp, Glycine max
  Peptide Sequence Number=SeqID_153492
atgctgatcaacttgatccgcaacaacgaaatctacatgcggatcaagttgatttgtaaacttcttctggatcaacttgatccgcatgatctgtcgtacaccagaacgcacctaacattgcgtacctcgtatgctatgccgacgaccaccgtaacaccgatcaccaataccttcaccttcacggcaccgaacaaaaccaatcgcaagaaaatgaacaagcagggaagcaccgaccgaagggagaaaagaaagagacaatgcgcaaggaaacacattgttccgtttaaaaccgtggagcaaagcactattcatggcaacactattcatggaaaagaaagaaagcaagaaggagcagcaggggtactttgggtatttttgaaagttgctgggtgcaccaacaataatgttgggtgcaactag

SEQ ID NO: 36715 - DNA, 740 bp, Glycine max
  Peptide Sequence Number=SeqID_153493
atgtctgatataccttttagaggcttgaaaagtgcgagaaaacgagctgtgttttctgcgttttctggaaaatgcgatgaacttgctaaacgagcatgctgcgctaagcgagttcatcaatactcattgtatatgacttccaggaagagaaagagtggtgattcaaggcccaccactcaatatgatacaagaagattctactcttttgaggcttggaccagatatactaacaatgttttgggaagacacatattagttgaaaggaaagtggaaatctatcacacaaagctggatgaattcaagggcgagctggagaggcataactttcacaagcgcctcaccaacttagctgatagtagcattggcctcccgttggtgaagaagttctacaccaaccactatagttctaaggggcctgcacctaaacaactcaaaattcggggccacttaataaggattgatgcagacaacctcaatgcctttctagaaacacttgtggtgcttgttgagggtgaatctttgcccgactactcaagatattgcaggatgcctactaacactaaagaaattaaggctgcactgtgcatacccgaccaagggtttattctaaatgctaaaggtcacccggggaagatcctcgttaaagacctaaccacccttgctcaggtctggagtgttctatcctactccaacctggctccgacctcccacacatcagatctgactgtggatcgagctag

SEQ ID NO: 36716 - DNA, 5883 bp, Glycine max
  Peptide Sequence Number=SeqID_153494
atggaagctaaggttacaacattggagagtgaagtgtcggaggtacgtaccacgctcatggaggttcaaaacaatgtgaaggagaatcacgcgaccttaatcgcgttgttggagaagtgttttggaaaatccgttcagcaggatgaaggtgcgagtggggtgaaacagaaaacgccggaaggaaaagggtatccagagaaggagggctcaagtggtaacagttccggtgaaagcggaggtgcggtgttgtcggaatttcgacacgctgtgaagaaagtagagcttccgatgtttaacggcgaggatccggcgggatggatctcgcgagcagagatctactttcgcgtccaagaaacgacgccggaagtgaagatcagattggctcagctgtgtatggagggatcgacgatccattttttcaactctttatggagtgaaaatgaagggttgacatgggaagggttgaaagaagcactgctaggaaggtatggaggttacggagagggtgatgtgtatgagcagctgacggagttgagacaaggaggaacagtggatgagtacataacagaatttgagtatttaatagctcagattccaaaacttctagacaaacaatttctgggatatttcttacatggattgaagccggagatttgtgggaaggttagaagcttggcgacgatgggagagatgaatcgatcgaagcttcttcaggtgactagggcggtggagagagaagtaaaaggtggtgggtcaaatttctatcgtgggcctaaatctggaaatgggtcacaccggcccaattcctatggatccagcaaatccgggtccgattgggtcatggtaaaggggcgtgaggtggaagcaacagggggtgcaagaagtaatgctaatgggcccaatgctgataagccagcccattcagatagaaggaggactgggcctagagataggggcttcacgcatctttcctaccaagagctcatggataggaaacagaaggggttatgttttaagtgcaaaggcccctaccatccaaaccaccaatgtcccgacaaacagttacgcattttggtggtggatgacgacgccgaagcagagcaagaggcgaatgtattggcggttgaggtagacgaatcagaagaggaagagggtggtgagatgtgcatcttaaacttgaatcacattgcttttgaaaaccaccaaaccgtcaaattccaaggtcaagtccaaggggttcctgtgctagtgatggtggatagtggtgcaacgcacaattttatctcacaaaagctggtgcataaaatggagtggccaattgaagaaacacctgtgatgaatatcaagttgggagatgggtgttacaggagctcaagaggagtttgttgtggaatggagttgggcattgggagtttcacaatatctcccaagttgcatttatttgagttgggaggcattgatgttgttttgggcatggaatggttgaaaacattgggtgacatgatagtgaattggcgccagcagaccatgagtttttggagtgataagaggtgggtgactctacaaggcattgatgggcatgagaagaagttagtagctctgcagagtatcttgagcaaacccaagctcagtgatcaagaagtgttgtggggcttagagactcaagaaagaagtgaggtgcagtgtttgactaaacaccagcaggtggagttggatcatttattggtacaatttgaagatattttcagagaaccctcaggcttgccccctaggaggaataaagagcatgcaatcaaccttgtagaagggcatggggctgtcaatgttaggccctatagatatccacatcatcataaaaatgaaattgagaggcaagtgcaggaaatgctcactgctggaatcattagacacaacactagttcttttagcagccctgtcattttggtgaagaagaaggatagtacatggaggatgtgcgttgactatcgtgccttgaataaggtaactataccagataaatttcctattcccgttattgaagagttattagatgagttgcatggagctaatttcttttcaaaacttgatctaaaatctggttatcaccaagtgagagtcaaggatagtgatgtatgcaagactgcattcagaacacatgagggccattatgagttcttagtgatgccttttggactcatgaatgccccttcaaccttccaaagcttaatgaatgaggtattcagatcattgttaagaaaatgtgtgctggttttctttgacgatattttgatttatagtagaggatgggaggatcatatgaaacatttggagactgttttgaaaatgttagctcaacacagtttggttgttaacaaaaagaagtgtcagtttgtccaaaaatcagtagagtacctaggccatgtaattagtgaagcaggagtagcagtggatccgaacaaagtgaagagtgtgatccaatggccagtccccaagaatgtgaaaggggtgagggggttcttgggacttactgggtactacagaaagtttattagagactatgggaaggtggctaggccactgacagagttgacaaagaaagataatttcaagtggggggtggagtcccaacaagcatttgaagaattgaaaagaagactcactactgcaccagtgttggccttgcctgatttcaccaaacagtttgtcattgagagtgatgcatcaggtggaggcattggagcaattctcatgcaagacaaaagaccaattgcctatttcagcaaggcattagggaggagaaatctgacaaaatctgcttatgagaaagaaatgatggcagtagttttggccatacagcactggagaccttatctcttaggcaggaagttcacagtttatactgaccagaagagcttgagacagttgatgcagcaaagaatagttactgctgagcaacagaattgggcagccaagttgttggggtatgattttgagattgtgtacaagcaaggaaggttgaacaagggggcagatgctctgtcaagaatgtatgaaaggacagagttgaacaccatcacatcttatgcacaatgggatcagaaacagcaagtaactatggaaatacaaaaagatgagaagctccaatctattattaaggctttgcagcaagaccctaaggcaaaaccagggtatgtctacaagcaaggtgtgttgatgtacaatggaaggaggattgcagcaaatgtatattggatgggaatgaaagggactgttcaggagtatgtgaggagttgtgatatctgtcaaagacagaaatatatggctactgctccaggaggtttgctgcagccattacctattccagagcaaatatgggatgacatatcgatggattttattactggattgcccaaatccagagggtatgaagctatcttagtagttgtggatagactgtccaagtattcacattttataccacttaagcatccttatacagcaagaagcattgctgatgtgttttgtaaggagatagttaagcttcatgggataccagtgagtatagtaagtgacagggaccctgtgtttgtaagtggtttttggaaggaattgtttaggatgcaaggaacacaactcaagatgagctctgcctatcatccagagtcggatggacagacagaagttgtgaataggtgcctagagacctatttaaggtgttttgtggctgatcaaccaaaaacatgggtgttgtgggtgcactgggcagaatattggtttaataccaactttcatgcttctacagataagaccccatttgagattgtatatggcaggcccccccctaagttgataaggtggttacaaggtgaagtcagaatagaagcagtccagagggatttgatagatagagatgaagcattgagacagttgagaagccaattgctgagagctcaagaaagaatgaagagacaagctgataagaaaagaatagacagaagctttgtggttggagaggcacacagacaacagtctgtagtaactagaattaatgcaaagttggctgcaagatattatggtccttaccctattcttgagagaattggagctgttgcttataaattgaagctccctacaggatcaaaagttcatccagtattccatgtttcactacttaagaaggcaataggcgagtatcatgaagaagaggcattgccggagctgttgagtgatgaacaaacagaaatctttgaacctgaggctgtgttgggcactagaaaaattaaacagcaaggagaagagatcaagcaggttctgatacagtggaagggtaaaactactgatgaggccacatgggaggatgttataatgatgaaaagtcaatttccaactttcaaccttgaggacaaggttctaattgaagaaggaggtgttgataggggccatgctgttgattcagtgccacatgaggaattagctcatcatgagacaagagggcccagaacttggctaggtgaaattgggcgccgaagtggaggtgataatgttcttgagcgagagggtcatgctgtttctgcaggatttgcactgggtcttgttgcactgggacggggagaagatgcacttggtttcattgacacgtttgtgaatcgtctgtttctctatatcggtgacaaagagagatctcatttttcgacagtctcaatggacgaaagtcgtggatctgcacagatgatggatgggacaacagtcaatattgatgtcactgcacctggagccatcatcgccattgctttgatgtttatgaagacagaatctgaggctattgtgtctaggctctcaattcccaatacaggttttgatttgcaatatgtgaggcctgactttataatgcttagagtcattgctcgaaatttaataatgtggagcagggttaatccctcaaaagattgggtttggtcccaaattcctgagattgtcagatgtgctgtagaagggattggaggtgatgacaatgatattgatgatatggatgctgaggcttttatacaggcctatatgaagcctgtttctcctacatgtggaaaggttttcccaaagggactgtctcgctacattgatcggggcacattggaaacatgccttcaccttattgttctttctctatctgtggagcagaaattgtgcagatgggcagtcaagttatggtattcagatggcaggggttggggattgaactgccctaccttaaagtggctggaggtaagcttagctattggtttcttgtttcttggtggtggaatgagaacgttttcgacaaacaaccattccattgctgctttgctaattactctatatccacgcttgccaactggtccaaatgataacagatgccaccttcaggcatttcgccatctctatgtccttgcgacagaggcacgatggattcaaacagttgatgttgacacaggtctgcctgtttatgctcctcttgaggtcacagtcaaagaaactgagcactatgcagaatccagcttttgcgagttgaaaagaatacgtgtttgtggacctcgctactggcctcaagtaatagactttacacctgaagacaagaatagtccatttaattctggtattcttttcatcaaaagaaaggttggagcttgttcatatgttgatgatcccattgggtgccagtcactgctgtcacgggcaatgcacaaggtgttcggcctgacaagtttgaaagcatctgatacaatcacggacattcgtagtgggtctggttctatcacagttgatcagttggttggtaccttctcatctgatcctagtttgattgcttttgcacaactctgctgtgacccctcttggtataataggtaa

SEQ ID NO: 36717 - DNA, 267 bp, Glycine max
  Peptide Sequence Number=SeqID_153495
atgtcaagaacttggattttgtataacaaacctgaggagccaaattctgttcacgctggacttctacttgcactaggattgcatggatatctgcgtgtattagctgttactgacatctaccaatatttttctcagtgttgcattgtggctgtccctagctataggaactgcattgcagagtgttcctgtgtctcatctgttgtgcctacaatgcaattgcagttggtaaggagcaagaagacaatttttgttgctgaaggaaaatag

SEQ ID NO: 36718 - DNA, 222 bp, Glycine max
  Peptide Sequence Number=SeqID_153496
atgggtgggccagttccacagcttctaggtgagcaggcctcaaattttggattagaagacataacagtggtttattgtaatggaaggagatttggaggatcatttggttctggagattcgaaaaggatgaagagaagacaagagaagaagagaaactgtgtggagtctaaggctcaagtcaccaacctctcaatggtggtgaatgtttctacattactttag

SEQ ID NO: 36719 - DNA, 2148 bp, Glycine max
  Peptide Sequence Number=SeqID_153497
atgcagcactcattgtgggttgcagaaattgtcaactctaacattgatgaggatctggccactagtttattacatatagatcccatgagtgtattgccaaaacatttgtccttccgtaaaatatggcagggtaaaggtgctcagacagctgcttgtaaggtctttttggccactgatgatgatgcagctcctgttgtctgctttttccaccaagaacaaagaaagttgttgtctgttagtcttcagattgttgaaataaataatgagattgtgtttgatgttaaacctgatatgagctggaacatatctgcaattgcagcttcacctgtgatggtaacccgcccaagggtcaaagtaggactacttccatattcagacataatggttttggctccagaaaatgttctgcttctctatctttcagaagaatctcctcttcccaatgacttaaagattacaggcctggctgatgcagttgaggggcgagtcaatgtgatagtaaatcataggcagatcttcagatgtgcattacgacaaagtccttcatcagcattagctaatgattgcatcacagcacttgctgaggggcttcattctagtttttacagacatcttcttggtcttctctggaaagatggtgatccagctcatctgtcagatgctgaatctattgttgattcagaatgggactctttttgtcatgtaattatgcaaatctgcagaaaatataaaattatatgtcaaaagcattctgattcagtgccacattctgcttgggacttccttgttagtagccaatttcattataatttttgcaaagtaaactccatgttcggaataccttatgcagtgtcacttgatcaacggggattaaatttccaaaggtcatctgtagatggtgcacaaaattctggcaagccattttatactgatctgttaagggaaagtctggaatctcttcatgggctctatgaaagcctgaaacttgataatctccgcaaaagggacttggagcttctttcaattctcttatgcaacattgctgaatttctggctgaggacaactacttggaccattatattcgtgatttccctggcctctgtaaaaagtttctgaagtctggtggaatcaccattttgcctaaaatttgtccaagtttattcagatggtttgaaaattgcttgcaatatggatgtagttatgctaatattaatgatcttccagctttagtctgtaaagaaggaaattctgtggttagcatagcccggaaagtagtttgcttttatagcatattatctggtgccaaattgctgggaaagaaactgtctactggtgtttactgtaacattactgtgggatcacattcttcaaaggaggagcttactgttttagcaatggttggtgaaagatttggacttcaacagctggactcactaccttctggtgtatctcttccacttcgtcatgcattagataagtgtcgagattcacctcccaatgactggccagctgctgcttatgtacttcttggccgacaagatttggcaatgtcaactttggctcgtgaatgcaaatataggggcattgaaacaccaaccaatgtgaatgttatatctatgtccacaccttatatgttaaatctgcatccagtgacaatatcttctactatttctgatgcaattggattggaaggaacaaagtttgaggatacagattcagttgatgggtctatgactgatggtatggagcatatattcaactcaagcacacagttgcgttatggtcgtgatcttagattgaatgaggttagacgccttttgtgctcttcaagacctgtggcaattcaaacatctgctaaccatagtgcttctgatcaggacctccagcaggctcaattgtggcaccttgcacaaaggaccacttcacttcctcttggacgtggggcatttacccttgcaaccatatatacactcttaactgaggcttttactgttccaaagcttgtattagcgggccgattgccagcccaacagaatgctactgttaaccttgatccaaacatcaggaacatacaagaactcaggtcgtggcctgagtttcataatgctgttgctgctggacttagactagcccctctccaggtttaa

SEQ ID NO: 36720 - DNA, 426 bp, Glycine max
  Peptide Sequence Number=SeqID_153498
atgcagcaacagtgcagattcagacaaagtaataacaatgagaaacaaatgcacaggcacatcagcaaaagaacacaaccgaatttcaaaacgaaggttcaaattcaacttcgttttccgttttcctttttttcctttaacttcatttccgcactttcggaagcaactgagcagataagcgagggttttagtgttttactgcaagagaatgagaaattaccgattgcctcggatgaaaagctcgtgatcgccacgattgctcggagcagaagcgatgtcggcgcaatcgtcgtcggcgtctcggtctcgagcgatttcgggatcgaagaggaagtaatcgtacttgtcggtgacggtgtcggggggcttgccatcgagggcttcggcaatgaggccaaatggcttgaactcacccagcaatgttaa

SEQ ID NO: 36721 - DNA, 291 bp, Glycine max
  Peptide Sequence Number=SeqID_153499
atgtttgaatgtagaagatttgcagagaaaggagatgaccgaaaaacagaaaatcaaaagaaaacaaagaagggagcgttcatgagacgagaaaacgaagtgggtgatggtgaaggtatcaatggcgcacggtggcattacagtggtgctggggttgcacggttcagactccctcgctccttctccagatccgagaaaaaggtttgtatccagaccatctcggcctccactttgccgccaccaccgcatctaaagcaaggcaataacttggggtctatgaacaggaaatag

SEQ ID NO: 36722 - DNA, 168 bp, Glycine max
  Peptide Sequence Number=SeqID_153500
atgaatgaagatcaatggatgtatgatagtataatgtctgaagaagttgatatggatgatgaaaatgaacaagaatatggtgtgaataaacaacatgttgattgcttggatgcgttcaatacttctcaggtgtttgctatccgagatgatgttttgcagtgggcttga

SEQ ID NO: 36723 - DNA, 150 bp, Glycine max
  Peptide Sequence Number=SeqID_153501
atggcggccgcgaatgctccgatcaccatgaaagaagccctaactttgccgagcattggcatcaattcgcaattcatcacgttcacgcacgtgacgatggaatcggataagtatatatgtgttcgagaaaccgctccacagaatagcgtg

SEQ ID NO: 36724 - DNA, 900 bp, Glycine max
  Peptide Sequence Number=SeqID_153502
atggctcttcctcttcttccacctctttcttcaatcatcaacacccttttcttctttacactcttcttcccaaaatatgtttcgagtgatgttgaagggtactcagcatgtgaaccttttagctgtggtgaaatcgacattcgctacccattttggagtagtgatcaccaacaaagttattgtgggcatccaaagttcaagcttgattgccaacaagacaacgtgacaattgacatgatgtcgcagagattccatgttattgatattgatcaaacatctaaggttttgaagatggcaaggttggatttatgggatgacccttgtactgatgagtatagcaatgtcaagttggattctgatttcttcaactacaattccaatgatgatgactatactttgttatatgattgtggtcctcctgttacatatacgtctagtgtgaatattaaaggaacaatatcatttagttgccccatagatggtggttttcgagatgcattctttgtgtcaagtactgatgtgggtaatttgaaggatctggggtgcaagcatagcatcaatgtttctgttctaagagaggctgtgaaggatgctttgcaagtggaaaatgttttagaaaaaggatttgaggtagggtggattggtgtggatgaaggacaatgtgatggttgcataaaatctggtgggagatgtggacacaacgtatctaaggatgcatttacgtgcctctgtcctaatcagcaatcttatgatgaggtttgtagcaaaagccaaacaagttctcccttagcagcaccaacgcctaaaccaacaccagaacaggcactgtcacccccttttggtccaaaatttcaagaaaagtctccacatgctccgagtatgtattcttccttctcctga

SEQ ID NO: 36725 - DNA, 471 bp, Glycine max
  Peptide Sequence Number=SeqID_153503
atggcttccaagatacaaatattaccaatcctaggcgtgttggccatgttacttctgatctcctcggaggtgttagccactggattacatggtgttggtgttggtattggtggtggattacctggtgttggtgttagcgctggattacctggtgttggtgctggattacatggtgttggtggcgctggattacctggtgttggtgctggattacatggtgttggtggcgctggattacctggtgttggcgctggattacctggtgttggcgctggattatctgccaacgctggattatctggtgctggtggcgctggattacctggtgttggcgctggtgctggtggcggccgtcgtggtcgtgctggctccccttcttatcatgcaagttcccctagtggtggtgacagctccccttcttattcttatcatgcaagttccccgagtggtggtgtcgactactatggttga

SEQ ID NO: 36726 - DNA, 171 bp, Glycine max
  Peptide Sequence Number=SeqID_153504
atgaagaaaggattcgtgcttgattggatgagagctcaggaatgtgcagtgtgcgaggagtctaatggccattgcatattcgatccagccactaagcaatcgaggtgcttatgctcagatggcagaactgaagtcaatagttgcgaaaaaggtcgaccacgtattgtgtaa

SEQ ID NO: 36727 - DNA, 1184 bp, Glycine max
  Peptide Sequence Number=SeqID_153505
gaaaactcgaggatgggcgtgagataacgatccagtgctttaacgaagacaagcaccacacgttgcaacagtttatcaatgaaactgttatcctaaactacttgcctcacaaaaatatcgtgtcaatttatgggtgtgcttctcatcacaaggaatcactactcgtgcatgaatacctatccaatggcaatctttctgctcatcttcaaagtgaaatagccggaaacagcacacaaccttggttgaccagattagatatagccattgatattgcaaatgcattggactatcttcactattatggcatcatccaccgtaatgtgaagtccagcaatattctcctagatgtgaacttttgtgctaaacttgctaaccttcatttatctcagaaacttccaggtgaagttcctgtctatgccaccacccatgttactggtgatataattggtacatgtgcttatatggacccagagttggcatatggctggcttagtgttaaaaatgatgtttatagctttggggtgctggcaaaatgctgggttctgaatgaagaggataatcttgctaccctcttaagcagaaaaattgaaaaccaagctttggtggagctgttggatccaagatttggcttcgaaacaaaccttaagatcaagtggatgatgactgctataactgagcttgcacttctatgcatgaaatgcccacaagaattaaggcctaatatggaacaggtgctagagacactcaatgacataaagcaaggaagatatgaaacaaactcaataaaagctttgaaaatcttccaccatgctgaacttgaagaagctactaacaattttgacacttgccttggaaagggagggtacggcactgtgcatcatgccattgtattaggaaaacttaaagatggacaagaggtagcaataaaatgtttccatgacgagagcgagacagaaaagaccattaagcaattcatgaaagaaactgagatcttaattctgttgcaccatcaaaatctagtttcactttatggccgcacttctccccatagcaacaaacacatgatagtgtatgagtacatctccaatggcactctttctaaacatcttcatgaatcttcccgtggtaaattaccatggcatactagattgaacattgccattgtgatacgaggaagcagataa

SEQ ID NO: 36728 - DNA, 4191 bp, Glycine max
  Peptide Sequence Number=SeqID_153506
atggccaattctccttcctctgacaaaattgaagagctcctcatccgccttaccacccaacagctttccctttctaccaagattgatgacttcatttcccacgtctcccctctcttctccaattcacaccacataccttcgtcccttcctcgattgttccctgttcctgcacaacagcatcgtatcaaattggacgtgccacggtttgacggcacagacgcccttggttggatctttaagatcaaccaattttttgagtaccatggtactcccgaatatgaccgattgacgatcgcttccttttacatggagggcagggccttggcctggtttcaatggatgaccagtaatggtcaattcacttcctggcctaccttccttcaggcattacagacccgatttgccccttcacaatacgaggaccccacaggggccctctgcaagctcatgcaaaagggttcagttacaacttacctcgccgagttcgaagatttggccaatcgagtgattcgccgtgaagtccaggcgcaccaaccactcacgctctcccaagctgccggcctcgcgcgcttgcaggaggaaaagctcagtgaccttcgtcccccacctcctccaatttgtccacggcctccttcgctctcttctccttccctatcacgccctccatccctgtcgcctctccttccaccaccaccaccactgacttgccccaaccctccgcctccccccttcaagcgtttgacctccgaggagatcgcgagccgccacgagcgcggcctctgctttagttgtgacgagaaataccacagaggtcaccgttgtgcctctagggtatttctcttcatagcagagggagaggaacccagtgacccatcacaaatagcctcttttgacccgactctggaacccgaacctgacccacccgacacccaagacccgtacccggcccaactcagtctaaactcaatggctgggcacttagcccccgaaacgctgcgttttatggcctccattgccaacctcgacgtcgtgctcctggttgatggcgggagcacgcacaacttcattcaacaccagttggtgaccaagctgggtcttcgtcccacctccacagccccactgcgcgtcatggtcgggaacgaacaacatttggactgcagctccatgtgtgaagctgtccccatctttattcagagcatccaattcatagttgacctgtatgttcttcctatatctggtgctaatgttgtgcttggggtccaatggttgaagtcattgggacccgtgctcaccgattacaacacactctccatgcaattcctttcggacggccgtgtcattaaggttcagggcgaactcgacgctaagttgcatagtctcactccggtccagcttcgccagcttagtcgaacccaagatgaggctcagttctaccatattaccctcttcccgaatttgtcttcctcgcagacgcacgcactgccagccccaattcgacaattactactccgcttcaaggccctgtttgatcccccttccacattacctccgccacgcgccactgatcaccatattcacctgctccctcaggcctctccggtcaacgtgcgaccataccggtatccgcactaccagaagcaagaaatagagcaacaagttgattcgatgttgcagaaaggcttaattcagcccagtacgagtccgttctcgtcccccgtgcttctggtaaagaaacacgacggctcctggaggttttgtgtggactaccgggccttgaatgccctgacggtgcgcgatagatttccaattcccactattgacgaactgcttgatgagttaggcggcgcttgctatttctctaagctggacttgctccaaggctatcaccagattcgtatgaatcccgatgacatcccgaagaccatttttcgcacccatcatggtcattacgagttcaaggtaatgccatttgggttgtgcaacgctccatcctcatttcaggcgaccatgaattcaatatttcgaccttatttgaggcgcttcatcatcgtcttcttcgacgacatactgatttacagtgcctccatggatgatcaccttcaccatctagaaactgccttccaggtattactgaaccatcaattcgctttaaagctctctaagtgcttctttgcgcagcaacaggtcgagtatttggggcatttggtgtctaccaggggagtcgaacctttagctgagaaagtcgccgccgtgcgtcaatggcctattccccgcacgaccaaggccttgcgcagtttcctcggcctcgtcggcttctatcgccgttttatcaaggggtatgccactattgctgcccctctcgtgaaggccaccacgcttgacccgtttcactggactgatgaaactcaggttgcctttgaacagctgaagcttgctttgtcttcggcccttgtcttggctcttcctgatttccagagccccttcacgattgagacggacgcgtcaggagtgggcttgggtgctgtcctctcccagaagggccacccaattgcctattttagcaagccctttagtcccaagttactgcgatcatcgacttacgtcagggagttatttgccattacggcggccgttaagcggtggcgccaatatttgctggggcaccgttttgtcatcatcacggaccatcgcagcttaaaagagctcctgactcaggtggtgcagaccccggagcagcacatgtacctcgcaagattgatggggtacgattatgagattcactatcgcgccggcgccgccaatcaagcagctgatgctctttcccgcgttcctgaatttgaatcttccctcgcgatgctgctctctgtacctaacctgtccttcatggacgagcttcgccgtcagctccagcaacaccctgagtttaatcgccgtcatctcgaggtcatcaacagtcccaccgctcacccggggttctcggttgccaacaacctcattctctatcggcaccgcatttggttacctcgcgacattccgatcatctcgacactccttcatgagtatcatgctatgctgacagggggccactctggcgttgcaatgacacttgctcgaatatctgagaatttttattggaccggcctccgtgatgacatcaccacctttgtgtccaagtgctttgattgccaatctaccaaatatgaagcaaagcgatctgcaggtctcctctgtcctctcccagtgcctcaccgaccttgggaagacttatctttggattttatccttggcctgccggaatataagggtaacacggtcatcctggttgtcgtcgaccggttttccaaaggcgttcacttgggtatgcttccgactgcacacacagcttttatggtggccactttgttcttggatatggtcgtcaagatccacggcgtgccccgaagcttggtctccgaccgagaccccatattcctgagcaagcttcttctttgggctgaatggtcccataatacctcttggacctctgctactggagttactccttatgaacttacatttggccggaaaccctttaatttcccagattaccttgctggcgcttccagtaatgatgcaattgacaccatgttcagtgatcgcaaggaaacctttctgatgattcgcaagaagttgcttaaggctcaggaagctatgaagcggaaggctgatgttcaccgtcgggacgtgactttcttgccggggcaatgggttctgctacgactacgccctcaccgtcaggtctctgttagggaccatcctcacatttccgggaaattagccaaacgtttttatggcccctttcaggttacagaagccattggcaaagttgcttataggttacaattgcctcctggagccaagatacaccccgtcttccactgttcccagcttaaacagtttcatggtgaccccagtaacactgacataccccctttgccccctcagttttgtcaggatcaacctatcatccaacccgccgcaattttggattctcgacaaacctctgatacaacctgggaggtactcgtccaatggcacgacctttctcctgatgagacctcctgggaagactggtccatcttgcgccaggattatcaccttgaggacaaggtgatttcccaagggcccaggggtatacgaggaagcagataa

SEQ ID NO: 36729 - DNA, 612 bp, Glycine max
  Peptide Sequence Number=SeqID_153507
atggatatccatatccacatgctcctcacgtccatttcttgcttattctttatcactctgccgcagtccctctctcaaccaccacctgtcttcaattattcggcttgtaaggaatggccatacaagtgcggaacactttccgacatcttctatccattctggggagagaaccgaccccctcaatgtggtggcggccaagcattcaggctgagctgcaaccatgataatattactactattctaattgcctcacataatttcacggtggagaacgtcgacaacaccactcgaaccatgagagtagtgccaactgaccttggccccaacgattgttctctgcaatctaagaacatatctgatgacattcatgcgaatgccactcacttcctctatcccaattcttcattgtacagcaacaacatatgcgaagggtttgaggtaatttatgatgtttctgaaaattgcacaaaatgcctgggaagtgaaggagagtgctggaaggatgaaattgatggacatgatgtggttccatgctattactgcccagatggatctcattccctagactgttctcctctaaaaagaagtacgtcttctatcctcttttcttga

SEQ ID NO: 36730 - DNA, 759 bp, Glycine max
  Peptide Sequence Number=SeqID_153508
atgcataccttagactcctcacagtttcccttcttctcttcatccttttcgaatctccagaaccaaatgatcctccaaatctccttccattacaataaacctcaactatgcattattacctctatcttattcttggttaccactgttctatcttctaatccaaaatttgaggcctgctcacctagaagctgtggaactggtccacccattaagtatcctttctggattccttatgaacaggaaccattttgtggctaccctcactttgagatcacctgcatggacaaaaatccaattctcagaacttctaattatgagtttttagtgaaagatatctattactctaactcctcatttactgtggccgacatagatgtctatgaggacaagtgccctgttcccttatataattacacctttgatcaaactccattcacctacagttcagaaaattggaatctctctttcttctacaactgttccacagaacctatagattaccccacttacgaagtagattgtgctaaaaatgctacacatttttcttttgcggattttcataaggaggcactggagcacaaaaactattccttgaatgagtgccagtttatggttactacgccattgaacatcaatgaagctgttaatatcagtagcttattgagaatgaattacactgagattttgaagacggggtttgttttgaattggactgcacctcattgccactactgtgagaaaagtggtggacgttgttga

SEQ ID NO: 36731 - DNA, 1509 bp, Glycine max
  Peptide Sequence Number=SeqID_153509
atgtctgccaaaaggtttttcaatgattctgatcaagaccctgagaatcctggcggaaaacggatgaggaatactagaccttcttttgcttcggttataggagaagtggttatggtgaaaaacttggagaaccttttctcagccatggaacctttgcttaaaagagtggttggagaagaagttgaccaagctatgagacaatggtcacgctcctttgctaggtctccttcactgaggctccaagcaatggatcagcaacaaccttcaactttgcaactatgtttcagcaaaaggctttcccttccaatcttcacaggtagcagaattcttgatgttgatgggaaccccatcaacatagttctaatggacaaaagcaatggccaaggagtccccacaagtctctcaaatgccatcaagctagagattgtggttgttgatggagactttcctcttaatgacaatgatgaggattggactagtgaggaattcaataggcacatagtgaaggagagaaatgggaagcgaccattgcttgcaggagaattgaatgtgatcatgcgtgatggaattgcaccaaccggagacattgagttcactgataattccagctggattcgctgccggaagttccgagttgcggtgagggtggtaccggggactaatccaggcggtgttcggattcgtgaagccatgactgaggcgtttgttgttaaggatcaccgtggagaattgtacaaaaaacaccaccctccaatgcttcatgacgaagtttggcgcctagagaagataggtaaagatggagctttccacagaaaattgtcatcagaggggatcaaaacagtgcaagactttctcaaactagcagtcattgatgctcttaagctaagaaatattttaggcatggggatgtcagacaaaatgtgggaagtcactatcaagcatgcaatgacctgtgacatcgggagcaagatgtacatttatcgtggaccagagtttactatttttctggatccagtgtgcaaattaataagagcagatgtcaatgggcatacattttccaacagggatccgatgagccatttgaataaggcctatatagacaaattggtgaaagaagcatatgctagatggagtaacttggaggagattgacgaagttctgaatgataacattgctttgttaacccaagccacagtaactgatgttgatgtgaacataataactataggtgatcaaactgtggaacaatttgcaaacaatcaacctgcagctgcctcagtagaaacaacatatgatcagaatcagtattacagtgacaaatcaggcagctatgtagcaaacaacaatacacaaatgggatgctgcgagtggtcactgaatcaagcctatagcccagcaccgtttgccaatggctttccttttagtttctcagtgagacaatcggatggtgacataaccgcttcaggttctagctctgtggatgttgatggagccacaaggcataattaa

SEQ ID NO: 36732 - DNA, 531 bp, Glycine max
  Peptide Sequence Number=SeqID_153510
atggctaaattgattataccaattaatggcttgagtacaagtgctggaaacaacatttatacaggaattatgatcagaaacattgcaagtggaatgtgtatccttgaggttcaaaacatagagtccatgaatgaggtcccctctaccaatcttcttgcaatgaggcatttcctgtatgacaaattgagagttagagaaggagataaatgtacagtgccaactgcaatgactgggacaattgcattattagtgataagaatcaaagagatcaatggcacaaacaatgtgagtgttggcactcgaatcaacaatccaataattttgaggaaacttagtaaagaagcaaacaagaccataccagtgttggaagattcaatatcaggagtaatggcatttgaacttgaaacacctatcttgagtatggccaagtcgaccacaatatgcatagagaggtcgatttctggaagaagtactaaccttgtgatcagactaatatttggaatccttaacagcaaaagcatgagattgtga

SEQ ID NO: 36733 - DNA, 730 bp, Glycine max
  Peptide Sequence Number=SeqID_153511
atgaatcaagtctcaccatctacttctgttcctgattttcatctcattgctcaacaatatagccaactcatgagcttgcttcaaacacacacttcaaatgccattactcctgatattgaatcttccaacactgctactttgaattatgaaaggaataagttttacccaagagcaataccttttgtgtttgttggttatccacaaggcatcaagggtgacctagttgtttccctacctattcctgaatctatgtcctcaaccattcaacctggagccactaaacctaatatccctcatgccacaaataacctacctattcaattatctgattctgcagtagatactaccattagtacctcatttgctttgccttctccttctgtgagaagatccattagaacatcaaaccctccaccatatcttcttgattacattagacctcaacccagaaaaaaatctcaccttatacaagatcattgctctttggttcacctccactctctttatatggactttattgctcaggtttccaccatttatgagccacaattttatcatcaagcttttccttttccagaatggcgccaagccatgacagctgagatcaaagctttggaatccaataacacatggactttggttcctcttccaattgtgaaattcaagcctgatggcactgtggatcgccatacagctagattggtagctaagggttacacacaacaagatg

SEQ ID NO: 36734 - DNA, 916 bp, Glycine max
  Peptide Sequence Number=SeqID_153512
ccaaggaggaggcagtggaggttacggtggtggtggaagcggaggaggagggggtagtgctggaggtggtggtagcgaaggaggaggaggtagtgctggaggtagtggtggtggtgaaggtggtggaagcggaggaggagggggtagtgctggaggtggtggaagcaaaggaggtggcgaagctggaggaagtggtggaagccaaggaggaagcagtggaggttacggtggtggtggaagcggaggaggagggggtagtgctggaggtggtggtagcgaaggaggaggaggtagtgctggaggtggtggtagcgaaggaggaggtagtgctggaggtggtggtggaagccaaggaggaggcagtggaggttacggtggtggtggaagcggaggaggagggggtagtgctggaggtggtggtagcgaaggaggaggaggtagtgctggaggtggtggtggtgaaggtggtggcagtgcgggaggtggtggaagcgaaggaggagggggcagcgccggaggtggtggtagcaaaggaggaggaggttatggtggtggtggaagccaaggaggagggggtagtgctggaggtggaggtagccaaggaggaagtggtggaagtgcaggagggggtgaaggtagtggtagccaaggaggaggaagtggaggtggaggtagccaaggtggtggaagtggatcaggtggcggaggttacggtggtggtggaagtggtggtagtgaaggaggaggttctagcggtggtggtggtggaggtggaggcggaggtggaggtggaggctacggtggtggtggcgataaaggaggaggaattggaggtgacaaaggagactatcatcatggaaaaggaggaaaaggtgacaaagatggaggagacaaaggtggcggaggaggatattga

SEQ ID NO: 36735 - DNA, 243 bp, Glycine max
  Peptide Sequence Number=SeqID_153513
atgcaggagcctacacaaaacacaaaagaaaaggaagagtcactgggagttttgttgtccaccaccccgcgaaagaagttttgttgtacaaccaccactgctcgttctagatgtatattcaggaagtctcaggtaaatctctacttgctacaactaattatggggatcagagcaacaatgatggggccaagagaccaagggaagactgagattgaggcttccttagaaaccatttttcattag

SEQ ID NO: 36736 - DNA, 765 bp, Glycine max
  Peptide Sequence Number=SeqID_153514
atgaagaataataataaggagcaacaaggcaaaggtgcagcctcgtatctgaaactcttcagtgctcaactcgaccttctcaatctcttctctcatgctctagtttttggaattggtttactcattggtgtcacactcactttctttgtcaagaacttctccttaatcaactttccaatccaaaaattctccttctcatccaatagcctcatgatcaaaccaccaacttctttgtctccctctcatccaatcatctccaacatctcattattaacatcgaacaaccaaacaaaaaacgaatctcagtacttggaaggattagtggtatctgactctcggttaagacaccacgacaaaaccaaaccttcgtcttccgattcgtcgtcgatcaacagaaaaagggttatgaacttcaacagagtagggttgagggaattcttgaagccccccatggccatgcatgatatgagtgatgaagagttgttgtggagagcctccatggttcctatggttcataaactcccattcaaacaaaccactgctaaggttgcatttatgtttttgacaaaaggtccagtgctattggctcctctgtgggaaagattcttcaaaggaaatgaaaggttgtattctatctacgtccactccaacccttctttcaatgaaacagtgcctgaaagttctgtgtttcatggccgcaatatccccagccagggtgtgattaccttaaaaacaaccaaagaagatttcttcatcatgttttaa

SEQ ID NO: 36737 - DNA, 243 bp, Glycine max
  Peptide Sequence Number=SeqID_153515
atgatggcacatcacagtgcctctcctttccctcattttcgtttttccctttctcctctcaaaaccctttctttttcccgcaacccacaaaacctgtctcggaaaaataacgatctcaagctcattaaccatttgatcgtcgtgaaatttaagcaccaagtttgcaacccaattcctagcattctcaccgttgggaattgcaaaaacatgtcagagataagaggaatacccttcgcaccgtag

SEQ ID NO: 36738 - DNA, 318 bp, Glycine max
  Peptide Sequence Number=SeqID_153516
atgattgattcaaaacctatttcctctcctatggcattcagctgtaagttatccaaacaagattttgattcactacagggtggttcattttacagttccattgttggagtcttacaatatgtgattgtaactcatcttgagctatgctactcagttaaaaaagtttgtcactttatgtcctctcctcttaagagttactgggttgttgtaaagcaaattctaaggtatcttagagaccatcttcatcatggattggttcttcatcctgctcttctttatccagctttctccatttatgcattatgtgatgctgactag

SEQ ID NO: 36739 - DNA, 147 bp, Glycine max
  Peptide Sequence Number=SeqID_153517
atggagaaaggtacaagtcttcctatggagaaaggtttcaagatcctgttgtttcctataattgatagtctagggaaccccttaatgttttacatgtggtatcagaacatgtgttatgaaatttatgattctccaagaatgatttga

SEQ ID NO: 36740 - DNA, 177 bp, Glycine max
  Peptide Sequence Number=SeqID_153518
atgaaggtagatctgtgtcataccctaatttcgtccggggaccatttgtttggtgggatgcaaccttcgcttgaccacttcgagcaaccaggcccacttggaccttccagggtgttccaacagaaggcggtgccttttggtggaagtaacccagctcgcctgggtgagctgagctag

SEQ ID NO: 36741 - DNA, 399 bp, Glycine max
  Peptide Sequence Number=SeqID_153519
atgaataccaagccctttttctccttgtgcttactctgcgcactgcttctcatctgtgttgtggcaactgagccatccaaagatgcgacacaaggtagtgtctattgcataactagctgcatcttcctttctcaaatcacgccaagaaccattgttcttccacttattctacatgctttctttcttgctactcctattccccactcaataacagaagaaccaaagacacggccagatgcctggagaagtggtggaagtggaggacatggtggaagtgggggacatggtggaagcgggggacacggtggaggctggggacatggtggaggctggggacatggcggtggacatggcggaggatgcaaatgctgcggtcgaaagggctgcaaatgttgctga

SEQ ID NO: 36742 - DNA, 938 bp, Glycine max
  Peptide Sequence Number=SeqID_153520
agatattagggattgcattccctgctgcactagctgttgttgctgatccgattgcttctttgatagacacaacattcataggccacttgggaccggtagagcttgctgctgcaggagtttccattgctttattcaaccaagcttcaaggattaccatattccctcttgtcagtattacaacttcctttgtggctgaggaagatactatccaaaggttgattaacaaagaaactgaaactgataacatagaaaatgaaacaataaccaaagaaaatgttgaggctccaaaaaaattcaagggggaaaccgacgaatcaaacaatgttgtagcgaagagtacttttacatctggggatgtggaaaaattagctacagggaacatgggcataaataatgaaaatgcatcaacagcgttactttttggcactattctaggcctccttcaaactgcaatcctcacatttgcagccaaacctcttttatatgcaatgggtctaaaacatgattctcctatgctaattccagcagagaagtatctaagattgagatcaattgggtcacctgctgttcttctctccttggccatgcaaggaatctttcgagggttcaaggacacaacaactcctttatatgtgatcgcatcattggcagcaaggctaggttcaattcctatggctgcatttcaacctggcctacagatttggttggcatcatcccttcttgctgatggtttggctgtggcagtacagacaatgctagcttgttcctttgctgagaaagactataacaaggcaactgctgctgcaacacggacactacaaatgagttttgttttaggcgtggggctctcttttgcagttgcacttgggttatactttggacctggaatattttccaaaaacgctaatgttgtgcacttaatcaaaataagcatgccg

SEQ ID NO: 36743 - DNA, 243 bp, Glycine max
  Peptide Sequence Number=SeqID_153521
atgttcacacccacgatcatggaaaatgagaaactattggatggaggtggtggtgatgaggcacagagagtgtcattcaaagagaaagtgataggaacggtttctatgtcaacaaaacctaagaatatccttaaagagggtatgatgagcatggaatacgagggaagaaataaatcacttacaaagttcaaaatgggacatattgcttttgagcaactgtatcctcctggaagaagtgtctag

SEQ ID NO: 36744 - DNA, 552 bp, Glycine max
  Peptide Sequence Number=SeqID_153522
atgaaaatacttcagttgcggcatttggaggaaattagagggtgcaatccatctccgaagagctcgtgtgcatctactccaacaagtggaagtgacggacacgtgtcgtccactgatttctccccaaagagtttagagaagcactgccgtccgattgaaaacattatgatggagaccgaagccaaaggaacgatgatagagaggctcaatcaggtggaggatcgaatgctaaagctggaagaagagttggtagcaaagaagaaagaggaagggaagaaaatgaatagcccaaagaaaggttttaaacagcttgtgaagcaaagagttaccaatattcagtttccagttaaatacagattaaaaagagagcatggacaagtattcataatctcaaaatcttggaaattgaggagccaacttttgccaagccatcggctgtacacatgtttccttgcctgtaaaaatgttgaaaagagaattggcagtctagagattgaaaatgacgaatctgttgaaaaagaggatgataaggatgtaacctcttatggctaa

SEQ ID NO: 36745 - DNA, 399 bp, Glycine max
  Peptide Sequence Number=SeqID_153523
atggacgccattgattctgtgttcgatccgctgagagaattcgcaaaggacagcgtgaggctcgtgaagcgctgccacaaacccgatcgcaaagaattctccaaggttgccgtccgtactgcaattggtttcgtcgtgatgggattcgtcggtttcttcgtgagatcattttcattccaattaacaacatcatcgtcggatctggatgaagggaactacaattgcctcagaattcaggttgtcaagcaaaaggagagaaagggaaggttgaaaaaattgtttgattcaaagtacgagggaaataatcttaatggaggaaaagaaaaggaggaggagaggagaagaggggaggggagagctaatggcttgctaaattaccaagctagggttatggtgtaa

SEQ ID NO: 36746 - DNA, 3135 bp, Glycine max
  Peptide Sequence Number=SeqID_153524
atgattccaggaagtcctgcaattcttggagacatggaagaggatggtgctgctgctgctgatgccagtgacttcaattatgattcagaaaatcaaaatcaaaatcaaaaccaaaagcagaagatttcagagcgcatgttaagctggcaattgacatacccacgaggagaggaggttggtgctccaaattatgataaggatgtttctcacaaccacattcctctgctgaccagtggacaagaggtatctggagagttgtctgcagcctcacctgagaggctctcaatggcatctcctgcagttggtggtggaaagcgtgtccataatattccatattcatctgacattaatcaatctccaaatatcagggctggggatccaggattgggcaatgttgcatggaaagaaagagttgatggctggaagatgaagcaagaaaagaatgttgttccaatgagcacaggccaggctgcttctgaaagaggagctggagatattgatgctagtactgatgtgcttgtagatgattctttattaaaaattgctgctctacttgtattggaagcctctttgctcgtttctccgacagtatcaactatcaactgcatatttttaatgtcattggttaacaatatgatatggaatgatgaagctcgacagcctctttccaggaaggtttctattccatcttctaggataaatccatatcgtatggtcattatgctgcggctggttatcctttgcattttcttgcattatcggataacaaatcctgttcccaatgcatatccattgtggttggtatcagttatatgtgagatttggtttgccatatcttggatattggatcaatttcccaagtggcttcctgtaaaccgtgaaacatatcttgacaggcttgcactgaggtatgatcgggaaggagaaccgtcacaactagctgctgttgacatttttgtcagtactgttgatccattaaaggagcctccacttgtgactgccaataccgtactatctattcttgcagttgactatccagtggataaggtctcctgctatgtgtctgatgatggtgctgctatgttgacatttgaagcacttgctgagacatcggaatttgcaaggaaatgggttccttttagcaagaagtatagcattgaaccccgtgcgcctgagtggtatttttctcaaaagattgactacttgaaagataaggttcatccatcatttgtcaaggatcgtagagcaatgaagagagaatatgaggaatttaaagttcgtattaatggacttgtttcaaaggcacagaaagttcctgaagaaggatgggttatgcaagatggtaccccgtggcctggaaataacaccagagaccatccaggaatgatccaggttttcttgggccaaagtggaggacttgacactgagggtaatgaacttccacgtttagtctatgtttctcgtgaaaagcgtccagggttccaacatcacaagaaagctggtgccatgaatgcccttgttcgagtatctgcagtccttaccaatggacctttcttattgaatcttgattgtgatcactacataaacaacagcaaggccttgagggaagctatgtgctttatgatggatcccaatcttggtaaacatgtttgctatgtccagtttccgcagaggtttgacggtattgataggaatgatcgatatgccaatcgtaatacagttttctttgatataaacttgagaggtttggatggcattcaaggtcctgtttatgtgggtactggatgtgtcttcaacaggacagctttatatggttatgaacctcctcttaaacccaagcataaaaagcctgggttgttatcatcactctgtggtggaactcggaagaagagttcaaaatctagtaagaaaggatcagacaagaaaaaatctagcaagcatgttgacccaactgtgcccattttcaatttagaggatatagaagaaggagtagaaggtactggatttgatgatgagaaatcactacttatgtcacaaatgagtcttgagaaaaggtttggtcagtccgctgtctttgttgcctctacgcttatggagaatggtggtgttcctcaatctgctactccagaaactcttcttaaggaggctattcatgttatcagctgtggttacgaggataaaactgattggggaagtgagataggatggatttatggttctgtcacagaagatattcttaccggatttaagatgcatgcccggggttggcggtctatatactgcatgcctaagcgcccagcgtttaaaggttctgctcccatcaatctttcggatcgtctaaaccaagtgcttcgatgggctttaggttccgtggaaattcttttcagccgacactgtcccatctggtatggttatggtggaaggttaaagtggcttgaaaggtttgcttatgtgaacaccaccatctatccagtcactgccattccccttctcatttattgtatcttgcctgctgtctgtctgctgactaataagttcattattccacagatcagcaaccttgctagcatatggttcatctccctctttctgtccatctttgctactggaatcctggagatgaggtggagtggtgtcggaatcgacgagtggtggaggaatgaacagttttgggtcatcggtggtgtctcggcacatctctttgctgttttccaaggcttgctcaaagtgcttgctggaattgacaccaacttcactgtcacctccaaggcctcggatgaagacggagactttgccgaactatacatgttcaaatggaccacccttcttattcctccaacaacccttctcataataaacttggtgggggtggttgctggcatctcctatgccatcaacagtggctaccaatcttggggacccctctttggtaagcttttctttgcattttgggtgatcatccatctataccctttcctcaaaggtctcatggggcgccaaaacagaacaccaaccattgtggtggtgtggtccgttctgcttgcatccattttctcactcttgtgggttagaattgatccattcaccacaagggtcactggtcctgatgttgaggagtgtggcattaactgctag

SEQ ID NO: 36747 - DNA, 159 bp, Glycine max
  Peptide Sequence Number=SeqID_153525
atgaatttttgtctgaccttaaccatcacagtccccttggaggagaggagcacacctattctgatggtggacatcaagagaagggagttggagttgcaaaagggagcgatctgcgaaagcaaccagggatttgatgcctttctaaatttatttttttag

SEQ ID NO: 36748 - DNA, 228 bp, Glycine max
  Peptide Sequence Number=SeqID_153526
atggctacacctcccgtaaccactcctcctgcggctacaccaccgaaaggtcatggagttcctcctccgcagttctgtcctcgattctgtcatcaagaaaaccctaaccgccctccctctctcccccgtcaaaccccgcctcaagaaaaccctcctcctccgcacccttcaaaccctcattcgtacaaccacagtaacggcaagaagcgtgggatctctggtttttga

SEQ ID NO: 36749 - DNA, 318 bp, Glycine max
  Peptide Sequence Number=SeqID_153527
atgaggagaaagacgagctactacattgaagtcacaagaagggtaaatgaaagcctattgaaggataaaggttttgctattggtggtgatgtcctttcagggttgatcaacaatgatgagtggctgaatggtttgtcctttaaaacacctcaagtggcagcggagggggccatgaatggtggtagggcattattatctcctggtacaatgatggaaaccgggattcatgcaaaaaaaatggaagaaaatagaaaggtggcaatctgggtgcgtattccagacttgtccattgaactatacaatgaaaggtttctctag

SEQ ID NO: 36750 - DNA, 186 bp, Glycine max
  Peptide Sequence Number=SeqID_153528
atggcgtcgtttgggtctctgaaatccaccattttcgaaaaagaagagagaaaacagcagtatcagtcgcatattcgaggcctcaatgcatacgaccgtcacaaaaaattcatggacgattacgggttgatggacaataaggaattgatcgaatttgtagcttttgatttggttggttcctcataa

SEQ ID NO: 36751 - DNA, 1193 bp, Glycine max
  Peptide Sequence Number=SeqID_153529
ggttccctttcagaccacccaattccactcttccagacccagaacctctattcttccatcccaagccatttttttccacaaaagaagctccttttcatccttttctgctagtgcccagttgggggttgagtgataatggaaatgggcaagtggagtctaatgatggttcagctacagtagccacacctggtgaatctgtgacagaggctctgaaaactaaggagtgggaggtgggaatgttccaaaacgaggttgcagctagccaaggtataagaataaggagaagaccaccatctggaccccctttgcattatgtaggaccctttcaattcaggttgcagaatgagggaaatactccccggaacattttggaagagattgtgtggaacaaagacacagaagtctcgcatcttaaagaaagaaaacccctcggtgtgctgaagaaagctctcgaaaatgcacctcctgctagggattttattggtgctctaaaggcagccaacgaacgaactggactgccagggttgattgctgaagtgaagaaagcgtcaccaagtagaggtatcttgagagaagactttgatccaaagctgttgatgttggaggttgtttggagtgaagatgttgttgttgttcacagaggtggaaggattctctgtcatgaagatgcatcagttgttgaaattgctaaagcttatgagaaaggtggagcagcatgtctaagtgttttgacagatgaaaagtattttaagggaagctttgaaaatcttgaggcaataagaatggctggcataaagtgccctttgttgtgcaaagaattcatcatagatgcatggcaactctactatgctcgaactaaaggtgcagatgcagtccttttaattgctgctgttttgcctgatcttgacatcaaatacatgatcaagatatgcaaattactgggattgactgcacttgttgaggttcatgatgagagggaatttgatcgtgttcttgcaattgaggggattgaacttattggcattaacaaccgtaatcttgaaacatttgagctggatatcagcatcacaaagaagcttcttgaaggagagcgaggcaaaataatccgtgagagaggcataactatggttggagaatctggtctgttcacccctgatgatattgcctatgttaaggaagctggtgttaaagct

SEQ ID NO: 36752 - DNA, 719 bp, Glycine max
  Peptide Sequence Number=SeqID_153530
atggctccatttcctgtgcaaatgtcaaagtcactctcagcagagttgatgccttctagcaacaacagacttatggaggagattggaaatcaagtgaagaaatttagggaatccaaggtagcagctgctgctagtactggaaaactggaattgttgaggaacttggtagcagacctacctattggttactcgaagaataattttgagtatttgccaaagaagtttgatgtggtgtacgatgcagtaggtcattgttcaataaaacggaaaggaagtgatcatctacattctatcgagatcaaagtcgaagctccaagtctagctcttcatcatcattaccttgattatcaacttcatcattttgtgcctgttcctttcccgagagtcaactcaactaagagtgattttggctactgcatgggaaatggacccatagggtttaacgttccaacccccttttgtaagtcatgccttggaaatcccctttgctggcatggggcacgaaatccaaaccatacagagttgtttcgattaggccatctagaggtgcttgaaacttgtgagtacaaaaatgatggccttgaacctgaggcgttgatgctcttcatggcatctattagcattgctggtgaggcacgtgcatttttccttttcctttgtcagttcacctttgttttggtgaaaactggtatcagcagtaagagcgatagcccagccat

SEQ ID NO: 36753 - DNA, 339 bp, Glycine max
  Peptide Sequence Number=SeqID_153531
atgattgaaagttttgaacaacaacaagaaatgtctgtcatagaattatgtgttgaagttgatgttgtgggtgcttctgcaattaatttcacaaattcattgttatcatgcgaaaataatatgtctcacaatgaatcgggtagtgcaagagttggaacaaattcagaagaagattttgatgatgatgatgattatttaatatataattcatacgttgaggactcattagatgaggatgaggatattgatgaaatatctgacacaaatgaagctgcccgtttgatcgaaccacttacagttgtgcaatcaggagaaggtagaagtcagactccattctag

SEQ ID NO: 36754 - DNA, 237 bp, Glycine max
  Peptide Sequence Number=SeqID_153532
atggtggaggatgcaagaacaatgctaggcaatcaattcgtgggggctccggacttggtggtggaggatacacgaacagtggcaatcaattcgtggggctccggacttgatggtggaggatgcatgaatggaaatcaattcatggggctccgaataagatttgatggtggaggatgcacgaacaacgctagacaatcaattcgtggggctccggactcgatggtggaggatgtatga

SEQ ID NO: 36755 - DNA, 503 bp, Glycine max
  Peptide Sequence Number=SeqID_153533
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagag

SEQ ID NO: 36756 - DNA, 249 bp, Glycine max
  Peptide Sequence Number=SeqID_153534
atgtcaaagaagaaaaacttggtgtgggcttcaagtgagatgtttgggaaacttagattcaaaaagaaagaaaaagaagaggaagaagctatcaacatgaaaccaagatatttggctggaatctgggtcgaccatgatggcaaagtaactgtggagaggaggggaaagaaagggaatggaaaggaaaggtttttagggaagtttcccttatttgggagtttggaaaggggagggtctggggatttttag

SEQ ID NO: 36757 - DNA, 633 bp, Glycine max
  Peptide Sequence Number=SeqID_153535
atgattttgaccaaaaagaaggtgcagaagcgcaaggagaaggctttgagggcgaaaccccggtcggttttgatgatggtggataaacccactaccactatgcggcgttcgagtggggtgattgtgttgagggtagtgggagtgagagaagagaagggaaatgaaagaggggtgttttgggaaagagaagagaggacgaggaaggtggaagttaggtggcattgggaggtgggagcggcggcggcgacggaatgtaacaaatcgatcggattgattcgaccaatcgaatcacaacccgatggctggattgggttgagtcttacgtttgttcgagtgtgctctcaatctggagtgacccaaaacaacccgatcgaatttgtgatcaaattggtgactcgtcaacccgaaccagaaattaccatatccttcctctcgcggtctcgctctacgcctccacttcgctcaccaacctctccttctttcctcttgctcacaatctcactctcagtctctcatagcctcaccttctacaccgtcgctcgccaacgaccgacctatctatccttccttcctctagtcatggcattgtgctactgccaccttctatgttgtcacttgcagtctcggtcttaa

SEQ ID NO: 36758 - DNA, 366 bp, Glycine max
  Peptide Sequence Number=SeqID_153536
gtatttgactctcctcatgtcaaaatacttgttggcaagaacaagacaacccgaagacgcttagatgccaagtctgttgttgagttggctactgttaggcccatttcacaagtatataggagaaatggaaagaaaaatactgaagggagagtgggagaggaaaatgggcccagaggcaatgtgggtttgattatggcagctgaggtggagtttgaaaaccggaaagatagagttgtaacagaatgtacagatggcaagcaaggagagggggatcagggatgtaggtgcggaaatcatggaaggaatataagttggaaattaacagaatgcaggggaggaattgaagggtggtgggtgtttgggtga

SEQ ID NO: 36759 - DNA, 267 bp, Glycine max
  Peptide Sequence Number=SeqID_153537
atggcggatgtgactataattatagttgtgacgcgatcacggtgtacccaaaaatctagaggttgtgatcaatcatggcagcagatgcatctgcaacttgcaagatatatggacgacaaattaaagataagaatggtgaacccaaaaatttgcttggcagagactggggaagaaatggtcgatcacgtatatttgattcccaacccgcatcctcaatcacttgacccagtaatgatgagaaacgaacccaataagaaattaatgtag

SEQ ID NO: 36760 - DNA, 1527 bp, Glycine max
  Peptide Sequence Number=SeqID_153538
atggccttctatggagttgcttccaacttaatcaattacctcaccacccaacttcatgaagatactgtttcatctgtgagaaatgtgaataactctgattcttacttgggtcgtttctggacattcgctctgtcatctctcatttatgtcttgggcatgattcttctcactttagccgtatcactcaagagcttgaggccaacgtgcaccaacggcatatgcaacaaggcttcaaccttacaaatttcatttttttacatggcactctacactatggcagttggagctggtggaaccaaacccaatatctcaacctttggtgcagaccagtttgacgactttaatcccaatgagaaacagattaaggcctcttttttcatgaggtggatgttcacctcattcttgggtgctttggtagccactttaggtttagtctacattcaagagaattttggatggggtctaggctacggcatcccaacaattggtcttctattgtcccttgtaattttctctatagggactccaatttatcgccacaaaaatagggcagccaagagtcctgctagagacctaattcgtgtcccaattgttgccttcaggaaccgaaaactggaactccctattaacccttcatcagatctttatgagcacgagcatcaacattatattatattagtggtggaaaaaggcaatacaccagctttgaggtttttggacaaggctgcaattaaagaaagaagcaatattggttcctcaagaacaccattgaccgttacccaagtggaaggattcaagcttgtctttggcatggtcctaatatggcttgtcacactgattcctagcacgatatgggcacaaatctacactctttttttaaaacaaggtataaccttagaccgaaagcttggtcctaattttcaaattcctgcagcttctcttgggagcttcgtgacactctctatgcttctctccgtgccaatatatgaccgatacttggtgccattcatgcgtcgaaaaactggcaacccaagagggatcacgttgcttcaaagtctaggaattggattttcaatccaaattatggccattgcaattgcttatgtagttgaagttagaagaatgcatgtcataaaagcaaagcacgtagttggtcctaaagaccttgtccctatgaccgatgtgttcaatgcaatcgggttgctagaatttttctatgaccaatccccagaagacatgaggagtcttggaacaacgttcttcactagtggaatcggtgttgggaacttcttgaacagctttttggtcacgatggttgataagattacaaggagtactgagtgtgatgaggcaaagagttggataggtgacaacctaaacgattgtcacttggattactattatgggtttctattagctctatcgattatcaatttaggtgcgtttttttgggtatcaagaagatacatttacaagaaggagatgggcgaagatagtctttatgttcaaggggaagccaaagtgtga

SEQ ID NO: 36761 - DNA, 132 bp, Glycine max
  Peptide Sequence Number=SeqID_153539
atgaagaggaacactgaaaaggttaaaccggaggaggcttatgctggttttgtttctgaggacggtgttgctttaggtgaagtgacgagccttgtgaatttttctggttgtttaagatacataaaggcatga

SEQ ID NO: 36762 - DNA, 723 bp, Glycine max
  Peptide Sequence Number=SeqID_153540
atggcttcttactacttcctcctcttgctagttctcgttggtgcaactacagcagcttctgaggaagagctatgcacagacttttactcctgcacctgcccaaacttgttgcctatagtgaagaaaggagtggccaaagccattcagaaagaaccacgcatgggggcttccttactccgattgcatttccatcacttctttgtaaaccttgttccaagttgctttcataagatagtgatatttcagggttgtgatgcaccaatactgttggatgatacaagcaacttcgttggagagcaaacagcagaagctaacaatcaatcagctagagggttcaacgtgattaatgatattaaggccaatgtggagaaagaatgccccagagtggtgtcatgtgctgatattcttgctctggcagctcgagattctgtattaggaggacctacttgggaagtggggttggggagaagagcttctactacagcatgtagaagtgatgctaataacaacattcccgggcctttcctcagtctatctgctctcataaacaattttgctaatcaagacctctcagttacagacttggtggctctttcagaaaatttacaacaacttacttacgcaccgaccaccttactttttaatacatctgggttccaaattaaagttgtggttttatatatgtggaatgattgtgatggcatgtggagtttcttgcattag

SEQ ID NO: 36763 - DNA, 408 bp, Glycine max
  Peptide Sequence Number=SeqID_153541
atggaacaacctgctaagaaatcctccagccattgcactgctattcaagcaggcattggggctacatcgacgactcccacatccgtagtcactaatacccctacggtattcatgataacacctaccagtcatccagattatatactagaggactacatagatagtgaaggagatgtcctacaaatgaaaatgaggatccatgatatcatgcaacatctctctaagaagttgggtgatattgtaaaacctatgatcttgaatgaaatccaaaaggttcgagaggaggaatattgccatagtcaatcaaaggcaacgactaatttgctcccagaattcagccttgtcagccttggtcactggacctatgaggactacatagatagtgaaggagatgtcctagtactatag

SEQ ID NO: 36764 - DNA, 570 bp, Glycine max
  Peptide Sequence Number=SeqID_153542
atgaggatccatgatatcatgcaacatctctctaagaagttgggtgatattgtaaaacctatgatcttgcatgaaatccaaaaggctcgagaggaggaatgttgccatagtcaatcaaaggcaacgactaatttgcacccagaattcaaccttgttagccttggtcactggacctatgataggtgtttaaacactcaaaattcctccaatgcaatttggcaaattcgatcaatagttgggctaacatggaacggtgttttcatgacaggaaggataagagaaaatcttagaggtaggagaaatcctcagaccaaatacatggtattggaaaaggatgaggaagactttggtgatgacttgtctactgatcaaatggcgactgagttgatcaaagagaaaccttattcttgtcctgccttacaaccctttaaagggaaagaagttgaaggaaagaagccttaccttttcaatattttcaaggtggaacaaatctttgactacttagttaaagatcaacaaattcgactacacaagggtcagaaaattcctccttcaaatcaaatcttttga

SEQ ID NO: 36765 - DNA, 258 bp, Glycine max
  Peptide Sequence Number=SeqID_153543
atggcaactcctgtcatctctctcatgaacacttctcatctaaagattgctctctttgatatcacaactggtcctcctcaggcttactttatctggggtaataattgtatttttgacgatgagaagtgggatattcagagagtagtgcagagtatatgcttctatcatgatgatcttgtctctaccaactctgattgtgctttggccagtcaatctcctctcttcatggctagatggcaaccccctcctgtggattga

SEQ ID NO: 36766 - DNA, 1554 bp, Glycine max
  Peptide Sequence Number=SeqID_153544
atggtgacaatgccaatgttgatggtggtgttgggagtggtagttagtgatgttggtgtaagtggtgatggtgattattgtagtagtagtgttagtggtgatgtcggtaatgacaatggtggtggtggcagtgcgatggtgacagtggtaacaatgctagtgatgttctatgcccgtggagcatgtttgaagggggatcaatgtgattttgctcatgagaaaaaggatgatatttgcagctattataaaaaaggatcctgtgcttatggtagtagatgcagatataagcatgtcaaagcttctcaagcgtcatcttcagcaaatggacgccattctcctgttttggatcctgttgtgaatcataccattaaaggaacatcaagttgggttccaaaggctgtgaagtcatcttcatcggacaagcgtgcaaggagctcacaacaaaagaatctgccctctcttgaaaatgatgttggtcaatccagtactagtagtgttataccatctgaacatttgttctgtgcatttgctgctgccaactgcccccttgaagataaatgttctcgcattcatggaaatcagtgcttatactgtagaaaattttgcttacatcctactgatcgaaaggaaaaagaaaaccatttgagaacttgtgagaaaaaggaaaaataccttcaggctttgaaagatagtcaagaagtagagtgcaatgtttgtttggaacgtgttctgtccaaacctaaaccagctgattgtaagtttggtctgcttcctgaatgtgaccatgctttctgtttatcctgtatccgcaattggcgtaatagtgccccaacctctggaatggacatcagtaatgctggcactgctaatacagtcagaacctgtcctgtttgtcgcaaactatcatattttgtcattccaagtggtatttggtattctactaaggaagaaaagcaggaaattattgacaactacaaggcaaactgcaaactaattgattgcaagcattttaactttggaaatgggaattgtccatttggggctagttgcttctacaagttgagccctggtgcagcggtaaagttgtgccttggtgacttgttggtcatgggttcgaatccggaaacagcctctttgcatatgcaagggccaccacctcaacgtagacagaaccattttgatgtgcatgacatgttgaacatgctccaggatgttgacttaacaagtgcagaatatttttccatcatgagggactcggacctttatgatgatatggatccattcgagatgatggtatctgataggcttgctggtgattcaggtccttgtttaggtccttttgattctgatgaggaggacttggatatttttcagatggctgcattgtcagaagtgctggcttctggcgtggatgattttggtcccgaagatttcggtgatgaagatttcaatcctatggaggctgccttgttatcaatgatgatgcattctaatatggaagatgaagatgacgacgatgatgaagaagaagaatacagtgatgaagactactag

SEQ ID NO: 36767 - DNA, 1029 bp, Glycine max
  Peptide Sequence Number=SeqID_153545
atgacagatcctaagtccaatgtatacactgaaacattcaacttcatgcccctctattctcatcactcttcttttacttctcaatcaagcctactctcttcttaccctctttcatattcaaacaccaacaccaacaccttttccaatcaatcggatacctcttcttcctcttgtgcagcccctcctccttcttctcctctcagagaagcccttcctctcataaacaacataaaacagaagaaaaatgaaccctcaaacggtggtgaagaagttgaagaggaaggacaaaagaaaagggacatagatgagacccttttgactagtattactgaagagggtgatgatgatgaaactgtgacagtagcactgcaaataggccttcctagcgtggctacttctgatcttaatggatcaagaaagatctttgaagcttgtgcaaaaatggatgtaaaggaggatgtgagggttatttctggacacccgttggatagattgaacaacattcagtattggattcccaccccttctcagattctcattggtcctactcagtttttgtgtcatgtgtgctctaagagtttcaacagatataataatcttcagatgcatatgtggggacatggatctcaatatagaaagggccctgattctctaaaaggaacacaaccatcagcaatgctaaggcttccatgcttttgttgtgcaccaggttgcaagcacaacattgaccacccaagaacaaggcctctcaaggacttcagaacccttcaaacacactacaagagaaaacacggcattaaaccctacatgtgcagaaaatgtgacaaaacatttgcagtcaaaggtgattggaggacacatgagaagaactgtggcataacatggtactgtttatgtgggtctgattttaaacacaaaagatctctaaaagatcacataaaggcctttggccatgaccacggtgtagttgacattgattgcatgcaagaagatgaagcagcctctgaaattgaacatgatggaggatag

SEQ ID NO: 36768 - DNA, 876 bp, Glycine max
  Peptide Sequence Number=SeqID_153546
atggccaccaccaccatgttctcatcaccatcagccattttatcctcaaccaccacaccaaaaccatcatcttcagcaccaccctccccatcatgcaaacctcttctacccttcaaacaacccttaacaaccttaactgccgccgccgccatcgccaccattttaaccaccgcaccagcaccctccttagcacaagagtctccctaccaagtctactacggcaccgccgccagcgccgcaaactacggcgggtatggtggcaactccagcaagaaggactctgctgagtatgtctacgacgtgcctgctggctggaaggaacggttggtgtctaaagtcgagaagggtaccaatggaacagacagtgagttctacaacccaaagaagaaggcagagaaagagtacctcacttttctcgctggatttcgccaacttgcaccaaaggatgtgattttgaacaacttggcactatctgatgtggacctgcaggacctgattgctaatgctgacagcgtgacctctgatgaggtgaaggatgataaggggcagctgtactatgtgtatgagattgatggagttggtactcatagcttgatctcagttacttgtgctaagaacaagctctatgcacattttgtcaatgcccccactcctgagtggaatagagacaaggacatgttgaggcatgttcatgagtcttttaagactgctgaaattagaaatattcctctggagttaggtaatgattatctgttctatgcagaggatggtgcccttgggatggcttcttttgataaatttgggatttttactgcttcaatttttggtatagctggcttcaatttgaaactttcaatttcagatgtggttaattga

SEQ ID NO: 36769 - DNA, 2835 bp, Glycine max
  Peptide Sequence Number=SeqID_153547
atgttgtcaatgaacaaaacatctccaaggttttggtacatcaatttcctcccacatagtattctccaacgtctctacttcccattcaaacgcgccactctacaaactgcttctctagccacagtaaaagattcacaaaccacgttcacaaaaccccccatatcctattccaagctcttatcacaatgtgttgcttcaaagtccctaacttcaggtatggaactccatgcacacttgatcaagtttgggttttcccgcgacccaagtctcaggaaccacttggtaactctgtattccaagtgtcgtcgttttgggtatgcccgcaagctggttgatgaaagttctgaactagatgtggtttcttggtcttctttgctatctgggtatgtgcaaaatgggtttgtagaggaggcactgttggtttttaatgagatgtgcttgctgggtgttaagtgcaatgagtttaccttccccagtgtgcttaaggcatgttcaatgaagagggatttgaacatggggaggaaggttcatggtatggctgttgtcacagggttcgagtctgatgggtttgttgctaacacattggttgttatgtacgccaagtgcggcctgctggatgattctaggaggttgtttggtggaattgtggagcgaaatgttgtttcatggaatgccttgttctcttgttacgtgcaaagtgagttgtgtggtgaggctgtgggtttgtttaaggaaatggtgaggagtggaataatgcctaatgaattcagcatttccatcatattgaatgcctgtgcaggcttgcaggaaggcgacctgggaaggaagattcatgggcttatgctaaagatgggacttgatttggatcagttttctgcgaatgcgttggttgacatgtattctaaagcaggggagattgaaggtgcggttgctgtttttcaggacattgcacaccctgatgttgtttcttggaatgcaattattgctggttgtgttcttcacgattgtaatgatttggctttgatgttgttggatgagatgaaaggctctggaactcgtccgaatatgtttacgctgtcaagtgctttaaaggcctgtgctgctatggggttcaaggagttgggtagacagttgcattctagtttgataaagatggatgctcactcagatttgtttgctgctgttggacttgtagatatgtattctaagtgtgaaatgatggatgatgcgagaagagcttacgattcgatgccaaagaaggacattattgcatggaatgctttgatctccggttactcacagtgtggtgatcacttagatgcagtctcacttttttctaaaatgttcagtgaagatatagatttcaaccaaactactttgtcaacggttctcaaatctgtggccagcttgcaggcaattaaggtgtgtaagcagattcatacaatttccatcaaatctggaatttattcagatttctatgtaataaacagtcttcttgacacatatggaaaatgtaaccatatagatgaagcttcgaaaatatttgaagagcgcacttgggaagatttggtggcttacacatccatgataacagcatattctcaatatggggatggggaggaggctttaaagctatatttacaaatgcaagatgcagatatcaagcccgatccatttatctgcagttcccttttaaatgcttgtgcaaatttgtcagcctatgagcaagggaaacaattacatgtccatgccatcaagtttggatttatgtgtgatatttttgccagcaattctctggttaatatgtatgcgaaatgtggaagcatagaggatgctgatcgtgccttttctgagatacctaacagaggaatagtctcctggtctgcaatgattggaggatatgctcagcatggccatggtaaagaggctcttcggttgttcaatcaaatgcttagagatggtgtgccacccaaccatattactttagttagtgttctttgtgcatgcaatcatgctggtttggtaaatgagggaaaacaatattttgagaaaatggaggtaatgtttgggattaaacccacacaggagcattatgcttgcatgattgatctccttggacgatcagggaaattaaatgaagcagtggagctagtaaactcaattccatttgaggctgatggctttgtttggggggcacttcttggagctgcgagaatccataaaaatatagagctcggtcagaaagctgccaagatgctttttgatcttgagccagagaaatctggtacccatgttctccttgcaaacatctatgcctccgcagggatgtgggaaaatgttgctaaggttagaaagttcatgaaagacagcaaggtgaagaaggagcctggaatgagttggattgagatcaaagacaaggtatacactttcattgttggagacagaagtcattctagaagtgatgaaatatatgctaaactggatcagttgggtgaccttctaagtaaagctggatatagttccattgtagagatcgatatacataatgtggacaaaagtgaaaaggagaagctcttatatcaccatagtgagaaacttgctgtagcctttggattaattgctacgccacccgggggccctataagggtgaagaagaatctacgaatttgtgttgactgccacacctttttcaaattcatgtattatgagcagatcatgaatctgttaaatctgaatcaaagaaacctgcaggctaaaagggctactgtaaaccatccttataaaggaggatggtcagagcaggataaggctggtccaaaatacaaaaactgttga

SEQ ID NO: 36770 - DNA, 138 bp, Glycine max
  Peptide Sequence Number=SeqID_153548
atggagaaagctaaggaagaagtaggagccaactacactattggagacaacacacaactgatctccttgacctccaagcctctcaaggaagaagcaatggtcaacttcaagctctatttaaggatgaagagacgttga

SEQ ID NO: 36771 - DNA, 814 bp, Glycine max
  Peptide Sequence Number=SeqID_153549
atgggaaaggttgggattggctttgtgcacttcctaggcatagtattaccacctgggatcatcagtgcaccaacaaattcatcccgaagtactttttttgtggtgaaaactaatcaaatacagaaagacattgagaattttgctcataagggacaagagagtctagcagaagcgtcggagagtgtgtcctctaataacaagacaatcttcgatgtcgcgggtgggggtaacttaattcttaaaccacctttagaagccatatggatcattaaaaacatgtcttttaacccatataacaactctagggatgagagaattttgaggaggcaagtgaatcagattttagccttcacacttccaccctttacttgtgataagtgtggggaagctcatgctgcaggagagttcctggtgagtgatgcacttgcccaagccttggaagatgagcaaaggtataatatcctgtgtacattaccaaaaatgatactcaactctcttccatggaagctcttttgtctcaaaagctactgccacacttccttcaattcccaaactgaagccaatgctaagaaggaagaagtgaatgttatgagtactaggaatcgaagtaaggatgttgaagttttgattgaggcacaatggtctctggtggctagaggtgccttgggtcttgaagctttaaacttcacagatgagaggagaagcaaaatatttagaggaaatggtgagggggtttttagtcaatatgattggagccaaaaatccctccttgtgcctttgaattttcagctatatatgactctccaccaacaag

SEQ ID NO: 36772 - DNA, 330 bp, Glycine max
  Peptide Sequence Number=SeqID_153550
atggttcatagaggcaaaagctcggaggagaaggatttgatttttggggttcaacgatcccaccctgttgacatgaaaccacggcttgatgtgttcatggccaccaatatcaatgaagatatcagcagctttcaacttgttgggagccacattgacaagtcctgcaaagtttacataggagacaccatgattgcagaggtaattgatgtatatccaagaagcaacttcagcaattggaaagaaggcttgaaggtcaaaatcaatgcaggggtggattatgatttcattgttgcgttgcttgtaatactcacagtaaatgattacatatga

SEQ ID NO: 36773 - DNA, 285 bp, Glycine max
  Peptide Sequence Number=SeqID_153551
atgggattactgcttctaaaggttgtgagtaagcacaacaaaatgccatttacaaataaactcattttgaaagtttcatatcatattaaaattagtttaagagtatttttatgtggtggaaatgacaataataatgataataatgttaacaacgacgatagaagaaatactagtggtgactgcaatgacaatgacgatgacaacgatggtggtgaaggtagtagtggaggtggtggcgatgtcgatggtggtagtagtagcggtgttggtggtgagagccgatga

SEQ ID NO: 36774 - DNA, 915 bp, Glycine max
  Peptide Sequence Number=SeqID_153552
agggatgttgtctcacaagtaaatattgctgctccacggaggctgcttcaatttgcagtgcgagatgcagtagcgacttcaaggacagccacaggcatgtcagtggagccttccctaaaacgtcttcgttctgtagtttctacatctgctggcgattcatctttcgtggaacgtccacagaggatgcagcttgcttccagggtgtcaaatccaatggctacaatgattaaggctgtggcagaagctgccgaagatgtgataaagtccaagccatctggaagtgtatttgatagacttggtcgtggtattgatacatcagatgacaacaggcaacttgaagatagttaccaacatcaggagcaacatcatttattccattctcaaagaactgagtacaatggggggtatgctgcaaatacaactatggcgggacatgaaactggttatccttctgattctaattcagacaatgaagggtttaatgatattaatgtcatggatcatagggtgtctggagcttctcagatccgcccctctgttggaaacaggggcaacgattcactgatggtgcagtatagtgtagcaaaaaatgttgatgatagtttgcgccaaaagcggaatcgagaacaggagcaacttgcagcatcacccaacacatctcataagatagtgaatatttctgttaatgtaaatacatggaaacctccacaacatcaggtatcacgagaggttacagaattagatggtaatataactttttacaatgaaagaggagatcccagatctagtacacggctggtgaaggagaatgccagcactctaaaagttagtaatgggaatggtaaaatacatttcacctccttgaagaatagctcgttcttgacctacctccctgagcattttttttacacttag

SEQ ID NO: 36775 - DNA, 177 bp, Glycine max
  Peptide Sequence Number=SeqID_153553
atgccaggttgttgcaccgctgctgccgccggactgccaacagaagtacttgccggaagatcatcagacgacaccccaagatttgtgtcacatacttgttggccgtggcaatcccaaacatatgggacaagcggaattaattgctatatggaccaacttgaatggttcagggattga

SEQ ID NO: 36776 - DNA, 630 bp, Glycine max
  Peptide Sequence Number=SeqID_153554
gttcattttgctgccaccaaagatggcctgtctcggcattttaatagatttggggatgttttaaaagtgattatagttacagatgcagcaacagggcagccaaaaggggcagcttatgttgagttcatgcgaaaagaagcggcagataatgcattatctctggataacacttctttcatgtcaagaattctcaagcggtgcaatgcaaatgataaccggcacacaatgcaaagtgctacacctcaagaatcacctcaagtgctactcctcaatgcaaatgataacccatctgtagtaatacctaacaaacctcgagttattaagaaaagtgctactcctcaagaatcagctccagccatggcatggccacgcattgttaagggttctccattcccttctgctaggttttccagacatccctttccaagaggtattcctggtgtgtttagagctcgacccccaattaaactgggtgccaggagcatgcaatggaagcgggatgctcagggatcaggatctgacagtagttcatcagtgaataccggcaatgttgctgctcctgttggtcgtgggttcacctacatcagaacagaatctaagccagaaggcagcttgggtacgacaacatag

SEQ ID NO: 36777 - DNA, 1677 bp, Glycine max
  Peptide Sequence Number=SeqID_153555
atggtttccgttgataatggtaaagatgaaattgaagaatctaatggaagtaaagtaaatgagtttgcttccatagatatttcaacttctcgaagaacaatggtgggcaatgaaaatcctcaaagaaagttccagggcaccttgagttctattcccaataggatcaacttcttcaaatttggttctgcatctgccaaattcaggaggcttgctactgagaaggaccagatttcgcaaggcgtgccttccccgggttctattgggttaagagagcgcttcagtggcatgtttgctaagaaacttgactgggtttcactcaagaagatgtgtttagaatggtttagggacccaatgaacatagccctttttgtgtggatcttgtgtgttgctatttcaggtgcaattctgttccttgtcatgactggcatgttgaatgctgtgctgccaaggaagtcacagagaaacgcgtggtttgaagtgaacaatcaaatactcaatgcactgtttaccctcatgtgtttgtaccagcatccaaagaggatctaccaccttgtccttctgtgcaggtggagtccacaagatatctcaaggcttagaaaggtgtattgcaagaatgggacttataagccccatgagtgggcacacatgatggtaatggtcattctccttaatgtgaactgttttgctcaatatgcactttgtggtctaaacttggggtataaaagatctgaccgtccggccattggagttggaatatgcatatcttttgctattggtgcgcctgcagttgctggtctgtattccattcttagccctctaggtaaagattatcattctgagatggatgaagaagcacagattcaagaatctgttgctcagaagcaagagccactgagagtgaaatcatttcagaagaaatattcatttgcctccaaacagcagcgaagggttatcgaaactagaccacagtggagtggaggaatacttgacatatggaatgatatttctcaagcatacctatcacttttctgtactttttgtgtgtttggttggaacatggagagacttggctttggaaacatgtatgttcacattgctacttttatgctattttgtatggctcccttttggatttttatcttggctgctgtgaatattgaggatgaaactgttaggcaggctctagtagcaaccgggatcattctgtgtctttttggtttactgtatggtggtttttggaggatccaaatgagaaaaaggttcaatttgcctacttataacttctgttttggcaagccttcagcttctgattgcacactttggctatgctgttgctggtgctctcttgctcaagaagtgcgaacggggaatagctatgatattatagaagataaattatgcaggaaagaagtttattctagtgaccaacagctaatgtcacctttgcctcgtgaagatgtggcatcaagcaaatctggcacaagttctcctttgggtaacaactcttccccttctatgatcaagccatctagtcctctaaattcaagcggttttgttaaggggtattatagtccagagaggtcactatctactgtaaaagaagaggttcctgaaagaagtaaagatggaacaatgaacccaccaactcctccatcaatacaaagagaatctccttag

SEQ ID NO: 36778 - DNA, 162 bp, Glycine max
  Peptide Sequence Number=SeqID_153556
gatattgctgctgcaattgatgaggaagatgttggaaagtttactgaagttatcaaggaatttgatagtttgactcctttggattcttggaagacaacacttcttttgagggtgaaagataaactcaaagccaaagaaatcgaggaggatgatcttacttga

SEQ ID NO: 36779 - DNA, 282 bp, Glycine max
  Peptide Sequence Number=SeqID_153557
atgtttcctttcgactcccgtcatgtcgcaaaacttcccggattgcttaacgatgagtgtcaagttcctcgatgcagtcaagcagaggataggttgatggagaagttgaagagacaactagaaatggaggatagatgtaaagaggagaggtggggggttaaagaagttcgagatgctattgctccaatccttattcccactaaagaggttaagttagctgagcagaccttcaacaccttcattgcatggccgagacgtctagtgaagcttgtttcattggag

SEQ ID NO: 36780 - DNA, 240 bp, Glycine max
  Peptide Sequence Number=SeqID_153558
atgggaagataccacaacaccttcgctagagggcccttctttgagttttcatcagaaatgcagtcctcatcatccttgactttgtactgtgatgccccactgtcgcaacatgcccttttgcgggcgagcgaaggcgaggctcacgggtgcgttctccaaaggaggaaagatgcgcggagtcgccaccaacgtttatttgtggaaaacgtcggaaaaaccgaaggaaatcggtcaaaatga

SEQ ID NO: 36781 - DNA, 228 bp, Glycine max
  Peptide Sequence Number=SeqID_153559
atggctgtagtggaagtgaaggttggttttcactgtgatgagtgtatcaagaaaattctcaaggccatcaagaagattgaagatattgagaagtataacgtgaacaaacagttgaacaaggtcatcgttacagggaatgtcacaacggaagaagtgattagagttcttcaaaagattggcaagaatgctaccccatgggaaaatcctaaaccccaacccaattgctga

SEQ ID NO: 36782 - DNA, 210 bp, Glycine max
  Peptide Sequence Number=SeqID_153560
atgaccatcaaaccaccatcctgtggccgatgcgaccatcacaatcccaacatcgtcattgtgacctcgatcccatcacctcaaaggctggctagcggtagaggaggtggtgtaggaggcggtgtgacgcagaggagatgggtagggtacttgactggttggtcgtgcggtggtcagggttgtggtgatgatgacatgcgcgaattttga

SEQ ID NO: 36783 - DNA, 140 bp, Glycine max
  Peptide Sequence Number=SeqID_153561
ggtgaaatggatgataaatcacctttggataaatatgagttaaaacttgctgtgggtgagagttctaagattgatttgtacaaatatcttgggaaagcctctatttacacccatgcccatgcctatgctacttgtgccat

SEQ ID NO: 36784 - DNA, 240 bp, Glycine max
  Peptide Sequence Number=SeqID_153562
atggatatcaagtccacacctattgatacaaaggctttcatatttcatacacttgttcaattgaaggacaccaccatcagagatagttttgacttgtacagtggattattcttacataataggttcgctttacaagtgttggagaatcttgaacatgccttgcacaaagtcaaagagactctggttcaaaggaagagtgagaggagctgggtccagaaaagactgaatgctgatatataa

SEQ ID NO: 36785 - DNA, 660 bp, Glycine max
  Peptide Sequence Number=SeqID_153563
atggctgccaagaagtactttgtcacacttatcccagatgcttttgtgaaatgtacacgcttacaaggatggaggatccctgcggatgtcatcctcacaaatgttggtacgagagtttggaatgtgaaaacacgtcttgttagaaacaaaatttactttgaagagggttggaaggtttttcaagaagaaaactttgtaggaaaagaagattatcttgtttttaagtatgatggggccaacattttcaaggttgtaattcttgaacaatcgtcacggtgtgaaaagacagaagttgaagaagaagatgaggtgatagatattacagatgatgaagaacatgaagaagctgaggatgatgacaatgatgatgatgagtatagagacatggaagaagagagtgaagaacatagtgctgaatacacgaagagtcaaacacatcctcttagagcctccaacagggagaatgcttctagttccagtcctatagttgaaggtcctcatcttgaagactatgaaatccacaaatgtatattcagcagggagatccatattttgaagcaaagctcctcaaatgcagacccaacgaattggatactcaaagagatgaattacgagactatcatggcttgccacaacggacattcatctattccgaagtag

SEQ ID NO: 36786 - DNA, 324 bp, Glycine max
  Peptide Sequence Number=SeqID_153564
atggaatttggatgttatgcatttttcaacaatcatgtgagggctaaatttgagtcagaaaactacgcatttgatgtatgcattacaaaggatgaaagagttaagattgtggattccaacccttggggtgcctttacattgtcattgttgtttacatgggatgaattagaccatattcatagtgaaggaaatgatgtggagtttagaattgtggaagatcgttgtgctgttaggccaggccttaaaacagcagtcccatttgattatttggataccagcccggggagtggatcaatttctaaaaaaatgcagatgaagagttaa

SEQ ID NO: 36787 - DNA, 1635 bp, Glycine max
  Peptide Sequence Number=SeqID_153565
atgatgaatcacgattccgacgaccaacagcatcacattctccacgcctcccaggacgacgagataatggactcgctgatcctccaccacgacgacgacggctcctccgttcaccatcaccaccgtcctacgtcgccgcaaagccctaattcccctttcaactcgttccttgaccctccctcttacgccgatgcaatcttcacctccttcgattccaacggccacgaccaagccgtcgagtcccccgccgcccgattcggctccggcgactacctccacatctccgtcaccgatcctcagaaggagcaggacctcgccacctccacctccctcgtccctggcgccgccaccttctacacctacctcatcaccacgctcatcaacctccctgaatacggcggcgtcggttccgagttcgccgtccggaggcgattccgtgacgtggtggcgctctcggaacggctggcgttggcgtatcgcgggttcttcatcccggtgcggcctgacaagagcacggtggagagccaggtgatgcagaagcaggagttcgtggagcagcggcgcgtggcgctggagaagtacctcaggaagctggcggcgcacccggtgatcgggcggagcgaggagctcaggctgtttctcgaggccaaggagcggctgccgctggcgaaaaccaccgacgttgcgtcgcggatgctcgatggcgccgtgagactgccgaggcagctgttcagtggagaggcggagctgggagaggtggctcagccggccaagggcgggagggacttgctcaggattttcaaggagttgaagcagtctgttgccaatgactgggttgggagcaagccccttgttgtggaggaggataaggagttcatggagaggaaggataagttggtggattttgagcaccatcttagcaatgtttctcagcaggctgaatcccttgtcaagtttcagcaagacatgggtgaaacgatgggtgaactaggtctggcttttgttaagcttacaaaatttgagacagaagaagccatatttgagtctcagagagttcgagctgctgacatgagaaatgtggcaactgcatctgttaaagcaagcaggttatatagagagctgaatacacagacaatcaaacatttggcaagtacacatattcttatgacttatgatagaacctttaagcttgtttataaatctatggataaactacatgaataccttgggacaatgctagctgtcaacaatgcattttctgacagatcgagtgcattgttgactgttcaaactctctcatcagaactagcttctttacattcacgggtggaaaagcttgaagttgcttcatccaaaatatttggtggagacaagtctaggatgcggaaaattgaagagttaagagaagccattagagttactcaggatgctaaaatttgtgcagatagagagtatgaacgaatcaaggaaaataataggagtgaacttgaaagaattgatcaagagaggaatagtgacttcctaagcatgctgcgagggtttgttgcaaatcaagcaggctatgcagagaagacagcaactgtgtgggagaagcttgcggaagaaacggctgcttacttgagagacagcagctaa

SEQ ID NO: 36788 - DNA, 231 bp, Glycine max
  Peptide Sequence Number=SeqID_153566
agaatccccaaagttaagtatgctgtgaagaacattatccttaggacattgaagcttctcttctggggtatacttttgcaaggtggatactctcatgcccctgatgatctatcatatggagttgacatgagatttatccgatggtgtggcattctccagagaatagcccttgtgtactgtgctgtagctctaatagaaacatacaccaccaagcttagacccctaccttga

SEQ ID NO: 36789 - DNA, 2502 bp, Glycine max
  Peptide Sequence Number=SeqID_153567
atggaggacaagaacctgacctcaaaatggttttttaaccccaacccaagtagtcattttttccagttgtttttctgtttgtggattctcatggtgccagtggtggcgagtgaagagcgttgggatggggtggttgtggcacagtcaaacttcctagcacttgaagcgttgaagcaagagctggttgaccctgaaggcttcttgagaagctggaacgacactggctatggagcttgttctggagcttgggttggtatcaagtgtgctcggggacaggttattgtgatccagcttccatggaagggtttgaagggccacatcactgagaggatcggccaacttagagggcttagaaagcttagccttcacgacaaccaaattggtggttcaatcccttcagcacttggacttcttctcaacctaagaggggttcagctcttcaacaataggttcacagggtccatccctccttcgttagggtcatcatttcctttgcttcagtctttggacctcagcaataacttgctcactgggacaatccccatgagccttgggaatgccactaagctttattggcttaacttgagctttaattccttgtctggcccaataccaactagcctaactcgcttaacttctctcacctacttgtctcttcaacacaataatctctcgggctctattcctaacacatggggtggtagcttgaaaaatcacttctttcgccttcgaaatctgatcctagatcataacttgttgagcggaagcattcctgcttctttggggagcttgagtgaacttacagagatttctcttagtcataaccagtttagtggagctatcccagatgaaataggaagcctttctagactaaagacagtggatttttctaataatgacttgaatggaagcttgcctgctactctctctaatgtttcctcactcactctcttaaatgtagagaacaaccaccttggcaatcccatcccagaagctttaggtagattacataatctttctgttctaattttgagcagaaaccaatttattggccacatacctcaaagtgttggaaacatttcaaagcttacacagcttgatttgtcactgaataatctcagtggagaaattccagtctcctttgacaatctgcgtagtcttagtttcttcaacgtttctcataacaacctctctggtccagttccaaccctacttgcccaaaaatttaacccaagctcatttgtggggaatattcaactatgtggctacagcccttcaaccccatgtccctcccaagctccttctggttcacctcatgaaatatcagaacaccgtcatcataagaaactaggcaccaaagacataattctcatagtagctggagtgctccttgtagttctggtaacaatttgctgcattctgctattctgcttgatcagaaaaagagcaacatcaaatgcagaggctggccaggccacagggagagcatctgcatctgcagctgctgccaggacagaaaaaggagttcctcccgtcgcaggcgaagccgaagcgggtggcgaggccggaggcaaactagtccattttgatggaccattggcttttacagctgatgatctcttgtgtgcaacagcagagataatgggaaagagtacatatggaactgtgtacaaggctacattagaggatggaagtcaagctgcagtgaaacgtttgagggaaaagatcactaaaggtcagagagaattcgaatctgaagttagtgttataggaagaattcgacacccaaatcttttggcattaagagcctattacttaggacccaaaggagaaaagcttttagtatttgattacatgcctaatggaagtcttgcttctttcctacatgctcgtggaccagaaacagcaattgattgggcaacaaggatgaaaatagcacagggaatggctcgtggcttgttataccttcattccaatgagaacattatacatgggaaccttacgtccagcaatgtgctgctggatgagaatacgaatgctaaaatagctgattttggtctttctcggttgatgacaactgcagctaattctaacgtgattgccactgctggagcattgggataccgagcacccgagctctcgaagcttaacaaagccaacacaaaaactgatgtatacagtcttggtgtcatcttgttagaactcctaacggggaagccacctggtgaggctatgaatggcgtggatttacctcagtgggttgcatccattgtcaaagaggagtggacaaatgaggtcttcgatgtagagttgatgagagatgcttcaacatatggcgacgagatgctgaacacgttgaagcttgctttgcactgtgttgatccttctccatcagcacgactagaagttcagcaagtccttcagcagcttgaagagattagaccagagatatcagcagccagttcgggtgacgatggagccattccttcgactagtgaatga

SEQ ID NO: 36790 - DNA, 237 bp, Glycine max
  Peptide Sequence Number=SeqID_153568
atgcaagttagtgaagaagtgaaacaatattttttacagggtcattccgagagactcaagcaatggctcttaatggggtttctgttattaaccctaggcctcatgcttcattttacagaggctatcccaattaacaagcaactctacagcttcagctatgtttgtttcacagctggggcagctggaattgtcttctctgtgttctacctactgctaaatggaatcttaattaagtaa

SEQ ID NO: 36791 - DNA, 145 bp, Glycine max
  Peptide Sequence Number=SeqID_153569
atggatgaagccaagagaatggaagaagggctaaagacaacctataatgattaccataagggcgagttgaaacatgaaattgaaagaactaacggtaatggagattccattgagcatgacaaagacgcaaggattacccaagagg

SEQ ID NO: 36792 - DNA, 714 bp, Glycine max
  Peptide Sequence Number=SeqID_153570
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttactaagggaatccttcgtgcgtgcacgcaaaagggtcgtcgatggggtccagaactgaccggctcgcacgtgattgggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 36793 - DNA, 801 bp, Glycine max
  misc_feature (797)..(797): n is a, c, g, or t
  Peptide Sequence Number=SeqID_153571
cagcggctggccgaagctgtccttgtaggtcgggtccagcgacaggtaggcgtcgcggtacgacatcaccgagccggaaatgccgatggtcatgaagcgctggtaggcgtcctgcacgccggccttccaggccgtgccccaggtgggcgtgcccggcgtggtgggcgtcatcttgatgggacggccgccgtagcgcacgtggcggatgctggccccgccaagaaagccgagcgggccgtggtcgaactggtcgccgttcagatcgtccatgccgacgccgccggcgccggtgcccacgaacgggttgagctgggtgcccttgggcagcagcacgttgaccgcgccgttcatctggtaggcgtagttcttgccgaccacgccttcgttggtcttgggatcgtagggcttgccgatgccggacagcagcagcaggcgcacgttgtgcatctggtaggccgacaggatcaccaggtcggcgggctgttcgacctcgcggccctgggcgtcgatgtaggtcacgccgaccgccttcttgccggtcgaatcgaggttgaccttgatgacgtgcgaatgggtgcgcagttcgaaattgggctttttcagcagcaccggcaggatggtcgtctgcggcgaggccttcgaatacatgtagcagccgtagttctcgtagaacccgcagaaattacaggggcccaggcgcacgccgtacgggttggtgtagggccccgacgcgttggccgcgggcgccggatacggatggaagcccacttcgcgcgcggccttgtcgaacagctggncgcc

SEQ ID NO: 36794 - DNA, 105 bp, Glycine max
  Peptide Sequence Number=SeqID_153572
atggaagagcaaccagatgaaaagcttgaggaatgtcagggagccattagagatgtcgctatcactgccagaatacacgtgagcccgcttagaggattaacgtga

SEQ ID NO: 36795 - DNA, 426 bp, Glycine max
  Peptide Sequence Number=SeqID_153573
atggatatcatctccggcaaggaccagaaattcgaaaatctcgacagcctcaagggcaagcgcgtgtcggtcaaccgcggttcctcacaggaaaccgcgctgcgcaaggccaacgtcgaaggtctcgaaatcgtcgtttacgaagacgattccaccagcgcccaagctttgcttgcgggtcatgtggatgccgtcgccctgccgtccacggttggtgaagcaatcatcaagcagcgcccggaagccggtctccaggtcgggttcaccttcttccagcagggcaattccatggcgaccaagcttgaggatttcgagctgcgccagtggctgaacacctccatttacctgatgaagatgtccggcgatctcgaccgcatctcggtcaagtggaccggtcgcccgctgccgcaattgccaagcttctga

SEQ ID NO: 36796 - DNA, 276 bp, Glycine max
  Peptide Sequence Number=SeqID_153574
atgatcacttctttctcttcagaaggtaatgatgaggaggatcaccatgagcactggaatggatctatgagtagaagtcagtcaaaacatcctaatcaacaagcttcaccacttccgactaaacttccagctggagctcatataccctcttgtgcttggcctgaagagggtggatctgagtatcccagacacatgccaggagctgatcacaagcaacccaatcacaaagtagatcaattcagtagatttcctaatttgccattgaatcctagataa

SEQ ID NO: 36797 - DNA, 360 bp, Glycine max
  Peptide Sequence Number=SeqID_153575
ctaataacaatgctatgggtcaaacacccacgtcactacatgaaagggctgagagcattttgggttttacaaagggacttcattttgaaactccgatcatgccaataggaagcgtaaaacattcaatggcggtttccaaactcagaatgatgcaaagggttcctctcagtgtagggtttcaacggagaacaatggaggtttgtggtggctactggtggttgtgggtgatggagaaagagcttggaatgaagcgttactcacacgccagacgtcgtatcgaagatcgcaacggtcagatcgtggacaagtgtcctgtgaagcgacagaccaaatttcaagaagatccaatggttaatgaag

SEQ ID NO: 36798 - DNA, 663 bp, Glycine max
  Peptide Sequence Number=SeqID_153576
tctctgcgtgctatcagggttttcgtcttacagacagctcaaaggaatgtttatacggataaccactctggaatttcagcccgtcagcgtgactcaaatgtcagtatgacagatcttgtgagcgcggaagatgacatagcaaaaaagaatgtttatacggataaccactcgggtatttctgcccgtcagcgtgactcaaatgtcagtatgacagatcttgtgagcgcagaagatgacgctaatctcctcgtgtcaactggcttgtcggccgcgattgacgaagggcttttcgtcttacagacagcaaaaaagaatgtttatacggataaccactcgggtatttctgcccgtcagcgtgactcaaatgtcagtatgatagatcttgtgagcgcagaagatgacacagcaaaaaagaatgtttatacggataactactcgggtatttccgcccgtcagcgtgactcaaatgtcagtatgacagatcttgtgagcgcagaagatgacactaatctcctcgtgtcaactggcttgtcggccgcgattgacgaagggcgcagaagacgaccaaaaaagaatgtttatacggataaccactcgggtatttctgcacgtcagcatgactcaaatgttagtatgacaaatcttgtgagcgcggaagatgac

SEQ ID NO: 36799 - DNA, 378 bp, Glycine max
  Peptide Sequence Number=SeqID_153577
atgccgatctccccctgcgaaagtatcggttggtctgtgccgtcacaacataggggtcgcacccacaagacacccagtggaaccggagaaatccaacagggccctggggtttccagctctggttatgggcctctatcagtcctacagggtgctcgtaccccccggcaaggggtcgtgcccacaggacacctagtgaacccgaagaagtccaacaaggtcctggggtttccagctctgattacgagcctttgtcagttttacggagtgcctgtcacccccagcaaggtcatcaagccccctattaaccgggctttcatcaagaagtactgcgccccccagataggcgcagggcgagacaccacaacagcctggggatag

SEQ ID NO: 36800 - DNA, 267 bp, Glycine max
  Peptide Sequence Number=SeqID_153578
atggcttcccaaatgtttaaatctatagcctctatgaagatttgcatacgggacaacgatctcaacacagaagattgtgtgaagaatccctggaggatttgcaacattcagcaaatggaagaagtcaaatgtttgatcaaagtgcttccaatccgggctttaggcattctctgcttgattcccataacacaacatggtgtccctaatcaccataggcttgttccccaatcaccattggtgatgtgtgttcaattctcacaatggtaa

SEQ ID NO: 36801 - DNA, 267 bp, Glycine max
  Peptide Sequence Number=SeqID_153579
atgggtgtcaagtacctcgaagtggtcaagcgagggtcgcatcccaataaacagatggctcaacgcacgagtggcgctaagcctgaatccacttacccgagcaaaggtatagactttaagcagatgattgacacagattccagagcacatcacagtgcctacttcaggaaaagagctctggaggcagcaagaggagaagcttttgcagagatacctaggttttgtaagcttattattgtgagggtttcttctgtaatggctggctaa

SEQ ID NO: 36802 - DNA, 381 bp, Glycine max
  Peptide Sequence Number=SeqID_153580
atgagtggaaagggattgcagcatgttcggaaatcactttgtcaatatcagcgtcttagagcatgtttggaaatcaaatgtgataccaattgggaaagagggtttttggtttatgtaaaggggcaagtgaacaagtcgataatcacatattcaagcattaccaaagaacaactcaaaaaccctaaatactataacatattgcaccattaccaaaacagaactcaaaaacttcgacatccttaccttcaggaacactcgaaaggtggcaacgccactaaaaaaggcacgacttcggctacgtggcggtaccggtggtgggagcagcaggtccacttcggcttcaagtacttcacgacgagaaacaaaacgtcagggtggtag

SEQ ID NO: 36803 - DNA, 264 bp, Glycine max
  Peptide Sequence Number=SeqID_153581
atgcggagataccttatggttatctgcatcttttgtcagctagaggcaagcgagctcgttgacacacagagactaacatcgtcatctgcacctttgtcatccagagacgctagaggcaagcgagcccgccaacacacagagactaacatcctcttctgcaccattgtcatccagagacggttttaccttcgctatccagagacattcaagtccgacaacgcgcaagattcttctctgctaggcagggacgatcgagttcgataa

SEQ ID NO: 36804 - DNA, 330 bp, Glycine max
  Peptide Sequence Number=SeqID_153582
atggaatgtgtattggctgatgtacttagagatcaaagaaatttgggcaacaagggtgacggaggttggaaaaggtcagcattgaatgctgcagccgcagtgttatctacaagcttcaatatagagccaccggtcatggaggatgctgatgaagcgatgagtagacaaacaaatgaagtggaattcatggggttaggtgctactgccatagatttagaagaatcaagctctaatacaaaaggaaaaagacaaggttcgacttcttctggcgcacatcctcacaagagaaagatgggagaaaaaaaaggaataggcagcttctttggataa

SEQ ID NO: 36805 - DNA, 279 bp, Glycine max
  Peptide Sequence Number=SeqID_153583
atggggaatagaaatagcattattccgagaacgcacattgacgatgagtatgcttatgctgcggaaaaggatcctaaaattttgctgactacttccagggatccgagtgctcctcttcaacagtttgttaaggagttgagttttgtgtttcccaatgtgcagagggtgaatcccgatggtcagatatatgaccatgatgactcaagttcagcactaaggtttttttttcatgccaaccatgttattgtaaacattgcttgtctagattatcccaattaa

SEQ ID NO: 36806 - DNA, 305 bp, Glycine max
  Peptide Sequence Number=SeqID_153584
atagcaaaaagtatgtttatacagataaccactcaggtatttccgcccgtcagcgtgactcaaatgtcagtataacagatcttgtgagcgcggaatatgacgatgcagaagacgacgttagtctctgcgtgctatcaggcttttcgtcttacagacagcaaaagaatgtttatacggataaccactcgggtatttccgcccgtcagcgtgactcaaatgatgcagaagacgacgttagtctctgcgtgctatcaggcttttcgtcttacagacagcaaaagaaagtttatacggataaccactcg

SEQ ID NO: 36807 - DNA, 664 bp, Glycine max
  Peptide Sequence Number=SeqID_153585
tctcaacacattcttggagacacctgtggtattagctgagggggagaccttagccgctcactccagatactgcaggttgcctacagactatagagagatagaagctgccttatgcatacctagccaagggttcatcttgaacttagagggccatcctgggaagattctcaggaaggatctgactacactagctcaagtgtggagtgtcctctcatactccaacttggcccccacatcacacacttctgacttgacagtggatagagctaggctgatatttggcctagtctcttgcttggatatgaacataagagccctgatctctggccagatgacctctatagcccagtctaacacttctagacttgggttccctgctctaataaccgcattatgtagagccagaggaattgtctctgatagcctcacttttgagcgctcgagcccggtcattaacttggcctacatcaagaagaactgttggaaccccgaggatctaacaatttctattcgaggggctaggagggcgagggcaaggccagctgagcttccttcaacttcagtagctcctactccagcatccacttcagcagccccttctatcccaagtcagacagattctcagtgctttgaagctatgcttcagagcattcatcagggatag

SEQ ID NO: 36808 - DNA, 141 bp, Glycine max
  Peptide Sequence Number=SeqID_153586
atgttggctagcgtcttagatgcaccaaaaaggctctcgaaggccggcagcaaaagaagagttatagcgggcgaagtaggacccaccccatatggccatcttcaaaggggcgtagcgcttgcttactcggggatcctctag

SEQ ID NO: 36809 - DNA, 681 bp, Glycine max
  Peptide Sequence Number=SeqID_153587
atgttaaacgactgggactgcatcctgttcgatgcggatgacacacttttccactttgacgccttcgccggcctgcagcgcatgtttgccagctacgacgtgcacttcagcgatcaggattacgctgattatcaggccgtcaacaaaccgctgtgggtcgattaccagaacggcactatttcagcgttacagctccagacgcgccgcttcacgctgtggggcgaaaaactgcgcgtggcgccggaagtgcttaacagcgactttcttaatgcgatggccgagatctgcctgccgcttgatggcgcagcccgcctgctggatacgctcaagggcaaggtaaaaatcgccatcatcaccaacggttttacggcgctgcagcaggcgcgccttgaacgcaccggtttccgtgactactttgacgcgctggtgatctccgaacaggtgggcgtacccaagccggacgcggcgatttttgaccatacgctgcagctgctgggcaatcccgatcgccgccgggtattaatggtcggcgacacgccggaatcggatattctcggtggtatgaatgccggcgtgaaaacctgctggatcgatcacggcacgcgtccgctgccggcgcacatcacgcccacctggcaggtgaaaaccttgcctgagctgcaatctattctgactgcttaa

SEQ ID NO: 36810 - DNA, 102 bp, Glycine max
  Peptide Sequence Number=SeqID_153588
atggagattccttccaatataaagcaaccatggaattcggaatactcaggtacttgttcggaacaacctcaacttatcctcaggatccctttagaaacttag

SEQ ID NO: 36811 - DNA, 276 bp, Glycine max
  Peptide Sequence Number=SeqID_153589
atgcctttccatgcttttgaaaacataagaagaaagaaaaagagaggaaaaactaaatgtaagagacaattgagaatgcttacatggaggtgggcagtggaagagggggagtgcaatatttgggcccggccaacacggatttgggcctgtacatgtttgccggcagtggtaatgaactacattgatgataaagcacccgtgaaaggtcttagatgcgagcctttactcaggcaaatgccaaggcagagacatcaagaatctaagactaggacataa

SEQ ID NO: 36812 - DNA, 219 bp, Glycine max
  Peptide Sequence Number=SeqID_153590
atgggcccgaaatctaccctaaggctcacgagaaccctaaggccttctcttgcatctctggcccaatcttcttggagtcttctatccaatgcccttgcagggactcaagctcttcagggacttcgaactagtcttgatgtgtcaggctatgctataagggagatctggtgggagatgaggtaccctacattcatatccatcttcatgacgatgccataa

SEQ ID NO: 36813 - DNA, 873 bp, Glycine max
  Peptide Sequence Number=SeqID_153591
atggaaagcaagtgtgcggataaccaaacggtgtctctgcatgctaccggagtctcacaagtcgagggtatttccacctgccacctgacacatgggtcaggatcaacagatgttgtgtttgtacggataaccacttggggtatttccgcctgccacatgacgcatgggtcaggattaatagatgttgtctttgtacggataaccacttctggtatttctgcctacgacctgacgcatggatgttgtcttgtatggataaccacttggggtatttctgcctggcacctgacgcatgggtcaggatcaacaaatgttgtctttgtatggataaccacttggggtatttctgcctgccacttgacgcatgggtcaggatcaacaaatgttgtctttgtatggataaccacttggggtattttcgcctgccacctgacgcatgggtcaggatcaacagatgttatctttgtatggataaccacttgcggtatttccgcctaccatctgacgcatggatcaggatcaacagatgttgtctttgtacgaataaccacttggggtattttcgtaggatcaacagatgttgtctttgtacggataaccacttggggtatttccacctgccacctaatgcatgggtcaaggtcaatagatgttgtgtttgtacggataaccacttgggtgtcttcgcataccactggactcacgggtcacgatagcaaaagacctcatggttccttcttccaaggacaaggatggaaattctcatcctttgtcaaggtttatggtggtttgaggtcttggcacaaaaggcttgcagaatggccagacacgatgtacgtcagggtgttggtttggccagcggttcagggataa

SEQ ID NO: 36814 - DNA, 267 bp, Glycine max
  Peptide Sequence Number=SeqID_153592
atggggaaaaggggtatgagtcgatgtccccttgggcacgctcccgaggctcttcgtgggtgcccctataggctggggaggccgcctttcgaagacggaaggatcgggtttgcttcaacggcggcgctggcagtagcagctgtggctgcattactctctattaatcttttcatagctagcatggctccatcatggaggccatttgatctttcagagtcgagatgccagctttcatctattcttgcgcttcctctatgtcatccatag

SEQ ID NO: 36815 - DNA, 276 bp, Glycine max
  Peptide Sequence Number=SeqID_153593
atgggtcgaaagacaggaaaacatttgcgtcaagcaaaggccgctgccgcgcttaacgaaaggtcaagggagaccaaaatgatggctccgaagaagctctccataaagaggtccagaaaggacacccctggggaaggctccgatgttgcccaggattttgacaatcaccgattccagagcgccaagcaccagcagcatttcgaggccatcataggatggtcgttcctcagagaaaggcgtgtccagcttagggaggacgagtaccctgacttctag

SEQ ID NO: 36816 - DNA, 663 bp, Glycine max
  Peptide Sequence Number=SeqID_153594
atggcaccgctccctcctaagaagccgaataggtcggccatgtcttcatcatcttgggcttcgttcgtggctctgggggcccctgtaggtcctgcccctggtagggcatatgaaaggggtggaaccctaaccctactggctaagactgaatcggtagaggcattcatgcaactgcatctgtccgcaatggttggtcgcccgctggcgaaccacatgcttactatacttctcgacaaaggccctgttgataggaggtcggatgaccttgctgggcatgatgggcaatccggccctgttggacttctccgggttcaatgggtatctcgtgggagccataccggcaaaaatataaatggcgtcagccatcagctgagccacatgaacactcatcctcgtaaggatggcatacaccagctgacacttcagcaggagaaggtcagagttatggtcgctagggaggatgttgttgagcagcagcgtcatccatatttgggtcagggtggtcaagctggtgcgcatgatccaaacccatctccctacagcagtacaggcgaaatcctaccccagtgtacacagccactgggcgatggcctcctcgtcgaaaccattagcctagttcctcttcttgtcatactcgcattgttgaccctcttccaggattag

SEQ ID NO: 36817 - DNA, 651 bp, Glycine max
  Peptide Sequence Number=SeqID_153595
atggcgaggattcctgacaagattaggtctattgatggatcaaaagaaatgcttaagcttgctgttaggatcaccgatctttggttcgttgggactcctaacaagtctgagcaagcggaaatggtttttgttgattctgagggtgatcaaattcatgatatttgtaaatcggaccacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcatgaactgtcttttaaggaatttagatttgttgaattttgcaaatgttgttgctggcaattttgtgtctggcctgttggttgtggtgaaattttgtcttgcacactttgggagaattactgtactcagttcctatcctatttgaatgaacgtggggatgatgggccgatggttattatattgacacatgccagaataaaagatgcacagggaagttatccagcttcagtgagcaattccttcaaggcgtcaaaactattgattaatgatcctatattggaaattcaggaatttaaagagaggcttttagatttaggtgttgag

SEQ ID NO: 36818 - DNA, 222 bp, Glycine max
  Peptide Sequence Number=SeqID_153596
atgtcaatgaaaaaccacgtcgggcgcctaggagtacatgacaagacaaaccacacactagctagcttaaaggagcactcaaaccggatgacccccaaggcctacactccgaagagtctgtcagggccgctccctcctgattcagcgcttgtgattaaactcgtcgggttcccacaatggattgcatcacaatactcgtcacgcaaaactcgtcgcccttaa

SEQ ID NO: 36819 - DNA, 324 bp, Glycine max
  Peptide Sequence Number=SeqID_153597
atgcagcatgtgactagccagcaggcggctaatcacaggagtcaggtgcagctaaatgagagcttctaccggtacacccaacaacaacagagccaagaccccagtcctttcccgtggcctacccccgaggagttcagggccacaattgcatggcctgaagatgagcctgattttgagacaggggcaagacctgtaggggcccctggggacgacgatggagctcaggaggatgattatatggctgatactctcttcgatgcaactcaaaggaagtcgctccaggagtccagagagcaagcagccaacggatggaagaatttctag

SEQ ID NO: 36820 - DNA, 222 bp, Glycine max
  Peptide Sequence Number=SeqID_153598
atggtgtctcctgtaaaggctgcggtggtgcacctacagctagctgttgttggccctcttcctgctgctattgtgtgttcgctttcgacaagtgcaccgaattgcacaagtagtataaaacggactttagaatcagaccagtttccactgttgaatgaccctaacaaagcatgcatctacatgatcaaggtacctacagggaagatccaacagaggatttag

SEQ ID NO: 36821 - DNA, 210 bp, Glycine max
  Peptide Sequence Number=SeqID_153599
atgaccggaacctctgaggctagaaagcccgttgcttaccatattatgctagcaacttcacaccaacaaagagcaaagataaagaggaatggagaccataggtctccgcgccgactcaaaaagaaaggttcttactctgagaagacttaccaaaaagggccaaagcgttcaggttatcaactcggccttgcctacttcggaaggatctaa

SEQ ID NO: 36822 - DNA, 608 bp, Glycine max
  Peptide Sequence Number=SeqID_153600
atggcttctaggaaacgtaaaagtattggttcaagacccacaatgcagtatgacataaggagattctcttccttagatgcttggaccagatacatagataatgtcctggggagaaacattttactagagaggaaagtagagatatatcactctaagctagatgagtttaaggctgaattggagaggcgtaatttccataaacgcttcaccaatttagtcgatgggagcatagacctagctttggtgaaagaattctatgcaaatttatacagttctagggaccatccaccaaagcagcccagagtcagaggtcatttggtgaagattgatgctgatagtctcaacacattcttggagacacctgtagtattagctgagggggagaccttacccgcttactccagatactgcaggttgcctacagactacagagagataaaggctgccttatgcatacctggccgagggttcatcttgaactctgagggccatcctgggaagattctcaggaaggatctgactacactagctcaggtgtggagtgtcctctcatactccaacttggcccctacatcacacacttccgacttgacattggatagagctag

SEQ ID NO: 36823 - DNA, 1143 bp, Glycine max
  Peptide Sequence Number=SeqID_153601
cacgccctcgccttgagagggatgcacaccctcacctttagaggcctacatgcccttgccttcagaggactacatgtcctcgccttcagaggactacacttcctcaccttcaaagggctgcacaccctagccttcacaggactacacgtcctcatctttagagggttacacgtcctcgcctttagaggactacacgtcctcgccttcagagtactacatgccctcaccttcaaaggactacacgagctgtcagagggctgcacaccctcgccttcagaggactacacgtccttgccttcagagggctacaggactacacgggctgtcagagggctgcacaccctcgccttcagagggctgcacaccctcgctttcagaggactacacgtcctcaccttcagagggctgcacaccctcgccttcagagggctacacattctcgcctttaaaggactacacatcctcgccttcagagggctacatgccctccccttcagaggactacaagtccttgccttcagagggctgcacgccctcgccttcaaagggctgcacgccctcgccttcagagggctacacgtcctcgcctttagatggatacacgcccttgccttcagaggactacacgttcttgccttcagagggctgcacaccctcgccttcagagtgctacgcgccctcacttttagagggctacacgtcctcaccttttgggtactagtcccctcgctttcagaggactacactaccctcgccttcagaggactacacgtcctcgcccttagagggctgcacgccctcaccttcaaagggctacaaaccctctccttcaaaagactacatgtcctcaccttcagagggctgcacgccctcgtctttagagggctacatgtcctcaccttcagagagctacacgccctcgccttcagaggactacattcctcgccttcagagggctacacaccctcagagggttgcacaactcaaagtcctctgcccttaatgcttaaccgagacttgcactcccgggtctctggctttgatgaggagactatcgcacaactactatgcataccaaggcaagatttcacccaacgactacaaggagacgagtgtggatcatgcgcaccaacatatggatga

SEQ ID NO: 36824 - DNA, 648 bp, Glycine max
  Peptide Sequence Number=SeqID_153602
gcagtgattaacacttttctcgtctttcatgaccgcaaggaaagcccggttgtcgctatcttagccgatctatatgacacctttggccgaagatgtgaaaagaacattgcaaggatcatttgctgtactccggccctctacgtatgcttggtttcgcaccttttccgccaagagacaacttggctaccctatgagaggggcaccaacacgggggtgcttcagagggcccgcaaggcatgggaaagggtgcaaaagaaggacgaggaacttaggggaagtagcaacgggcccatcggcagttaccataggtggttgaaagcctacgcacaaggtctggattggctcccgaatttgagaactactaaagaggtggagggtgaagcttcagaagaagatgaaaaggtacaagccctcaaaacagagcttgagagagcccaaacaaccaaagaaaagtccaagtccatagctgttagcatccgaaaagagaacgccgaactaagagacatcaacatagccaccatcaaggcgttggagcaagagaccaagagggcccgcaaggaagaacatggccggaacaagttccgaggggctctgtggggtagtaacagcaaacttaagctacaaagagaggaaagggaccaatcgtga

SEQ ID NO: 36825 - DNA, 453 bp, Glycine max
  Peptide Sequence Number=SeqID_153603
ttgcaatcacaggggctcacactatctcctaagcctgaggttggtccttcaagtgctcgtgttagcacaaaggagagttgtgttgatctctcagggaacgacctagacagggttgactttgagaaatgtgggttgtacatcgaagaaaatccttcccgcctggttgccctaagaagactttatgagaggtcgacaaccgttcacaacatccctttacgcaatgatcaagtcaaggttggtgttgaggaagttagagatgcagatgttcccattcctgtacccactcaaaaggttcaattagtggggcagacacttaacacttttgttggttggctgacacatcttgtcaagggtttattagaacagagagctgtgggattggcgaaacatgttgataggtcggatcatgatgtcgatgatcccctatatctgatgacattgaccatctcatag

SEQ ID NO: 36826 - DNA, 642 bp, Glycine max
  Peptide Sequence Number=SeqID_153604
atgagtgttcggtccaaaaacttgaactctgtattttacgcagattcataccatcccatacaagctggcagcatcgacggcaccgatgttgttcctcacgacaacgccgtttatcgcgctcaactctgttcctccattggcctttatgacccatttggtgatcccagggctgctggagacccttattgcactctcttcgtcgctcgtctctctcgcctcaccaacgaagataatctccgcaagcttacgagtttcttccaggaaggatgggagttggttttgacgtcgacaatttcgtcaaactggtggaggatgttgaccattctcctgactcatgttatgagtaagtatggtcgagtgaagaacttccgcttggttagggacattgtgaccggagcttctcgtggttatgcttttgttgaatatgaaactgaaagggagatgcgacgagcatatatggtgctggaacatgatgctcatcatttgattgttgatgattctgaaatcatagttgattacaacaggcagcaattgatgcctggatggattcctagaaggttaggtggtggtcttagtggtaagaaggaatcgggacaacttcgttttggggggaaagaaaaaccatttcgtgcacccctgtaa

SEQ ID NO: 36827 - DNA, 222 bp, Glycine max
  Peptide Sequence Number=SeqID_153605
atgtggatgtgtaagctgagcaacttggtggacttgacattagacaatggatcttttcaaaagttaatcaggagggaagtatgcagctatggaggacctttctacttacaccttttaagctcatcactgtgtttctgcatgaagcgagtcatgccattgcttgctggctcacttgtggcaagtgagttagaagttttagcttgtattctatgctctaaataa

SEQ ID NO: 36828 - DNA, 267 bp, Glycine max
  Peptide Sequence Number=SeqID_153606
atgtccccaatagaagtgtcaactgtcgcaacctacccttcgacgagagggcaagtgagactcaagggtgcatcttccaagaaaggaaaagacgagggagtcgccaccaacgtttattccaggaaaacgttagaaaaaccaagaaaggggtctacgaattttaagaataagggttcaggagttgtttacgtgcggggaagatcgacaagggtgttgcccttgctcctacatatcctcaggtgcaatgaggaaatcatacctacgtag

SEQ ID NO: 36829 - DNA, 432 bp, Glycine max
  Peptide Sequence Number=SeqID_153607
atgcatcaggctctcttttcttcccgtgaagaaattgtcaatcacgatgatgtcatcaccgcgagcgatgagtttgtcaatgaggtggctctcgatgaagctcgagccgtcggtgacgatgattcgttgcctcctgccgccaatccagataggaacgcggcccgtagtgggctggatgatgaagaaggtggagtcgatgaggatgaacaagaggcgttgctcgcggaggagactcatgtttggggaaggtgtgggaaatggagtccggaagggccttcagaactgcctcttgggcttttgaagcacaccactcgctttgtgaactcgatcattgggattaggtggcccatgctaggggatggcagcatcgccactactgccggtgcgggtgccactcgagcttcttcttttgagacttctatggctaacgtc

SEQ ID NO: 36830 - DNA, 504 bp, Glycine max
  Peptide Sequence Number=SeqID_153608
atgagtctgcatcaccgaagggaggaagagatgttggggagcagtgagagctcaccctactcccccaaatccatcaagcacactagatctctcccccagatccatcaactacctcctccgcgagcaacgcctcttgttcatcctcatcgactccaccttcttcatcatccagcccactctctcttgcatgggcccacccgagccggtccacacattcctccctcaaatcgggcttgctcgcttcagcggcacaaggctcacacgggccgcgttcctatctggattggcggcaggaggcaacgaatcatcgtcaccgacggctcgagcttcatcgagagccacctcattgacaaactcatcgctcgcggtgatgacatcatcgtgattgacaatttcttcacgggaagaaaagagagcctgatgcatctgttcgggaaccctaggttcgagctcattcgccacgacgtcgttgagccgattctattcgagctcattcgcccgtga

SEQ ID NO: 36831 - DNA, 237 bp, Glycine max
  Peptide Sequence Number=SeqID_153609
atggttagcgaaaatgatctctgggaaggtgaaagttttgactcagaacaagaagttttgatctctgggaaggtgaacgttttgatctctgggaaggatttgacccctgtccaactccagagtgcgcttagcaagacattctcagtgaaaaagaaaaagggaaagctacgaaaagcttgggatgggagcaaagttatttataatgttgcatcatggggggctacggccatagggtaa

SEQ ID NO: 36832 - DNA, 207 bp, Glycine max
  Peptide Sequence Number=SeqID_153610
atgaagtactcaccagaatcccttgaggcatttgtccagaccgtcgccagcggctcgttttccgcagcggcgcgtgtgctggcaaaaagtcaatccaccatcagtagcgcggtggccaatctcgaagatgacttaggctttgcgctgtttgatcgcagcggtcgccagccggtactgaccgctcaggggcagcgcgcactggcgcag

SEQ ID NO: 36833 - DNA, 264 bp, Glycine max
  Peptide Sequence Number=SeqID_153611
atgttgattgatgttggaaatgcattggcatgtgcatgttgtgtatgttcgtggggggaactgtgcatagaccttccagggtctttggcactagcttttggccacgttcatacgttggatgttgtgtatgttcgtggggggcactgtgcactgaccttccaggggggcttgtcacttggtagggaacacctttgggctctcaggctgatcacctatgggaggggggctgttacgtgcacaaccgggtggtctcgacaaacttag

SEQ ID NO: 36834 - DNA, 611 bp, Glycine max
  Peptide Sequence Number=SeqID_153612
atggcgattggtacctcaaagccttacactggggcaatgaggggcatcatgcatgagcctcaagtgaacataggggcagatcaaaaggtggacccatgggtactagtacctattgcctttagagggcttcacgtcctccccttcagagggctaaacgtcctcgcctttagagggttgcacgccctcgccttcagaggactgcacatcctttcctttagaggattgcatgtcctcgccatcagaggattgtatgtcctcggcttcagagggctacacgtactcgccttcagagggttggacgtcctcctcttcagagggctacacgtgctctactttagagggctgcacgtcctcgcctttagaggactgtacgtcctcgccttcagagggctgcacgtcctcccctttagagggctacagtcctcaccttcagagggctccacgcccttgccttcaaagtactgcatgtcctcaccttcagagggctacactccctcacctttagagagctacacgcccttgcctttagaggactgcacgtgttcgccttcagagagctacaaaccctcgcctttagaggactacacttccttgccttcagaggattgcac

SEQ ID NO: 36835 - DNA, 261 bp, Glycine max
  Peptide Sequence Number=SeqID_153613
atgtctatcttagagcctaactggatgggtcttgatgatgctccacagcctaaatcaaaggctcctgctaggtggattgtcgtcaagtgtaataaacaaaaaggaagtactaagtgcggctattatgtcatgcactggatgtccaccatcattttaggaagttttaggaataattgggaaacgtattttaacaatgctagaccattggagccagagagattaaaggcgctgcggatccagtgggcacagtattatctctga

SEQ ID NO: 36836 - DNA, 246 bp, Glycine max
  Peptide Sequence Number=SeqID_153614
atgaagctatgggaaaaggtgatagagcatagattaagagaagaagcaacaattgccgagaacgaatttgttgacacagtaacagcagctgctagtgttcaattcattaggaacctaacagaggaatacttcttgtgtgttcacattgtttgtgagtatacgatgttgttcaataatattgcctctattcaatctgtagaagcggttagagtccctaacagaagcagaaaaacaagcactgcttga

SEQ ID NO: 36837 - DNA, 582 bp, Glycine max
  Peptide Sequence Number=SeqID_153615
atgttatacactacaaaaacaagcatatctatcaacacaatagatgtaggtggtctaacaacagaagagagaatgctcgtgtacctcataacctacattctcactccgaggtcaagcaatcatgcacaggtaactgacgatgatctgcacattgtgtattgtcttaaatctggtatcaagatgaaattggtacttttgaatgaagacataatgttgaagagtcgtcgattcattaactatttcaatgttgatgtatctaatgaggtagtagatttcaccaaagcgtctagtgagatcaccgaaaggcatctccagcagattgggatgagagccaccagcagcaggaaacatggatatcaaagggaagaagaagttgaagctaaagctccgcaagagcctgcacaccaatggggtccttttgagtctcttgtgattaacaaaatggatgtcatgcttcacctccatcaagagcactcagctgacattcatagtactttagaaaacattactactcggcttgaaaacatagaaactaggccaacccttggtaacctccttaacccagatgaagatgaagcttag

SEQ ID NO: 36838 - DNA, 315 bp, Glycine max
  Peptide Sequence Number=SeqID_153616
gaatcgcacccacaaagacacccagtggaccaggagaagtccaacagggccctggggtttccagttctggttatgggcctctatagtcctacagggtgcccgttccccccggcaaggtcacgtcatcatagagtgcctgacacctccaacaagggcatcaggccccctactaatcgagctttcatcgagaagtattacgtctccaggcaggcgcagggcgaaacaccacagcagtctagggatggccagcagcgggcaacagatgcaccgccatcacctctagagttcacctcagctcatccacaaaaaggttaa

SEQ ID NO: 36839 - DNA, 210 bp, Glycine max
  Peptide Sequence Number=SeqID_153617
atggctgagtctcctcaagagcaggtgcagatggtggagatggctgtggggtctaagctggagtggtctcctcctctgctgctgctggtgatgatgctggtggctcctcagtcacaggctcctaggttgtggaggccccaccccctccagaggaagaaggctggtctcctggtcaggccacctgtgcgtcgaactcctccatgcccataa

SEQ ID NO: 36840 - DNA, 772 bp, Glycine max
  Peptide Sequence Number=SeqID_153618
atgaatgaactgaacgcgcacagcaacaagccctacttcaagtcggcgcgtatcgtcggtgacgtcatcggtaagtaccacccgcatggcgatcagtcggtgtacgacacgctggtgcgcctggcacagccgttctcgctgcgctacatgctggtcgatggccagggtaacttcggctccatcgacggcgactccgccgcagcgatgcgatacaccgaagcgcgcatgtcgcgcctcgcgcatgagctgatggccgacatcgacaaggaaaccgtcgatttccagcccaactacgacgaaaaggaactggagccgacggtcatgccgacccggttcccgaacctgctggtcaatggttcggccggtatcgcggtgggcatggcgaccaacatcccgccgcacaatctgagcgaatcgatcaacgcctgcatcgcgctgatcgacaacccggaaatcgatgtcgacggcctgatggaatacatcccgggcccggatttcccgaccgccggcatcatcaatggcaccgccggcatcgtcgccggctaccgcaccggccgtggccgcgtgcgcatccgtgccaaggccgatatcgaagtggccgacaacggccgcgaatcgatcatcgtcaccgagattccttaccaggtgaacaaggcgcgtctgatcgagaagatcgccgagctggtcaaggaaaagaagatcgaaggcatcagcgagctgcgcgatgagtccgacaaggacggcatgcgcatctacatcgagatcaagcgcg

SEQ ID NO: 36841 - DNA, 237 bp, Glycine max
  Peptide Sequence Number=SeqID_153619
atgcctactttcaacgatgaccatttcaacattggttctagaactgaagttgaaactcctccagaaccgatgttaaatcccttttatgtagtagaccagctcgctcaagcgagctggttgcttcatcctgaaggtattagctcgcccaggcgagttggttgcttaaggctgaaggtatttcatggccaaggcgagccagatgctatcctgggcgagctagggtccagaaaattctag

SEQ ID NO: 36842 - DNA, 147 bp, Glycine max
  Peptide Sequence Number=SeqID_153620
atgagtccgacagagcctgggaatcctcctagacatccacctgtggtgcacgatgatacatttattgaaccagaccttcctcaacagttggtctctgcaacggctatgtcaaaaccacctacaactgcacctgcttatgaggcttaa

SEQ ID NO: 36843 - DNA, 345 bp, Glycine max
  Peptide Sequence Number=SeqID_153621
atggagatcaaacatcaatccaaagaagaaggagaaaattcctccttagccccaaaatgctatgaatgcgatcaacctgtgcacttgagatttgattttgatgtctttaaaagaagaatgaaaaaatctgacaagagaaatttcaaagaaaagaaagcatacatcacttgggaagataatgacatgaattcttcaagtgattcagaaaatgaaatcataaatctgggtctcatggccaaagactatgaaaacgaagaagagaaaaatcatagtgcatcaacatgctatattagaaacaatggtaatagcattggaaaaatgatgagtttcattactcaaaactaa

SEQ ID NO: 36844 - DNA, 297 bp, Glycine max
  Peptide Sequence Number=SeqID_153622
atgtatgaatatcttaggagaacccgcacattaacgcgtaagcattcctttcaaaattcgtatggatattcatgctttgttggaaaagggaaatggctccaaagaaactctccacgaagaagtctagaagagacgccacaagagaagggtccagtaccgcccccgagtttgatagtcatcgtttcccggagtgccgagcaccagcagcgcttcgaggccatcagaggatggtcattccatagggagaggcgtgtccagctcagggaggatgagtatacggactttcagaggagatag

SEQ ID NO: 36845 - DNA, 1396 bp, Glycine max
  Peptide Sequence Number=SeqID_153623
atgacggacgatatttatgcgcggctgaacttcaccgacgagccgacggtgcatccgttgcaggtggcgccggcgctggcggcgcgcacgctggtggtcaatggcgtgtccaaggcctatgcgatgacgggctggcgcattggttacggcgccgggccggacgagctgatcaaggccatggcgattctgcagtcgcagagcacgtcgggcgcgtcgtcggtgagccaggcggcggcgctggaggcgctgtcggggccgcaggactgcgtgacggagttcgcccgcgttttccgcgagcgccgcgatctggcggtggcggagctgtccggcacgccggggctggcgatcgtggtgccgcagggcgcgttctacgtgtttccggattgctcggggctgctgggcaagcgcacgccggcaggtgatgtgatccgcaccgataccgacctgacgcattatctgctgcgcgaggctggcgtggcggtgatcgacggccatgcctatggcgcgccgggcacgttccggctgtcgttcgcggcgtcgctggacgatatccggcagggctgcgcgggcatccgcgaggcttgcgccaagctcgtcgcggacatcaaggcccgcggcgaattgatctgcggcacgctgggcacgtcgcagccgttcagcttccaggacgcgacgacgcgccagttggtgggctatgacgtggacgtgtgcaagctggtggccgacaagctgggcgtgaagatcagctacaagctgctgtcggtggcggcgcgcgtgccggagctgaacgagggtcgcgtcgacatcctggcggcgaacctgggctattcgccggaccgcgcccagcagatcgccttcagccacgcgtactacgtcagcccgcagaagctgctggtgcgcaaggattcggggctggacacgatcgagtcgctgaacggccgccgcgtcggcgcgaccaagggttccagttcggagcgcgagatcaagcgcattctcgataagtcgcagctcggccacgtatctggccctgcagcagaagaaggtggacgcgcagttcgcgtcggaactggtgctggtgcgcctggtgctgcaaagcccgccgacggcgccggtcagcgtgatcgccaagtcggtgttcgacgagccgtggggcctgggcgtgcgcaagtcggagccgggcatgctggcggtggtgaaccaggcgctggacgaggcggaaagctcgggcgtggccgcgcagctgttcgacaagtggttcggcgcgcagacgccgtacaagctcgaacgcggtttcaagatcggccccatcgcgggctgaacgccgctgctggccagcggcatggtggtgacgctgcagctgttcctggtgtcctgggtgatggcgttcacgatcgcg

SEQ ID NO: 36846 - DNA, 354 bp, Glycine max
  Peptide Sequence Number=SeqID_153624
atgcgatcagagaagaaaccatggtcgccactcctctttgacgaactcatcaaggaaatcttgtctcgtcttcccgtgaaacctttgatccaattcaagtgtgtgtgcaaaggatggaactccctgatgtcagatccctatttcatcaaattgcaccttagcaaatctgctgcgaaggatgatttggaacaccttcaactgatgaaaaatgtctgcctcggatccatccctgaaatccacatggaatcctgtgatgtcaccatctggtcggttgatgtaatgggttgcactgtagggttagcgaaataccagaaggataccgtgtttgtttctggaacaaggcgacaagggtga

SEQ ID NO: 36847 - DNA, 453 bp, Glycine max
  Peptide Sequence Number=SeqID_153625
atggtcactgaccaatccctcttctatgatttgacccaattatctagtgacggtataccatttgaaggtgcattggacgatgattggaagtttgatttttctgtacataatgcccgctggttggtttgcaccaaccaagtggatatgaccggaaggcttcttgccgattcattggctcttgaaagttgcatccttcactatcttattgttcgtatcggtgctcaaccaaatgatgatgaagaacaattaccagttgaaggggactcttctctccttcaaagtattttggacaggtttgatggactccaaacctatgttggtgaaaggtttgatgctttggaacaacaagtggacatgcgattcgatgcaatggactcaaggatcacaaagattgaagaagatgtcaccatcattcgcgattgccttgatttacctccagcaccatcagtctag

SEQ ID NO: 36848 - DNA, 240 bp, Glycine max
  Peptide Sequence Number=SeqID_153626
atgcaactttcaagagccaatgaatcggcaagaagccttccggtcatatccacttggttggtgcaaaccaaccagcgggcattatgtacagaaaaatcaaacttccaatcatcgtccaatgcaccttcaaatgggtcaatgatagaacgagaggagaagaggtttgtgtaccgtatacgttgttcttctgatgagaacaatgaggatgaggaaatggaggaaagaataagagtatcctga

SEQ ID NO: 36849 - DNA, 1734 bp, Glycine max
  Peptide Sequence Number=SeqID_153627
atgccttccaacccctttttcaaacaccaaacaccttgcctccttcacgcaccactaatcattcgatacacttgcttcctcactcaaaaccagtcaacatctgaccatatagatacccgtactttcaaaaatgggaaattggagctcagggctctgaatgctatcaccgtcaaagaccgctttttgattccgaccatcgacgaattgctagatgaattgggcggtgcttcctggttcttgaagcttgacttactacaggggtatcaccaaatattgatgaaggaggaagataagcaagtcgactatctaggtcatatggtttcccatactggtgttcaaccagttccaacaaaggttgaggcaattccacaatggccgacacctagctccgccagggccctacagggttttctcggcttgttgggattttacaagaggtcaccagaagctcaggtagcttttgtacaactcaaggaagccattttccatgctccggctctcgggttgccggacttttctctacccttcgttgttgagactgatgcctccggggtgggcatgggtgccatcctttcccaacagaaccaccctatagctttcttcagcaaagctttctgcccaaagcttcttcatgcctctgcgtacgttcgtgagcttgccgccattactgtcgctattaagaagtggcgccaatatttgttgggccatcaattcactattttaactgatcatagaagcctgaaagaattgatgtctcgggatctcaaagagaagcttcacacccaccccgattacgtgccatttcgggcagaaattgatgaattccactcaacccctactggtggacatatgagggttatgaagaccttggcgcgactgagtgataacttcacctggccgaacatcaaaactgatgttctcaacttcgtactggcttgtattgattgtcaacaaaccaagtatgatcattgtaagccatctgggttgttatgcccccttccggtaccggcgcaaccatgggaggatttatcttcagatttcatcggaggtttgtcggcgttcaaaggacacacggtggtgctcatggtggtggatcgcttttctaagggtcttgaacaaaagtacctccgtgctttcgttcatggccattcggcgaactggggaaggtacttgatgtgggttgaatggtctaataacacatcagtacatgcaggcactcagatgactccatatgagatcacatttggtaaaagacctccgtctatccctcagtacatcaccggaacatcaaatgtcgacaccgtggatgactttctcaccaatcgcgaagctttgtttgccagtctgcgcaagaaactcctgaaggcacaacaaaccatgaagaactttgcaaataatcacaggcacgatgtcagcttcaaggtgggtgactgggtgtttgtgaaattacgtcctcgacgacagtggaaagggctggctacagatgatgctacatgggagtcctgggacgaactcaagacagaataccaccttgaggacaaggtgcttctcgaagggcatgggaatgttatgaaggatcaagagataccacaattacaagcaataccagcagaggcatcatcagaacataccacagagactacagatatgaatcaaaggcagaaaaggatagtggctcctgaagattaccttgtctgctatttcacaattctgttatgccctgtatcagggtag

SEQ ID NO: 36850 - DNA, 243 bp, Glycine max
  Peptide Sequence Number=SeqID_153628
atgtcagtgaaaaatctcgtcgggcgcctaggagtacatgacaagacaaaccacatgctagcaagtcaagtcactctcactagtcttaccattgggatcttgaaaatactaacttttggtctccttctaagcgcatttccaaccgaagggaattgtgctgagcggcccaaagctgcgctaagcccaattccaaccgagaggaagtgcgttgagcgcccagagggtgcgctaagtgagccctag

SEQ ID NO: 36851 - DNA, 477 bp, Glycine max
  Peptide Sequence Number=SeqID_153629
atggccaacaatcataacactattgttgagattgatgctactagagaaaactggaaaatatgtgttagggttgttcgtttgtggttggttcctgatttcaaaaataaaaaactatcacactccttggagatgggagatagaatccacaccactgtgaagaggacattggtttacaaatttcgaaatgaaatcaagaaaggaaaatgttattccttcagtctggtgggtgttgcttctaatattggtggtttcaagactaaccaccatccttacaaactcatatttcaatttagcaccaaggtcatattgttagaggatggtgcagtcccaaacattgtgtatgatttggtgcctatttctacaatcatggatggtggtcttgatgttgattatttagtgggaaagatgccgtgggactgttcactagagttgcaaataagggagagaacgaaaaggatggcaagaagacccagatga

SEQ ID NO: 36852 - DNA, 204 bp, Glycine max
  Peptide Sequence Number=SeqID_153630
atggttagtgacctcgcagtcttgctcccaaccctaacacaactcgtagtcttgcactcggcgcagcagccaatactcaagcttgctcatccttggcctgagtggttccaactcatgaagtgcttgctcgacgtcattagaaccaagtttggccgtgcttcagaactctgtcagactgtgatattcaattggacaagaacctag

SEQ ID NO: 36853 - DNA, 773 bp, Glycine max
  Peptide Sequence Number=SeqID_153631
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgatatctctaaaccagggcttcgacttggtcttggtcttggtctccatgatgatcactcatcagaaaattgcatgaagaccaatgaacaaagccaaaggcaaagacaaagccagaagaaaaaggaaacagatccatgtaacaaggcttacccatcacttaagttaggaccacccgatgatgaggcaaacaataataatcaacaaattacaaatattgaatccgatgaatactattatttccacccacatgcctcttctagatctccaagtgcagtgtcttcattttccaactcatctagcatcatcaagagagagagagaacaacttgagttagaggtagagaagatttcgctgtcaagggattttgtcgatgttgacgaaaatggtaaccccaagaagaaacttaggctcaccaaagaacaatctgcagtcttagaagatagcttcaaagagcattatactatcagtccg

SEQ ID NO: 36854 - DNA, 420 bp, Glycine max
  Peptide Sequence Number=SeqID_153632
atggctacagccaggtgggcactcaagcatcccgtttatggcattgtgatactacggttgggaatttacacagacagacccaacgtttccaagttatgttctttcatcagttcaatgaattcatccatccttatctcggacgacgttcctaaatggaaaactccacacgactctggaatttcaaagaacactattgacaacaacgaagtaaatactaacgtaacagttcaaacgacatatagcatacaaatgataaatgatggaacatacgaatttggggatcccacggtcatgtggctccgcatgccaccgggctcttgggtcacggtaacaaaaagtggggtggtcgacaaaagcagggcttttgctcctgcgtatcctcaatttgtgatgaggaactcagacctacgtagttcttga

SEQ ID NO: 36855 - DNA, 225 bp, Glycine max
  Peptide Sequence Number=SeqID_153633
atgatgacattcaagattgagttcaagactgagtcaagaacgcttcaaggatcaaaatttgatttcaagaatcaagattcaagaatcataaagatcaagatccaagactataagattcaagaatcaagagaagacttaatcaagataagtattaaaaagtttttcaaaacattgagtagcacaagaagttttcacaaaatcattaccaaagagttttactctctg

SEQ ID NO: 36856 - DNA, 387 bp, Glycine max
  Peptide Sequence Number=SeqID_153634
atggcctctgctgatcctgcgttcttcttctctgctgtcagccactgtcagtcaccgtcgttagccgctcaaacctctccttttggcccttcttctttgtctactgaactatggcatattttggtcctgtttaaggccccacctggtttcttggctctcttttatgttacaaacaacaacattattaccaagccagagggtacccattgcgttggcttcctcaaaagtagttactcagtttggtatggttttgaatgttgccaaggttccccttccagctgccttcgaagttccattgtgttctggtttctgaaaatgtcaactttagaccctgttctttctgttccttggacatcctccattggacttttgaagaaagattggtag

SEQ ID NO: 36857 - DNA, 907 bp, Glycine max
  Peptide Sequence Number=SeqID_153635
atgcgcacgcaaccgcagatcaccgagctgtccagcaacctggccgaccaggtcggccgcgattggcccggcttccggccgctgttccgctgcgcggtggtcgaactgaagccaccgggcgcggcagacgatggccacctgcccttccgggcaatcactgtggcgctgagtgcgatcgaatccggcgtcgtgttcttcgacgacccgatccagcgcgacagcgagatcgatgccgtgattgaagtcgcccttgatcgctggctgcagcagggcgacgccccgctgtgctaccagcccaagcatcgcctgcaggatcgccagctggtcggcgccgaagcactgctgcgcatgcgcgacggcgagggtcggctgatcacgccgatgcgggtgatctcgctgctgcgccggcaggggcggctggctgaactggaatgggccacgctgcagtcggccatccacttcctgcagcagtgccgacgcgatggcacgcagctgaaaatcgccgtgaatgtttcggccgagtcactgcgcctgcccggcttcggcctgcgcctgcaggaactgctggcactgcacgatgtgcccggcgtgatgctgcgcctggagatcgtcgaatggaccgagatcgtcgagcgcgacgtagtcgatgccaacatcgcacagctgctggcggcggaggtcacgttgtcactggatgatttcggtgccggctattcaaccctgatcctgctctcgcagctggccatcgccgaggtcaagatcgagcaggccctgatcgccacactgtccgacgccaaatcgcagtcgatcgtgcgcttcatcgtggaagtcgcgcaccgctgcggcgccatcgtggtggccgaaggtaccgagaccctggcgcaggaacagcaactgcgcgcactgg

SEQ ID NO: 36858 - DNA, 1590 bp, Glycine max
  Peptide Sequence Number=SeqID_153636
atgaagaaacaagtaagtgagcgagatggggaacttattgcattacgtgggaacgttgcctgcctttatgatgcatgcattaattttgtcattgtacttgaaaatgaaaaagctgaactggttggaaggaaggttgaatctgcagatctaggaattaacttggaaacaccttcatttgatgatggcatatctgaggaatgcattaaaaccctgacagatagactgctgttggctgcaaaaggttttgctagtataagaactgaatttttagatgccaatctaaaggaaatgaaggctactataacaaattttcagagagagcttcaggagaaggatgttcaaagagataggatttgctcagaactggtaaaacagatcaaggatgctgaagctgctgcaaacagttactctcaagatcttcaagcttttaggcttcaagaacataatctaaagaaagaggtggaagcaattgaggcagaaaggaagatactggaaaatagagtgaatgaactgcaggatagacaagaaactgcagctgaattagaggagaaaaagagatctcaaactgatttactggctgccaaagatcaagaaatcgaagcactaatgcatgcacttgatgaggaagaaacgcagatggaagagttgacaaataagattgtggattttgaaatggttgttcaacaaaagaatcaagagattgagaaccttgaatcttctcgtggtaaggttatgaaaaagctttccataactgttagcaagtttgatgagcttcaccacctgtctgcaagtctcctttctgaagttgaaaagctccaatcccagttgcaagaaagagatactgaaatttctttcttgaggcaagaggttactagatgcactaatgatgttcttcttgcatcacaaatgagcaaccagagttctgatgagatctttgagttcttgatgtgggttgacacaattgtgtctcatgatggggtgcatgatatatatcctgatatgaagagcaacagtaaggttcatgaatgcaaagaaatacttcataagaagcttacgtctttattgtcagaattggagaatctaagggaagttgcagaaagcaaggatgcaatgttgcaaatagaaaggagcaaggtagaagaactgagccacaaaacagtaactcttgagacatccttacatgagaaagaattgcaattgaatttgcttgaaggtgtggaagacactggaaagggagctggcacaagctcagaaattgtggagatgaatgattggtcgccatctggtgcttttgtaacacctcaagttcgcagtttgcgcaaaggcaatagtgatcatgttgccattgctgtagatgtagaccctggtagtactagtaggatagaagatgaagaggacgacaaagtccatggtttcaaatccctcacaacatccacaattgtcccaagatttactagacctttgactgacttgattgatggcttgtgggtttcttgtgatcggactctaatgagacaacccgtcttacggcttggaattataatttattgggccataatgcacgcactccttgcattttttgttgtttga

SEQ ID NO: 36859 - DNA, 3369 bp, Glycine max
  Peptide Sequence Number=SeqID_153637
atgtacagtgacctgaggaaacttgtgcatggtaatggtggcactatggatgaagataagatagatttacaaagtgaagcgctgcctgatcttctgaactataatagctatcagcccatcttgaaacatcttgggaatatattggccgagaagctggaacttgagtctgttaccaaggagattaagtcagaattgatgcacagggaaacagaaatggaagaattgaagatgaagtgccttggtttagattctgttagtaagctaatagaagatgtggcgggcatgctgaatgcggacatttcaaagatcgatataaataaatcacccctttcttgcttagattcattagtctctagtcttgtacagaaaaccagagaggctgaaatccagtatcacacaactaaagaaggatatggatctaaggagatggaattggctgaattgaaggaaaaaatgcattatctagacacactttgtcttgagaatgaaaatgaaatccttgttctgaagggaagcttacatcaggctgaggaagctcttactgttgctcgttctgaattgcacaagaaagcaaatgaacttgagcattcagaacagcgggtgtgctccattcgggagaaacttagcatagctgttgccaaggggaaagggttggttgtacagcgagatggcctcaagcaatccttggcagagacatccagtgaattggagagatgcttgcaagagttacagttgaaagatacaaggcttcacgaggttgaaacgaaacttaagacatatgcagaggctggtgaacgtgttgaagctctggaatctgagctttcttatatccgtaattcatctaatgctttgagagagtcatttcttcttaaagattcaatgcttcagaggatagaggaaatattggaagacctagatctgccagagcagtttcattccagagatataattgaaaagattgattggttggctagttcagtttcgggaaactcattgccaatgaatgattgggaacagaaggaagctgtgggaggaggctcatactctgatgctggttatgttgtcacggattcatggaaagatgatagtcagctacaaccagattcagatgattttagaaaaaaaattgaggagttgcagagtaagtattatgggttggctgagcaaaatgaaatgctggagcaatcattgatggaaagaaacagcttagttcagagatgggaagagcttgtaaatagggttgaaatgccttcacatttgcagtctatggagacggaggataagattgaatgtataggtagtgcgcttactgaggctaatcatcatatagattcaatgcagctgaagattgaaaaatatgatagctattgtggattgctaaatgccgatctgcaagagtctcaaaggacagtgtctgctcttcaagaagaccttagtgctcttacatctgaaagagagcacctttctgagaaaatggagtctttggtgtatgagtatgagaaactatcattgcagacaagggaggctgaacttgagaatggaaagctgcatgatgaaataactagtttgaaggataaattggaacacaaaactgcaattgaagaacaaattttcactattgattacaagatcagaaagttgcgagacttaattggtgatgccttgtcggaatctgaaacagaaaatatggttttcggtagtgcaaatattgattccttggaagaattgctgggaaagcttgtagaaaagctgaacatggaaaggaaactatcagcacagacaagagaagctgaacttgagaatcaaaagttgcaaactgaaatttctagtttgaaggataaattggaacagaaagctgcaattgaagaacaaattttcaccattgatggtaaaatcagaaaattgcaagacttagttggtgatgccttgtcagaatctgaaacagaaaatttggtttcttgtagtgcaaatattgattccttggaagaattgctgagaaagcttatagaaaatcatgcaaagctttcatcaatgaaacctgcatatggggttgtaggtgatggactccattctcaaaagggtgatgctacagttcatgaggaaagaagtatagatgtacatgatgaggaggcagcagatatggatagatataaaagagatctggaggagtctttaaatgaattgatacatgtgaaggaggagagaaatagatctttggaaaagcaaatatctttatcaggtgaagttgaagctctgactaaaagaattgaggaattgcaagggcttcttaatcaggaggagcagaaatcagcttcttttagtgagaaattatcaggtgaagttgaaactctgactaaaagaaatgaggaattgcaagggcttcttagtcaggaggagcagaaatcagcttctgttagagagaagttatcaggtgaagttgaaactctggctaaaagaattgaggaattgcaagggcttcttaatcaggaggagcagaaatcagcttctgttagggagaagttaaatgttgcagtcaggaaagggaagtcattggtgcaacaacgagacagtctaaagcaaaccattgaagagatgactgttgagatggagcacttgaaatctgagatatacaaccgggaaaacactcttgcagagcatgaacagaagttgagactgttgtcaacctacccagataggttagaagctcttgaatctgacagtttgcttctgaagaaacatttggaagaaactgagcaccatttgcaggagcatgaatattctctgaaactgattttgaataagttagatgaaattgaggttggtggtgaaggtcatataagtgatccagtgaagaaattggaatgggttgggaagttatgctctgatctacatagtgctgtggcatctttagaacaagaatccaggaagtctaaaagagcatcagaactactcttggcagagttaaatgaggttcaagaaaggaatgatagttttcaggaggagctcgcaaaggtgaatgctgaacttgtggatctcagaagagaaagggattcagctgaggctgccaaactggaaatgtttgcacatcttgaaaaattatcagccttgcatgaggagggaaaaaagagccatttttctgacatcatggaattaaaatctagtttgaaccaagtctgcaaaagctttgatgaggttcagaatttactgtctaatgcttttttcttggatttggaatcttatcggaaagttgaggctagtctcgagtcatgtatgaaaggaaacaatgataaaaatgtggtggattcatctgtcaccaaagaacgtgatggcattttacactggtcatctgctaataagatgttagtttaa

SEQ ID NO: 36860 - DNA, 375 bp, Glycine max
  Peptide Sequence Number=SeqID_153638
atggaggttgtttgctcaaaaagaggaattgttgtttcccaacaaaagtatattctagacctcttggaagaaacaggaatgagcggttgtagaccaggagatacccccatcgatcccaatgggaaattgtgggaaaaaggaagtgttcctgttgatgttggaagataccaaaggtatttaaagagcaatcctggaaaaggtctattttttaagaaaaataatgacttggagaagagcaaaaaacaaggtgttgttgccaaaagcagtgtagaagctaaatttagagcaatagcccaagggatttgtgaaggattgtggatttatagagtcttagaagaactcgagatggcaatagaactcccattgaagttgtaa

SEQ ID NO: 36861 - DNA, 261 bp, Glycine max
  Peptide Sequence Number=SeqID_153639
atggagcttggagatagcagcaggaagagcaggttttcctcttatgagagagtagcagccataagcttggtggttctagctgtggcttctcctctctatatagaccatagaccagagaccatagctttatcggcttttctcgaccggaacttcaccaggttcgatcgtcactggattcatagagttggtggttcttctggtggtattgttttgattcttgttgttctctttctagttttgaagtgtaaagcgtctgtgtaa

SEQ ID NO: 36862 - DNA, 1098 bp, Glycine max
  Peptide Sequence Number=SeqID_153640
atgtttatggtctcacttgagttgaaaggatgtggtgttctgtccgaggcatcacttaattgtcctctcttgacatctttggatgcttccttttgcagccaactcactgatgaatgcttgtctgcaacaacggcctcctgcccattgattgagtcattaatattgatgtcatgcccatcgattggtttagatggactttgttctttgcgttggctccctaatttaaccctgctggatttatcgtacacttttttggtcaatttgcagcctatttttgagtcttgttcacagctaaaggaatgtagatgtttcacattggatagaattgtagccagtataatccttataagacatatgcattcctcctcccttaagccagcttttgggagtgagtcagttctggtattaaagttacaggcatgcaaatatctcactgactcatcacttgagcctctttacaaaggtgctttaccagtacttcaggagttggacttgtcttatggaacactgtgtcagtcggccatagaggagcttctttcttgctgcacacaccttacacgtgtgagcttgaatggctgtgccaatatgcatgatttaaactggggatgcagtcgtgcgcatactgctgaattgcctggtgtaaatgtcctacccattgcaagttcccctgaaaatgtcctcgagttaagtgagcaacccatccggttactgcagaacctaaactgtgtgggatgtccgaacattcggaaggttttcattccatcaacggcacattgttcccgtttgttatttttaaacctttctctatcagctaatttgaaggaagttgatgtagcttgtctcaacctaagctggcttaatctaagcaattgttcctctttggaagttttgaagctagagtgtccgagattgaccagtctattccttcagtcttgcaacattaatgaggaagctgttgaggctgctatatcaaaatgcactatgctggagactcttgatgttcgcttctgtccaaagataagctcaatgagcatgggaagattgcgtgcagcatgttctagtttgaagcgtatattcagcagcttgtcagcttcataa

SEQ ID NO: 36863 - DNA, 1734 bp, Glycine max
  Peptide Sequence Number=SeqID_153641
atgaaggaaggagacatcattttcggaaacgtcgtcgtttccgacgacgacgacggcgacggagacggaaacgatacccgcggcgacgataagcaattcgcgatggtccgcgccgatgtattgggctcgtggcccggcgagagcagctccaccgccgccgccgagtgtttggatatcgccgccgccggcgagagccgcgatttgagcaacaagcgcgccaagttctacgccgacttcgaggagcatcacttttcaaccgggaagtgcagtgcatctaatgaatacgttgattataactttagtattaaaggcactcttcgacccaacggtgagacttgctatgatgcattttcattgatgggtgttgttgaagagaatagtagtggcttcgattcccgcattgtgaaagagggtggtgagggagatgatagcgatatctcgaaagtggaagaagatgtagaggtcagaatggatctcaccgatgacttgttgcatatggttttttcgtttttggatcatcccaatctctgcaaagctgccagggtttgtaagcagtggcgaggtgccagtgctcatgaagatttctggaaaagtttgaattttgaagatcggaacatatctgtagaacaatttgaggacatgtgtagccgttatcctaatgccacagcagtgagcttatctggttctgctatttacttgcttgtcatgaaggccatctgttcattaaggaatctagagtttctaacattaggaaggggacagatagctgatacttttttccatgctttagctgattgttctatgttgagaagattgaatatcaatgattctatacttggcaacggcattcaggagataactattaatcatgacagattgtgtcatcttcaattaacaaaatgccgtgtgatgcgaatagcagtcaggtgcccacaacttgaaactatgtcgttgaagcgcagtaacatggcacaggttgtgcttaattgtccacttttgcatgagcttgatattggctcttgccacaaacttcctgatgccgcgatacgagctgctgcaacttcatgccctcaactggtctcactggacatgtcaaattgttcatgtgtcagtgatgaaactctgcgtgaaatagcattgagttgtgctaaccttagttttcttgatgcatcatactgctcaaacatatctttggagtctgttagactgccaatgttaacagttttaaagctccatagctgcgaaggcattacttctgcctcaatggctgcaatagctcatagttatatgttggaggttttggagcttgacaattgcagcctgttgacttcagtgtctttggatcttcctcgtttgcagactattagattggtacactgtcgcaaatttgctgatttgaacatgagaactatgatgctttcttctatactggtatcaaactgccctgcactccatcgtatcaacatcacttcaaattcacttcaaaaattagccttgcaaaagcaagatagtttaaccatgctagctctgcaatgccaatctttacaagaagtggacctctcagagtgtgaatctttgacaaactctatatgtgatgtttttagtgatggtggaggatgccctatgctgaaatcactagttcttgataattgtgagcttggcatccgttcggttcatcagcacctctttggtcagtctttcccttggtggttgtcgggcaattacttctcttga

SEQ ID NO: 36864 - DNA, 216 bp, Glycine max
  Peptide Sequence Number=SeqID_153642
atggcgctactctgcagggggaagcccttcaagaacgaccattgtggtactggccccaacgccaacaaggccctcgactccttcatcaaagccactgtgtgcggctctaccctcaccatggttgatgtcagcctcatctgctgggcgcgaggcaagaagcccaaggccatggagttttatcttaaggctgcgaaactcggaaacctttatgcgtag

SEQ ID NO: 36865 - DNA, 348 bp, Glycine max
  Peptide Sequence Number=SeqID_153643
atggacaacaccaaagcttcatgcaagttgaagttggggtgtcgatctagcgcatttgggaaaggaattgaagaaaccctaaccggcgagagcggaaatggggtttgggggaaagtgaaaagaaaaagatgggaaattgaagaagccaattttattgagcagaacaatgttgagaagaaacatcctggcaatatgagaagaaaccttgttgtgctaccgtgggattgccggaggagaaggaaacagagtggttttcgaataacaacgttgatgttcgagacgtctaacaaagacgatgacgaaaagagtgtcgtgttgtgccgtcgtgggattggcggaggagaataa

SEQ ID NO: 36866 - DNA, 180 bp, Glycine max
  Peptide Sequence Number=SeqID_153644
atggtgggggggggtggagttgcatgtgcacgacagggtgacctcgacacttactgcctagttttcctaagtgagagtgttgtgtggacacacttaggatatttccttagggatggtaccacattgcatttgagagttgatgtcaggagtagaatgacagcagtagagtacaagaagtga

SEQ ID NO: 36867 - DNA, 880 bp, Glycine max
  Peptide Sequence Number=SeqID_153645
tgtctatggtgtgagtttggagcgtctcctaaataatagtcttgaggtgctcgacctttttggtgttggccagcttggagaacatgtcttccctggtgttgctctccctgggtatgtagtacatctcaaagcatttgaagttgtcgatgagagttttggtgatgtgatagtacttgagcaacactatttccttgttcagttatctgttggcaacttgcccctggataagttgcgagtcggtgtatcattgcttgctatgagtgcctcgtactcagctcgattgtttgaggctttaaagttgaacctgagggcttgctctagagtgatgttgctaaggccttcgaggatgattcctgccccgcttaccttcacgttggatgctctgtcgacgtcaaactctgaaagttcaacgaatcaggctaccattcctcctgctaatttaggctttcacaaaacctacttaatgggggctaagctaacgactttgtcagctactgaaagatataggagtagcggttctcctggtctgggtcaactcacgattagaggtgtggcaatggtcctctttaaggctgagatggcttatttcttgggcgtttgtatgactgtgcatcttcagtatggttgtgcatttgttggggttgacttttattccatggcgtgtgatcataatgcccaagaacttgtctccactgactttgaaggatttgatcaccatgtcatcgacgtagacctcaacatttcatctgatatgctatttaaagatatggtccatcaacctctaataagtggagcctatatttttaaggccaaagggcattaccttgtagcaaaagttgacatctgtaatgatgaatgttgttttcttctcctcatctag

SEQ ID NO: 36868 - DNA, 309 bp, Glycine max
  Peptide Sequence Number=SeqID_153646
atgtggcagagagctagaccaacagctcaagttggcacccccaatgtagatgatggagttttggttgttggattggatcatgacagctgcatgacctatcggtgccaaagcgaccacgacaagattatcgaggcaaaccccgccaccgcggaggcccgccgtaatgagtctcctgtaagtgtcatccccgacctactcgatgaagtaaatcaggtacgtgagcttggtggagcatgtggtcgggttggctcccttgccggcaacaagcgtctgcccggacctcgccaccagggtctcaccctcgcctag

SEQ ID NO: 36869 - DNA, 719 bp, Glycine max
  Peptide Sequence Number=SeqID_153647
ccaacttgtgggagaaagaggttgtccagtgtcaagcccccaagcatggatgggtgttattcgatgtcgagagtggtaacctcgacaagtgcaagagttgcaggatggacatgcttttggttttgcaagcgaaactagacgtgttaggcgtgtgcggcgtacgcgcagtactcttgcatacatgtcactcatggaatgggcatatactggaggcgtggtgcatgggtaaatttcttctaacaatgtctttctttctttttgattccaccattggtatggggtgtagtgactttgggttcgatttagcaacccctggtagaccgagaggtcaacttcatcggtggttcctcctcggaggagactcgtgtggggcttctaacaacgaatcatcttccttagaaaggttgagggtttcacgccgtgttgggagagtgaggaagagtggtggcggggatgttagggggtcccctggtgtgcgatgtagccatagtgttgggtcattgtcgtccccccctgtcgtcgctggctttgaatgggtgagggatgacattttaaaatacaagtcctccatcacctctatggcgagctttgttgctctgcaatgccaagtgaaatatgcaagccctgaggactcttgcaagctagtcattcaggcttgtgggagtgatgattatgttgaaagatatgcatatatagtatttatgtcatgtattttctag

SEQ ID NO: 36870 - DNA, 327 bp, Glycine max
  Peptide Sequence Number=SeqID_153648
atgttggtggcgactccgtgcgtattcctttcttggaacacgcacccgcgagtcacgtgttaccctcccaccgaaggtccctactgctgcaatatgttcttcgaaggggatgatacctctagagaccaccaagagagatatgaccaccttgggtgtcgcaacatgccctttggcgggcgagcgaagtcgaggctcacgggtgagctttccacaggaggaaagatgcgcggagtcgccaccaacgtttatttgtggaaaacgtcggaaaaactgaaggaaaccggtcaaaatgaaaattctaagttcgggagttgtatttacgcttga

SEQ ID NO: 36871 - DNA, 2460 bp, Glycine max
  Peptide Sequence Number=SeqID_153649
atgacacacgctacgacgtcgtttcaacaaccctcaaccaaggaggatctgagcgatgaccatgactcgtttttggtgactgcggcggttaccgtggggagcaagaacggggtggatcggaaaatggaccggaacaagagccgtaccgatctgctcgctgctggcaagaaaaagctccaacaatttcgtcagaagaaggacaataaaggtggtagtagccatgcaaaatcatcaaaaaaagctggcaagcctcagctacctgactctgattctgatgctgcaagtagtgcctcaatttcaacggtaacatctcaaattactgatggaaatgttgaagctgacagtcactccaatatggttaatacggaatcatcagagtcacagtctatggcaaactcattagctcacaacaatattgatccatctgttgattcttcatccgtggtcactacatatgatacaggcaatgaaactgtattggattctaatgccgaggtagcacatcaagttcatggtgtccgtgagaatgattctgagttatctgcccaagatcaaggggaaatcgctcaagacattggtgctgatgtgctagagggtgtgtctttgagaacttcagatagccaggtttctgaaggtggagcaacaaatgatcatgcatctgtacctgttgccgttttgccctcacttgcttctgttacaactgcagtgggggagagtgttacagatgaaagaaagtgtcaaaagagggaagagttgttgcttttatctgaggatatacccaatacatctgtgatgcaaacaagcgaagatcaggaagctgatggtttggacatgaagaaatcttatcaaagcactgatgctgtgattgatggtcaaaagcagcttcctttgtctgaggttggtgagagtgaccagtatctttcaggaattgctttggacaagactagagttgaggaggcatctcatgaagctgagcaactaggcaagtcaattgaattactctcctctcacgagctgccaaggggaactaatgagtttgatccagccagaccattggatgtctcctatgtttatgatgcaaactcaattaatctcttgcagctgggtgaaattataaaggggcttaatgaagaagagtgtcggtttctgctcgaggcaagaggagcagtctctgatttgaatcctttagccagtagttcagttctatcagacaatgacatttcagaagcatttcagagtctcaaagaagaattgttcattgcaaacttaatgaaaaatatatttaacactcaactagctgaacaactggagtttgatgatcagcgtcgccagttggttgatgaaatatctcagctccgtgcttctcctaatcaagttaatgagaagaatcaacaacttactgaagaacttgctaattgccgtgttgaactacatgatatttctagcaagaatgtagaactacaaaatcaatttaatgctgccatggctgaggtggaagctctttctgccagagtggttgatctgcagaatagttttgacgtgtcccaaaaagattcattggaattgtccacagagttggctgactgcagagacttgatctcaagtttacaggtggaaaagaaggacatgaatgaaacacttgatttgacgattgctgagaaaaatgaacttgtggaggagaaggaatttcatctatgtgaaagtaagaatctggcaactgaattagctgacttcaagagattgatggaaggagtaaaagttgagaattccaacttaattgacaggatctctttggtgactgaagagaggaataagattgaagcagaaattgagcatctcagacatgagatcgataggctgtcattagatttggttgaaaataaagattttgtggcaagtctacagtcagaaaattccaacttaaatggtaaccttgcattgtcagctgataagattaaaaatctcgaagatgaaaatcaaagactctcttctcaaatcattgtcctaaatgagcaattgtctacagaaaagggggaacaaatgaggtttgaaggtgaccttaaagaagccgcagagcgcctggaacaaatttccaaggaaaatgtgtttctcaatgacactttgaataggcacaaggccaagatagaagaaattggaaaggagcgcagccaactggtatctcaatctagggaccttggaaatcaagttcatgttgcacgtgagcatgaaattgctattattgaagattctctgtgtatggatcaggatccagatgaagtctttgatgattctcatgggtttgtttcattgaatgcttccttggatgaggtggagaaagttctggtgaagcttgaaaaggcaatcgatgagttgcattctcaatcagtatcctccagcaggtccggtgaaaaagtttcttcgcctgtggtatcaaaattgatacaggcttttgaatcaaaa

SEQ ID NO: 36872 - DNA, 636 bp, Glycine max
  Peptide Sequence Number=SeqID_153650
atgtccaggtacgagcgttacagactcctgacggctaatcatacaaccattctagaggaagctttcaacttggaggtacccatcaggctacccccgataaaacctcccagcctggggttaaatgcgactacatactacatgtaccatcgtgatcggacaaccaccaagcaggagcaagacctggaggacactgagaggagtagtagaggaatcacgatgcaaacagaagaagagatagagcgaaatatcgagtccagcatgtcccaaaaatgccatcttcacgccattcgagacatcaacatcaattttgtcgattcaccattagaacgaagtctccctcctatcactttcacggatagggacttcaaggttatcaatcccattaaccaggacaacctcatagttgtctccatcgtcatcgcaaacttcatggtgcccaaggtcctcatcgaccagggaaactccattgatatcctatattggagaactttccagaggcttgaggtctccccagacactgtccaccttcacgagacacttaacgagcttggagccatagtctccacaccgcatctaaaaatgaaattccccaccttgaccgaggagactgtaaccgtcaaggcaaatcaaaagtaa

SEQ ID NO: 36873 - DNA, 351 bp, Glycine max
  Peptide Sequence Number=SeqID_153651
atggcctcccatacaccattgtcatggacaacgacactcaagtcaaagctcatatgcaagtacgaaggcttcctgacaagggtaggtgtcaagcaccttgtcacacttatcgaacatcctcagaccaatgatcaggcaaaggcatctaatagagttatgctcaaggtcctatgcactagactcgacaagtctaagggtctatggaaagaggagctccccagtatactctgggcctaccactgttcacctcaggcagcaaccaacaaaacttcttaccgactcacatatggcatagaggccatgatccccattgaagtcgaggaaccatcgaaaagaagattgttgttctag

SEQ ID NO: 36874 - DNA, 303 bp, Glycine max
  Peptide Sequence Number=SeqID_153652
atgtcactccctgaacgacatgtatgcaagagcatgacacacacgcgacacatacaaggctcgtcaaacccaagctccgcgcttagtgagtctcacaggttcatcaaacccgaggtccgtccttgggcaaacacgtccccggtccaaggctcgataaacccaaggttcacccttggaatacaagtctatcaaaaacccaaggtctgcccttggtatgcacatttacaaaacccaaggtccacccttggtaagaacgcctacaaaacccaaggtccgctcactcgcaacaactacaacgattga

SEQ ID NO: 36875 - DNA, 2079 bp, Glycine max
  Peptide Sequence Number=SeqID_153653
atggttcgtgtgagtcatcctgacaaagctctagctatggaaatggtccttattgattcttttgtgaggtgggctctcggacttcacacatcagctttgagaggtgcctttgttaggaggacaggaggggggacctacaaaacaaaggactctgacgctcaaggttcgatggaacctgacatttataggagtggagtggagattgttcgtgctcctgttccaagactgacgtggagggttgacatgtgtctcgaagtgtcgtgtaaggagggagacgagtttatcaagcccccgagtatggaagaatgttgttcggtgtcaggtgtggtaacctcaacaagtgtgagaactgtaggtctacctggcttgtcaaatccccaagccaagtgctatttgggttgcttctgtcaagttgtctgggatggacatgtctttgatcttacaaggcgtgtgcaaaaatttagggcaccacttccactcccgctagttaccgaagagtctgtttcccttttaaatggagcgaaccaacccatgatggaccgagaggtcaattccgttggcgagtcatcctcttcaaagagggtgaaggcttcacgctgtattggtggaggcacttctcaccttcgtgggagggcgtggatttccattgcttccgaggagcctatcccggttaatgtgattctccctcttctacttctaagggacgctaggtcgccatcgtccccacttgctgttgttggctatgagtgggtgggggacgatgttctaacgtataagtcatctctcacctctggggactcctgcaagatagtcgttcaagcttgtgggagtgatgacttccctttcttgcgagcgacgtcggatgaaattgatgggaaaaattggttgggtctccttgaacagcgtgtccaagaagtagttcgagcttatcccaccaggtttaagtcttttgatgaagacctgttgaccctcgtggagagggaggccaaggccatcttggagccactatcagcctcgctggacgcatgggccattttgtctcttccctcggtgatcgatcccctctctgcgttggacgataaatgtattataggtgactttgcttggaggcctctcgtgaagaaggtcggacctagcagtggtgttgtgccaccatctattactgcttctgttaggaagcgagatgatggtgttaggctgtcaggccacaagaagtcaagggcctctttgagccttcatgccctgaggcaggctgtagggttgtcgctcggttcaggtcgcccttcaagtgtgcaagatgtgcctttggctccatcagccatcaaggctcatgctgctgatgctattgttggtgttactcttgcccctccacttccttctgttgtgtttgttcatgaggtcgctcttgttgctgttgaagtgagtgtgccagttggtttggctggttctgctatggtgccctcatccactgttgttgcacctttactgagtgtcgatgtggcgaccactagtgccaatgtgctgcctcctccttccttttcgggtccaagggtccctcgttccactgcattggcttcgacttccacctcttcccaccctatgtttccctggatcacatctacactgccaatgatgtcagtcaagttccaacatgctatggattctgccaagaaggtgactgcttgcactatctggagagtggaacgctctaaggacattgtgacagagaaagacaagcttgccaaaaaggtggtggatcttgaggcccgactgaaggagtcaaagtccatgcttgaggagtcccagctacaggctgctagggagagggaggctagcaaggagcttgaggaggagctgcttgtttacaataaggaggtcatggagcaacatgaaaagggttttaacaaggccataaggcaagccagattcttcgccaaggaccttgacttgggtctttttgaccctttcaaggacgtgaaggatgatgttctgcttgatgaagaagagattgttgcggaggaggaggtcgaaaaggaggagcagggtgctgaggagcaaggtgatgatgccactgtttag

SEQ ID NO: 36876 - DNA, 978 bp, Glycine max
  Peptide Sequence Number=SeqID_153654
atgggagaagaacaatgcaaagctggcaaagaagaagtggataaactcctcaatgctaacttcataagagaagtcaagtattccacttggcttggcaacatcgtcatggtaaaaaaggctagtgacaaatggggaatgtgcatcgactacacaaatctaaacaagacatgccccaaagacgcatgccttctacccagcatcgacaagctagtcaatggagtgttcgggttccaagtgctaagcttcctggatgtctattctgggtacaaccagattcaaatgtacactctagaagaggagaaaacgacattcatcattaaagatgccaatttctactacaaggtatatgcggacgacatggtcgtcaagtctcaaagcataacccaacatgtggtggacccgaaagaagtctttggtgaactccacaaatatgacatgcacctcaaccctaaaaaatatacttttgggatgtgcaacccgaccaacctccaagaagttcagaaactaaatggtaggccaacatccttgtccaggttcctcccaaagctcgtcgaaaaggcaaagctgttttatagactgctcaagaaaactgagcccttcctatgggacaagacgtgcaaacaagccttcctggctttcactaagaccatagccacactgctagtttttagccaacctaggcaggagtacccttactctcaactttcagagttcgatatccagtgtgaacctcacagccccatgaagacacagttcatggcagacttcctgggaagtggggcaagaatcattctcgaaggccctaaaaatgtcactctagagcaagctctcaagctcaacttcaaagcctcaaataaccacacaaagtatgaggcactcattgcaggtctaaaactagaaacaaaagttaaggccaagaagctacgatgctacacaaacttacagcttgtccaaggacatcttgctaatagattctag

SEQ ID NO: 36877 - DNA, 414 bp, Glycine max
  Peptide Sequence Number=SeqID_153655
atgcccaaacccgactcccctaaaagaaacaaaacaggtgtcaacatcttagaactccacccaagtcctagaacaacagctcaagccttaatcaatgacaatctcattaacttaaggcatacacagttgctccctcaccacaacaccaacacttcgtcttggattggagacttttctatgtttacaacaaaagagattttctatgaaggtattgcacaaacacaaattcttcctagaatgaggtttccactcatgaatacaaatctcacttctcacagatttacaatcttaaacctctttaagaaggctttcaacaaactatctgttggaagtagagaccaccttgtagcttttttgcagaagttcaaactttgtgccagactgccagttgtgtcatgttctgtcagatcttaa

SEQ ID NO: 36878 - DNA, 273 bp, Glycine max
  Peptide Sequence Number=SeqID_153656
atgctgcctctattggctcttcaatcacaaacaacaagatatgtaaaggtgggtggtgatgaacttcatgttgaaaagaccacattggcatttccatgcttaaattactccaaatttgcacattcaagtaatgcattcacgttctcacgaaatggcccgttaaacataacaggatatccaggtttaccaaaattcttgaagctgaaaaccttcccacacctcttcctttttttgttcccaactactatagacttttatgaagctgatgactag

SEQ ID NO: 36879 - DNA, 324 bp, Glycine max
  Peptide Sequence Number=SeqID_153657
atggttaccagacacccacggagaggcacattacagcacttgtatgcttttagccggaatattattaaaaatgggagcatatgggttggaattggttctataagcgatacaggtctcaacggggctattttacaaataatatctcacggatttattggcgctgcgctttttttcttggcgggaacgagttatgatagactacgtcttctttatctcgacgaaatgggtggaatggctatcccaatgccaaaaatattcacggtttcactatcttatcgatggctctctgcattgccgggcatgagcgttttgttgcagaattga

SEQ ID NO: 36880 - DNA, 312 bp, Glycine max
  Peptide Sequence Number=SeqID_153658
atggcggttttaccaagtagctcctcaaacttggaattgaccatatctgtccctggctttgcttcttcaccagtccttcttcccttatcatctgtgaaagaattggacataaaccaagtacctctagaagaagattggatggcatcaaacatggaagatgaagaagaaggcagcaatggagaccctcctcgcaagaaactccgtctcacaaaggaacaatctcgtctccttgaagaaagctttagacaaaaccacactttgaacccagtaaataaccctccaatctctgtctctctctctctctcttattaa

SEQ ID NO: 36881 - DNA, 198 bp, Glycine max
  Peptide Sequence Number=SeqID_153659
atgatgaagatgaagaagaggaagaggaggacctgtgtatcaacaaaaaggagagaaaaaaggcgcatagaaaatcaaagggaggttaccttagaaaaacgtatatcaagaggtgtaggtttccgaccatggtcgtccaagtcaaagggtatgtggcccaaagatggtgacacgtgtaggtgggagagtaaaagatga

SEQ ID NO: 36882 - DNA, 372 bp, Glycine max
  Peptide Sequence Number=SeqID_153660
atggagaaatctgaaaagaaaaattttagtgaaaagaagatgaaggcctacatcacatgggatgacaatgatatggaatcacccgaggattcagaaaatgaagagataaacctgtgtctaatggctaaaagttatgaaagtgatgaagaggtatctttgaagaagagatggtacatagatagcgaatgctcaaaacatatgacgggagatgcatcaaagttcacacatatctctcccaagaaaagcggatatgtaacttgtggcgagaacaacaaaggtagaattcttggagttggaaaaataggtataaattcttcaaactccattgaaaatgttctacttgttgaaggccttaagcacagcttgcttagt

SEQ ID NO: 36883 - DNA, 333 bp, Glycine max
  Peptide Sequence Number=SeqID_153661
atgagagttgtcgaggaacgcctacgaagcattgggaaggctagtggtggtaccattggtatccttgaggatttacaaatgtgtgaatccacatcaagccggagccgttacaaactccatgttgtggtggtgacccccacatacatatttcctaacgatgccccaattgctctaagatcatatctagtgtcaccccaatggtttttctttgacatgtttcattttgaggattcgccctgttgttgctgctgcaccatgcttaagagacacgtcaaacggattcgtccacatgttggagatctccatggagttgagtctacttatatggcataa

SEQ ID NO: 36884 - DNA, 261 bp, Glycine max
  Peptide Sequence Number=SeqID_153662
atgagggtttttacccgctgtggaatgcaagaggtgtggttgtgggtgtcataccctaatttagtctggggactattgtttgatggcatgcaacctttggttgaccgctttgaggtacttggcaccctttgttgcacaatacgtgaagttccgagtcataccggaaatcaaaaaggaagcattgttgcacaatacgtgaagtttcgagacatgccggaaatcaaaaggaagcatcgttacgcaatccgtgaaattctgtaa

SEQ ID NO: 36885 - DNA, 759 bp, Glycine max
  Peptide Sequence Number=SeqID_153663
atgataaagttacagagcaggcacttcatgccagaaccagccacaagtctagaggtcgtggtggctggaaccaaagaggaaaaggaagacatagaggagattggcaacaacaatgcccatagcaaatacaagaagaatgatcaggcacacttggcacaggaggaagatggatctgatttagaccaagttttgcttatggtaaccacgagaagtaaagaagactattcttcttggtatctcgacactggatgctcgaaccacatgacaggaaataaagatcggctggttgatttcaatccaaatgttaccactagtgtgaggtttgcagataatagcaccattcttgcaaatggtattgggaagggaaaccatattgagatctttgatgataaacaaagactagtgctcaaggcaccattatccagaaataggaccttcaaggtgaatttaagtactactaccattcaatgcttgtccactgttaacatggaagaagatagctggctatggcactacagatatggccatttaaattttaagagtctgcatcaactaagcagcaaacaaatggtgcttggaatgccatccattcacttaccacaaaaaacctgtgaaggatgcttgattggaaaacaacccagaaaagccttcaagaccaaggcaccacaaagagctaagcaacctcttggaatagtccattcagacgtgtatggaccctttgatactccatcccttggtggtaataggtatttgatatga

SEQ ID NO: 36886 - DNA, 369 bp, Glycine max
  Peptide Sequence Number=SeqID_153664
atgaaatttgaggcgaagaataccctcaaaatcattgccagtaatgacaatgtcatcaacatagacaacaagctggtgaagagaccaatgttgaatggcagccatagcaagaaagagatggacatgagcaattttggccattggggaaaaggtgtccctgtagtcagggccaaaaatctgagtgtatcctttgtccaccaaacgagagtaaccaaggaaaagacacttcaaggacctagcaaaaagcttatctttacctggtgtaagatcatggacataacaagtgcagccaaagacacaaaggacagtgtacagaggttgtttagggtacatgatggagtaagagacctgatttccaagaacagatga

SEQ ID NO: 36887 - DNA, 483 bp, Glycine max
  Peptide Sequence Number=SeqID_153665
atggacatcattggaatagaccttcttagccttattccatacctcataacaagtgggaaaagcttgaaattgtggttgaaggttaggagcaagagaaccaaaggacactacacaatgaagcatgtcaacaaaacgttggtaaaagtcatagtagaggaagcaaaaacaggatcggaagaagccatgagaaaggtaggagccaaacagcaacaagcggggccaaacggtaccaagcagagccaaacatgcaataagcagggtcgccggaggatgcggagtacggtgatggtgtcgtcgaagggtgggctttccggaaaagtgccatgcatgaatggtcgacgatggagggcgactcttgtcgggttggttcgcatgcaatggaggtcacggtgttggccaaacgacgtaggcacagtctgtgggtatttgttcacccgagaaaagggaatgtgcttgaaaaaaaagaaaaacctaaactactga

SEQ ID NO: 36888 - DNA, 519 bp, Glycine max
  Peptide Sequence Number=SeqID_153666
atgggtctgctcaaatacttcctagggattgatgttgcccaatcctcctatggcattgtcatttcccaatggaagtatgctttggatatcttgaccgagaccggtatgcttgattgtcttcctagtaatactcctatggatcctaatgtgaagcttctctcagttggtgtgcttagtcaatttctgaaagacccgactgatagtcaatggaatgcaacaatccgcatacttcgatatatcaagaatgcaccgggtcatggattgctatatgaagacaaaggcaatggcaaagttgtttgttactttgatgctgattggccaggatcaccatcagacaagagctccacctctggatatagtgtctttatgggagaaaacttgatctcatggagaagcaagaagcagaaaatcgttgctagatttagtgctgaagctgagtgtcgtgtcatggcagcagctgcatccgagatcacatggctcaggcaacttctccaacagataaaatttggagacgtttag

SEQ ID NO: 36889 - DNA, 378 bp, Glycine max
  Peptide Sequence Number=SeqID_153667
atggaattggagaacatggatatgcaaactaccttgatacgttttatgaggaacgcagccagttctttatggtccttgcccttgttggccttgcacctaaacttgaggcagtgtgcaataagattttgtcaagttctgctattccttcctatgacatggttagtgaacaactgctttgcctcttcactatgcatgcctttggatcatcctctgcacctgttgaagattcctttgctcttgtctcccattcttctaattgtggtggatgaggcaaaggtcgtggtggtcaaccatgtttcaaacgttgcaactattgcagcatttatggtcatattgaagccaactgtcgcaacaaggctcgcgatcaagcaaagttag

SEQ ID NO: 36890 - DNA, 264 bp, Glycine max
  Peptide Sequence Number=SeqID_153668
atgttcctaaacgaagaactctacacggttccagaatttcaaataaacatcatcgataataatgatataaacactaacgcaacaacccaaatgtcgcaacgtgcccttcgcgggcgagcgagggcgaggctcacgggtgcgctttccaaaggaggaaaggtcgacaaaagcggggcttttgctcctacgtaccctcctttggagaggaaatcagacctacgtagttcttccttaagcgtgaatcgagtgattctttttacttga

SEQ ID NO: 36891 - DNA, 231 bp, Glycine max
  Peptide Sequence Number=SeqID_153669
atggcgaaacggctggattgggtatttatatcgcggtttattacctttagcaagattatggcatcgtttcagcaaataaaggacatcgttaaaggtataaagaagcagattggaaaacttcttgcactaactctaagcattggaggacttaatttaagactacctttagttttaaacgcaggaagggaggaaggtctcggaaagggatatgcgaaaacattcaagggataa

SEQ ID NO: 36892 - DNA, 687 bp, Glycine max
  Peptide Sequence Number=SeqID_153670
atggccagacctttaattatagtcatcccttctttccgttatcaggaagccatatttcgtgtcttagcggaaattttacatttgggaaacattgaattttcacctggaaaagagcatgactcatcgggagtaaaggatgaaaaatcaagatttcatatgcagatggctgctgatcttttcatagctcccaatccagggggctctgcttctccatttttccaggcagccttcattgctgcagttgatactgtttctgtgcccaatgactgcatataccactggtcgttgtccgccgctgtccactgctgtcctccgtcgtcaaccaccttccgccgcaaaactgatcggagaacccaccaggagaagcgctttctccagatcggcccatccctgaagtttcaccgccaaccgccatcggacgcgctgccactcgctgtttttgtctccggcgtgtgtaagccacgcgccaccgtacaggccgtcttttttgacggcaccgccacagaacaggtcaccagtccacctcggttctgttccaaggaaaccctagctcgagaaggttacggttaccgttctacgttttttctctatcttgtttgtactcctacggaggatgacaaagaccttgaactagcatcatcaccagttcatcataaggaggatagacgctttgagaatcagtactag

SEQ ID NO: 36893 - DNA, 1073 bp, Glycine max
  Peptide Sequence Number=SeqID_153671
atggacctaatgtcttacctgttgtcatcagtcatttatctggtgcagaggctttggaaacagagtttatggaacctcttatcaagattctgcttcattatgcaggtttctaatgaagaggctaagaaagtagagatttccaaacttcaaaagatgttagaagctctgaatcttgaattggatgcagctaaattggcaaaaattaatgagtgcaacaagaatgctgttctgcaaaatcaatttgaattgtcagtaaaggaaaagtctgctttaaaaagagagctagttgcagtggatgaattacgaaaggaaaatgctcaattaaaggttccattggatgcatttgaaaagaagtgcacaaccttagagcttgagcttatgaatgctcaaaaaggccgggatgaaaccatggagaaactgagagagtctgaacagaagtgctctcaacttgagcaaaatgagaaaaggcttgaggaaaagctattgaatttagaggatgaaaatcatgttcttcgtcagaaagccttaagtacccctcttaagagtaaccgtccaggttttgccaagtcaatatcagaagagtcacccacacccacaaaacttattgccccttttacactaagcttgccagactctcgtcgatctaataagttaacagcagagaggcagcaggtagatcctgttgcacctatgttctgtcttaaatcctacacctttagttttgggcatcctgctatttcagaagaacttgtggaatacagaggatgtgaagagggtcataagtatttcttggggaagcaaaattggactatgatatggagagtggagaccaattccagaaattccattgagaaatatctacccccatgtagaatcgaaaccggagtagactcgtccgatttagcgcagactcgggcgagtttaggtagactcgcgagtctgcgacgagtccgcaactgctactcaccgctgttcactcgcatcgtcatcgctggccctcagtcgcggtcctccatcgtcatcggccgtcgctgcctcgctggtcctcacttgcgctccaagctttgcttcac

SEQ ID NO: 36894 - DNA, 582 bp, Glycine max
  Peptide Sequence Number=SeqID_153672
atgaatctgcgccacggctccaaggtttggctcgaggaccgcgattcggcatggctcgccgccgaagtgctcgattctgacggtaatcgcttcttgctcgtcaccgattccggcatgaagctttttgcttcgccggagaagctgtttccgagggatgcggatgaagaggagcacgggggatttgaagatatgacgaggttggcgtacttgaacgagccgggagtgttgttcaatcttcggagaagatatgcgctcaatgatatttacgtgagtgggagcattttaatagctgttaatcccttcacgcagcttcctcatttatatgattcccatatgatggagcaatataagggagctccattgggtgagcttagccctcatgtttttgccattgctgatgcatcttatagagcaatgatgaatgaaggtaaaagtcaatctatcttggtcagcggtgaaagtggtgctggaaaaactgaaacaacaaagttgattatgcagtatcttacctttgttggtggacgtgctgctgttgatgatagaacagttgaacagcaagttcttgaagtaaactattcttga

SEQ ID NO: 36895 - DNA, 195 bp, Glycine max
  Peptide Sequence Number=SeqID_153673
atgcattatactgctagcaggggacagcttctaacggccaggaatcttggattgcttctagatgatgctgacctggctgcatgcttagctcactttgccaccatccctgcaggcttccaaaataaccttgtcctcaaggttgtagtcgcacttaagggattcccactactcccacgatgtgtcttccggaattaa

SEQ ID NO: 36896 - DNA, 4293 bp, Glycine max
  Peptide Sequence Number=SeqID_153674
atggcggacaacaacaatgatcgtacaaggcttcagcatatgcagactcatatcaataccttgaattcgtggatggaagagcagcgcaagcgcaacatagaaaatcaagatcgcaattcttcttcgggtggtattccagtaactccaatttcttcatttgcgcctgtcaaagacatttctctgggatttccccattttgatggccatacacctgttctggaatggattttcaaagtcgaaaagttcttcaattatcatcatactcctgactctgatagagtggagattgttgcgattcattttgagaaggatgtcatatcgtgtgggttcaatgctgatattcgtagagatgtgattgctcaggcgcccacgacattaattcgagttgtgtccttaaccaaattatatgaggaaaagtatcaaccagtaaactctaattggacccacaattattctcatagatattcccccatttctactcacactgttaatttcaattatactccttctaatgctgctaaaaatactaccaaaacatctttgcccttattgttgcctacgcctaatactcctcctcttagaaataattttgttaagaaaatttctcctgctgagatgcaattaaggcataaaaaagggcagatgttaatgttacaacttgaggatgataaaggtgaagctgagatgagttttgatgttgggtctggagataataatagtactgctaaaactgtgattgacaatcctcaccatctttccttgaatgccttgaaaggaggtcttggtgttggcactattagatttgtagctcatattaataccttacctgtgagggtacttgttgatggtggtagctctgacaattttctccagccaagagtcaccaaatttttgaaactacctatagaaccaacacccttgtttaaagttatggttggtaatggtaattacatgactgttttaggcatgatcagagaacttagcattcaagctcaaggtaacaggtttcaattacctgtattcttgctgccaatatctggcgctgacttgatattgggagctaactggttgaaaacactgggttctaacattgcggattatgattccttgagaatgatttctactgattctattgctgaagttttcaatatgcagcttattgaaccttccaattttcagtttcctttatctgaattacctgttgatttagaaccggagttggcacttttcttgcatacatatgaatatgtttttaagactcctacatccttaccacctccaaggtctcatgatcatgctatacacttgttggagggatcaaaaccggttaaagtcaagccttaccagtatttacatagtcaaaaagatgaaattgagaaattggtgcaaggaatgcttgaggaaggcatcatccagccaagtaagagcccattttcttctccaattattttggtcaagaagaggggtggttcttggagagtatgcactgactatagagcattgaatgctattacagttaaagatacatttcctattccaacaatcgatgaattgattgatgagttgtttggagctgaatttttctccaagttggacttaaggtctggttatcaccagattttgttgaaacctgaggatagacaaatcgattacttgggccatgttttgtcaggtgcaggagtgcctatggaaaccactaagctatttgtcaaaaattatgcttctattgttggaccactcactgatttattgaaaaagaactcctttcagtggtctgattctgcttctcaagcatttttgcaactcaagaaagctatgacttcaactccaatgttagtaattcctaattttagagaaccatttgtacttgagactgatgcttctggttcgggtattggagcattattgagtcaatctcaacatcctattgcttatttctttaagaagttgtcccctagaatgcagaagcaatctacttatactagggaattctatgctatcacagccatggccaaattcaggcattatttgttaggccataagttcattattagaactgatcagaaaagccttaaggagttgttggagcaaacattgcagactctggaacaacaacaatggttacacaaattccttggttatgatttcaccatacaatataaaccagttgcaacagttactaatgaggataagttactaagtgaactgattagtcgctatgctcatgggggaaccattgatcctaagtatgatgctaaggtggatgaagcagtacctgcaggattgcttcagccattacccatcccacaacaaatctgggaggacattgctatggacttcatcactaatttaccatcttctcatggttattcaactatcatgatcatagttgacatgctttctaaatttggccattttattgctttaaaagttgagtttaatagcaagttggtggcagatgcatttatcaagaatgtggcaaagatacatggatttcctaagtctattatgtctgatcatgatagagtgttcattaattctttttggcagcaaccgtttaaagctcaaggaaccactttagctatgagttcatcttaccatcctcaaagtgatggcctgacgaagatccttaataagactcttgaaatgtacttaaggtgctttgtgtttgataatcctaagatgtggtaccctatgctagcttgggcacaatattggtacaactcttcttatcatcacagtttgggtatgagtccatttaaagttgtatttggcagagaaccacctgcaattgttccttatcaagtccatcctaaggatcctatatctctacaggaaactcttgttaacagagataaccttttacaaaagctcaaggggaacttggctagagcacagaattacatgaaaatgcaagcatacaagaagagacgagactttcagttggaggtgggagatttggctttggtgaaattacaaccatataggcaacaatctgttgctcttagaaagaatcagaagttgggaatgcattttttcggaccctttgaagtggtggaacgcgtgggacaggtcgcttataagttgaaattacctgaggttgcacgcatacatccagtttttcacatttcattacttaagcaatttcaaggaagtcagtcacatcagtacttaccaatgtcacttacaacaacagaatttggcccaatcattcaacctgaacatgttttggatacaagaattattaagaggaatagtattgaaattcagcagatcctgattcaatgggagtcatttgatgctagtgaggcttcatgggaggatttgacagctattaaacaatcgtatcctcgattcaaccttgaggacaaggttgatttcaaagggaagggtattgtaacgagtaactcagtgggtgacaagtgtgttggaaattctattaagaatgatggacacatggaaggcgatccacaaaacttggccacgagaaggagcacaagggctcacaaggagaacgtgcattttaggggttatgatcatggaggaaaggcatatgtgaataagatattagaagaaaaggaagtggataacaaatggtataatcttggtaggcttaggagtaacaattggtataacaaccctggtaggcctgaaatccctgaaaacacaagggaggttgagtttgttggtaagatcaatgcaaggatctcattggatggtgcataccatgatatggatgagcctagtgaatatagcagtgagttaagaccctcatcaaaggaactttgcagttccaacattggtatgttggaggtagggatcataaaggcaacaactttggtgccaatgaagaatggaggagctagaactgatgcttattgtgtggccaagtatggccccaaatgggtgcgaacgaggaccgttgttaatagcctctcaccaaagtggaatgagcaacatgcttggaaggtttatgatccattcatagtgattactattgttgtgtttgacaacaaccagttagatgctaatagtagagctagaggagaaaaggatgctacaatggggaagataaggattcagttgtccacacttgaaaatgaaaaagtctatgcactttcttatccacttgtaggtgtgaatccttctggggtgaagaagatgggtgaaatccatttggcagtaagacgttacttcaagaggcctaggaatccttgccacacagatgcaatattgtgtggtgctaatgtggcaactctcaaagacttgcaagaagaacttgacatgttttga

SEQ ID NO: 36897 - DNA, 789 bp, Glycine max
  Peptide Sequence Number=SeqID_153675
atggaggagttcttgtttgtgagggttgtgacgatcaacgactttccaacaaacattgactactacgtggaagtcatggttggagacttgactgcatcaacccttttgttcatatcccccgaatggaaccaagtaaaattcagcattgatgatgttccaacgcgtgtatcgccagaatcttcaacattggcactccaatggtacaagcaagagggtccaaatggaagacttgttatcagagagatcatgctatgtttgtggatgggaactcaggaagatgaatcttttcccaatgcttggtgttcaaattctacaatggtgagtggtgatgatgttgtctacactcgttccaagggcctggaattggaattggttagagaatcagatttttttgtccaagttgatttggggagccaacacctaagaaccaagctttccaagagtccaaatctgctatggaatgaggatttggtgttttttgcacaagaaccattcagtgacacacttttcctcattgtgaagaaagcgacaccggtaaaagacgtaacaacaaccttggggatgcattgtgtaacgagtaatttagtggatgacaagtgtgctggaaattctgttaagaatgatggacacgtggaaggcgatccacaaaacttggccatgagaaggagcacaagggcatgcaagcagaacgtgcatttaagggttatgatcattgaggaaagacatgttgttggtatgattctctctcttatgcacccatcttcttttggagctcatctctttctctga

SEQ ID NO: 36898 - DNA, 195 bp, Glycine max
  Peptide Sequence Number=SeqID_153676
atgtcactactcatcacaatcccttttgcagcctcacgctttaaaactacagtcttgccactggcacacagaatcagaagatacagggcaaggtataaggcaagtaacaaaaccaaacgaagaagaagaatcaagggcaaaaaggaaaatcaacaggccacgatacctggaagattacgtgtcaaagtgagctga

SEQ ID NO: 36899 - DNA, 567 bp, Glycine max
  Peptide Sequence Number=SeqID_153677
atggcggcagtaaaaaaatggagacaatatattttaggtcactgctttgtgatcctaacagatcatcgtagcttgaaggaacttatggctcaagctgtgcaaacccctgaacaacaacaaattaaatatgaccaccgccgaccaccaggcctcttgtgtcctcttccaattctggcgcagcaatggaaggacttctccctggacttcatcgtgggacttccctcctatcgcggtaactccgtcattttagttatcatggatcgcttttcgaaaggactccacctgggtgcacttccacaacatcatacaactttgagcgtcgcaaggctattcatggaaatttctggcaagcttcacggcatgccacgaagcctagtctcagacagggatccattgttttaccttgaaggaacatcgaaggtcgaggttgttgacgagtggttaactcatcgcgataagataattgccagtctagtaaagaagttgtccaaagctcagaaaagaatgaaggaatttgcggaccaacaacgccgtgatgtgaactacacagaaggggaccaagtgttg

SEQ ID NO: 36900 - DNA, 2355 bp, Glycine max
  Peptide Sequence Number=SeqID_153678
atgtgccagttaactgggctgtggtattttgatgtgagaaacaatagcctgacaggaagtattccagagaacataggcaattgtactgccttccaggtcttggatttatcctacaaccaactaactggagagataccattcaatattggattcttgcaagtagcaactttgtccttgcaaggcaataaactctctggacatattccaccggtgatcggtctcatgcaagcacttgctgtcctagacttgagctgcaacttgttaagtggatcgatccctcctatcttgggaaatttgacttacacagaaaaattgtacttgcatggaaacaagctgactggcttcatccccccagagcttggaaatatgtcaaagcttcactatttggaactgaatgataaccatttaagtggacatatcccgcccgagcttggaaagcttacagatctgtttgactttttgatggagtcacccatcattctttcagaaatgttgcaaacaacaatcttgaggggccaattcctagtaatcttagctcatcaatgtgcatggcaacaagttgaatggatcaattcccccttctttgcagagtttggagagcatgacctctttgaatctttcttccaacaatcttcagggcgcaattccaatagaactgtcgcggattggcaatttggatacattgtaaatgatttcctccccagggatatttcaaacaataacttagttggttccatcccttcttcccttggtgacttggaacatcttctgaagttgaatctaagcagaaacaatttaacaggaattattccagcagaatttggaaatcttagaagtgttatggaaattgatctttcaaataatcaactctctggcttgattcctgatgaacttagtcagcttcaaaacatgatatccttgagacttgaaaataacaaattgactggcgatgtggcatcactttcaaattgcattagtctctctctacttaatgtgtcctataacaaactatttggtgttatcccaacgagtaacaactttaccaggtttccccctgacagtttcattggaaaccctggtctttgtggtaattggctgaatttgccgtgtcatggtgctcgcccttcagagcgagttacattatctaaggctgccattcttggaattactcttggtgcccttgtgattcttcttatggtattgctggcagcttgccgaccacatagtccctctccttttcctgatggatcatttgacaaaccagttaatttctcccccccaaagctagtgattcttcatatgaatatggcactacatgtgtatgaagatatcatgaggatgactgaaaacctgagtgagaagtatataattggatatggagcatcaagtacagtttataaatgtgttcttaagaattgcaagccggtggctatcaagaggatctattctcactatccccaatgtattaaagaatttgaaactgaacttgagacggttggcagcatcaagcaccggaatctggtcagtctccaaggttattccttgtccccatatgggcatctcctgttttatgactacatggaaaatggcagtctatgggatcttcttcatggacctaccaagaagaaaaagcttgactgggagctgcgtctaaaaatagcacttggagcagcacaagggcttgcttatctacaccatgattgctgtcctagaatcatccacagagatgtgaaatcatctaacattctattggatgcagactttgagcctcatctcactgattttggcattgccaaaagtctctgcccctcaaagtcccatacttctacttacataatgggcacaattggctatatagaccctgagtatgctagaacttcacgtctcactgagaagtctgatgtgtacagttacggtattgttttacttgagttgctaactggaaggaaagctgttgacaatgaatccaacctccaccatctgattttgtccaaggcagcaaccaatgcagtgatggaaacagttgatccagacattactgccacatgcaaggacctaggagctgtaaaaaaggtttatcagcttgctctattatgcacaaagaggcagccagctgataggccgacaatgcacgaagtgacacgtgtactcggaagccttgtgctgtcaaacaccccaccaaagcaactagctgcactaccacctgcttcaaatccatctgccaaagtgccatgctacgtggatgagtatgcaaacctcaagactccacacttggtgaactgcccctcaatgagcacctcagatgctcaactcttcctcaagtttggagaagtaatctctcaaaacagtgagtga

SEQ ID NO: 36901 - DNA, 564 bp, Glycine max
  Peptide Sequence Number=SeqID_153679
atggatttactgcaagggtaccatcagattttaatggtgccggaggatgtgagcaaaatagcgtttcgaatgcatcatggccattatgagtttatgactttctctaatcatctcgagcatttgaggacaaccttgcaaactatcactgacaacaactttgttatgaaattatccaaatattccttcgcgacccaacaagtggaatacctgggtcacttggtttctgaaaaaggcgttgaaccagtccctgtgaaggttgctgtcgtgcaacaatggccacctccttattcgatacgagcattgagaggatttttgggtctttcaggtttttatcaccgtttcattaaagggtatgctaccatagctgcacccttcacggctttaatgaccaaggatcaatttcactggactcttgaagctgatcaagcttttttgaaactaaaggaagctctgtgtcatgcccctgttctgggcttacctgatttcaattccctgtttgtcgtagaaattgatgcttcagggataggcatgggggcaattctgcacaacaccatcatcctctag

SEQ ID NO: 36902 - DNA, 507 bp, Glycine max
  Peptide Sequence Number=SeqID_153680
atggcatttcgatttggagtccttattcttgctttggttatttgtttgaatttcaattctgtggaatctgatgatggagcaacgttgttagagataaagaagtcatttagagatgtggataacgtgctctatgattggactgactcaccatcatcagattattgtgcctggagagggatatcatgtgataatgttacctttaatgttgttgcactcaatctttcagggttgaatcttgatggtgaaatttcacctgcaattgggaaacttcagagtttggtctcaattgacctcagagaaaacaggttatcagggcagataccagatgagattggtgactgttcatctttaaagaacttggacttgtcatttaatgaaattagaggggatataccattttctatttctaagttgaaacagctggagaatctgattttgaagaacaaccaattgattggaccaattccttcaactttgtctcagattcctgatttgaagattctgtaa

SEQ ID NO: 36903 - DNA, 153 bp, Glycine max
  Peptide Sequence Number=SeqID_153681
atggctatgcctatgccgcttttttgggggcttcattcaaatagcattttcgaaacttttttggataagaaatctaatgcagacgtgaaaaggacgatggtggagaggagtgacagcaacgttaacggcgtcaggctttatgagaataggtag

SEQ ID NO: 36904 - DNA, 180 bp, Glycine max
  Peptide Sequence Number=SeqID_153682
atgttcatgaccctaggctatgcatttcggctattttgggtaaaaaaaacacgtttccgtgaagaaaaatcgagtcgaagtgcttccgtaatgcttccgagatgtttccgtgagcaaatctgtgaagattttccaccgttcttcaccattcttcgttcttcaaccgcaaaatctaactaa

SEQ ID NO: 36905 - DNA, 294 bp, Glycine max
  Peptide Sequence Number=SeqID_153683
atggggagtcaccagcgatgtccaatgcctgcaagctatgtcctcctgagaatctgtatactcatcttccctgagctggacgcacctctctctatggaacgaccatcctttgatggtctcgaagcgctactggtgctcggtgctccggaaacggtggctatcaaactcgggggtggcactggacccttccactgcggcgtctctcctagacctcttcgtggaaagctttttcagagccatttcctgcgaagacaaacgtttggaaagtcaatttacaaggaaatgccattttaa

SEQ ID NO: 36906 - DNA, 498 bp, Glycine max
  Peptide Sequence Number=SeqID_153684
atggctaaaagtgaagagatgaaatcccttcaaaagaacaagatttgggatttagttgagctacctaaagaggtcatccctctatgcgcagaagcaatctccaaggtagtggtggagaatagttcccacatctatcctctaatctttgtggacggcatgctcaaagcatctcaaaatttgttggtaattcaaaagttgaagtcattactcagtagtgaatttgagacgaatgatactgaaaagattataggcatggagatcaagagggatcgctccagaagaaaatctttctgtgttagaagaaatacagttagaaagtcatacctagcacaaaaaattagtggtgggagtaggtatatgggtaatcctgggaaggaacattggcaagctacgaaacgcatattcgtgtaccttaagggtacaacgaatattggactcatctaccatggagacacgtattatgctctcgctggtttctcatattatgactatgcttga

SEQ ID NO: 36907 - DNA, 660 bp, Glycine max
  Peptide Sequence Number=SeqID_153685
atgagcgctgttgatcggcggttgcacgggctggatctggcgcgctatctggcgctggccggcatggtgctggtcaacttccgcctggcgatggccgtgcccgcagagggtgagggttggctggcaggggtggtggccggccagtgtgcagacctggcggcgcgcactgttcctgatggtgctgggcctactcaacctgaccctgttcccagccgatatcctgcactactacgcggtgtatttcgcgttggccgtgctgtggctgcgtgcctcgccgcaggtgttgctggccagcatcgtgggcctggcggcctgttcgttctgggcgttgctgcactgggactacagccagggatggaactggcaggcgctggaatacaccggtctgtggcaatggccgggcgcggcccgcaacctgctgttcaacggcttccatccgctgctgccgtggctgtgcttcttcctgctggggatgctgctggcacgcctgcaactgtcgcagccgcgggtccagcgcgcgctgctggtgctgggcctgctgctgatcgcggctggacatggcgtgcagcagcttgcgcagggaacgccctggcaggcgtggctgggaacgcagccgatgccgccgggaccggcctacgtactcacgggtgcgggcgcggc

SEQ ID NO: 36908 - DNA, 324 bp, Glycine max
  Peptide Sequence Number=SeqID_153686
catttcgtttctaaacgaccatatagaggaaacactgggtccaacaaagataggagaaaatcactcaaagtgtatcaatctcacacagtgtgtggcgagaaagtcgctagcgcacaagattttgtcggcaatcaaagggagaggaccactttaggtcgtgggcaaggattgacattctcaccctgggtcaaggtttatgataagttgggattttggctcaaggcttgtagaacgggtggtcatgatatatgtcagggtttggccagcggttcggggataaaggggatgtcctacattatttccatgatacacatgcaacaatga

SEQ ID NO: 36909 - DNA, 174 bp, Glycine max
  Peptide Sequence Number=SeqID_153687
atgatatttttaccaagtttcatggaaaagtttcctggggccattgtggatatagcacttgttggaccaagaattatttgttgggcattgccacgtagcagcaatttcacgatcttctcattttgtcctttcataaaagggttgtggatcgattcatatgagctcaatccgtaa

SEQ ID NO: 36910 - DNA, 1260 bp, Glycine max
  Peptide Sequence Number=SeqID_153688
atgacttatgtacactcactcatgttgctcctgcttggagtagtggttctcactactactccagtgttagctaatttctttccacccatttatgagcctcccccaattgagaaaccacccatatttgaacctccacccacctatgagcctcccccaactgaaaagccaccaccattatataagcctccattctaccctccaccactgtaccagcctccatatgagaagccaccaccagagtatcaacctcctcatgaaaaaccaccaccagagtatcagccacctcatgagaagccaccaccagaataccaaccacctcatcaaaaaccgccacatgagaagccaccgccagagtacaaaccgcctcatgagaagcctccaccagagtaccaaccacctcatgaaaagccaccagtgtatgaacctcctcacgagaagccaccaccagtgtatgaacctcctcacgagaagccaccaccagtatatgagccacctcatgagaagccaccaccagtgtacgaaccacctcatgagaagccaccaccagtgtatgaaccacctcatgagaagccaccaccagtgtatgaaccacctcatgagaagccaccacatgagaaaccaccaccagtgtatgaacctccacatgagaaaccacctcatggaaagccaccaccagtatatgaacctccacatgagaaaccaccacatggaaagccgccaccagtatatgaacctccacatgagaaaccaccaccagtgtatgaacctccacatgagaaaccacctcatggaaagccaccaccagtatatgaacctccacatgagaaaccaccacatggaaagccgccaccagtatatgaacccccttatgagaagccaccaccagtgtaccagcctcctcatgagaagccacccatctacaagcctccttatgaaaaaccacccattcacaaacccccattcgagaaaccacccatttacaaacctccattcgagaaaccacccatttacaaacctccattcgagaaaccacccatttacaaacctccattcgagaaaccacccatttacaaacctcctttcgagaaaccaccagtatacgagccacctcctttggtgaagccaccaccatttgaaaagccacccttttacaaacctcctttcgagaaaccaccgctttacgagccacctcctttggtgaagccaccgatctacaatcccccaccttatggccactatccaccatccaagaaaaactaa

SEQ ID NO: 36911 - DNA, 505 bp, Glycine max
  Peptide Sequence Number=SeqID_153689
aggactacacgtcctcgccttcagagggccgcactccctcgccttcagagagctacacgccttcaccttcagagagtcatgtaccttcaccttcagaggactacacgtcctcgcctctagaggactacatgtcctcgccttcagaggactacacgtcctcgccttcagagggctacacgccctcaccctcagagggctacacgtcctcaccttcagaggactacgtgtcctcacctttataggactacacgtcctcgccttcagaagactacacatcctcaccttcaaaggactacacgtcctcgccttcaaagggtcacacgccctcgccttcagaggacttcacgtcctcgccttcagaggactatacgtcctccccttgagaggactacacgccctcgcctttagagggcgacacgtcctcgccttcggagggctgcacactccctcacctttagagggctacgcatccttgcttttagagggctcctcatctgcaccttaa

SEQ ID NO: 36912 - DNA, 339 bp, Glycine max
  Peptide Sequence Number=SeqID_153690
gaactttctttgttctggaagcgtgttagcagctcaatagtgaatgactttttttcttgggagaccccattgttccttcttccgaggacagggatggaaattctcatcctgggtcaaggtttatggtggtttgaggtcttgggtcaaaaggcttgcagaacgaccgaacatgatgtatgtcagggtgttggtttggccagcggttcagggataaaggggatgtcccatatttatttccatgacacacatacaacaatgatgatttggaaattttatgcaaaactggtcatgcatgcacccatgtggacactcaagcgtcaagtttttatggtcatgtga

SEQ ID NO: 36913 - DNA, 1632 bp, Glycine max
  Peptide Sequence Number=SeqID_153691
atggcagtttcaggagcaacctacatgtttggtttgtactcaaacgaggtcaaagcctctttagggtatgaccaatcaaccctcaacttgataagcttcttcaaggaccttggtgcaaaccttggaattttttcagggttaatcaatgagataagccctccatgggtgatcctagccatgggagccaccatgaacttcattggctacttcatgatatggctctcggtcacctcacgcattgccaaaccccaagtgtggcaaatgtgtctctatttttacattggtgcaaattctcagtcttttgccaacactggtgctttggttaactgtgtcaagagcttccctagaagccgtggaagtgtcattggtcttcttaagggttatgtgggtctaagtggtgctattttcactcagttttaccatgctttctatggtgatgactctaaggctcttatttttctcattgggtggcttcctgctgctatttccttcatttttcttccaacggttagggtgttgagtatcaccccacaaccaaaagagattaaagggtttctaatggtgttgattgttgtacaaaacaagttgagtttcacaagggtggagttcatagtggatggcatggtggttcttttagtacttcttctcccacttggtatcgtgtttaaagaagaattcaaaatttggaagaaccaaaaccaaaacttcactgatgctgctgcttcagttgttgaattgtcacagccagaagaagcaccatctcattcagaaaggaaaaacaacaactcatgcttgaagaacgttttcaagcctccaaaaaggggtgaggactacaccatcttccaagctctcttcagcattgacatgttaattctgttcattgcaacagtttttggtgttggtggaacactaacagcacttgacaatttaggacagattgggaactcattagggtaccccaaaaagagcctcacaacttttgtgtcccttgtgagcatatggaactatttgggaagagcatcttcgggctttgtttctgagtacttattgaccaaatacaagttccctcgtcccttgttgctcactctagtcatgcttctatcttgtgttggccacattctaatagcctttggtattccaaactctctttacttctcctcagtgattatcgggttttgctttggggccatatggccgttaatgtttgccatcatatctgaaatatttggcctcaaatactactccactttgtacaattttggggcagtggcaagccctgttggctcttacattctcaatgtgagagtgaccggttatttgtatgataaagaggctttgaagcaattgggggtgaagggactcataaggcaaaaggggaaggacttaacttgtgtgggagtgcaatgctataggatggcttttctcataatcactgcttcaactttggttggttgtgttgtttcttttattcttgtgttgaggactagaaatttttacaaaggtgacatttatgagaagttcagagttgttgaactagacacaggagaaagtcttccaacttttggcagcactggcaccaccactaccaccacaaaccgcactgaagaaccagataaaatcaataggaaataa

SEQ ID NO: 36914 - DNA, 3297 bp, Glycine max
  Peptide Sequence Number=SeqID_153692
atggactcccgctaccaggaatactcgcaacatcgtgctgctgatttggcccgcatggatcgtcttgagtcccacctcagttccgtgcaaatgggttcaccatctgctgggtcccactcacacaacgccgttccatcttctcctccacccttccaggtttgcaacattaagcttgatttccctagatttgatgggtctgatgttttgcactgggtctttaaagctgaacagttttttgattattactccacccctgatgcacatcgcctcaccattgctgcggtccatctcgagaaagatgtgtttggtccctcaccttatgattctcctcgagccaccttgtttaaactcacgcatactacttctgttaatgattattatttggagtttactgctttggctaatcggacccagggcattagtccagatgctttgttagattttttcatcagtggactaaaaccgaatattcgacgtgatgtgatttcacagagtcccttttctatgtctaaagctgtttcattagctcgattatttgaagaaaaatatgcccctaaacctaaaccttattttgcctccaccgggctctgttacacttgtgatgacaagttctccattaatcacaagtgtcccaatcaacaatacttactactcttaggggatgatgaggatacattcaccccggaactggaacctccagatgctccaacgaatgacaattctcttactgcccatgaacatcacctatcctttaatgctctcaaaggttcacatgggttgggtacattaaggtttcaaggctcgattcagggaatcaaactgcaaatcctcttggatagtggtagttccgacaatttcttgcaaccccggattgcccattgtctcaaattacctgtcttacctgctgagaatttttcagtgttagtgggcaacagtaattgtctgacagctgaagggtatatcccaaatttacaggtgcatgtgcaaggtcatgtcttgcagctcccagtttatttactgcctgtgactggtgcagacttagttttgggcgctccttggttggctaccttgggtccacatattgctaattatagtgctctgacactgaaattttatttgggtgattcatttgtcctcttcttgagggcaccaacccagtcaagtactagtccgttttcttcacctgtcttactcgtcaagaaaaaggatggtacttggcgtttttgtacagattatcgagctttaaatgccatcacgattaaggatagttttcctattcccactgtggatgaactccttgatgagttaggtggtgcgactcatttttccaagttagatttgcgttccgggtatcatcaaattctggttaagcccgaggatcgatacaaaatggctttcaaaactcaccaaggcctctgtgaatggctggtcatgccatttggccttactaatgcccctgcctcatttcaaagtttgatgaatcatgttttccatcaacagctctgcaaatctgttttggtttttttcgatgatattttggtttatagcccctcatggtctgctcacttattgcaccttgaagaggtactccagttacttcgacaacattgtttatttgccaaattatccaaatgcagtttcgggcttactaaagtggactatctaggccatactgtttcaggaaatggagtggaaatggatcagtctaaggtccaggcggttttagattggcccagtcctacatctatcaaacaattgagaggtttccttggtctcacggggtactatcgtcggtttatacaggggtatgcctctattgctctaccattgacatctttgctcaagaaagatagttttaagtgggatgcacaggctgatttggctttccagcagttgaaacaagccatcacccatgctcctgtgttggctctccctgacttcactcaaccttttacccttgagacggatgcatccggttcaggcataggagctatactcagccaaggttctcatcctattgcatatttttctaagcggcttactgtcaaaatgctagttgtgccccagcaacccgaattaattacttccattctcaaagagtatcattcatctcccattggtggccattccggcattagccgaaccaaggctagaattgctcgccaattttattggccatctatgaaaaaagacatccgagtgcttctctctgaatgccttacctgtcaacaggccaaatcttctaacacagttcctgctggacttttacagcctttgcctattccatttcaagtttgggaggatgttgctatggatttcatcactggactccctccctcaaatggttacacggtgattttggttgtggttgatcgcttatctaaatatggtcactttgcccctcttaaggctgatttttctagtctcaaggtcgcagaaaccttcatgcattcagttgtcaaattacatggattccccaaaagtattgtctctgatagagacaagataatccccgatcctggtcttgattgctctcgtgggcagaattttggtataatacctcttttcatagcagcatcggaaatgttgatggagagggatgttgttatcgtacaattgaaggccaatctgaccaaagctcaaattttcatgaagaaatttgctgatagtaagagaagagcaatggatttcaacattggcgatatggttttagttaaacttcagccttatagacaacactcagtcgctttgcgcagcaaccaaaaactgggcttacggtattttggtccttttcctatcattgaaaaaataggagaggttgtgtacaaactaatgttgcctccttcagctaaaattcatcccgtatttcatatttcacttttgaagccttgcaagggagtccatgacactcagtatatgcctttgcctctactcaccaatgaaaacggtcctttgctgattcccaagtcaattctgcaatttcgaattttgcttcgaaataatcaacatgttccacaagttttagtccattgggaaggtcttcctggttcagaggctacttggaaagactgggtgcctttgcaccatgcgtacccttctctcaaccttgaggacaaggttgttttcaatgggggaagtaatgttatgacagagaatgccacatgtgaaatgacacctggcctaacagattcagttaaaggaaggggacaagtggctattgatccagacaatcaggtagtgagaagaggaaatagagagagaaaacataacagaaaatatgttgaagactatgtgtga

SEQ ID NO: 36915 - DNA, 834 bp, Glycine max
  Peptide Sequence Number=SeqID_153693
atgaagcagtggtgcaaggctttgaagaaagagcaatggcgagaggcttcgaagaatgagtacaacaacaacagtgatagagatattagtgatggtcacaatgactgtcatagtgatggcggaggtagtggtattggtggtgatagtgacaaaggtggtattagtggcaacgatggtagtggtggtgacgatggtggtgacagtgacaatggtggcaacaagtggtggcggtgtagtggtggtgaattacacagtagaagacttggaagatggttgaagaactggagcagctcgctcagcgcgtcaacaactgctcagctcgaggagccaacttggaggtcaggcttagcgcacatctacggcttagcctgcatgcgcgctaagcctgcatctgacggcttagcgcgcatctgcgacttagtgcacaatcacttatgccagctggactgtggcttagcgagcatgtgccggcttagcgcacgtaatggaggtagtattgttagtagtggtgatagtggtgacaatgacaatggtgatagtagcaataccgatggcgatgtcaatgttatggtggcagatgacactaatgctggtcgtggtgatgtcgatggtggtagtggtgatgatgattatggtggtgacaacgatgatgatgatggtgatagtgtggtggtggcaatgacaaaggtgatagaggtggtggtgatggaggtagcagtggtgtggtgtgacaatgacaaaagttgtatcggtggtagtggcgatgatagtgacaatggtgataatagtgctattgaaggtagcggtggtgacaacaaaaaatattattattag

SEQ ID NO: 36916 - DNA, 3878 bp, Glycine max
  Peptide Sequence Number=SeqID_153694
catttgaagcagttgcatttggctcatggcaagctgtggagttcataaaaattgaggcaggaactatgtccatgcattttgcagataatcatcatgtggttatggagaaaggacccttgtcagatattcgaataaggtcaaggaaagctactttacctgattgctcgcgttttcttcgtcctggaattgacgtatgtgtactatctgcccctcaacaatctgatgatgcagatgcaggaattaatctcgaccctgtttggactgatgccaaaataagctctgtacaaagaaaacctcatgactcagagtgctcgtgtcagttttatgtcaacttctatgttcatcaaggttcactcggtgcagagctaagaactcttaataaggagatcaaagtagttggaatcaatcaaatatccatcctccaaaaacttgaaagtactccttgtgaaaatcagcactaccggtgggcatcatccgaggactgttccattatatcacacactaaattgcttctgggaaaagtgttatgtgatctttcatggttagttgttaccacagctttaaagaagaaggtttcattctgcgtaagatctctagaagacaagctggtgtatcaagttttggaaagggatactactgttagcacttcattgaacaatgagtctcacattgatgttgtgaatttcaaaacagaaaaaggcacgttattttccattgtttctcaagtagctacacttaaaactaagagggttgaacctgaacaggaatcccatgaagataaagaatcaccatcttacaatgttgagggcttacggcgttccaagcgtcggaatgtacagcctgagcgttaccttggctgtgaaaaagtttcccagattgatgttggttctttcagaaacttaccaccagttaagataaacacttggaaagatgatgatgttgatcatgaaatgaatataccattagctggcctgtttagtttgcagaagaagtttttagaaggggatactgacaatcatcaaaaggtcaagaaggcgagctcgtgccgggagcttgtggtgtaccaaaggaagaagactaaatcccagaaagtaaagtcaggaggtgatgatcagaatgaacatcaaaatcatcttgctattattgctcttcctgctcaacatgatccggtagaagttatacattgtgatgatctaaatgacaaggttactagaagttatggtcatgaatcctctgaagtttcttccaagtatcgtcatctaatcggtaccacttcaaagaagaacgatattaaattgttaacttttgagtctcataatcatgctgcaaagtcagatgatgcagacaagattgatgatttgtcatcgagatatcattatagttatggcacccctaagtcacagaggatgggtttaagtgatctggatgatatggtggatcttggaaataaatgggaagggattagttccagtaaaggatttcaagggaaaaaacagcgtacgacatatttaagaagtagagatcatggagaacaaaaaagatacaattataaagacagatccttaaatgcagctgcctacaaggatttgataaattcgtacttgaagaatatgaatacaagaccaaccaatgaagaatcagctattgctgaccaatggaagcaaagcgaaacaccaagcaacattgggcaaaagacggaaactcagatgcttgatgaagaggatgcagaagaagaatctgaaatggatatgctgtggagagaactggaagtgtcattggcatcatgttatctagaagaagagacagaggattcacatgctgctgttttcaccgagactctggaaaatccgaacccaggttgtcctcatgatttcagaatgaatgaagaaattggaatttactgctatagatgtggctttgtgagcactgagatcaaatatattacaccaccctttattcaacattcagtgcgacaccaagaggagaagcagagccctgaagaagattcgaagaccaagcctgatgaggacgatgacatagatcttttgccagctctagactctcctgagaaacttgtatctcaagaaaatgaaaacgtttgggcgttaattcccgaacttaaagcaaagttgcatgcccaccagaagaaagcatttgagtttctttggcaaaacattgcagggtccatggacccggaattgatggaaactgcatccaaaagaagaggtggctgtgtgatatcccatactcctggagcaggaaaaacttttctcattattgcttttcttgttagctacttgaagttattcccagggaagaggccactagtccttgctccaaagacaacactctatacttggtacaaggaatttatcaagtgggatattcctataccagtttatctgattcatggtcgtagaacctaccgtgtattcaagcagaaatcgtcgattgttattcctggagttcctaagcccactgatgatgtcaagcatgttttggattgccttgagaagatacaaaaatggcattcgcacccgagtgttcttatcatgggttatacttcctttttaacattgatgcgagaggattcgaagtttgcacacaggaaatatatggctaaggtattgagggaaagccccgggatcatggtgctggatgaagggcacaatcctagaagcaccaaatctaggttgagaaaagttttaatgaaagtgcagacagaactgagaatactgctttctggtacattgtttcagaacaatttctgcgagtacttcaacactttgtgcttggcaaggccaaagtttattcatgaagtactgaaagcattggactccaaatacaagaggaaagggaaagttgcaaaaaaagcgagtcatttattagagtcgcgggctagaaagttcttcttagaccaaattgccaagaaaattgactcgaataatggtagggagaggcggcagggtctaaagatgttgagaaatgtgacaaatggtttcatagatgtgtatgaaggtaggagttctgatggtctacctggtttgcaaatttatacattactgatgaattcaactgatacacagcatgagattttgcatgaactgcacaagaaaatggccagagtcaatggataccctctggagttagagcttttgataactctaggttcaatacatccttggttggtgaaatcagcagtatgtgctgagaaatttttcactcctgcgcaattgatggagctagaaaaatgcaagtttgatctgagaatagggtccaaagtaaaatttgttttgagccttatctaccgggttgtcaagaaggagaaggttctcatattttgccacaacattgcacctgtgaagttatttgtggaatattttgagaagtactttggatggacaaaaggtagggaagtgttggtgctatctggggaactagagctgtttgaaagggggagagtaatggacaagtttgaggagcctggtggagtagcaaagatactacttgcttcaatcactgcttgtgctgaaggcattagtttaacagctgcttcaagagtgatcatgttggactcagagtggaacccttcaaaaacaaagcaagccattgcccgcgcctttcgccctggtcagcagaaagttgtttatgtttatcagctgttggtgacaggttcattggaggaagataagtacaaaagaaccacttggaaagagtgggtttcaagcatgatcttcagtgaggcctttgtggaggacccttctcagtggcaagctgagaagattgaagattatatactcagggaaatggttgcggaggaccggtctaaatcgttccatatgatcatgaagaatgaaaaaacttctaccaacaaataa

SEQ ID NO: 36917 - DNA, 201 bp, Glycine max
  Peptide Sequence Number=SeqID_153695
atggctaaaaaggagaaacatgaaaccttaaagaaaattaatcaaatctccaaagtccttactagcatgtacagacctcacatgatttacgtggcatgggtgacttggcctttcatctgcacagaacaaaaagaggctaaggtagggattaaaagatgtcattctaaaaataaagggcactatttagggagaaattattaa

SEQ ID NO: 36918 - DNA, 858 bp, Glycine max
  Peptide Sequence Number=SeqID_153696
atgtgtcataccctaatttcgtccggggacctttgcttgatgacatgcgacctttctttggtccttgtgagaaaatctaagccgaggcgcttccgaaacattttcgtaacgttttccgtgaggaatttcgcaaaggtttcaaccgtccttcgacgttcttcattcgttcttcatcgttcttcgatcttcaatgggctgccgtcccttgggacggacgtgtggggtgctaataccttccccgtgcgtaaatacaactcccgaacctttcacttaaaagttcgtagatcgcgccttttctggtttttccgacgttttcctcaaataaacgttggtggcgactccgggcgtattcctttcgtggaacacgcatcccgcgagtctcgcgtcgccctcccgccgaagggtaggttgcgacacaatttaattcacatcggttttaaaacaccaaattcttttccccccacgcactcagtttcgcaaaccctttctccctcattgtcgtctccctcctccacgacactgcattttgagcattccaggtcgtttcgtgtcaccatcaacgccagtgaacctgtaactggtccgcgagttggggttcatcactactaccgtgagattgaggtacatggttgcttaatctttcttgattttgagcattccgtatacttccctcatgtcttgcgagcattcattgaggtacgtgactgcttcttttcaaattgtgagcatcttggacttctgaaaactcttctaagcatcatcttcatcacttacttgaagatacattccgttgaggtacgtggttgggaatgttgttcagctaggtttctttgtgagtactttagtccacctaaatag

SEQ ID NO: 36919 - DNA, 315 bp, Glycine max
  Peptide Sequence Number=SeqID_153697
atgacttttgtgtcatcatcgcaacaaacttctaccattgcgctcacatccttcagcatacaacgggtgacaggttcacctccaccaatgacagagatgcgcaccttaccactctatcaactctcttcatttgccattgtcggagggaaggtcaataggaaccctaggttttcgcaccaccgtggcctccgcaaaggaaccctaggttgtcgcacccccctaagctccgcgtcgcgtgtgcctgactttctcaccaccgtgacctcgacctcgtgccctttagtggtcgcgccctgcaagtgttcgccaaggtaa

SEQ ID NO: 36920 - DNA, 1665 bp, Glycine max
  Peptide Sequence Number=SeqID_153698
atggcaacaaccactagattattgttgcgttcctctaagccaattcaacttgctccttctcctccttcttcttcttctaattcgttgtacatgaaatgtgtacggtaccaaagtatggctagtttgaatgaaaatcatcataacataggttctgtcaagggagaaagaaaaccagtgggggctgtgaaggcaactatcgctaccaccaaccacataaccacgtcaaaaccagtgattcaacaaggtttgtcagatttagctactttgatagcaagtattcgcaatgctgttttggtttttttgaggacttttgtcaaaaggaagcctcgcaatttaagaccacagatgctcattgaaaaggcaataatcgattgcagattttttacgctgttcgcagttgcaggatctttaattggttcggtgttgtgttttgttgagggttgccttctagttatcgaatcatacgcgcattatttccatatgttatctcaaaggttggatcaaggacatcttgtgcatctactcatcgaagccatagactcgtttctgatgggtactgccttgctcatttttggggtcggtatttacgttatgtttgtggggtcaagcactactagtaaagaaacacaaccacagctttgtggatcaaatttgctcggttccggaagtaaatcaggtgatggtgaacatggtggtgctaattgcggtgtaagctcttcatcttctgttaccaagatgagcacttgtgacctcgagagaatttctcgttgcaatggaaacacagtcccttttttcggcggactgcgagctcttccggtgcgattgagtggttacggttgtcgcggtggttgttggagggtgatatggtggtggtcggcaagcatccatgagcttttcttcatcagctcaaaacaaacgtcgtcgacaaacctacgatacgatttgctaaagactcaaattcagacaaataggcgcttatcgatgaatgttgctgaagcttacacaacaaacccgtgggatcttcatatgtcgatgacgcaaaacgggaatgcaacgcatggaggaacgctgaccatgaagaaagctacgcattacggtgcatccattggaaccatgcaagggctggtccttccatgtagaatgatgctatcgtcaaccgttcctaatccggcgtggagtgacaattcactgaactggacgctggcggcgtctgtcctgccaaagaagatggtggcgtttatggtggttgatggtttgcttctagttgcgtcatacgctgaagaagatcgtcaatttttgtattcatggcaagttgagacgctcgcctccagaaatgcagagaagaagaagatgaaagtagcgtatattctcattgctttgaacaccttattacaagctatttataaggcaaagttgcatgctttccttataggctgtgcacgtagtcttccaagtatagcgtcaccccctcgatgggtagggatgcaatcaattgcacaggcaaagtccaagattgggcatgcagtgatgatgattcttcaggtgggactgttagacaagttcaaagacattcccttagtcacaggccttgatcttgcttgctttgctgctgctgtactcacatcctcagcatgcatttttgtcctctctaaactccatcactag

SEQ ID NO: 36921 - DNA, 855 bp, Glycine max
  Peptide Sequence Number=SeqID_153699
atggatttcacagcggagaagaaggaatcagagagcaacaccgaaaatgctcatccaacaacgttagattcttcttctcaattggcatcggcacttgattccaacaacaaagaaattgaagaacgacaagctcgtgaactcaaagccgttatgtttgtttcactctatcttttatactgctttgaggctgtgtggagtatggatggcctctcagacaatatgacaatgccaattaatttaaaagcaaaagttgttgttgcagctcatgataaagatataaattctgtagttgttgctccaaatgatagtttagtatgtagtggttctcaggctatatctgatggctcctgtttgaagacatttgaaggacacacttcaagtgtgttaagagcattgtttgttacttgtggaacacaaattgtttcttgtggtatgaggctatctgtagctgattttgttctttataacattttggtcgtggaaaaagcaagaattcgaagaataattgaagccgaaggaattccatacacttacctatgttgtcatgcctttattgattacttcttatgtaacctggcacagattgacatcactgttcctccgagggacaaggtattcattctaggagatggaaatgtgaaaggagcgtttgtgactgaggctgatgtgggaactttgaccatcgaagcagcgaatgaacctaatgccttgaacaaaaccgtgcgcataagactccctaagaattatttgaccataaatgagatcatctctttgtgggagaacaaaattgggaagactcttgaaaaaacttatgtttcagaggaaaaggttcttaaagacattaagggtcggtaa

SEQ ID NO: 36922 - DNA, 186 bp, Glycine max
  Peptide Sequence Number=SeqID_153700
atggtaaagcaaggtttagggggtagagtacatcttattttgtctggagtcgcacctttatctgcacatgtggaaggttacttacaggtggttacttgtgctcttgtcctacaaggatatgaagatattgtagacatctttatggtccttgtactagattatggccttgatgtcttgtcactctaa

SEQ ID NO: 36923 - DNA, 372 bp, Glycine max
  Peptide Sequence Number=SeqID_153701
atgacatactttgatggtataaatgatggagggagtctgcttggtgataatgcaggtggacacattgatcagaacacatccttaaagatcaaaaccaaaaagaaaccctcaaggagaaagcatggaaaagcatacaaatcaattagtcttgatgttttgcaacattacttcacaggaagccttaaggatgctgcaaagagccatggtggagcacttggtttgaattctctaagtactatttcacttgccattgctgctggttccttttctgagttgtccacttcaaacaagttcaaccgccaaacatcattgaccattaggccatcggaacctaagatcaatgaaaaggattttgatgcgtctagagcataa

SEQ ID NO: 36924 - DNA, 225 bp, Glycine max
  Peptide Sequence Number=SeqID_153702
atggctgcaaaacatcaaagaattcatcatgttcatgatgtgaaggcaccacacggaccattggtgcctcaaaacattgcaaaatcttatgataagggtattcctcatctcacttttcttgtgatgcattcaaagccacctaagagaagaagaagctattgctacaggcatatgactgagacaagtatgcgagcggggaatgccaccattgtttatctgatttga

SEQ ID NO: 36925 - DNA, 2484 bp, Glycine max
  Peptide Sequence Number=SeqID_153703
atggccattcttcttaccatgcttgtaatttttattctactattattgtcctgtgatagtaccactctcaccatcacccagtttcagccactttctgatggaaccaccttggtttccaaagatggaacctttgaggttggtttcttcagcccaggtagttccacaaaccgctacctaggaatctggttcaaaaacatccctataaaaaccgtcgtttgggtagccaaccacgacaacccaatcaacaccaccaccactcccaccaagttaaccataaccaaagaaggaaaccttgcacttctcaacaagaacaacagcgttatttggtcagcaaacacaacaacagcaaaagcgaccaacgttgtagcacagctcttggacacaggaaacttggtcctacaagatgaaaaagaaataaattctcagaactacttgtggcagagctttgaccatccctcagatacaattttaccaggaatgaagataggttggaaagtaacaacaaagggtcttcatcttaatcgctacatcactgcatggaacaattgggaagacccatcttctgctaacttcacttatagcgtgtcaagaagcaacattccggaattacaacaatggaatggctcaacgatgttatatagaagtggcccttggaatggtattcgattcagcgctacaccctcgttgaaacaccatccattgttcacttacaatttcgtgtacgacacggaagagtgttatttccaattctacccccggaatagctcgttgatttccagaattgttctcaaccgaaccctttatgctcttcagcgcttcatttgggctgaggaaagtaacaaatgggagttgagtttaactgttccgagggatggttgtgatgggtataaccattgtggctcatttgggtactgtggcagtgccactgtgtcttctatgtgtgagtgtttgcgtgggtttgagccaaaatcgccgcaaaactggggtgcgaagaattggagtgaagggtgtgtgcctaatagtaaaagttggaggtgtaaggagaaaaacaaagacggtttcgtcaagtttagtaacatgaaggttccagacactaacacgtcttggattaatagaagcatgacacttgaggaatgcaaggaaaagtgttgggaaaattgttcgtgtacggcttatggtagctccgacatccttggaaagggaaatggttgtatcctttggtttggtgatctattggacttgagactgcttcccgatgcagggcaagatctgtatgttagagtgcatatcaccgaaattatggcaaatcaaaatgaaaaaggtggttcaaggaaagtggccattgtggtcccatgtattgtttcatctgttattgcgatgattgtaattttctcatttgtttactggagaactaaaacaaaattcggaggcaaagggatcttcaagacaaaagtgaaaataaatgagagcaaagaagaagaaatagaactacctttgtttgactttgatacaatagcgtgtgccactaatcacttttcaagtgacaacaaggttagccaaggtggttttggtcctgtatataaaggcacactactagatggacaggaaattgctgtcaaaaggctctcacacacatcagcacaaggtttaacagaatttaagaatgaagttaatttttgttctaaacttcaacatcgaaatcttgttaaagttcttggttgttgcatcgatgagcaagagaaattactcatctatgaatacatgtccaacaaaagtctagacttctttctttttgattcttctcaaagcaaactcttagattggcccatgcgatttagcattataaatggaattgctagaggacttctttatcttcaccaagattctagattaaggatcatacacagagatttgaaagcaagtaatattttgcttgataatgacatgaatccaaaaatttcggattttggattagcccgaatgtgtagaggtgaacaaattgaagggaacacaagaagaattgttggcacatatggttatatggcaccagaatatgcaattgatggagtattctccatcaaatccgatgtttatagcttcggtgttttactactggaggttttaagcggaaagaaaaacaaaggattttcctactcaaacaacagttataatcttattgcacatgcatggaggttgtggaaagagtgcatcccaatggaatttattgatacttgtttgggggactcatacactcaatctgaagccttacagtgcattcatattggtctttcatgcgtgcaacatcaacctgatgatagaccaaatatgagatctataattgcaatgttaacaagtgaaagtgtgttgccacaaccaaaagaacctattttcttaacagaaaatgtttcagctgaggatgatcttggacaaatggtgaactactcaaccaatgaagtaactatgtccgggatggaaccaagataa

SEQ ID NO: 36926 - DNA, 556 bp, Glycine max
  Peptide Sequence Number=SeqID_153704
atgttgaatccaactcagtttcaggccaaagaagagaaggttcaagtagctgataactcgctcaacgagtgtcatccgctaagtgagacatacagctcgcttagcgggttgggaaaccctagaagaggattagtcagagatgtgcttgcccagcgtgcagctagaccgcccagcgaggtcgagctgaaaggaccaagagcctttaaaacattgaagttggcggaaataaaagagagagagttggaaagagcgcataagaggaagctgagaagacataaggaagacaggttgatgatggtggatgtggttggaaccagatgcgtggcaatggccacttgcaagcactccaacaccaaagacatcaactaccccatgcctgatccttatcatggacatgagacatacattgtcatggagcagtccctgaagcatgaagtaaaagagctagaatatatgatgccgagtgggaatgtgtggcgctcctatttggtcggattaagtattgggcctttattgggcaaggcaatcttatggaacaattttaggccgaatgaag

SEQ ID NO: 36927 - DNA, 213 bp, Glycine max
  Peptide Sequence Number=SeqID_153705
atgagttcttctcaaccctaccaggttttcttgttttgctatttctccctcacgcccagaccagtacctccctccgtcgacctcatcgtcatgtctgttgcgttgtcatatgtcaacctgagacgtcactacctagtaaactgtgccaccattgccgcccagtttgggggaggtaatccaacaaggttcttgaggaagcttacaaaagattaa

SEQ ID NO: 36928 - DNA, 218 bp, Glycine max
  Peptide Sequence Number=SeqID_153706
atgaccgtactccttcacctcctcctcagcgagatgattcagcactcatgattgaagttctttccgaattatggggtcttcgttcttatgttggtgaatgtttcgactcactggatactcgttttgccggaatggatattcgcctcacacagcttgaagaagatgtgggttacattcgtcagagtttcgatcttccaccaccatctccaccttcttag

SEQ ID NO: 36929 - DNA, 640 bp, Glycine max
  Peptide Sequence Number=SeqID_153707
atggagcggatgcgccagcaggcccgcgaccagggttatgtggagaccctgttcggccgccgcctgtacctgaacgacattcatgcacgtaaccagggcctgcgtgccggtgccgagcgcgctgcgatcaatgcgccgatgcagggcaccgccgccgacatcatcaagcgcgcgatggtggatgtggaccagtggctgcgcgacagcggggcaccggcacggatgatcctgcaggtgcacgatgaactggtcttcgaaaccgaaagtggtggagcgcatgtcgcaagcggccaaactgcgcgtgccgctggtggtcgataccggcatcggcaacaactgggacgaagcacactaggatctcggaacggggactcctccccaagtgcccgttccccggccccgttgacctccccctggtcagcggggctttttatttgtgccgccggaatcgcagatggggtcgcctttgcccaccgggcaaagggatctgaccccagggcagatcacgccgttcgacgtgctgttgatcgtgctgctgggcaatgcggtgcagaacgcgctgctgggcaccgatacctcgctgggcggtggcctgctgctggccgcaaccctgatcctgctcaactatggggtaggctgg

SEQ ID NO: 36930 - DNA, 204 bp, Glycine max
  Peptide Sequence Number=SeqID_153708
atggatgttgatgaagcaatgagtaaagaaataaatgaagtgaaattcatgggtttaggtgctattgctactatagacatagaagaatcaaattctaatacaaaaggaaaaagacaagaaaaaatgggtgataaagtcaataatgaagatattcaagaagtgttatgtgagatacctttgataccagatcttaatcgacaataa

SEQ ID NO: 36931 - DNA, 234 bp, Glycine max
  Peptide Sequence Number=SeqID_153709
atgccacttcaaggagaagatgagttgagaacaagctcaccacgaaaggaagccatggataagagcttgaaggtaggagaaatgagtggaagaagaaggagaatgagttgtggaaccaaatttggagccaaaatttcactaattatgattagtgaatttcagctatggttcagtccactaatccaagattctctactaagtgtgcttaggtgtcatgaggcatgtaaagcatga

SEQ ID NO: 36932 - DNA, 238 bp, Glycine max
  Peptide Sequence Number=SeqID_153710
aacatacagcttcaaggtagatggagaacaaagagagcaagaaagcatagatggagaagaagacagagagaaggacaagacaacgcgaaggagacaaaacatacctaggtatggtggcgaaggagaagaatcagagacttgtgacgatgctcgagtgcgacaaacacgatgctcagatgcacacagggacggtttcgctagatggagattagaagaagaagagagcccgaaagcttag

SEQ ID NO: 36933 - DNA, 567 bp, Glycine max
  Peptide Sequence Number=SeqID_153711
atgacacaagatagctttgttccccatggtcatgaggatatactcaatactgcaattaggggaccgaagcacctaggtcgtgttcgtgttgtgggaagtggtgtgacaatcaaccaatactttggacaagcacgatgtgcctccaatagttcctctacatcaatcaacccactacagttggctgagctaataggaaaccttaaggaagagtggaagagagaaggaaattgtgctgaaattgctaccaatccatcaggagaaaagcatgttgttaatgtcatgcctactataggattgtatgttcaagatgttgattctactcgcctggtggccttgccaaaaatatatgatggggcatcgaccatacacaacttgccttatgcaaatgatgtggtgaatgtgagtgttggagaagtttatgatggtaatgctcaagtccttttttccatgttagaggttcagtatgtgaggcaggcccttgacacattcattgcatggtcgacatatcttgtgaaacctgtatcacttaaggatgaacctgttcataggtggactcttgttggttga

SEQ ID NO: 36934 - DNA, 278 bp, Glycine max
  Peptide Sequence Number=SeqID_153712
tcgcgggtgaccatgacttgtcgttcccggattttcacaaattgcctaatgatgggtgccaagcacctcacaaggaccaaagaaaggtcgcatgtcatcaagcaaaggcccgccgcctctggatgatacaagggtgcagaatgaccaaatttggtctctgcttgtcatcgggcccgccgcctctggatgacaaaagggtgcggataaccgtaaggtatctccgtgtatcatcgggcccgccgcctctagatgatacaagggtgcagaatgaccgtaag

SEQ ID NO: 36935 - DNA, 300 bp, Glycine max
  Peptide Sequence Number=SeqID_153713
atgtctccttatcgggttgtctttggaaatgcatgtcatcttccagtggaaattgagcacaaagcatactgggcagtgaagacctgcaacttctctatggatcaagctggtgaggaaagaaagttgcaactgagtgagttagatgagatctgcctagaagcctacgagaatgccaagttctacaaagaaaagaccaagaattttagctttggattactgttcaccttcctggcagttttcccttcaccaattaacccacattcgttactgttaatctatgcacgcttcgtgttcgattaa

SEQ ID NO: 36936 - DNA, 3030 bp, Glycine max
  Peptide Sequence Number=SeqID_153714
gtctttgaacttcaccgcttatacagaatacaaagggatttgatggatgaagttaaaatgaaagatttatacagaaaccatatatctgttgagaaatcattttccacaggtcccttggcatctcagttaacatctgaagatggtaaaaaatggcatgttcctggatttccaatagttggaagttctacttgtgctagaccatctatttcaggcgttgagggcattcattctcctttgagttctaataaaggaatcagtaagcaagctggtctgttcccatcgccaaatgggagtagtagctcgaaagatgttgagatactgggtttcagaccctcaaaggtgaggagaaaaatgtttgaccttcacctccctgctgatgagtacattgatactgaagaaaatgaaaagcctggtgacgaaaagattagtggcaccacaaattttctttctgataggagctataaacacgaaaagggaggtgatatggacctttttagtggcaatggtggcaagactggtggccaggaagacatttcaagacctaagcaatctttaagaagcagaaatagtttggcagacttaaatgaacctgttcatgtggaagaaacacatgatgttgcttacgttcctcctcagaaccataattcctatcaaggggcaactgaatgttctgatctatctgccaaacagaagttgagattctttggtctgtccaaggaagatttactgaactcacatcatggaactgacagttgggctcgtaataatggatatttggataatgacaggaatggaaaaatgtggatttcttcaatagagtcagggcaagctaaaagcaatccaaaaaccattcctcaactcctcaaacaagaccaatcacttttatcttcccaaacaatgcaagatgaactcagtaaatctcatgagcctacatctgattatctaactaatggaagcaagactgatttgttgagggaaaagacagctagtggtttagatatcagtgaaagaaatcatgaatcctctgctaataagctttcagagtctgttgcatcatcacataggcatggtctctttgcaattgctccttcctcagatttagctagatcttggtctcactcatcttgggacatggcaagtagtaccctaaaccagaagtttatatctgtacagacacctccatctccatgtctaaatgcatctggttccttgagtaggagttcccagtcacatcagagtaatgggatgttgggagatagttggcctctaaatatcaattcaaagcttaatcccggttttcgatgtgaggcatctgggaaaaatggattttaccctgggactttatctgggtccaaggagctgtcagtgaacatctcttcaattagctatcttaaccatgatagtgattgcaagaaatttcctgaacacttcaataatggtccagcaaactgctacaagagttcaaatttgaattcaaattgctatgacatgaagtctgcaaaaaatattaacttgaatgagatactttcaaatgcttcatccaacaacttagtttcccagtcaggtctgggaatcatggatggagaacagaagcatgaggagcagcttgcagtgttgccttggcttagagccaagacaacatgtaagaatgtggcacaaaatgctggaggtttaaatgttttccaagtttcttcttcatctaacaaagaagaaactggaaaggggtctaatggaaaatttattcacaatgtaactacaggtttgttttcaaatgatattgagctaaagaggagagaagtaagcgagagttctagtaaaaggaaaattcttggtgttcccatatttgacatacctcatatttctgctaaggagttatcttcattcatgtctccatctgtgtcggttcctaatccatctgacgtagaattagtgggaaattatcggaaagaacagatacttgatattaacttgccttgtgatgctgctgttcctgagttggacgtacaagctgtagctacagttattgtttgtgagacaggattatccacaacaaaagccaactctagaaatcagattgatctgaacttgagtatgaatgaggatgaagcatttgtgacaaatattccagcaaccaacttagaaacaaaggcagaaatagatcttgaagcccctgctgtttctgagacagaggaggatgccattcccgaagaaaagaagcttgaaactcctctagtttcgctacttggcccacaagacacagttgaaaagccacaggatgaacttatgaggtatgcagcagaggcaattgttgtcttgtcatcttcttgctgccagcaagttgatgatgtgatcagcagtccatcagaaggcccggtggtggaccctctaagttggtttgtggatatagtttcctcgtgtgtggatgatctacagaagaagactgataattcaagggaaaaaaatatcgaggataatgaagaatcttcctcagatggaatggattactttgaatcaatgacattgaaactgacagagaccaaggaagaagactacatgccccagccccttgttccagaaaacttcaaagtggaagaaattggaacaacctcgttacctactcggacacgaagggggccggctaggcgagggaggcagcgaagggacttccaaagggatatccttccaggccttgcatctttatcgaggcatgaagtaacagaagatctccaaacatttggaggactcatgaaagcaacaggtcatgcatggaattcaggattaaacaggagaagctcttctaggaatgggtgtggtaggggtaggcggcgatcacaggcacaggttaccccaactcctccccctcctcctgtggcaactgttgaaacaagcaccccacttattcagcagcttagtaacattgaagtggtgggattggaggatagaagcctagcaggttggggcaagacaaccagaaggccccgtaggcaaaggttcccggcaggtaatcctccgtcaatccggttaatctga

SEQ ID NO: 36937 - DNA, 2513 bp, Glycine max
  Peptide Sequence Number=SeqID_153715
ttactgttaaactcggaaagctacctctaccttcaccaagtgaaaacccagccgtggcactcgtttctccagccttagattcaagcaactatcattcatggagtaggtccatgatgacagcattaagtgccaagaacaaagtggagttcgtgaatggaaaggcaccagagccattgaagaccgatagaacgtacggggcgtggaattgctgtaataacatggaaaggcaactagcaggtaacaatcctcttccaaacttcaatattgaaactaaagaaggatcttctattaatgttgtcaaaagcacctgtgaattttgtggacgcattggacatagtgagagcatttgctacaaaaagcatggcataccctcgagttatgatggaaaaggcaaagggtttagtgcgagaaatggaaagacatgtgcatactgtggaaagcctggccacacaatagacgtatgctataagaagcacggatatccccccgggttcaagtttaccaacagcaaaacaatggctaacaacatagtggcagtagaaggaaaggccacaaatgaccaagcacagcaccaagaatcccaagaatcggacaccaataccaaggtgaggattggtacagctgaagtgagtcgcgatctctatcaactcatactcgaagtcacgaattcacatactatgtgtgccactatcattcacccacaataccacttcccatcaccaactcaaagccaagaccacaccaacacagatatccgcgtttcaccatctcccttctctagcaccaccgaaaaccttgacactcccattcccctcccgatacctagtctcactactccttcctcatattctcagaacccaacattaagacgttccacgaggacaagacatgcacccacttacttacgcgacttccatcacgcactcacttcatctgctgataccacctcgaccaaggttaagtatcctcttcattttgttctctcctattctcgcttatctcccactcacaaacacttcatcttgtctataagcaccaccactgaacctaactcatatgttgaggcccctaaacatgattgttgggttaaagccatacactctgagttacaggctctccaacagaaccagacttggattctgactcaactcccaccacacaaaaaggctattggttgtcgctgggtatacaaaatcaaacacaatacagatggcatcattgagagatacaaagcgcgtctcgttacgaaaggatacactcagatggaaggtctagattttctcgataccttctcccctgtggctaagctcaccacggtcaggttactccttgctctcgctgctctccgtaactggcatcttcgacaactcgatgtcaataacgcctttcttcatggggacttccacgaagaggtatatatgaagcttcctccaggtttaattgtggacaatcccaatctagtctgccgtcttcagtgttcgttatatggccttaaacaggcgagtcgcaaatggttcacacgactctcgtcattccttctttctcaaggctttcatcaatcctctgctgatcactcacttttcttatacactaacaattctcatgatctcacagttattctcgtatatgttgacgacattatcttgacaggcaacaatcttgatactatcattcacattaccaagcttcttgatcagacttttagcatcaaagaccttgacattctaaaatacttccttggtctcgaagttgctcgttcgaaacatggtatacacttgtgtcaacgcaaatacgcactggacatcctatcagactctggtatgctcggctctcgtcctatatctacccccatagagtattccacgcatttaagtgctacaatgggcaccccattatcagagacttgtgcctcttcctacagacgtctcgtcgaccgccttatataccttacaaacactcgccccgacattgcttatgtcgttcaacaactcagccaatatatggccaatccaacgtccacacattcacaagctgcttttcaggttctacgttacatcaaaggctctcccggttctggtattttctttgcagctcaaggaagtttcactctcaaggcttttagcgactccgactggtccacggtttctcaaagttcgtctaaagcggaatatagagcattggcctccaccacttgtgaacttcagtggctcagctttcttttgcatgatttttgggttactttatctcaacctgcaacgctctattgtgacaaccaatccgccattcaaatagcttcaaacccagtctttcacgagcatactaaacacatcgagatcgactgccatattgtaagagacaaagttcacaaaggcctgttgaagctacttcctatctcatcctcaatgcaactcgccgacatcttcacaaagcctcttcctcctgcttcttttcaaggtctctataccaagttgggaatgatgaacatccattcccaacttgcggagggctcttag

SEQ ID NO: 36938 - DNA, 318 bp, Glycine max
  Peptide Sequence Number=SeqID_153716
atggaaaaatccgacaagatgaatttcaaagagaagaaagaaaagaaaggatatatcacttgggaagataatgtcataaattattcaagtgattcaaagaagaaaatcataagtctgggtatcatgatgaaagactatgaaaatggagaagagcaaagtcgatacattgatagcaatttctccaaacacatggcatgcatcaaattggaagttggaagtggaagttactggaagttggaagttggaaatgaaagttattggaagttgaaagttgaaaatggaggttggaagttggaaggggaagttactaaaagttga

SEQ ID NO: 36939 - DNA, 213 bp, Glycine max
  Peptide Sequence Number=SeqID_153717
atggtcatggacatggctgacacatttggagaaggattttggaaatgggcttctttatacgaggaccctatacagctgcaatgtgacatcttgaaggaaatgggcttgtcttataaggaagaagatagcaaggttaaggggctactgctggatatggagaataaagatgatttgatggcaacagaaaagggaattaaatctcagcaattatga

SEQ ID NO: 36940 - DNA, 252 bp, Glycine max
  Peptide Sequence Number=SeqID_153718
atgcgcggcgtcgacgagacccgacgcgccttcgatgagatccacgaaaacagcgacttcgtttcgtggacctccatgatcggcgcgtacgtgcagagcgcgcgtgaggggctaacgctattcaacagaatgcgtgtagcgtttatcgacagaaacgagttcactgtcggtagcatgaaactagaaaggctattatcatcaccgttaaccccacgagatacactcaaacaggcacatgatgaacttatgtga

SEQ ID NO: 36941 - DNA, 168 bp, Glycine max
  Peptide Sequence Number=SeqID_153719
atgactgaagcacgtcaaaaggggggtgatgggaattttacggaagcattacgggtgtcccggaagccccggaatcccatttttcaacaaaatggggggtgtggtggccaccaagctcacccaggcgagctcagctcacccaggcgagctaggttgcttcaaccttaa

SEQ ID NO: 36942 - DNA, 902 bp, Glycine max
  Peptide Sequence Number=SeqID_153720
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgagcagtttgacagaatcggccgcgaacccatgacgctggtgaagtcggatgacctgaacgcacggctcggtggcatccgggtcgacatcgtcaaccagtctggccgcgacgttgtgctcccccaacagctcggacatgcgtttggccatgccctcaccctcggcgcacaacaggaccgtccagccgtcgtcaaggcgagtcgtcagatctttaacagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 36943 - DNA, 861 bp, Glycine max
  Peptide Sequence Number=SeqID_153721
atggatcctgtgatgatcttgaactttgtgttcatgggagtagatggaacagtgcggcgatttcttgagaagcagaaaaacaacataatagctgttgtcttttgcactgtgagcacaactgatactgagatatataaaaggttgcttccactgtactttcctcgggataaacatgaggagcaggttgctttgtctaaacttcctgcagatgttggggatgaaaatggtgagacaatctcagatgagcgtaaaatcagaataaagcctttgcccaaaaggagagtttcaacaccacctgaatttccagttgatcttcctgttagtgatgttggcttggttagcaggaattcatcacatttagattcatttctggatcctgccttcatgtccatgatcaaagaccccgatcaaaggcggatggagcagtgggagaaaactgccgaagcacaaagaggctggaattgtgctaaattgattggatatggcgaccttggtcgacccacattgtctgctgccgaagaatattctctacactctagatacctgtctaaagcaaattccttgaatctttctgaaattgcagaaatgaaaattgtggaaaagggagcaaggaaattgggacatgagggtaatctggaaaatagtaagggcaatgaaggaataacaactaatgggataaggaaagatttggttgggggagagcttgatgggtgttataacagaatggacaggtggcagcctttggttggagagggggattctagcatgattggagagatggaaaggaaatatagaggagtgaagggattcagaagaaggggggaattttggggcaaggacattaggaaggcttctgcctga

SEQ ID NO: 36944 - DNA, 267 bp, Glycine max
  Peptide Sequence Number=SeqID_153722
atgggaaggatgccatgctgtgagaaggtaggtttgaagaaaggaccatggacacccgaagaagataagaagctcgttgcttatgttgaagagcacggccccggaaactggcgttcagtgcctgccaaagcgggtcttgaaagatgtggaaagagttgcagacttaggtggattaactacctcaagcctgatataaaacgaggaaacttcagcatggaggaagaccacaccattattcaacttcatgctcttcttggaaacaagtga

SEQ ID NO: 36945 - DNA, 174 bp, Glycine max
  Peptide Sequence Number=SeqID_153723
atggagaaatggttccttatattggaaatcgcaagagacgaatggaaagaactcttattgttcgtcatggcggtgagaagaagaagaaataagagatggagggaaggtaagaatgattgggacatgattcttgatgttggagacagcaagagcagtgtgaaagatagagtttga

SEQ ID NO: 36946 - DNA, 348 bp, Glycine max
  Peptide Sequence Number=SeqID_153724
atgtcttatttggaaaccgccaaagagctttgggatgacataaaggagagattttcagttgtgagtggtccaagcattcaacagctgaaatcagacttggcccaatgcaaacaaggagatgatgggctctatggaacagtccgttccaacttgctggccacagatcctatggaatctttaaacaagatgtactttattatagaacatgaagaaagattacggactatcacacaaagcaaagaagaaagaacagaagtcatggccttggttgctcaaacaggcacaagggtgaaagggcgtgagacaagacagatctgtttgcatgaattgcaacaaatctggtcatga

SEQ ID NO: 36947 - DNA, 681 bp, Glycine max
  Peptide Sequence Number=SeqID_153725
atgactgactccaacaaattccacccagctcttgttgtctccaacattaagaaccatatctccatcacctcggagatggaaaacgttcaatacgcgatgtgggcgaaattgttcaagattcatgcacgttctcacaaggtcttccaccacatcgtcccacccgagaaaggcaaggaaagggtttctaaaactgatgaagaaaaggcgtggaataggttgcatgatatattccaagacaataagaattcttgggttgtaactcttgagcaagaattctcccgtaccaacatggaggatttcccaaatgcctctgtgtattgtcaacgactcaagaaattgtccgatcaactcaagaacgtaggcgcacgagtgtcgaataaccgtcttgttcttcaaatggtggccgacctcattgaggcttacaatggggttgcaaccggtaggggtgccgccatggtggctcgcaacactgataactctcaccccctctcaaaaaattcccatcaaaatcaaaatactcatggtggtaaaaagggtcaaaattgcaacaacaatgacaaaaacaatggtggtaatcgcaatggcgtcaagagcaacggtggtggcggtcgtagtcacggccgcaatagtggttggcagcagcaatcagagcacaaacagtggcctaccaaacaacgatag

SEQ ID NO: 36948 - DNA, 159 bp, Glycine max
  Peptide Sequence Number=SeqID_153726
gtcacaggttgtaccatacgtggtggtactcatgaatccgatctttgcattccttttgaagagaaaatgcaagaggttagctacatggggaatcaacaaaggcagggaggtggattcttaggtttccaccagggtccttacaaccaacaaggacaatag

SEQ ID NO: 36949 - DNA, 285 bp, Glycine max
  Peptide Sequence Number=SeqID_153727
atggagactgatgatggtgacggcacgacaacaataacacatagacagaggaggaagaagttgcattgtggcgaaaacatcaacaaccctaagtcagtgaacatctttctagtggggcttccacccattggcccaatggccacaccatgtcaaggagaactgctaggggcaccttgcatttttgctggtacaccccgtataacatgtaaaatttcagttttaccctttcataagcccaatatggattggaaatccgtaggtccaatatggattgttaatccgtaa

SEQ ID NO: 36950 - DNA, 651 bp, Glycine max
  Peptide Sequence Number=SeqID_153728
atgggaaggatgccatgctgtgagaaggtagggttgaagaaaggaccatggacacccgaagaagacaaaaagctcatggcttatgttgaaaagcatggccatggaaactggcgttcagggcctgcgaaagcatttgttcttaaaaatgaagtccaaaatttctttagaagtctctttcagtctcacactgattgccagcctgatagcttgatcatcagtgaccttcctcaaattgaccaggttggttatatgtccctccttgctcctgtttccattgaagaagttagaaaggatgtttgggaattagtagctcaaccattgactactggccacattaatgaaggtttagctgctactgtcatagttcccattcccaagaatgatcagcctcaaaccttgaaagagtttcgctccatcaggggactcgatcgggataatgtgattattgcccaacatattgtgcatcctcttcacaagaaaaaagactttgggtttccccctcaaatcatcaaagccattatgtctctaaccacttctaccactttggctctaagatggaataatgaggtgcttgattccttatctccctacctcttttgtcctgtgtatagagaaattggcaatgatgattcaggacaaggtccaccataa

SEQ ID NO: 36951 - DNA, 162 bp, Glycine max
  Peptide Sequence Number=SeqID_153729
atgggaggggtcgaacttcgacgacattgtgaagtggtgatgatcgaagaggaagaggaagaggtgttatgcagcaagaagacgcatagcaggaagaggcacaacccagcagaaagagaagattgtacaacaaaaagtgagaaaagagttagaaaagtttga

SEQ ID NO: 36952 - DNA, 963 bp, Glycine max
  Peptide Sequence Number=SeqID_153730
atgggaaggattccatgctgtgaaaaggtagggttgaagaaaggaccatggacatcggaagaagacaagaagcttgtggcttatgttgaaaagcatggccatagaaactggcgttcagtgcctgccaaagcaggtcttgaaagatgtggaaagagttgcagacttaggtggattaactacctcaagcctgatataaaacgaggaaactttaccatggaggaagaccacaccattattcaacttcatgcccttctaggaaacaaatggtcaatcatagcagctcacttgccaaagagaacagataatgagataaagaactattggaacaccaacgttaagaaaagactcatcagaatggggttagatcccattacccacaaaccaataaaaaccaatacttttgaagcatacggtggtggccatggccagtccgaggataatataaatatgaaccacatggcccaatgggagagtgctcgaattgaagctgaagcaagaggatctgtgtttcaagctggatctcactcctcacatcaaccccaactaatcttaagcaaaatcccaactcaaccttgtttttcatcatcagattcactatcaaccaaacgcaacactgtgtataacatgtatgccctcgtgcttgcaacaaatcatgaccctgtattgccggtatctacattgagcatcccctattggcagactccttcgccagtctctaccaatattggaagatttaccgacacgggaagctcactctcttatgaggaaaatgttaacatcacagaaactagttgtcaaactcaaaagataatagaagattacatgttaaactcgcaagatgatgatattatcgtggccgtggaagcatttagaacaacaagatgtgagagtattcaagaattgtttagggggtccaatgacgtggaaggtccaaacaatgattcttttgaaagaaatgtgtag

SEQ ID NO: 36953 - DNA, 415 bp, Glycine max
  Peptide Sequence Number=SeqID_153731
gggaggagcttgccacccagcttgcccaggcgagcaaggttgcttcctccagatgcaaccaccttctggaggaagaatctggaaggcccaattacggaaactcacggattgcgcaacaatacttccttttggttgccgttgcattatggaatttcacggatcgcgtaaccctgcttccttttgatttccggcgcgtctcaggacttacatattgtgcaacaaagggtgccgagtatcttgaagcggccaatcaaaggttgcacgtcatcaatgagtatgaaaagagtgacatggaaccaggtacttatagagtggaatgggagaaacggggcggaacgaggctcacgggtgcatcttccaaggaaggaaaacttgcggagtcgccaccaatgtttattcgaggaaaaaccaaaaa

SEQ ID NO: 36954 - DNA, 486 bp, Glycine max
  Peptide Sequence Number=SeqID_153732
atggtggcccgagtgatgttagggcacggctatgagcccgaaatgggtttaggcaagaataacggcggcagggccgccctggctgacgtaaggaaaaacatttcggaaaggaagaataaaggccaaggcccgcagtcaggacagcaagccaaagagattccaccatgccacatcagtaagagcttcatgagtgcgggtttaagatgcgaaggacaagtcgccacgatatgcgatgaaaactcctcgaggagatcggatttggtacaaccatgccctcccggtttccaactagggaattggcgggtggaggaacgcccggaggtttacacgacaagcataatatctgacgacgagtcccgcgaaggtactaatatcgaggacccggtcgtcgatttcgagcaagaagcgagtcggatggaggaggaagaagacgaagatgtagggcttcccccagagttggaaagaataattgctcgggaggattga

SEQ ID NO: 36955 - DNA, 312 bp, Glycine max
  Peptide Sequence Number=SeqID_153733
atgtcggtcttcttgatgtcagagttgcggttttggcaaagggagtttgtagatctgatttgtaaagtcatttctaaatctcgtgttgttcttcgttgttcctcattccggcgcgatgatgacctccccaacgctagcctgcgtcctgtgtggaaatataaaaattcatacattttaaatggtggaacctttgatacatgggaaagttgtgatgaaaaatatttgtctgtgacttgggcttgggtaaagagtaagacaccatccttaatgtgcagctttttggagtttggacgcatgactggttttggttaa

SEQ ID NO: 36956 - DNA, 255 bp, Glycine max
  Peptide Sequence Number=SeqID_153734
atgtccctaaaaataaaggaagaagtgaagaagcaattcgacgttggtttcttggccgctgcttggtactcggaatgggtcgccaacattgtgtcagtccctaaaaaggatgggaagataaagatggcatcggaggatatggaaaagacaaccttcatcactctgtggggaactttctgctacaaggtgatgtcctttgggctcaagaacgctggcgcaacataccagcgggcccatggtggcattattccataa

SEQ ID NO: 36957 - DNA, 2403 bp, Glycine max
  Peptide Sequence Number=SeqID_153735
gtgagtctaattgataacctttttttgggcagcttttatgttcaccactctgtatttgctgagcgtgttgatacttcttggaggctggaggcttgtggtaaaattgatgatactgtttatccacttcttgccctattaaaaatgctagagatcaagccaagtcaaaaggctgatccagatgaagctgcagcattgcctttgatcaagcgaagaaagggcggtgagccccttcctgagcaaaataatgatgaacaagctctttcagagtcagctttgaataaacttgttggagcggcagaaatctatgacctcaaggagaaggaagccccagagacacttgtgtgtaatttaaagccttaccagaagcaggctttacactggatgactgaaatagagaaagggatggatattgagagtgtagaaagaaatctgcatccctgctggtcagcctacactatatgcaagggaaggacaatttatttgaatatttttactggagaggcctctaaaaaatttccaaaagcaacgcagatggcaagaggaggaattctagcggatgcaatgggacttggaaagactgttatgacaattgctttgatactcagtaacccaggcaggggtaactcagaaaacaatgatgtggagaatggagatgataattttatcacaaataaaagaaagaatgctaataccttacataaatttgagggtggcactcttattgtttgtcccatggctttgttaagtcaatggaaggatgagcttgaaacacattcaaaggaaggtagtatatccatatttgttcattatggtggagcaagaaccactgatccctggatgatctcaggccatgatgttgtcttgacaacgtatggtgtcctacaagctgcatacaaaaatgatggagagaatagcatctacaacaaggtcaagtggtacagggtggtgctagatgaagctcataatataaaagcccatcggaatcagactgcccagtctgcttttgttctgtcctcacacagccgctggtgtttaactggaaccccacttcagaatagcttggaagacctatacagtctcttgcgtttcatgcgtgttgaaccttggtgtaacttggcatggtggcagaagttgattcaaaggccttatgagaatggtgatccaagatccctgaagttggtcaaggccattttgaggatgctgatgttaagaagaacaaaggaaacgaaggataagaaaggaaggccgatacttttcctgcctccaattgattttcagttgattgagtgtgaacaatcagaatctgaacgggacttttatgaagccctgtttgagagatctaaagttcaatttgatcagtatgtcgcacaaggaaaggttcttcaccattatgcaaatatccttgacctactaatgcagttgaggcggtgttgtaaccatccatttttagttatgtgcggaagcgatacccagaaacgtgcagatttaagcagactcgcaagaaaattctttcagactaatactgaattccccgatgaaagcaatcaaaatgatccacggcagcaagcagagttgaacaaacttgcaagtagattacttctaaaatctgcttcttctttgcactcggttcaacctcatgcatacattgccgaggttttggagaatattcaaaagggtgacatcatagaatgctctatatgtatggaatctccagaagatcctgtgtttacaccatgtgcgcataagttttgtagagaatgtctatttagttgctggggcacctcagtgggtggcaaatgtccaatctgtcgtcaattgctccagaaagacgatctgattacttattcatctgaaagcccattcaaggtcgatattaagaacaatgtgacagagtcttcaaaggtttcgaagctatttgaattcctgcaacgtattctgaacacatcaagtgaaaagagtatcgtcttcagtcagtggacatcattttttgatctgttggagaatccattgaggaggagaggaattggttttttgagatatgatgggaagttgactcagaagcagagggagaaagttctggatgaattcaatgagacaagagagaaaagggttttgttaatgtcactaaaagctggtggtgtgggtttgaacttaactgcagcctcaaatgttttcattatggatccatggtggaaccctgcagttgaggagcaagcaataatgagaattcatcgcataggacaaaaccgaagagttgtagtgagaagattcatcgttaaggacacagtggaagatcgattgcaacaagttcaagctaggaaacaaaggatgatatctggtaccctcaccgacgatgaggttcggactgctaggattcaagacctcaaaatgcttttcacatga

SEQ ID NO: 36958 - DNA, 240 bp, Glycine max
  Peptide Sequence Number=SeqID_153736
atggcaagcagaaacaaaaatgtccctgtcatagtctactacgatgcctatgtagccgactgtgacgagggcgttgagtttaagggcagaaacaatgctgttaccattagtgacgatgaggatattgatggcatgttcgatgtatataaccgacatcaatgcttaagtggctttcagttgctcgtacaatatgaacaacaaccttcttctactgccaatgtcgaaacaactgttcaataa

SEQ ID NO: 36959 - DNA, 732 bp, Glycine max
  Peptide Sequence Number=SeqID_153737
atggcggaagaagaaccttccataacatcgccaccggcaagaacgttacacaagttcctctcccgcagcggcaagaccgtcatcgccgcgcaacctctggcggtggttcgcgccaccaccagcaccggcggcgcgcgcgttctcgccgcgccgccgaactcgaacgacgatccaacaccaccgcaggaagaagaaggagaaggcgaaaccggcttcgatgcttctcatcatcatgaacggatattgttgcagagagagctaacggtttcgttcgacgagtttctcgaggtcaccaacacgaaggtcgccaccgaagaggaggctctgaaatcagtgatggcgccgttggaagaagaaactgaagaaggagaggaagccgaatcgtcacaggctcaatcagcgcaaccggttcaaccggtgccgaggggaccgcaactgtttcgaccggtgcagaagaagaaagcggttaccggtgatgacgtggaggtggtggaggtgcggaagcctgtggaaaagaagaacattccgaatatttcgaatctcgaggacggtgagtttccggaggagtctgggtggttccttctcgggaggaaggttgaggtcgcagtttcgacggccaggggagtgaacaggttggtggataatgaaatcgttcatttcaattttcctattccgagttactcgagtaagtctcagtggatcgttcgagcgtcaaccaagcgttctggagag

SEQ ID NO: 36960 - DNA, 927 bp, Glycine max
  Peptide Sequence Number=SeqID_153738
atggggcctcaccacccatcaatgcatggtgttcttagacttattgttactctagacggtgaggatgttattgattgtgaacctatattgggttatttacacagaggaatggaaaaaatagcggaaaaccgaacaattatacaatatttgccttatgtaacacgttgggactatttagctactatgttcacagaagcaataactgtaaatggaccagaacagttgggaaatattcaagtacctaaaagagccagttatatccgagtaataatgttggagttaagtcgtatagcttctcacctactatggctaggaccttttatggcagatattggtgcacaaacccccttcttctatattttcagagaaagagaattaatatatgatctatttgaagctgcgacgggacccatgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaaatggttttccctggagatggaaaattcgtccgccaggttttatcaatttgcaaattcttcctcaattagttaaaagaatgaaattggccgatattatgacaatactaggtagcatagatattattatgggagaagttgatcgttga

SEQ ID NO: 36961 - DNA, 654 bp, Glycine max
  Peptide Sequence Number=SeqID_153739
gagcgtcctaagttgaagttatcctctcacgggaggaaggtccatagtttaggcaggcctgtccctgccattgagggactagttgctgggacaggactaagtcctctgatcacgtgttcggtagacactggcgatcggggacttttgtcctcgtttgtcgagcggtggcaccgggagacgtctagtttccatctccccgtgggagaggtgacgatcacgctggatgacttcttgtcgcttctgcatttgtccgtggttggtgacttgcatgcctttcagcccttgcacgtggatgatgcggttcaaatgctggtggacttattgatggtctctgcagaggctgccagggctgagacagggcagtgttgtggaccgtatgtacggctgcaatgggtacgtgatatctatgagcgccgatgccaggcaggtcattggacagttgcggctcgcgcatatcttcttcatcttttgggttgcattctgtttgctaacaagagtgcaagcaatgttcatgttgtgtatttggaggcccttcgtgacctcagtcagaccgggagtgttggatatacgagcattttccctcagtcggggaatccactgctgattaggactacgatgaggattcatcgcgtgcctgtaggtggattgctatga

SEQ ID NO: 36962 - DNA, 363 bp, Glycine max
  Peptide Sequence Number=SeqID_153740
atgtatatgcctgtggctacctctgccacgctgcgcggcggattgcctactgacagtggggactctgttgtggcattagaccaagttcctcgatggaatgatgctgatcaggccttggggtttgaaacttcgttttcgagttcacacttccccgatcctttagcatcgccctcaagggtagacagtggcgatggcagtgagtcggtgtcaaagtttcctgttgacgatgaagtcaattcgaagatatatttgtggcgggggaatccctggaatcttgaggtggatgcggtcgtaaattctacaaatgaggctatgtcactttttgtcctttatgttttagtgttttttcatttggttctttaa

SEQ ID NO: 36963 - DNA, 342 bp, Glycine max
  Peptide Sequence Number=SeqID_153741
atggatgaagcacacagcagcccagggttgcatgatgcagctggacctggtcttgcagaagaatgtgcgacactgggtggatgtcgaacagggatggctaaagttaccaagccatatgaccttcctgccaggaaaattatccacactgttggcccaaagtatgctataaagtaccataatgctgcagagaatgctttaagtcattgctatcgttcttgcttggagcttctgattgaaaatgggcttcaaagcattgctatgggctgtatttatacggaggcaaagaactatccccgagaaccagctgcacatgtagctataagcagcctcatgggaagttga

SEQ ID NO: 36964 - DNA, 345 bp, Glycine max
  Peptide Sequence Number=SeqID_153742
atgtggaaaaagaaatttaattatcattggatacctgtgatcttcagggtccaagagcacggtggtgagactattattcctttcagctgtgccttggaaaggaatcttgcagatatgccaccagatgaagctgctaagtattgtgaggagaacaaaacacaaagtgctcttaccaaaataataaagactggattttcagctattaatctcatttactttttcactgcaggacctgatgaggttaagtgttggcaaattcgacgccaaacaaaggctccccaagctgcaggggctatccatactgattttgaaagaggatttatttgtgctgaggtgagttcatga

SEQ ID NO: 36965 - DNA, 414 bp, Glycine max
  Peptide Sequence Number=SeqID_153743
atgctacatctacaatttcggaaaaatcattcacccctaactacgacacgtgtggcggagctcggagggaagaagaggaaaagcctttgcaacactacagtagttgagagaagagaagggaaaaaagaaaaaggaaaaataggtaaagattcgagcgaggagcaagtgtctttgatgaaggaagcgtactctctattcaacacaaacgatgacggtggaatcgcgccatttgagttgaggatcctgatgcggtcttactctttattcaacacaaacgatgacggtggaatcgcgccatttgagttgaggatcctgatgcggtcttactctctattcaacacaaacattgactcaaacatcgacgcccccatttccctccgagggtgcattttttttcatcccataaatcattaa

SEQ ID NO: 36966 - DNA, 492 bp, Glycine max
  Peptide Sequence Number=SeqID_153744
atggatcaattacgtaataatgtgaatgctaggtcgttgcccggaagcaacgcgctgtatggctcgagtacagtgtcaaaagagcaagggccgctgcatcgccgcccggatgtagtgaaaagtaagcaagggttcccacattttcgtgaacgggtgtgggtaaagaagctagttcatgacaggaggattcgctttggtacatggaatatagacacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtggatgttgggttagcagaacactttaaggtaaaattttgggaggatctagaaggggtacttcaggatataccctaa

SEQ ID NO: 36967 - DNA, 3225 bp, Glycine max
  Peptide Sequence Number=SeqID_153745
atggagtgtcaactggacagtgaatcacttggtggttgtttagttaggacacttgtggttttgaagaacccctctttgggattttgctggcagcttccctctcaggacattttaacattgctggagtttaagaaaggcatcaagcatgaccctactggttatgttctcaattcctggaatgaggaatccattgactttgatggatgcccatcttcatggaatggagttctgtgcaatggtggtaatgttgctggggttgttcttgacaacttgggtctctctgctgacactgacttgagtgtgtttactaatctcacaaagcttgtgaaactctccttgtccaacaattccatatcaggaacactacttgacagcattgctgatttcaaaagccttgaattcttggatatctcttataacctcttttcctcatccttgccattggggattggtaaattagggagcttgcagaatctgtcgttggctggaaataacttctctggcccaattcctgactctatttcagaaatggcctccatcaagtcccttgacttgagctgcaatgccttctctggaatgctgccagcatcgttgactaagactattagtcttgtatctcttaacttgtctcataacggcttcaatggaaaaattcccaaaggtttggagctgatccctgctcttgaaaaacttgacttgcatgggaatatgcttgaaggtaatttggatgttgtatttatgctttcatcaagtgccagctatgttgatttaagtgagaatatgctgtcaagttctgattccaatcagaagtttctaccgcgaatatctgaaagtattaagcatctgaatctaagccacaacaagcttactgggtcattggctagtggagccgcggaacctgtttttgaaaacttgaaggtgttggacctcagctacaatcagttggacggagaattgcccggatttgattttgtttatgatcttgaagttcttaaactcagcaacaacagattttcaggatttattcctaatggcctgctgaaaggagactctttggttttaactgaattggatttgagtgccaacaatctctcagggccactaagtataattacatcaacaacacttcattctcttaatctctcatcaaatgagttcacgggtgatatgccactgttgactggaagctgtgctgtacttgatctgtcaaataacaaattagaaggaaacttgaccaggatgttgaaatgggggaatatagaatttcttgatctcagtcggaatcatttgacgggggccatccctgaggaaactcctcaatttctgcgattgaattatttgaacctatcccataattctctaagcagctcccttccaaaagtcttaacacagtatccaaagcttagagtgctcgacattagtttcaaccaattggatggactacttccagctaatctgctcacactgcccacattgcaagagctgcgtcttgaaaataatatgatctctggtggcatcaagttttcgtcttctcctgaccaatccgatcttcagattcttgatctttctcacaaccagcttaatggctattttcctgatgagtttgggtcattaactggcctaaaagtgctaaatattgccggaaataatttttctggttctcttccaactaccattgcagacatgagttcacttgactccctggatatatcagagaatcattttactggtcctctaccaagtaacatgccaaaggggctccaaaactttaatgcttcacaaaatgatctgtctggagttgtcccagaagttcttagaaagtttcccagttcttctttctttcctgggaataccaagttacattttccaaatggtcctcctggatcaatcagttcacctgctgaaagttccaagaggaagcatatgaacaccatagttaaagtcataatcatagtgtcatgcgtggttgcgctcttcatattaatcttgcttgctgtcttcatacactacatacgtatatcaagatctccaccagaatatgaaacaagtaaggatatccacaggcatcctcaaccaattatctcggctcctgttcgtacgacagatgggggtggcgctttggttgtttcagctgaggacctcgtgacctcacgcaaagagtcaccatcggagataatcagctctgatgaaaaaatggcagctgtaacagggttctctccatcaaaacaaagccacttttcatggtcaccagaatctggtgattcacttagtggtgaaaatcttgcaagactagatacgagatcgccagatcggttggttggcgagctacattttcttgatgatacgataacattgacgcctgaggagctctcaagggcccctgctgaagttttaggaagaagtagtcacggtacttcttacaaggcaactctggagaatggtttgttgttgagagtgaagtggttgagagaaggagtggcaaaacagagaaaagaatttgtaaaggagacgaagaaatttgcaaacatcagacatccaaatgttgtaggattgagaggatattattggggtcctacacagcacgagaagcttatactttcagattacatctcactaggaagtcttgcaagttttctttatgatcgaccaggaagaaaaggtccaccactaacttggacccagaggctcaaaatagcagttgatgtagcacgtggcctgaactatctccattttgatcgcgctgttcctcacgggaatctcaaagctacaaatgtgttgttagatacaactgatatgaatgcacgtgttgccgattactgccttcaccgactcatgactcaagctggtaccattgaacagattctcgatgctggggtcttgggttattgcgcaccagagttagctgcttccaagaagccaatgccctccttcaagtcagatgtttatgcttttggagtgatacttttggaacttctaactggaaggtgtgctggtgatgttatatctagtgaggagggaggtgttgatctgacagactgggtaaggttgcgtgtagcagaaggccgaggctcagaatgttttgaggctaccttgatgccggaaatgagcaatccagttgtagaaaagggaatgaaggaggtcctgggaatagcaatgcggtgcattcggtccatttctgaaaggcctggtatcaagactatttatgaagatctctcttctatatag

SEQ ID NO: 36968 - DNA, 2434 bp, Glycine max
  Peptide Sequence Number=SeqID_153746
gtactttaaaccagctccaaggtgggacaaagagactggaacactgtatcttcccaagagttgccctctacagcctatttgtgtagaaggtaacaaaaaacacttaaagaatatcgcatgccttgaagcatgcaaacaacttcataaaattggagctctgacagataatcttgttcctgatattgtcattgaagaagcagaggtggaggaatttgggaatgaaccttatgatgaaaaccaaccaacttttgtcccatttggattggtaaattctgtgtcaaataatagccacacgatataccattgttacttgatggaactcagtcaaaattttagctatgatatctctgtgcaagatatttttcttgccataagaattgagcttgatccagaaattggatgcacacaatttgatatgggttttgacagaggtagcgtgtcactaaagttaagatacaaaggaacgattaatctttcgccaaacctggttcttttgtgtaaaaagttccaggtcactttgcttggaagtatcatagatcatagcatgaataagttggcaactagtttagacaaatgctatttggaagacaatgttgagattgattatctgctgcttccagctattggtaaaggggaaaaatcacatgtaaactggttagctatcaaatctgtagaaccatctagttttacgtgtaagtatcatcaaccccacatagagacaaaaagtggtctagtttgcacttgtaaactacaagatgcgttggtttgtacttcccatcctggtggtaagatttatttctatatcaccactggtataatggagttgcatggaaactcacctatggaactaaggggtggtgaagttactacatacaagaaatactatgaacaacaccatggcattcaactacaatttgaaaatcaatggctactcaaagcaagacaccattttaaagttaaaaattactgtcatggacaaaaacaagggaaggatggagaagcaagcaaggcctttgttgagttacctcctgaactgtgctctatagtcatgtcaccgataaaagatagtatcatttataccttctcatttattccatcaatcatgcatcggctggaatcattacttggagctttcaacttaaagaagatgcatttggatcattgcacacaaaatgaaattcaaacaatcaaggtcttggaagcaataactactaaaagatgcaatgaggcctttcattatgagtctctagagactcttggagattcttttttaaaatatgctgccagtcaacagctttttaaaacatataaaaatcaccatgaaggtctccttagtgtgaagagggaaaagatcatttctaatgctgccctctgtaagttagggtgcagttctggacttccgggcttcatacgaaatgagccttttgatcctcatgcctggaccattcctggggataaacctgaaagtttaaaattagaagagctggttatcaaggggaaaaaaatttatgttcacggaaaaagaaaattaaatcgcaagattattgctgatgttgttgaggcactaattggtgccttcctcagtactggtggcgaaatatctgcattgctgtttatggattgggttggtattaaagtcagttttgataaaataccctatgagaggcactttgacattcaacctgagaaactgttaaatgtcagattcctagaatcacaattaaaatactcattccatgaccattctcttttagtggaagccctaacccatggttcgtacatgctgcctgaagttcctagatgttatcagcgactagaatttcttggagattcagttttggattatctgattacttggcatttgtacaatgaatatcctggcatgtcacctgggcagttgactgacatgagggcagcttctgtgaataatgattgttatgcatggtctgccattaagcatgggttgcacaaacatgtactccatgcctcacaagaactgcataagcacattgctgtcacacttaacaattttgataagttgtcttcatcatcaacttttggatacgagtcagaggcatcaccccctaaggtacttggagacattatagagtctctggctggagcgattcttgttgactcaggattcaataaggaggttgtgtggcaaagcataaggccacttttggaaccccttgtgacaccagaaacattgaagctccatcccatccgagagttgaatgaactatgccagaaaagaagttataagattgtactagaggacgtgtctcgcaaagatggtgttactaattatagaatgaaggtagaagctgatggggtcattcacgagtatgagtataccggccctgctcttagggacacagccaagaagatagcctgcaaggaaattttgaattccttgaaggaagatttatag

SEQ ID NO: 36969 - DNA, 1107 bp, Glycine max
  Peptide Sequence Number=SeqID_153747
atggcgatttgcaagttgaaatctttgctttctctttcgaaatgcaactctgcgttggtctcctcttcaatacgcgctttctcttcggcacagaatgttggattcattgggcttggaaatatgggatcacgaatggcaaataatctgatcaaagctggattcagactcacagttcatgacctaaactctgatgttctcgagatgttctctcaaatgggagttcccacaaagaaaacaccttatgaagtttcagaagcaagtgatgttgtaatcacaatgttgccaacttctgcccatgtgattgatgtttacactggaccaaatggtttgcttcatggtggaaaactcctaaggccatggttgttgttagattcatccactattgatccacaaacatcaagaaacctttctgctacagtaactaattatattctaagagaaaagaaaggtgaatgggaaaaacctttcaagttggatgctcctgtatctggaagtgttactgcagctgaagctgggacacttacttttatggttggtggctctgaggaagcatttcttgctgcaaagcccttactcttttcaatgggtaaaagtgcaatatattgtggtggagcaggaagtggttctgcagcaaaaatttgcaataatttggctttggctgtgagcatgctgggaatatcagaagctcttgctctaggccaatctctaggtgtttctgccagcaccttgacaaatatatttaattgctccagtgctcgctgttggagtagtgatgcttacaacccagttcctgggctgatggaaggggtgccctcgtcaggggattataacggagggtttgcatccaagcttatgttcaagcttgcaaaaatgcatcaactactcacagctaagggtgtggggatactagagcaaggacacacgataatagcaaaagacttgaatctagcagtagaatcagctaagctggctggatgtaaatacccactaacatcacaagcgcaaaagatatatactgagctctgcagcgttggccatgaagccaaagacttttcatgtgcttttcgccattattactctggaattgacgaacctcatgatcagtaa

SEQ ID NO: 36970 - DNA, 1227 bp, Glycine max
  Peptide Sequence Number=SeqID_153748
atgagatttttatccaaagattgggtggtttcatgggcactattacttcttgtgtcatgcacaacattctcatcagcttctttggggaaacctgagaacaaaataaaaacatctgtttttctatcaccaaagattgagctaggtccagggttagtttcaaacaaaaattattttgatgttgactttccaagaggccatattgcaatcaagagtttcaatgctgaattagttgatgaggcagggaaatcagtaccactccaagaagtatatctccaccattgggttatagtaagataccatcaacccaaaaatgtgtcacaaaataatcaaacagataatattgttatagtgagaaacagtggcttttgccaagatggttttcttgtccaatattttgggctaggatcagaaacaagaggaactgccactgatattccagacccttttggaatagaagttggaaacccttcagaaattccctatggatttgaagagaaatggttgatcaatgtgcatgccattgacacaaggggtggtgtggaagataggctggggtgcattgagtgtaggtgtgacctttataatgtcacaaaggatgcagatggtaaccctttgagtccatattataagggaggtttggattgttgccctgataatagcacgtgcaggttgaacaaaggcttcaagggtcctaagagaaccctaaaccttaaatacacagtgaagtggttcagttgggacaactgtgtggtgccccttaagatttatatacttgatgtgactgatgttttgaacgtgtccaaaggagtgagtccaaagcataattgcaaggttgaatatcaggttgaaccttgcagcaaaggctacaatagtagtgcttgcattgatgtcagaaagacaagcttccctatgcaaactggtggatatgtcatctatggtgttggtcatcagcatgttggtgcaaatgaatcaactctatacggacaggatgggggagttatttgttcttcaataccaaaatatggaaatggaaacgaagcagggaatgagaaagggtatgttgtaggaatgtctacatgttaccctcgacgaggtactatcaaaataaaagatggtgaaaccctaactctagagattatctacagcaacaaccaaagccacagtggagtaatggggcttttctacatcttggtggctgaacaactgccacaccaacacctcctttga

SEQ ID NO: 36971 - DNA, 264 bp, Glycine max
  Peptide Sequence Number=SeqID_153749
atgtgtgccgtcgtgttgatccacgggctttctctaccgttcgatttgaagaaacgccttcttcataaagttgatgatgcgaggttttttctcctccgtggccacaaacaattctctacatgggccttgtgcagcacctctggcttttcatgggccgttggagaaaaatctggaggaaacggaaagttggaatacacattgcatagtttatacccacaattacagtatcctatgagctcaaaattggcaatggtgggcccctga

SEQ ID NO: 36972 - DNA, 498 bp, Glycine max
  Peptide Sequence Number=SeqID_153750
caagcggaagccgtgaaaagacatactgatttgaaagtgggaatgtattggggagatatgggagttgacttctgggatgctgctacctggaaacaagaaatggaaaaacatgaggtgcttgtcatgactcctgcaatattgctgagctgcttgaggcatagcttcttcaaactgaatatgattaatgtcttaataatggatgaatgccatcatgctaggggtaaacacccttatgcctgcatcatgactccactgcccgtgaccattccggccggtgaccccaccaccagcattactgttcgccaatctacacaacggtggccacggtgtcgggattggacttctgacgtgcccccatgcagcccttttgtgcttgccaaacaacaccagacagcaatgcctttccagcacgtgacgcattcgttgcggccgtgctttcaccgccgctatcaccctctgtttaatagttgcaatacgctgtcatataaattgcagtaa

SEQ ID NO: 36973 - DNA, 593 bp, Glycine max
  Peptide Sequence Number=SeqID_153751
atgaaggtatatacatgtgtaagtgaagctgtcatcacagagttcataccaacatcaacaccaaaattcaagttttacagcaacaatggaattcaatttgtattatttgaagaattagcatctaaactcaagatgttaaaagagcagttgtgtttgaatcaattcccaattgctgatcctatcatcttcatggtttttaacagtggatattctgtttctcagcatgaactcactctaagaagttcagatttcactaaatcaattgctgagtctgcacaaaaaagaataacaaagattttttgttctttaatgttttgcctggatgagcttggtgtttggttggctttgaaggctgcagagtctttatcttccaatgaaatagagtcattttcatggggacactctggggatagagttgtcaaagactttattttggaaggtgtacatgcacttaaaagttacttgcaatgtggtaatgattcttctaccattgagagaacatggtctattggtgacaatattaaatctgatgtgaagatgggtctgttgacctccaaagtttgctgtcttgttgactctctactcgagtacag

SEQ ID NO: 36974 - DNA, 561 bp, Glycine max
  Peptide Sequence Number=SeqID_153752
atgggttcgttcgtgaagctttcaaggagggccttggaaactgagatgcccgttatggttcagatgcaggaattgctccgaggagctaagaatgccgtgtctttggcccagggggtggtttattggcagcctcccaagcaagcattggaaaaagtgaaagaacttgtatctgagcctttaattagtcgttatggtaacgatgaaggtattcctgaactcagagcagcattagtcaaaaagttgcgtgatgaaaataatttgcacaaatcttcagtaatggttacatcaggtgccaatcaggcatttgtgaatctagttcttactctctgtgatccgggtgattccgtggttatgtttgctccttactacttcaatgcctacatgtccttccagatgactggcgttaccaatattctagttggtcctggtagctcagacacactccatcctgatgcagagaagcaaaggcaatctttggttgctaagagcatcttttttcctccatccagggggttcacatattggttaaatgttggatggattgggtctgtatacatgtaa

SEQ ID NO: 36975 - DNA, 150 bp, Glycine max
  Peptide Sequence Number=SeqID_153753
atgacgggttctgcaccagcacagcagcagatgtcatactatgatcacgttcagacgcgccatcaggagaagggaagcctctattcttgggttgcaagtgctgcttggaacgcacctgttgttgctgtccctagattgcccgttaaataa

SEQ ID NO: 36976 - DNA, 324 bp, Glycine max
  Peptide Sequence Number=SeqID_153754
gttgtatgtggatggtggtgtagagaattgattagtggtagcatgaacattgtggagctacttcgtaaacatttgtactcgaaagaacttgatggaattaataaaaatattgtggaatacattgagaatcatggtggttcaaaacttgattgtgcatgtgaattatcatgttggggcatatatcatgaaaagcccattggtttggtaattggggttgtgcatgcacatgtgactgatcatgttagtgcatatatcctcaaaatcccattggttgaaagttgggtttcgcatgtgactagtcatgttgagccatatatggcttga

SEQ ID NO: 36977 - DNA, 705 bp, Glycine max
  Peptide Sequence Number=SeqID_153755
atgtcgtttatgcgaggggattttctttctcgaacgaggaagctcgtgaagggtttggccaaggcgcaacccgcgtggctcaaagccatggaacaggcaccacctgcaacgtttcctcggtctgccgggaaaattccgaccattactcttcccgaggatgtttatgtgaagaagttttataagaaatatccggaatccaaatcccatgacgccataaagtatttcccttttaccttgtatctagtttttgttccatttgcaatgtttgggcatctagttcttgtttctgtattgctgtttcatgcttttgatccccctccgtctcgtgtatttgccttgagggttcttgaattgaaggagcagggcattagtgaggagcaagctatggctatagctgatatggaatatctgacagagaagaagacaaagaagaaagcatatacccgtttgaaggaaattgcacgtcttcaagggaagagacttcctcaaaatccatatcctagtgccatcaaggagatacaagctgaggagaggaaatatgttcgtgatcgtttcttcaatcccaagatgcttgaaattgtggagaaacagaaagccgaggcagcagcggagagattgagtcgagctcttgaaaaattggctctgacaataatatttaccattcagccactgaaaagtgcgttcttcttccctgatattaggtga

SEQ ID NO: 36978 - DNA, 453 bp, Glycine max
  Peptide Sequence Number=SeqID_153756
atggagattcacgcatctggactctcaccgatcaaaaatggtacatgcactgttcgtagtgcttattacatgatgatgaagaagtttgtggattatgatgagttgatagttgaaggagattggaaattgctttggaatattgatgtttcccctagagtcaaattgttcttatggagattgtgcaggaacatgcttccttcatgggtcaagcttcgtactcgtggagtctcgtgcccaattacatgttctttgtgcaacattgatgttgagaccactagtcacatctttgcttcgtgccattcagaagaagctattcagtttatgcaagcaagaggttattcccttgttaccttcgagatggattgtaaaggagtagtggataaaataaggcgatccgatccagatgagtccgagatagaggttctgttattcaacatagcaggaacctcctaa

SEQ ID NO: 36979 - DNA, 774 bp, Glycine max
  Peptide Sequence Number=SeqID_153757
atgaaaaggatgagtgagagattggatgaaattgctgatgaaaggactaagtttcatttggtcgacatggttcttgagagaagaagtggagtcattgagtggtgtcaaactacatcattcatcactgaaccacaagtcaaggtggacttggaaaaacaacacttgcccaactcatcttcaatcatgaaaagtttgaagagaatgacaaaagctatcaccgaagcaacatctgggtgtcattgtgaggatttggatatagagccactacaaagagaacttcaagctttgcttcagagaaaaagatatttgcttgttttggatgacgtatgggatgatgagcaagaaaattggcgaaggttgaaatcagtactggtttatgggacgaagggttcttctattttggtcaccactcgtcttttaaaggttacaacaatcatggaattgtttaaacaccgagcctttcgaccaaatgaggtagaacaagtagagtttgtggtcattgggaaagagatagtaaggaagtgtgggggagatcctctggcagcaaaagcattaaaaggtattgaacttagacaattgtatctgtctccaaaagttgtaaaacagtttaatacgcttgaaatctctacaacggctatctttcaattgttgcatctcactatcaagcttacctcttcaaataaggaagttgacttccctaaggagtttaacaacgtactttgttggcaaagaaaaagggttctttttggaagagttgggagcactgaagcttaa

SEQ ID NO: 36980 - DNA, 471 bp, Glycine max
  Peptide Sequence Number=SeqID_153758
atggctgaggctgtccttgaaattgtgcttgagaatttgaaatcaatcttgcaaaaggagctgggacaatttttgggtgtcgatgatgacatgaaaaggcttgctagcttgttcactacaatcaaggctacacttgaagatgctgaggagaaacaattctcaaatagagttattaaggattggctggcaaagctaaaagatgaatctctcattctggatgacatcttggaagagtttgatctactagacaagggtgcttccattttggtaactactcgtctttcaaaggttgcaacaatcatgggaacaatgtctcctcatgaattgtctgagctatccgacaatgattgttgggaattgtttaaacaccgaacatttggacaaaatgacgtagaacaagaagagcttgtggtcatagggagggagatagtaaagaaatgtagggggtgcctcttgcagcaaaagcactag

SEQ ID NO: 36981 - DNA, 1494 bp, Glycine max
  Peptide Sequence Number=SeqID_153759
atggacataatagcatcatcaatggcacttccttcattgcaaccccgcaacaccaacctttcaaaagtttcaattttccaacgcttaacacccccaacaaccttaattccctcatgggcatgttcctccaaacccaataactccaccaccctctctccaatctcctcaaagtttccatctttcctacgctgctccacaaaaccagacaccagcgccaacagcgagacacagcacaccaataatcccaacaatgaacaacccaattcaatttcaaactcccagaatgcaccacaatcatcagattcatcatcaagtgaagccttttcttcatcaccaccacctttggggtcatcacattcctcttcctcaagagggttggtgcttgatttgggtccttcaaactcttgggacagtgctgacataggttccccagtggtgaagaggtttctgagtgatgaagaagagaggtggtacatgtggtaccatgggagggcaaaagggtacccttcttctgatttgatagggttggctgtttcaaagaatggggttcattgggagcgtggtggaggccctgctaggtcaagttctgatgtggggtttgtgattagctgtggaaaggattggtggggttttgacactggtggcattaggccttctgagatggtgatcatgtctagttctagggttagagcctctagtgctgtttactggctttactacactggctttgtttctgagaggatggagttttctgatcattctctggagttcagtgtggaaaaccctgatggaatgatcaatgatggtgtgagttgtgggaatggaaatgggaaagggaaggttttgaagtccttgcctggtttggctattagtcaggatgggaggcattgggctaggattgaaggggagcatcatagtggagctttgattgatgttgggtctgagaaggagtgggattctttgtttatttcttccccgcaagttgttttccatgggaatggcgatctaaggatgtactatcactcgtttgatgtcgaaagagggcattttggtgttgggattgctaggtcgagggacggaattaggtgggtgaagttggggaaaataatggggggagggaaagttggctcctttgatgagttcggagtgatgaacccgtgcgtgaccaggaacaggagtggcgggaactatgtgatgacgtatgaaggtgttgctgctgatgggaggaggagcattggtttggctgtgtctcctgatgggttgaaggaatgggcgaggcgtcaggatgaggcgattttaaagccgtcggaccaaggctgctgggatgataaggatgttggatccccgtgtctggttgaaatggatacagaaggagatgagtggaggttgtattatagaggtgttggtaatggaggaagagttggaataggaatggccatttccgaagggagggatattggaagttttagaagatggacaggtttccatgtataa

SEQ ID NO: 36982 - DNA, 132 bp, Glycine max
  Peptide Sequence Number=SeqID_153760
atgtcgtcagtgaatattgaggttgctctctcatggaagagaatcgctcagtatagaggagacaagatacttggggatgtaaggtacaaatatgggagtgttggattcatcccaactatgttggcaccataa

SEQ ID NO: 36983 - DNA, 1917 bp, Glycine max
  Peptide Sequence Number=SeqID_153761
atgacatttaagaaagactttaaacaacaaatggtgcctgagtgggagaaagagtacatggactatgaaggcctcaaaagaatattgaaagagataaaaaacagcaagcaagctacacacaataggtccttgcatcacaggctcagacttgaaagggcattcagtggaatacacttgcaaggtagcaatcatcagagagagggggatattgaggaccaagttatagaagtaaaaacattagaacaagatggttccagacagttatataagaccaactttcagaagttcgatgaagaaggaggagaggttgaggcaagactctttcagaagcttgatgaagagctcaacaaggtcaatgcattttacaaggatcaggtggaagcagcccagcatgaagtaacccttttgagtaaacaaatggaggccttggttgcactaagggtaaaggtgaaaagtccagatacaggattgaaacagattatctcctcacctgaagagactatggatgaaagtcatcagcaaaaagattctatggttggacctgaagataatcctcttcaacaggccaatagaaatactcatcatgaggagcaagcagaagcaaacaataattacatcacaaaagatcccttggaaatcctagagcacgtaaaggttgataatgttcctcaatctccaatatcaacaattaaaaaagcttttactgattccagtgataatgaattgagcttcagcaaagaagagctgagaaaagttgaagagcaactgagacttgtgtttgttgagttctatcagaaactcctccatctcaaagattacagttttatgaacctctcagcattttccaagatcatgaagaagtacgaaaagcatacatcaagggcagcatctgcagcatacatgacagtagtggataactcctatgtgggcagttctgatgaggttaactttctattggagaaagtggagtctaccttcatcagaaactttacacactcaaatcacaaaaaggggaggaagctattaaggcaaaaaacaaaaacagaaaggcacagcacaacatttttcacaggtttcttttctggttgctttgttgctctatttgttgctactatattaagaataacatctcaacaattcataaagaagaaggaagggacattttacatggaaaacattttcccactatacaggcctggaactgaattggactacagagaaattttccttctaaccgctggtcatgcagtggttgcactactatgcttcttaataaatttgcagatcgggatgaacccaaggagtcgacactataagacagctaatgaacttgttcctctgagcttagttgttgttaggcttccagatttcttcttggctgatcagcttaccagccagtgcatgcgtcaattctatgaagagggagacatcaaccgtgcattcaatggcttaaactatctctcaacaattgttgccatgatctttagaactacctttgaactaaagaagggattgagttggaaggtgttggcacttgtaacttcagcactagcagtacttcagaacacatattgggacattgtcagggactgggggctccttcgaaggcattcgaagaacccctatttgagagatcaactcatacttccacacaaaagtttctacttcatagccatggtcctggacatagttcttagaatttcatggatgcagttggtgtttgaaatggattggagcccccttcataaagtggcaatgatcacagttacttcctgccttgagattattcgccgtggcatttggaacttctttaggttggagaatgagcacttgaacaacgttggaaactaccgtgccttcaagtcagtccctcatccttttagttactatgatgataaaaatgacaaggatgcttag

SEQ ID NO: 36984 - DNA, 219 bp, Glycine max
  Peptide Sequence Number=SeqID_153762
atgcttgaagtcgccggtcaaaccaacgttttcgtccaggctggaggcgccaataggagtggcggcaaccactggctgtgtcgccagtggcagtggcgacatgccacgtgtcaagccacaaggaaagcaccaatggagctggcgtttttgcatgccctccacataaaaaaacagcaccctcatggaataactttcaaaacaaccctagttcaggaataa

SEQ ID NO: 36985 - DNA, 996 bp, Glycine max
  Peptide Sequence Number=SeqID_153763
atgcgtgctgcggtttgtacttcctattctgccattcctctgtttctattgtatgacaagcaaaaatactcatttagaggtgcggtgtttcagatttgtgatatggtaacagttgctcggtttttgaatctcacattggttgttccagagcttgataagacatcattctgggcagaccctagcaattttgaggacatttttgatgtgaagcatttcattgattctttaagagatgaagttcggatagtgaaaagagtgcccaaaaagttcagtagcaaacatggattctctaccttggagatgcctcctgttagctggtcaaatgaaaaatattacttggagcaggcacttaaattcactcctcaaattgagaatttggggcacaaattgattcagatgcttcatgagaagggatcttttgtggcattgcatctgagatatgagatggacatgttggctttctcaggttgtacttgcggttgcactgataaagaagctgaagagctcaagcagctgagatatgctttcccttggtggagagaaaaggagatagtttctgatgagaggagatcacagggtctatgtcctttgacaccagaggaggcagccttagttctgcgagccttaggttttggtagggagacacagatctatattgcagctggtgagatttatggtggtgaacgtagacttgcacaattaagagcttcatttccacaaattgtgatatttatgttgggttacaagtgtgaggtgaagtcccacatcgggtctccttatgtggtggctcgtgattcacaggtgtacccctcgaatctccctaacaattggtatcagagccgatggttcgaccaagtttcggctcagacgagtatacaagtaccgcagatggccagaatgactagcggtacaatgtgccccgtaggtggagcgggatggttaccatgtggaagagactcacacttgaggggagatgtgttgggttacaagtgtgag

SEQ ID NO: 36986 - DNA, 243 bp, Glycine max
  Peptide Sequence Number=SeqID_153764
atgtacatacctgaccaagctactgcttatccccctggactccacatcagcaaatgcactgacatcaagatgatgcctaatagaacatgcccaaggctacccatttatgatgaggggaagaagagaggcttgaagctctacttcaacaaagaaatgccaagcagagatatggaaagttctgatcatataagacagaaagacatagtatttgcttattccaagaaacaggatcaagtaggataa

SEQ ID NO: 36987 - DNA, 387 bp, Glycine max
  Peptide Sequence Number=SeqID_153765
atgggcattatcatactttgtccattaaggtggagtcactacctcatgctatcattggatggattccaaatatgggcactggaagatctcgctcttcttgcagtagttctgttgatttcttataaagaagaccacgagaaacttttttttcgcttcaatgtggatccaagtattggaaacttcgatgtgttgattggagaaagagacttcttggaatgcactagtggtgagctggatggctgtggagtggaaattggagttacctcaatgtcggacgaactagagtcgtcagaggatggcattctgatgggttcttttggagtcatggacttgcatctagcttgtgtcttcctcttctttggaaaagaagagaggatgattggttga

SEQ ID NO: 36988 - DNA, 234 bp, Glycine max
  Peptide Sequence Number=SeqID_153766
atgggttctccttcgatgtggatggaagtggtgtttgtggtgatgatggtcgtggcaggagcagtgttcttgctggagtttgtcatggttccattgttggtctattttatctgtagtcctaagaagaacttcagctctcccatcatactcattttgaattcaacatgcattagcttagaaaaatcctcacagataggtccattagtagcaccaaagataatgtcatccacataa

SEQ ID NO: 36989 - DNA, 543 bp, Glycine max
  Peptide Sequence Number=SeqID_153767
atgatataccaaaaactcgtcaggatgttctggaggaatgctaaactcaaggactggaagaacattgtgtctaaggttcttggaaaggaggtggtgttgtccatggagtccattgcacaaaagagcttcatgcataaagtaggcttaaaagactctatatctgacctacacaaatttgtgctcttccatctaatggatgagatcccttttgaccttccacacaaagtctacatcaatattgtaagaaacatgaagtctctaggaggagtggatgacatctactatgccgttatcatcaacaaactcctctgggaacaccagttctttcacatctttgagagaatggatgaggactccaatcagtccatcattagtaaaggtactttcatcgccaaacgactacactttagtgttgtcaacctaaaagcaatgaagggagcagaaaggcaaggtcaagaccaagaagcaatcccaacaacaagtggaggaagaagagcttatcaccaaggagcaacggacaaagaaaaaacatacagagtctag

SEQ ID NO: 36990 - DNA, 360 bp, Glycine max
  Peptide Sequence Number=SeqID_153768
atgaactcaataccaactctacttatccttatttgggtatgccttcggcttcctctggggctactacttcctgggaaacctttggctaggatcctagcagcaacttcgctcctaaccgtcaacacgtctcaatatgtgttagaaaaaggaaaggaagcggggaagagtttagcacagcggagcagcaagaacaaagggaagagaggggcattgggagtgcctgctttggtcacatctggtcacgaaggtgaatctctttctcacttactccgcatccttgctcgtcgaaagaggaagaatagcgaatttagtgacggaaaggcattcggaaactattcaagtgcgaggaactctccttaa

SEQ ID NO: 36991 - DNA, 135 bp, Glycine max
  Peptide Sequence Number=SeqID_153769
atggattatgaatcttcagatcctgagtatgaatcaaataaattggacactgacatagatgaaagtgatgaagatataaagatgtttgagaaaaatgacagtgagggtgagagtcatcaacatacttgggtttga

SEQ ID NO: 36992 - DNA, 225 bp, Glycine max
  Peptide Sequence Number=SeqID_153770
atgacaagttacttgggcttggcgaatcagcctcgcttagccacaagtacttatctagaggatgaatattcatcctctacagatccaatcgctttgcacgacaagtgcgctcagcaagttctaccagaaatgcataaaatgaatgtcaatagaatggagaaggaagagagagaggagatgccacttcaaggagaagatgagtctagaagaagctcaccaccatag

SEQ ID NO: 36993 - DNA, 177 bp, Glycine max
  Peptide Sequence Number=SeqID_153771
atgtcgcgggggtcaggggccttggggacgtcaggtggggtgctattgcccaaaaccaagcttgaccaatcccgacccaacccgagcatagtcagtcactgtgaatcttatgtgatatatgggttatggcctctggtaatcgattaccaagggtgggtaatcaattacaaggcttaa

SEQ ID NO: 36994 - DNA, 282 bp, Glycine max
  Peptide Sequence Number=SeqID_153772
atggatgcggcttttgttttcaagccaaccgaagaacaaatagtgaggttaaagattcaccatggagggatgtttatttataagtcatcaactgtgtatgtcaatagtgagatcgttgaagaagaatggggttgggatgtggatactatgtcgtatattgacttgaggaaggtgattaagtctattgggtacaaagcattcaagtgcttatggtacaagcacccccaaaaagcactttgcagagggttgaagcaacttaattgtgactctaatattttgtaa

SEQ ID NO: 36995 - DNA, 399 bp, Glycine max
  Peptide Sequence Number=SeqID_153773
atgcgatttcgtcctcgtggtcatcgaagcagcaacctagtgttgtttgtggctaggtggtcggcgtcgctgcgtcgtcgtcctagtgaaggttttggtgtcgtccctaaaacccagtgtttgggtgccatccgtaaacctcagcatggaaaggagttcctcatcgtacacctcggaggcccgaagtcgcgtggtaggaaatggtgtaattattttgagtggcacgatccagttgccaacatttgtcagaagaagatcattgtaacattgatgaagaaggttgatgaattgaaattgagggaaaaggatttgcaaaccaagatgagtgacatgaagatgaagggaaaatttttagggattgtattggttttttcttggcagaggaatgtaatttcataa

SEQ ID NO: 36996 - DNA, 831 bp, Glycine max
  Peptide Sequence Number=SeqID_153774
atggagcatgccacagcagtagctgctgctgcattcgcaattttttcacaagaggtttcacaaattcaacaacaaaagaaaatgagggagaaacctttgcccaggggcaaaagcaaggtggatgatccaaaacctccgatttctcagtttggaggcacatcaaggcagttctcagggtcatttaaacccccaaatgatcaaattaacaatgctacaatggatttaaagaggcctgaaaagaccatgaccccaccatcaagttttggtgaaaaggtgaaaagtagcactgatggtaaaaaacctgagatccaagccccaaaaaggattccaacttttggtgatgaggacttggtcaacactggtgaaataaaacctgagaccctacaattaccaagagttcctccaccagttcatcagcaaatgcctttaaagccgtcaccacctcggccaccatcaccaccgccaccgatcaggccgacttcagcaagaccaggtgccaatgaaacaaaagctgatgcctgggagagggaggagctggagaagatcaaagaaagctacgagaagttgctggaaacgatagattcatgggaaaagaggaagaaggcgaaagcaatacgcaagctaaataagcatcagcatagtgaaagtgagcggaaaagggcgaaagtgttgaagaattatcaagataagatgaactatataagtcaaattgcagggggagcaagagcacaagcagaggaaagacgaaggaatgaagtgctcaaagcaaaagagaaggcaaatataattagaacaacaggcaaaattccagggccatgctcttgcttctaa

SEQ ID NO: 36997 - DNA, 165 bp, Glycine max
  Peptide Sequence Number=SeqID_153775
atggacagtctaacgacggtgctgaaggttacgaggctttgcccatggctaacggtggtgttgaaggttacgacgctttgcccatgcaagggttgcaacaataggactcgagaggagttggaagaacacattaaagctgtcatttttatctcaaaaactccatga

SEQ ID NO: 36998 - DNA, 1544 bp, Glycine max
  Peptide Sequence Number=SeqID_153776
atgactagatttgaagtggttttcatcgctaccccagccctcggcaaccttgttccaattgtggaattcgcggatctcctaaccaaacacaaccctcaattatctgcaaccgttctcactgtcaccacgccgcaacgacccctcataagcacctacgtccaatcccgcgcctcctcagccactaatctcaaactcctccacctccctacagtggatccacccacacccgaccagtaccaatccttcatcgccttcgtctccctccacatccaaaatcacaaacaccaggtcaagaacgcgctcctcaacctaaaaaaaaacgagtcaaactcgtttgactcggttcgactcgtcgctctcttcgtcgacatgttctccaccacgctcatcgacgtcgccgccgagctcgccgtcccgtgctacctcttcttcgcgtcaccggcgagcttcctcggcttcacgctccacctcgaccgagtcgacccggtcgagtcggaatccgagttggcggttccgagttttgaaaaccccttgccacggtccgttttgcccaacctcgtgttggacgcgaacgacgcgttttcttgggtggcataccacgcgagaaggtacagggaaacaaagggcatcttcgtgaatacggttcaagagcttgaacctcacgcgcttcagtcactctacaacgattcggaattgccacgcgtttatccaattgggccggttcttgaccttgttggatcgaaccaatgggatccgaacccggcccaatacaagcgaattatggagtggcttgatcagcagcctgtgtcttcagtggtttttgtctgcttcgggagcatgggaagcttaaaggcaaaccaggtggaggagattgcaactgggcttgaaatggctaatgttagattcttatgggctttgcgggagcctccgaaggcccaattggaagacccgagagattacacaaaccccaaggacgtgctaccagatggatttcttgaacgaacggctgagatgggtttggtgtgtgggtgggtcccacaagcggtggtgttggcccacaaggccgtagggggtttcgtgtcgcattgtggttggaactcgatattagagagcttgtggcatggtgtaccgattgccacgtggccggtgtacgctgagcaacaaatgaacgcgtttcaaatggttagggaattgggattagcggtggagattagggtagattatagggtgggtggggatctggtgcgggcagaagaagtgctgaatggcgtgaggtcgctgatgaagggtgctgatgagatccaaaaaaaggtgaaagagatgagtgacatctgtagaagcgcattgatggagaacaggagctgccacgtggcctcggagactccagtagcagcagcgcgttgccctcctgcttacgtggcgatggacgcgcaaggagcattggcgtgttctgcatgggagagtgaaggcgccaggtctggaagtgcaaatggtgttggcgttttagggtggtctggaagcgcaaatggtgttggcgttttagg

SEQ ID NO: 36999 - DNA, 2196 bp, Glycine max
  Peptide Sequence Number=SeqID_153777
atggctgctctacccttctcaacaacctgcaggcattccaactcacctttacatcacaattcaaaaacaagcttcataggtttcagccaaagaaacaatatttggcagttgtttgtcatcacaaagtcaaattccagacgggcaataagaaagctctgcgtgaagaatgtcaccagcgataagaagcaggaactggaagaaccactcaatgaacaagacactttcaatgaatttgtaccagattctgcatctattgcttcaagcatcaaattccatgccgagttcaccagccctttttctccagagaagtttgagctcaataaggctttctttgcaacggcagagagtgttcgtgattccctcatcataaattggaatgcaacaaatgactactatgaaaggatgaacgttaagcaagcttattatatgtctatggagtatctacagggtagggcattgctaaatgcaattgggaatttacagctctcaggtccttatgctgaggctcttagaaagctgggtcacaatttagaggatgtggctaataaggagccggatgctgcccttgggaatgggggattaggtcggcttgcttcttgctttctggactccttggcaaccttgaattaccctgcatggggatatggacttagatacaagtatggtttattcaaacaacacataacaaaggatggacaagtggaagttgctgaaaactggcttgagatgggaaatccctgggaaattctgaaaaatgatgtctcttatccagttaaattctatggagaagttatttcagggccaaatggaagtaaacagtgggttggtggagaaaatatattggctgttgcttatgatgttccaatacctggatacaaaactagaaccactataaacctgcggttatggtccactaaagtttcaccagaagaatttgatttgcaagcttataattctggagatcatgccaaagcatatgctgttatgaaaaatgcagagaagatctgctacgttctgtaccctggtgatgaatcaatagatggaaagactctgcgactgaagcaacaatacacactatgctctgcttctctccaggacatctttgcacgctttgaaaggagattgggaaagagagtaaattgggacactctcccagataaagtggtggtgcaaatgaatgatactcacccaactctctgcattcctgagataattaggatattggtggatgtcaagggtttaagttgggagaaagcctggaatattactaagagaacggttgcttacacaaatcacacaattctaccggaggcactagagaaatggagtttgactcttcttcaggatttgcttcctcgacacatggaaataatacgaaagatagatgaggagttgataaatgaaatcatttctgagtatgggatagatgatctggacttattccaacaaaggcttaaaaaaatgagaatactagaaaatatcgagttgcctaactcagtgatggagctgcttagcattacagaagagactccagctgttgatcctgtgaaggaaattgatgttgatgatactgatgtaaaggcaactgaaaaagaagatggtgatgatgatgatgactatgaagtagtagaagaggaacaagaagaagataatgaagaaccatctgtcgaagaggatactagcaataaaatagaactgaaattcaaagttgatccaaagctaccaatgatggttcgcatggctaatctatgtgttgttggtgggttttctgtaaatggggtagctgagattcatagcaagattgtaaaggaggaagtttttgatgaattttacaagttgtggcctgagaaattccagaataaaacaaatggggtgactcctagaagatggatccgtttctgcaatcctgatcttagtaaaatcataaccaagtggattggaacagaagactgggtgacagatcttgagaaattggctatacttcgcaagtttgcagataatgaggatctacagctagagtggatagaagcaaaaagaagaaacaagattagggttgcatcatttctcaaagagaaaaccggttatgttgtcaatccaaatgcaatgtttgatgtacagttgtatagatttagtattccttgcaacggttgggcagtaggatcacagactcagtcatcttcatctctgttgtcatag

SEQ ID NO: 37000 - DNA, 129 bp, Glycine max
  Peptide Sequence Number=SeqID_153778
atggagaaagatgaattagagagggataaagacgatggaaggaggaggtattttgaaaacaaattcaagcaatccatgagattcataatcctcagcaacaacatcctaattcttactgtcggccactga

SEQ ID NO: 37001 - DNA, 1989 bp, Glycine max
  Peptide Sequence Number=SeqID_153779
atgattcccgatctacccctccccttcctcttctccttattcatcatcttcttccacctcgctgaatccaaaccctccctcaccgccacgccaaccaccctcccagcctccggcgccaccgtcaatctccgctggtccggcatcccttccccctccgacctcgacttcctcgccatctattcccctccgacctccccgcacgacaacttcatcggatacctcttcctctcgcagtccgccacgtggcgcaccggctccggcaacctctccctccccctcgtcgacctccgctccaactactcgttccgcatcttcagctggacccgcgccgagatcaaccccaagcgccaggaccacgatcacaaccctctcccggtcacacgccacctcctcgcgttttcggaggaggtctccttcgcccctcaccgtgggccccaacagatccacctggcgttcgttggggcccacggcaaggaggaggatatgcgcgtgatgtacatcacgcgcgatccgagagagacctacgtaaggtacggggagagggaggataagcttgatgggattgcggtcgcacgtgtggagaggtacgagagggagcacatgtgcgacgcgcctgccaacacgagtgttgggtggagggaccctgggtttatccacgacgccgttctcataggtttgaagaagggacagaggtattattacaaggttggaaatgataacggaggttggagtgcaactcaaagttttgtgtcgaggaatagtgattcagacgaaacaatagctttcctgtttggtgacatgggaacagctgtaccatacaatacgtttctgcgaacgcaggatgaaagcatatcaaccatgaagtggatcctccgtgatgttgaagctctaggcgacacgccagcctttgtgtcgcacattggagacattagttatgcaagaggttattcctggttgtgggaccattttttcgcccagattgaacctgttgcctcccaagtggcataccatgtttgcattggcaatcatgagtatgactggcctttgcagccatggaaacctgattgggccagttatggaaaagatgggggtggtgagtgtggtgtgccttacagtttaaggtttaacatgcccggaaactcttcagaactcactggaaatgctgcagccccaccaactaggaatctttattactcatttgatatgggagcagtacactttgtgtatatttccacggagaccaattttgttcctgggagcaaacagtacgacttcttgaagcatgatttggaatcggttaacaggagcaagactccttttgtggtggtgcaagggcacaggcccatgtacactaccagccatgaaaatagggatgctgctttaagaggaaagatgcttgagcacttggaacctctgttggtgaataacaatgtgacacttgccctttggggtcatgttcatagatacgagagattttgtccactgaataacttcacttgtggtgttaatgcgggtcacaatgcaggggacaaaaaaggatatactgttcacattgtgatcggcatggcagggcaagactggcaacctgtctgggaaccaaggccagaccatcccgatgatccaatctttccacagccaaaatggtctctgtaccgcggaggcgagtttgggtacacaagactcgtcgctacaaagcagaagctcgtgctttcttatgtgggaaaccatgacggtgaggtgcatgatcagttggaaattctggcatctggggaagttgtcagtggtgacggaggctgtagtattgctgatgctaattctaaagctggaaatgtgattgtggaatccacattgtcttggtatgtcaagggaggaagtgtgctgctgcttggtgcattcatgggttacgtttttggttacgttacaagtgcaaggaagaagtctgaggtgccagagagcaattggactccggtgaagactgaggaaacttga

SEQ ID NO: 37002 - DNA, 132 bp, Glycine max
  Peptide Sequence Number=SeqID_153780
atgggtgtgttgatttacacttcatttgtggaaaagaagcattatctgagtgtcagtgttattgtctcatggaagcaagaggcacacatggatgtacttgcttttaatgatgcagtgtcgtttgtgctgtga

SEQ ID NO: 37003 - DNA, 252 bp, Glycine max
  Peptide Sequence Number=SeqID_153781
atgagcagcggcggcggaggcgaaggagaaggagaaggcgcgtgtgagtcgaacgtcgctgattctgtggcacgcgcaccaaaacgacgccgcggcggtgcggaagcttctggaggaggatccgtccctgtgttgttttgttccggaaagcctctggctgatgcagaaggagctaaaagaactgccatgattgagcttttgaagtcacatggtggcttgtcgtatctgggtaccacatttctctgtctctaa

SEQ ID NO: 37004 - DNA, 114 bp, Glycine max
  Peptide Sequence Number=SeqID_153782
atggatggattgcgtccagatggcattcatgccgcaattttctaccatgtaccaaacacgaaagtgaaagaattgatggatgggtacaacatttttggcttctcaaagatttaa

SEQ ID NO: 37005 - DNA, 366 bp, Glycine max
  Peptide Sequence Number=SeqID_153783
atgagggatctgaacaagattgagattttgggtgtgttggtgttaacagtgaaaaatggtattggaaaatatgaggaggggaaggaacaagagcaagtttcgttttgcaccgtaggaactgtaatttcactaaccgcagggaaggagcacctgagttcaaacatttgtggtcctttgtacgagggaggtctcggccaaagattctttgtcaatctcaaccaagcaattattcttgctttaaccgagaaactcattaattttgattatcattgggctagacttatccgagctagagccttcaaaggtgctttacatcctcgttgttatataaaatcctcccttcggtttggtatgaagaacttctag

SEQ ID NO: 37006 - DNA, 420 bp, Glycine max
  Peptide Sequence Number=SeqID_153784
atgagtgaggtcttcgaagggtacgagcgccagtactgtgagctctctgctaatctctctcgcaaatgcagttctgcctctcttgtttctggccaggaacagcagcagcagaagttgtctgagattaaagcgggactagatgatgctgatgttctgattcggaaaatggaccttgaggcgagaagtttgcagccaagtgtaaaagcaatgcttcttgcaaagttgagggaatacaaatctgatctaaccaatttgaaaaaggaatttaaaaggctaacatcacctaatgctgacgaggttgcccgtgaagaattgttggagactggaatggcaaatacacatttgagcagtcccatcctctatggtcttcccatcactacttcattgcaaagctccctaaaattcagtattctactgtaa

SEQ ID NO: 37007 - DNA, 498 bp, Glycine max
  Peptide Sequence Number=SeqID_153785
atggagttcctatcctccattcaaggatacatttcacatagtgatatagaaatgagtgcatctagaaaagtgctgtggttcacagtatggaatgtttttttcgcaactgtattttctggctcaattctatctatgttcaataccctccttgatcccaagaacattcctgggaagctggctgttgcagttccagcacaggcatcattttttattacctatgttgtcacgcaaggatggacaagcgtgtcatcagaactcttccgtgtaattcctttcattttcagttggataacgaggcctttcaccagtcaagatgatgaatttgaagttccatctactccataccacaaggatattccaagggtccttttctttggacttcttggtattacatatttcttcctagctccattaattttgccgttcctcttggcctacttttgtcttgcttacatcatttttcgaaaccaggtcagcatttctttggatgttatttga

SEQ ID NO: 37008 - DNA, 324 bp, Glycine max
  Peptide Sequence Number=SeqID_153786
atgtacaaaagggttactcaattacgatctgattccactcagcagaagaatacgcagcgtggttttcctggactttttagccgaaaaaacagtgttatatattatgaaaagaaattagaggacattgaggagaatgtgagattgaagcagttagaggcttcattggcaggagaagtatgtgtaatcgtacaggggcttaccaacctcaatcaattggaaattttatttcccttcttgacaagtattctaaccatttcattaggaatatcagttagttcagacaaggttgtcagaattctaaaccatgacgctgttaattggtag

SEQ ID NO: 37009 - DNA, 471 bp, Glycine max
  Peptide Sequence Number=SeqID_153787
atggagccattcgccatctttataaaaggaggtaattgtgatgcgagaagatattacccaagtgcgaagaggggtagtgggtttataaatgtatatgcaccaaagtatgatacagctgggaaattttggcctattatacacaactcaatgatattttctctggtactcatgcacatcattgcagtgggaatctttgctttgaaaaagctttctctagcatctactttgacgatgcccctaccagtcctcacacttctctttaatgagtactgccgaaaacgattcctgcccatatttgttgcatattctgcagagagtttgaaaaagaaggataggcaagatcaaaatgatgctacaatgacacagttttatgagaatttggtaaatgcttataaagaccctgcattgcttccaattcaacattcacaaaacaatgacaatcttcgcagtccccttatatctcaggcttaa

SEQ ID NO: 37010 - DNA, 508 bp, Glycine max
  Peptide Sequence Number=SeqID_153788
ctgaggcgcttccgaaacgtttccgtaacgttttccgtgaggaatttcgcaaaggttttcgaccgttcttcgacgttcttcattcgttcttcatcgttcttcgatcttcaacgggtaagtacctcgaaccaagcttttcgattcattctatgtacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 37011 - DNA, 450 bp, Glycine max
  Peptide Sequence Number=SeqID_153789
atggcggggtcatgtttccacgggcttaggctaaggatgtctaagagtaaagctttaccagacccttcatcttcctccaagacccagttggagagtgacgcggagaacgtagaaaggaagagatttgatagcatggaatcgtggtcattgatattcgactcaatggagacatgggagacttcaaaggaggaccaggagggagaaaaagaggaatgggctgcagacctgtctcagctttttataggtagcaagtttgcttctggagctcacagccgaatttaccgtggaatctacaagcagagagctgttgctgtgaaaatggtgaagattccatcccaggatgaggagaaaaaggccttactagaggagcaatttaactttgaagtggctttgctttcacgtctcattcatcacaacatagtgcagggggttttgtctatgtggatctga

SEQ ID NO: 37012 - DNA, 561 bp, Glycine max
  Peptide Sequence Number=SeqID_153790
atgacccttaatttacagtttattgcagcatgtaaaaaaccgcccgtgtactgtatcataacagaatacatgtcacaagggactctgaggatgtatctaaacaagaaagagccgtactcactctcaacggaaacaatactaaggttagctctagatatatcaaggggcatggagtaccttcattcacaaggtgtgattcacagagacctcaagtcaagcaatttgcttctcgatgatgacatgagggttaaggtggcggattttggtacatcttgtcttgaaacacgatgccggaaaagcaaagggaactctggaacatatcgttggatggcaccggagatggttaaggaaaaaccttatactcgcaaagttgacgtgtacagttttggtattgtgctttgggagctcacaactgctctacttcccttccaaggaatgacaccagtgcaagctgcttttgctgtggctgagaagatgtggcattgtctgaaagatgattggtccggcaagttctttgggtcggtattatactcaatgattggtcggacaagttctttttaa

SEQ ID NO: 37013 - DNA, 177 bp, Glycine max
  Peptide Sequence Number=SeqID_153791
atgagactttgcatctctggatgcccctgttgggtcttcatcacctgctgctcaggcttcaaatacagactgcatagtgggcccaaggttggacggttcatttccaacttgtgtaaggttctagatgattcgtcgagtggagaagttagctcagggataatggctcccagtggctga

SEQ ID NO: 37014 - DNA, 324 bp, Glycine max
  Peptide Sequence Number=SeqID_153792
gaatcacccccacaaagacactcagtgaacccggagaagtccaacagggccctggggtttccagctctagttacgggcctccgtagtcctatagggtgcccattccccccggcaaggtcacatcatcatgacataggtaaagtgcttgtcacctccggcaagggcatcaggtcccctactaatcgagctttcatcaagaagtactgcgtccccaggcaggcgcagggcgaaacaccacagcagcctggggatggccgacagcgggcaacagacgcacggccatcacctctagagttcacctcagctcatccacaaaaaggttag

SEQ ID NO: 37015 - DNA, 348 bp, Glycine max
  Peptide Sequence Number=SeqID_153793
tcgagggtgtcacagtttttccaagaggatggttgtgggttggcaatgtgggatgcaagtgttgcggaacaaattaagattgatgagaatgtggaggtgattggatgggatatatgtaggttgtttggtggtggggtgcactggtgttgtggaaaggataaaggttctagattttacgttgatgatcatggacttaagagtgattactacttgagtaatgaagacagtgaaaaagatgaggtcatggtggtggggggtttgggttcatggtggcagtggggatcgagagagaaattatggtttgcaaaaagcatgtataaagagcaagaaggtcaggagtttgaataa

SEQ ID NO: 37016 - DNA, 2007 bp, Glycine max
  Peptide Sequence Number=SeqID_153794
atgaggaagaatgggtggcagctaccttatcatcctctccaggtggtggctattgctgtgtttatggctctggggtttgccttctatgtgttctttgctccttttgttgggaagaagatgtatcagtatgttgttatgggtctctacacacccctgatcacttgtgtctttggattgtacatttggtgtgcagcatctgaccctgcagatcctggggttttcaagtccaaaaaatatcttaaaattccagatagcaaaaagcttgatggactcaagaattctaaactaggaggcgaatcaacttcgtcaatgcatgatggaaatgcttcaactgttggaccaaaatcggtcgataaggaagaattgggaactgaagcaagttttaaagatgctgctatttctacagagaagaaaaatgcatcatcaccttctttgtcccgtctcctattggtttgctctccttgtgcttatatatgtggttgctcaagttcaagtaacgaatcttctgatcaacaagcaagtgaagatggcatgttctattgcagtttgtgtgaagttgaggtcttcaagtatagcaagcattgtagagtttgtgacaagtgtgttgatcgctttgatcatcattgcaggtggctgaacaactgtattgggaaaaggaactacagaaaatttttcacccttatggttgcttctctcctcttggttcttctcctgatcaccgtatttctgaaatcctctgttgtctgttctcaaaatactattccttcattcctttgtgaggctactttagttccccatcctactggaactggattaggaaatgagagcttacttattcttcagtggttgactgggatacttgtgcttatctgctgttttgttgagaagaagaaattttctgtggatatctcctccaaattggggagcagtttctctctggttcccttcgttattgtggtggcagtttgcaccattttggctatgattgctaccctaccccttgctcagctgttcttctttcatattcttctcattaaaaagggaatcaccacatatgattacatcatagctttgagggagcaggagcaggagcaacaaggcattggaggtcagcagagtccccaaatgtcgcctgttagctcccttactggaatgagcagtgcaagctctttttctactttccatcgtggagcatggtgcacacccccgcgtctgttccttgaagatcagcttgatgtagtgcccccagaaacggcttctgtaagttcactgggaaagaagacaatgagagacgagccggttaagaaaaagaatcccggagcagtcaaaatcagtccatggacgctggcacggttgaatgcagaagaggtttccaaggctgctgcagaagcaagaaaaaaatcaaagattcttcagcccgtgacaaggcataataacgagccattcaggctggagccagatcgcaactctggcagcagtggccggcgaatgagccctaggattgagaccaacagaagacggcccggtaaacggattcgcctgcctgccgacttgcctatggaggccataccaaaattttctgccagcaacattgacaaaggcttcattggaacatctagtttggcgcctctcccgcccaaagcacggagcgtgtttcaaccaagtcaagcagtgtcaagctcagccgggatggttgcctcctctcctgaaagcagtctagactcgcctgacattcacccgtttcgtgtgtcttccaccgaagctgaagaagcaagaaggctttccgatctttctgctgctgccgacgtgaacctgaagggaatccctctgtcaaggtcaactagtgatgggtatgaggcctctggtggggaagatagtgacagggttcccaccaggattgttcagaggtccacaaattggactaatatgctcttcagtgctgatcagtacgagagaccttttgagccaaaatcatcatctagcgtggtttatagcagaaagttgtga

SEQ ID NO: 37017 - DNA, 387 bp, Glycine max
  Peptide Sequence Number=SeqID_153795
atggcatgttggtacaaagagctggcagaaagagatgtaacaaaaatagatatagagagagagagagagaatggggtagttttttttgtgtgtagagtgaggaaaggtttgtctgattcactcagagacaaaccttacccaggtcatggaagatgtaaagaaatggccttttctttttctgggtttttagatgttggggtgcttgcttgcaaagctttttacttttgcagagagaagcgaatagatctctatgctgtgtggtgtggtgggagagcaaaatcatgttactcacaagccacactcactgcaatggacagttgtttggttctgcttttgtttgctcaggaaaaaacgcatgcaacgctttcgctctcttcactctcttaa

SEQ ID NO: 37018 - DNA, 2730 bp, Glycine max
  Peptide Sequence Number=SeqID_153796
atgaaccatcttgtttcttacactgattcagctccgaaggaacttcagcagcaaactaaggcatccttaaaaggagatgatgggaagaaactcattccagcaaggaagccacaggcagtaattgttgcaaggaggccagactctggtggcaaagaaggttctgtgatctctcttcttgccaaccactttttggtgcaatttgatccatcacagaagatatatcattacaatgttgaaatcactcctcatccctccaaggatgttgccagagcaatcaagcagaagttggtaaataacaattctgcggtcctctgtggtgctactccagcatatgatggtagaaagaatctttatagtccagttgaattccaaaatgacaagcttgagttctacataagcctcccaatccccactagcaagctgacttcaccttatggagaaatgtctgacttgaaagagaagcatgaacagcttaaacttttcaggataaatatcaaactggtctcgaagatcaatgggaaggagttgagtaactatttgagcaaagaggatgatgattggattccacttccacaggattatctgcatgctttggatgtagttcttagggaaagtccaaccgagaaatgcatacctgtagggaggtcattctattcaagttcaatgggaagaagcaaagacattggtggaggagctgttggattgagaggcttctttcagagtcttagaccaacacaacaaggacttgctctcaacgtggatttctcagtaactgctttccatgagagcataggagtgattgcatacttgcagaagcgcctcgagtttcttcgagacctgtctcaaagaaagacagctcaattaaccggtgaagagaggaaggaagtggagaaggcattgaagaacatcagggtcttcgtttgccatagagaaactgttcaacgatatcgtgtctatggcttgactgaggaggttactgaaaatctttggtttgctgacagagatgggaagaatctgaggttggtgaattactttaaagatcagtataactatgacatacaattcagaaaactgccatgcttgcaaattagtaggagtaagccttgttatctccctatggagctttgtgtgatctgtgaaggccagaagttccttgggaaactgtctgatgatcaaacagcaagaatactcaaaatgggctgccaaagaccgggagaacgaaaaaccattgtcgaaggagtcatgagaggaactgttgggcctaccagtggtgatcaggaaaaagaattcaaactccaagtatcaagagaaatgacaaagttgactggtagaattcttcaccctcccaaactaaagcttggagatggaggtcatgtgagaaacctgactccttcacgtcacgaccgccagtggaaccttcttgatggacatgtcttcgaaggaactacaattgaaaggtgggcactaattagttttgggggcacacctgaccagaagtccaatgtccccagattcataaaccagttatgtcaaaggtgtgaacaattgggcatttttcttaacaagaacacagttattagtccccagtttgaatcaatccaaattcttaacaatgtcacccttttggaatctaagctcaagaggatcctgaggacagcctcaaacaatctccagcttcttatttgcataatggagagaaaacacaaagggtatgcagacttgaaacgaattgctgagacaagtgttggtgttgtgagccaatgctgcctgtaccccaatctcaacaagttgagttcacaatttttggccaatttggccctcaaaatcaacgccaaagttggtggatgcacagttgccttgtacaactcattgccatcgcagttaccgcgcctctttcatattgacgagccggtgatattcatgggtgcagatgtgacacatcctcaccctctagatgatgtcagtccatctgtcgctgctgtcgtcggcagcatgaattggccaacagcaaacaagtacatttcaagaataaggtctcaaacacatagacaagaaatcatcctggacctaggcgcaatggtgggggagttgcttgatgatttttaccaggaggtagagaaactccctaacagaatcattttcttccgagacggggtcagtgaaactcagttttacaaagtgctggaagaggaacttcaatccatcaggtgtgcatgctcaaggtttcctggctacaaacctaccattacttttgcagttgtgcaaaagaggcatcacacaaggttgtttccctttgaaactgaccagtcttcaactcaaaaaaacaattttctatatgaaaacattcctccagggactgtggttgattctgtgatcactcatccaaaggagtttgatttctatctttgtagccattggggtgttaaaggaacaagtaggccaactcactaccatgtcttgtgggatgaaaaccagtttacttctgatgaacttcagaaactggtttacaacttgtgctacacttttgttaggtgtaccaagccaatttctttggtgcctcctgcatattatgcacatttggctgcatatagaggcagactctaccttgagagatcagagtccttaggtttattcagaagcacatctacactatccagagctgctcctccaaagacagcacctctacctaaacttagtgaaaacatcaagaagctcatgttctattgctag

SEQ ID NO: 37019 - DNA, 576 bp, Glycine max
  Peptide Sequence Number=SeqID_153797
atggacaacttacgtcaggagaaagttcaaagatttgaagaatttgttgacaaacgcctgaaacctgatcttgttcatgctattgctcagcggtttactgaggtctcaaattatatcttgcaaaatggatttaaagaaacaattacggacaaggtatttgaacaacagaaaattttgtatccattttcagttttatatataccgttaggatcaattagcaccattacacgactcatcatcatactatcaaatattaagatttgtgctatgttgcccaacttgcatctagacactccccgctccctcccccctccttctcctaggccagatacacaacacatatttgtggatgtaggatttggattccatgtggagtttacttggtcagaagctctgaactacatagaaaaaagggaagaaaagatagccaggcagatagaggagtacacccagttgattgcatctattaaagctcagattaagcttccagcatacactacacacagccttagaccacatgagataggcaaaaagcttataaggctggaaagcccacaaagcgcggaatgcgcttaa

SEQ ID NO: 37020 - DNA, 3879 bp, Glycine max
  Peptide Sequence Number=SeqID_153798
atgaatgaaaccacactcaacaatatagaaagttacctataccttcatccaagtgaaaacccatccattgcattggtctccccggtactggattctaccaattaccattcatggattcgttccatgattaccgcattaagcgccaaaaacaagttggaattcgttgacggaagtgcgccggaaccactgaaaaccgacaggacgtacggagcttggcgctggtgcaataacatggtgctatcttggatagtacactccgttgccgcttccataaggcaaagcatactctggatggacaaagctgaagacatctggagagacttgaagacgagatactcacagggagacctcttaagaatctccgatcttcagcaagaagcgtccacactaaggcaaggaactctctccgtaacagaatatttcactcggctacgcgtcatctgggatgaaattgaaaacttcagacccgacccagcttgtacctgcaacgtcagatgttcctgctcagccttcgccattattgcacaaagaaagcttgaagatagagctatgcagttcttgcgtggcttgaatgaccagtacaccaacattcgatcacatgtgttgctcatggatcccataccagcaataacgaaaatattctcatacgtggcgcaacaagaaagacaattgttaggtaattcctctcctaaccttaactttgaacctaaagacgtttccattaatgctgcgaaaaccatctgcgattactgtggacgcattggacacactgaaaatatatgttacaagaaacatggaatgcctctgaatcatgagacaaggaacaaaggcacgagtggaagaaaatcgtgtacccattgtggtaggatgggccatactgtcgatgtatgctatcgaaagcatggatacccaccagggtataaaccctacaatggaagatctactgtgaacaacgtagtgacgatggatagccaacccatggaagatcaaaatcagcatcgtgaatcccaggacgttgtgcgattctcacctgagcagtacaaggctcttctagctttaatcaaacagtcatcaacaggaagcacgacattggaacaaacgaaacaagttgcctcgatttcgtcttgtgccatagataaaccctccagcccaggtacattccaatctttcactagcccatggattctggactcaggagcaacggaccacgtgacttgctccttgagtaatcttcactcatatgaatgcataaatccagttcccgtaaagctccctaatggtcatcaagatgcaagcactcgtacgaagattggtatagttgaagagaaacatggtctctatcacctcataccagatcaagagaataaagtcatttgctcgaccatcattcaccctaaatgcaaaattatacctatagacctttggcattttcgaatgggccacctttcaacagaaagattacaatgtatgaagcctcattaccctattttgtggaatgataaaacttttgtatgcaatacatgtcattacgcaaaacataagaaacttcccttttcttctagcacctctcatgcatctcatatttttgacttgcttcatgtggatatatggggtccttgctcaaagccatctatgcacggtcataaatactttttgaccattgttgatgatcattcgagattcacgtgggtacaccttatgcacactaaggctgaaacccgagacattatcgtgaacttcattgcctctgttgaaacgcaatataataagaaaattaaaaagataagaagtgacaatgggtatgagtttcttatgcccagcttctatgcatcaaaaggaatcatgcatcaaaccacttgcgtagagacacccgaacaaaatggtattgcagaacgcaaacaccaacatttgcttaatgtgacacgtgctcttttatttcaagctaatttgccatctaacttttggtgctatgcactgttgcacgctacatacctagtaaattgcatacctactccattcttacataatgtatccccatacgaaaagcttcatggacacttacccgaaatatcacaccttcgcgttttcggatgcctatgttatgctagcacacttaaagccaatcgtaagaaactagaccctagggcgcatccatgcattttcataggattcaaggctagcactaaaggatatctggtctataacttgcatttgcatagcatcatcacatcacgaaatgtcgttttctatgaagatcatttttcgcaaatacccgaaacacaatcctcacatccagaatccatggaaccttcctcatatgccgaagcatctcagtatgactgttggattaaagccatggaagctgaattacaagctctacaatcaaacaacacctggaaactcactcttttacctcctcataagacagcaattggatgcagatgggtatataaaatcaaacatcgagcggatggttccatagagagatacaaggcgcgtttagtagcaaagggttatacacaaatggaggggcttgactatctttatacgttttctccagtggccaaactaaccattgttcgtttactcctagccatggttgcctttaatcagtggcacctaagacagctagacgtaaataacgcctttctccacggcgagttagatgaggaagtttacatgcaagttccacatggcttgtcggttccaaactcacaaatggtgtgtcgattgcagcgttcactttatgagctcaagcaggcaagccgtcaatggttcacgaaattgtcgggtctcctaatatctcttggttttgaaaaatctcactcagatcactcactatttttgcgattcactggttctattatcacagccctcttggtgtatgtggacgatattatcttaactggcaacagcgaatctgaaatacaagatgttatcaagctccttgatcaagcttttaaaatcaaagatcttggaaatttgaaatacctcctcggtatggagattgcacgctcttcctcaggtatccatttgtgtcaaagaaagtacactttggacatactttctgattcgggaatgctgggatgtcgaccgaatgtaaccccaatggactattcgaccaaactacaagctacagcagggacgccattatcaacggaagcttcttcttcttaccgaaggctcattggtaggctcatatatctcaccaatactcgccctgacatcacgtacgcagtacagcagcttagccaatatatgtccaaccccaccagtgttcatcaacaagcagcttaccggattcttcgctatctcaaaggaacgccgggctcaggcatcttcctttccgccaccggcactcctcagctccgagcctttagtgactcggactgggcaggatgccaagactcaagaaaatccattaccggcttcgtcatatacttaggttcatctcctgcttcctggcagtctaaaaagcagtcaacggtctcgcgtagttcctcggaggctgagtatcgagccatggctacgaccacctgcgaactgcagtggttgacctaccttctccaagactttcgacacaacttcactaagccagccaccatctattgcgataatcaatccgcaatccagattgccactaaccccgtcttccatgaacgcacgaagcacatcgagatagattctcatatagtccgtcaaaaagtcacctcaggccttcttaagcttcttccagttccatcttccttgcagcttgcagatatcttcaccaaagctttgcctcctatggtttttcagaacctttgtaacaagctgggaatgatgaatatccattcccagcttgagggggggatattagcagcaccttgtgacagttag

SEQ ID NO: 37021 - DNA, 333 bp, Glycine max
  Peptide Sequence Number=SeqID_153799
atgactgcttcgatggctggaccgaaccgggtctgtttcgaaactaattgcaacgggggtctaatatttacgttgattccgccattcctactggcggcaagcatgtatcgccactgccatcagcgatatacatgtgtaccgccattgccaaaagcggaaccaaagctgactcacctcgtgtcgcaattcgtattggcggaaccaaagctgactcacgtgtcgccattcgtattggcgggacatgccaacgtgggcagtcccgccattggcacctgcagaacgcgtaggggatgctttttgcagcgtttcagtctgaaaaacaaatgggtatag

SEQ ID NO: 37022 - DNA, 651 bp, Glycine max
  Peptide Sequence Number=SeqID_153800
caaggtggacaagcgtacgcagtaacgggagatttaacccgtgaggcagatattcaactgctttatcagcaagtctgttcgcttgtacaatccattgatattgttgttaataatgcgggtggctccggccccacagaggactggacgtcttctttgccagaaacctgggcggctgggtatgataaaaatgtcctttcagccttacgtgtcattaatctttttcttcctgggatgcgtgaacaaaaatggggcagaatcattaatatttcgagcctggcagcgttgatgcctcccgccaggcgtccggattatgctgctgctaaagcagggattattgccatgacctcatcgctggcaaaagcggtcgcacacgatggtgtaaccgtaaatactctctcaccgggtactattcatagtgcaagcctcgaaaaagcatttcgtcaaacggccaaagatgcagggttttcagctgacgcgccctgggaagatattgaacaggccgtattgcccctgtatgccaatgtgcccatggcgcgcgttgggacgctcaaagaaatagcggacgccatcacctttctggccagcccgttgtcgggttacataacgggttcaaatttaaggcttgatggcggtatgtggcccggactttaa

SEQ ID NO: 37023 - DNA, 293 bp, Glycine max
  Peptide Sequence Number=SeqID_153801
atggaggagaggaagaagtatgtgtgcaagtattgcagcaagagctttccttgtgggaagtctcttgggggtcacatcaggacccatatgatgactgaagaaagaaacaacaacaacaatgttaatgttgttgttgatggtgctgatgacaaggacaacatcaacaggttcatcaagttgggtggtactgtgatgaggaataataataacaagaagagagatttatcatggtgtgaagatagcaataacaatcccatttatggcctcagagagaaccccaagaaaacaatgag

SEQ ID NO: 37024 - DNA, 888 bp, Glycine max
  Peptide Sequence Number=SeqID_153802
atgcgtttacaagccaatgcccaatcagttgataatcaagaaactgctagatttgcaaagtggattctagatattggagatggagttattgggaatgaaaatgatgaatatgctacagttgaaattcctgagtacctactgattactgaatataatgacccaattgatgctatagttaggtcaacattcccaaatttatatcaacaccacagtaatcctgaattcttcaaatgtagagcaatattggcttccaccaatgaaacagttgaagaggtcaatgattatatactttctttgattccaggtgaacacatggaatacctaagctctgattgtataaacaaatcaaaaagcattgagagttggcatttccaatcaattaccaccgaatttcttaattcactaaacacatctggtttgccaaatcattgtataaagctaaaaatcggtagtcctataatgttgctaagaaacttagaccaaacacaagacctgtgtaatggtactagattagtagttacaagactagctaaacatgtaattgcagctggaattatttttggcaaaaatcctgaccataatgtttacatcccaagaatgtcaatgtccccttcacaatcaccatggccttttaaacttttgagaaggcaatttccaatcatgctatcttatgtaatagcaattaacaagtctcagggccaatcactttctatggttggactttatttgccaaaacctgtctttagccatggacaattatacattgcattatcaagggtcaattcaagggaaggattaaaagttcttattcatgataaagacaaaaaaaatatgacttctactaccaatgtagtttttaaagaggttttcaaaaatcttacaaggtaa

SEQ ID NO: 37025 - DNA, 219 bp, Glycine max
  Peptide Sequence Number=SeqID_153803
atggatagttggtcatattttcaagccttaagaatgaaggatgatttcggatacaaagaggagttgtggaacatgaagacaatgttgaggaaaatagtgattaggaaaaatgttgaaaaggttcacttagatgacaatgtggatgagagatgtgcaggagatgatgatgggattgaagtaataaggtttagggctaacagtaacaatgctgaagagtga

SEQ ID NO: 37026 - DNA, 702 bp, Glycine max
  Peptide Sequence Number=SeqID_153804
atggaggggagcatagatgtggctctcgtgaaggaattttatgctaatctttatgtctcagaggataagcctccaaagcaagttagggtcagagggcatttaattaagtttgatgtggattccctcaacacttttctggagactccagttgttctagagccaggggagactcttcctgcttactccaagttctgcagactgagaccagaccctcaggagctggctgcccgactttgtatctctggtagaggatttgttttgaatgctgagggcctgccatggaagttgttgaggaagtacctcactactctagcgcagacttggagcgttctgtcttatttcaaccttgcccctacatcacgcacttttgatctgaacttggacaaggcaaggttggtatatggattagtgatgaagatggaaatgaatgttagagccctcatctctggacagatcactcttatggctcattccaactcctcgaggctcgaatttccagccctcattactgccttatgcatggcccgaggagtcacctcagattccttgacttttgagtccctcagcctagccattaacttggcttacataaagaagaactattggacgaccccacggtcaactttccagggacccgcaaggccagggctagaggatctgagggtccatcttctgctgctccctagacatctactgcactag

SEQ ID NO: 37027 - DNA, 882 bp, Glycine max
  Peptide Sequence Number=SeqID_153805
atgggagaggatgtttcacgtcaatggactgaggaagaagaagacatgtttcatgaggttgtctacagcaatcctgcatcattgggtagaaacttttggaagcatttgtcagtcactgtctcttctcgaaccagtaaagaaattgtcagctactattttaatgtttttattctgcggaggagggctgctcagaacagatccagatttttggatattgatagtgatgatgatgaatgtcaaacaagaaactctaggatttttggttttgaaaattctgatgattctgccattgagtctcttggtgatgaagatgtccgtgtggaaaaccatgataattattctgatgaagatgatgatgacgataacactgatgatggaactgaagataatgttcatggagtaactggatgtgatattggaaacaccactgagatagagggtgagattgatcaaaacccatcaaattcgaaggtgaactcacagattgagccttggagtaatcctgatgagcatgtcaatgggactcctggaatcctgaactacaatattgctgtcggggatgactcctgtatgtccttcgaatgtgatgccaatatgcatgtgtcttgccattctcatggtttaggaggtgctagttccgctttgcaagctaggggatataattgtaatcagagtccacatacgcaaggaaaacttgatttgtccagcaatgagatggatcatgtttatttgatggagccctgtgtttctaaagattggtatcctggacctgaagtgactgaggtattaactcagtttttttggcatcagcttgacagatttaagctacttgagggtgccaatccaggtcttagaaagttccagtcatggacaaaggagagg

SEQ ID NO: 37028 - DNA, 522 bp, Glycine max
  Peptide Sequence Number=SeqID_153806
atggcacagaggatcacttctgtgaatgccatgtcagcactctgtgagactattgatgctgatgtgtcaaggtgttgcactcaattgggacagactcaagggttgaaccaagttcctgaatgccagtgttggctttggtggctcctgctttcagaaggacataatgaacttgggtggtgcatcaatgttcaacacaatttcaacaaaaaaattgcaattcttggctttgctttcaagaaggacactggtgacactagggagacttcaacaattgatatgtgcaaggggcttttgggagacaaggccaagttgagcatatatgaccctcaagtcactgaagaccaaatcacaaaggatctttcaatgaggaagtttgataaggaccaccctgcacatcttcagccaccaagccctacttcaataaagctattgtctgtggtttgggatgcttatgatgcactgaaggatgcacatggtgcttgcattctcaccgagtgggatgcgttcaagaagcttgattag

SEQ ID NO: 37029 - DNA, 678 bp, Glycine max
  Peptide Sequence Number=SeqID_153807
atggggtataagagatgccgtgaggctaatgaatttgaggatctttctttgaacaaggcaaaacgttttgaatgcaacaatgagctggtttcattagctgatattgttacgcccaacaaggcctttgctaagactgttattaaaggtgatgaagatggcttttacaacattcaatggtatgatccacttgaaacagatgctgccaaagaatctccatatagtggtgacaagaatggtaaaaccagtggccacttccgcagctgttctagtgaggatgatactggttctggggcgacatcattatcatctgcttcctcagattgtttggaatttgatactccgcagaaagtatttgttcctttggatgatgactatttagactttgattgctcacctagaaaatcagttcccattggaccaaatcatcaagccaccattcctgtttggaggggtaaagtgaataagatgttggagttaggcatatataatcatgacagtccctcctctggcttagtatcagctcatactgttgatgaagatgaagagaggctcatgggaacttctgtgctctcaatggatgagtttagctttcattattttagtagtaatgagattggacaaggcaggacagagtgtaactgcatggatcgttgctccatcagatgtgttagacagcat

SEQ ID NO: 37030 - DNA, 532 bp, Glycine max
  Peptide Sequence Number=SeqID_153808
gtttcttgatcctttgatgtttggggattatccaagctcaatgaggactagagtaggaagcaggctaccgaaattttcgcaatcagaagctgctcttgttaagggttcattagattttgttggaatcaatcattacaccacattttatgcaaaagacaattctactaatttaattggaaccctgctccatgattccattgcagactctggtgccgttacccttccattcaatggtactaaagctatttcggaaagggcaagttctatatggctgtatattgtgccacaaagcatgaaaagcttaatgatctatatcaaacaaaagtatggaaaccctcctgtctatattacagaaaatgatggttgcaatgtgaaaggttattttgtgtggtcactattggataactgggagtggtcagctggatacacgtctagatttggtctatattttgttgactacaaagacaacctgaagagatatcccaaacaatcagtggaatggttcaagaacttcttgaaacctacaaaataa

SEQ ID NO: 37031 - DNA, 654 bp, Glycine max
  Peptide Sequence Number=SeqID_153809
atgagaattagaaaccttctaatggggatagaattgctaattaaagtgaagagtaattttgctataaagtggtatatgttctaccaaggagatataaggtatggcaaaataattgatttcagcaatgctgatgttgcggtggatcagtaccaccgatacgaagaagatatacaactgatgaaggacatgggaatggatgcctatagattttccatttcttggtctcggatttttcccaatggatatggccaaatcaatcaggcaggagttgatcattataataaactcatcaacgcgttactagccaaaggaattgaaccatatgtgactctctatcactgggacctgcctcaagccttggaaaacaagtacagtggatggctaaacgcttcaatcataatggactttgcaacttatgctgagacatgctttcagaaatttggggatagggtgaagcattggatcacattcaatgagccacatacatttgccacccaaggatatgatgttggtctacaagcgcctggtcgatgctccattctccttcacctgttttgtagagcggggaactctgctactgaaccttacattgttgcacacaatgtcctactctctcatgcaacagtagcagatatttataggaaaaaatataag

SEQ ID NO: 37032 - DNA, 366 bp, Glycine max
  Peptide Sequence Number=SeqID_153810
atgaggctaacagtgcttggactttcaacaaaatgcttgctaacagtgcttggttgggactttcaaaccttgaagattgataatttaaatggtgcccaaaaagtcaaaaaacccagtcctgcacgtcctgcaaactcctgcaaccctaggctcgtaccctgtctgaaatcgccagtcaaagctgcgatttcagcacaggctcgaaatcgccagcttcaccggcgggacgctcctcaacctgaaatcgccaacagcagcagcggcttgccatccacgtgtcctgtgcccacgatgtcgccaatgaaggcccatgatagcagtatggaagacgtagaaagtaagaaggtgacaaggggaggaatatga

SEQ ID NO: 37033 - DNA, 504 bp, Glycine max
  Peptide Sequence Number=SeqID_153811
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtgggtttcgctggatag

SEQ ID NO: 37034 - DNA, 552 bp, Glycine max
  Peptide Sequence Number=SeqID_153812
cctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgtcctcgtcatctaattagtgacgcgcatgaatggattaacgagattcccactgtccctgtctactatccagcgaaacccacagccaagggaacgggcttggcggaatcagcggggaaagaagaccctgttgagcttgactctagtccgactttgtga

SEQ ID NO: 37035 - DNA, 201 bp, Glycine max
  Peptide Sequence Number=SeqID_153813
atggtgagcttcttcttgactaatattctccttgaagtggtgtctccaatcatcttccttctccattccattgtcattcatcttcaagaagcaaaggactccattgatgaagaagattcaaggcctacaggctccacatggagctacaccatgtggtatcaagagcatcttcatctaggttctatcattttccagtcataa

SEQ ID NO: 37036 - DNA, 210 bp, Glycine max
  Peptide Sequence Number=SeqID_153814
atgacggttgagggagaccgccttagaaacacaagacatgtgaggagatacatggagaaaaacgaagaaacaacaatggaagagaaggtaaagatgaaaactaatggaggtttaaggagcacctacttgaagctcttgtgctctgattaccacttgatggaaacttgcttgagaagcttctatggaggctggatctttgagcttcattaa

SEQ ID NO: 37037 - DNA, 180 bp, Glycine max
  Peptide Sequence Number=SeqID_153815
agaggaggggaaggaagctttaatcgtaacacatctagcaataatgtgaattttgaaagaaaaagggtaaaacacatgagaatttacgaaaagaaaaagaatatcgtattctttggaacacgagggttacatgtggagagcatcattagcttaaaaagtggatgcgtgagcggaatttaa

SEQ ID NO: 37038 - DNA, 1440 bp, Glycine max
  Peptide Sequence Number=SeqID_153816
atggcgagaacagtctccaacaacgacgatgaaacagcagcgaaagaagagggtgaggtgaaagatggcgtaaggaaggggccatggaccccagaagaagacgcgatcctgatggagtacgtgaagaagcacggcgaagggaattggaactctgtgcagaagaattctggtttgttaaggtgcggcaaaagttgcagactcagatgggccaatcatctcaggcctaatctcaagaaaggtgcattctctccagaagaagaacaagtcataatcgaccttcattccaagcttggaaacaaatgggcgcgaatggcagcacagttacctggtaggaccgacaatgaaataaagaacttttggaacaccagaatgaaaaggcgtcagagagcagggttacccatttatcctcctgaagttcatgcagaagccaatgcttaccatctacaacaccaccgctacttggaacaacaacaaccaccaccttattcatcttcatcattttctcttctcctatcttcatgttaccccaagaagctcaatgatccaaaccaaatccatcaccattccagtgcaaatccaatgcaaaaccaacctgatcattctgccgaccgttccatcaatccaagccagcaattcaagttttccaatgaaaacagtactggaaacaatggaaactttgcttttccaatgtctcctctttctccatatggatcatcctcctccacccttcttaaccacagttttggtggtgatcatggtggcttcattgcaggatctccctatgaacaaccctttcctttggtgcaaggctccaccactgacatctcttccaaccaaactccaacccctgcttcatcctatgctagtggggttgatggcttgatgggagcttcaagcatggttaataataacaataataacaatgattactatgaagttgcaccattatctcctcatcaaggaaacagtggcctgttggatgctctagtaatggaggctcagggactttatcacaatgagaagtcaaggagtgaggaggacttaaacttagctgggaagttgtcttgtaagagaaagaacatggaatacgcagaggagggaggcactgtgccagctggggtgtcagccatgaagaagaacagtggcaacagtagtaatgaaagccagagggatgatgatattagctcctctcaattgtcaaaagggaagaaacaaattggcgaggacccgttggaagagatgaatgggatggacgatgacttggttagcctgctcaaccaatttcccttagaaatgccaatgcctgagtggtaccgtagaggagaaaatcagtcattgggacttgaaaatcagcccaaagcttcatcaccagaccccgctgatcatgaacatgcttggactctcggaacttgctggaacaacatgcctcgcatatgctaa

SEQ ID NO: 37039 - DNA, 507 bp, Glycine max
  Peptide Sequence Number=SeqID_153817
atgctagttagagcaacccaccaagcactccatctagagaccgtgggggagagatggaggcagtttaaatcagacctcacgaggaaatgggcccttgcagccgatcaggacggtgtcgaggacactgtctgtgacaaatacggcatcagcaaggaaaagtgggcccagttttgccagactcgcagagacccttcttgggaggatgtgcgcatgaaggcacaggccatccaaaagcagaatactgccccccatgttttgtcttgtgggggttatgattatttggagcagaagctcctggctgagaagaccaagaagaagatgcaggaagctgcacaattaggaagtgttgatggcgtcatcgacgcttcatccccagtcagacgccacgtgaagtggaagatgacccgcacgaagaagacaggggagatgacgactgaggccgcaaaggaaatcgctgagaagattgtaagtcatgttcaacaaaccattacaattatgtttgaataa

SEQ ID NO: 37040 - DNA, 222 bp, Glycine max
  Peptide Sequence Number=SeqID_153818
atgaaggaagttagactgcaagtccctttaacttgtgcctctagaagtaaggaccttgtagaattggcaaagggttgtaagaaagttggttgtaagtggatcttcaagactaaacgtgactctcatggtaaccttgaacattataagactagacttattgctaagggatttactcagaaagatggctttgaatataaagaaacattttcaccaatcttatga

SEQ ID NO: 37041 - DNA, 690 bp, Glycine max
  Peptide Sequence Number=SeqID_153819
atgtatgatagtataaagtatgaagaagttgatatggatgatgaaaatgaacatgaacctggtgtgaatgaagaacaacatgttgattgttcggatgcgttcaatacatatgagtgggctcaatcaattgcttatgaaaacggatttttggcggtgattatgaggtcagacgctggtatgagaggaaggacttcatttgtgttaattggttgtgagaggagtggccagtataggtctgggaagaaagattttgttagaagagatactgggagtaggaaacataggcgtcccttcaagctttatgggaaaccagtggttgaagggcaaggctggatgatgaagttgatgtgtggaagtcataatcatgaattggccaagtcattggttggacatccatacgttgggcgattgagtaaggatgagaagacaattattactgatatgacaaagtcaatggtgaaaccaagaaacattctgctaacgttgaaggagcacaatgccaatagttgtacaaccatcaaacaaatatacaatgcaagaagtgcatatcattcttccattagaggaagtgatactgaaaagcaacatctaatgaagcttcttcaacgggatcagtatattcattggcatagattaaaggatgaagatgtggttttgcatatctggagggtgaacatgttaataatgtag

SEQ ID NO: 37042 - DNA, 311 bp, Glycine max
  Peptide Sequence Number=SeqID_153820
gtgaggttgcgttgaggaagtggatgatggacagagatgcactagggtgtagtgggcagagaatttcgaagaacttaggggaattagcgagtggtgactacctgacatttggtgagcagatgactcacccctgcaaccaacaactttctattactaacgatgttgagtacaccgaggcgtctacagactcagaccgaggtgaccatttggacatgtcgtctgaggagatggaggagtatcgagatctacagaggcaattggaaccaacatatgagaatgagagtaacgattcttctgaggacacatcttag

SEQ ID NO: 37043 - DNA, 432 bp, Glycine max
  Peptide Sequence Number=SeqID_153821
atgacaattgtggctattcccataggtgattttgatttgttcgatgcacaacaagaggatgatttagctgtcgaacacctggcaccaagcttagctactattagaatggagttgttccttggatacatgagtgatggtaacttttggaagatatactttgcaatcgtccaccctagacatagcaaaactaatattgctatttcatccactctacaacaattcgcggtatatgtgcaaataatggaagctagagcaatgttaactctggatttagacaaaagaagtaaggaaaagaaagaatctgacttatctactagagggaatattccctcaaaaagagaaggaacaagatctctttgtttcaagtattgttcagaagatgacataggtgtgacatgtgacctgagtctaaggagtgggatttgtaactaa

SEQ ID NO: 37044 - DNA, 501 bp, Glycine max
  Peptide Sequence Number=SeqID_153822
atggaaagcgattcaaaaacttttagttccattgggattgagttaggttcagatgcatcgtcagtaattaacctcgatgaatatatggtattcgataatgatagctcagcagccaaagattttttcaagaaattactttatcgacatgttactgcaattgatgaaaccctagattatcctgatgataaccacacatttattaatgatgtattcagtcagacgtcttcatttgatgaatatgtccgcgctgtcgaaggagttccaagagacgcaattaatataattgcatttgctgctcagcatgccaatgaaaataagatatcaatttcgaatataaggcactcagcacaacgatggtttcaagttaataaacattcagctctgaatagtaggcctgaagcagtatctttgctcgataaaatcattaacgaagtgtatcagcaagaagtactgtgggcaaaaagtacacattatatacccttgattatggttgctatgtag

SEQ ID NO: 37045 - DNA, 837 bp, Glycine max
  Peptide Sequence Number=SeqID_153823
atgacttctcgcaagcgtcgtgccgtgcccacaccaggggaagcgtccaactgggacacttcccgcttcacatctgagattgcctggcacaggtaccaagacaacattcagctccggaacatccttccggagaggaatgttgaactaggacctgggatgtttgacgagttcctccaggaactcaggaggcgcagatgggaccaggtgctgactcaccttccggagaagcggattgacgtggctctggtgaaagagttctattcgaacctttatgatccagaagaccacagtccacgattctgcagggtgcgaggacaggtcgttcgttttgatgctgacaccattaacgacttcctcgacaccccggttattttggaggacggggaggagtatacagcatacaccagatacctcagcactcaccccgatcctgacaccatcgcggccacactgtgcactccaggggggcgctttgtccttaatgctgatggtctcccctggaagctcctgaggaaggacatgacgacacttgctcagacatggagtgtcctttcttattacgatcttgcgcccacttctcacacttctgatgttaatcttgacagggcccgcttgatctacggtttggtgagccgcatggacatggatgtgggcagctttatatcacagcagatcagccagattgcccagtccagcacctcgaggctcgggttcccagcgttgattacagcgctgtgtgacattcagggggtggtttctgataccctgatctttgagtcactcagccctgcgatcaaactagcctatgtgaagaagaactgctggaaccccgcctga

SEQ ID NO: 37046 - DNA, 414 bp, Glycine max
  Peptide Sequence Number=SeqID_153824
atggcgcctactaggcaccctttggacctagagaaatccaatagggccttggggtttgtggctttgatcaccggcctctgccagtcctacggagttcatgtcaccccagcaaggcgtagggtgacgcacatcagaatgcgggcgcaccgccaccacattggcaggccgattgagctgggccactggacatggagtagtatctacaacatttggttcgccagtaggcagccaaccaccatggacaggtgcagatacatgaatgtctctaccggttcagcctcagttagcaggggtagggtaccaccccttttgtatgccctaccccggagcagtttggggcttaggtcgcatggcctggagactggcccgttgcccaggcaggggacaagcctgcagaatctgtggcgtccctaa

SEQ ID NO: 37047 - DNA, 294 bp, Glycine max
  Peptide Sequence Number=SeqID_153825
atgccttatgtccgatttctttcatcttctaattttattgtagtttctgcagatttaaaacaagcatttggttcttcgtttgaacataaatctattgtcattttcaacatgcagaactatcaacatgcaaagagatctgattctgcaaaagccgggatcaatagaaaacgtatcatgcagcagaagcgacatgctcatgctcagtcatcttcacaaccgacagttaactacacttcagaatatgatagtgagacatctgatatagcatgttctgcaagaaatcaatttacttag

SEQ ID NO: 37048 - DNA, 337 bp, Glycine max
  Peptide Sequence Number=SeqID_153826
gagttgatgatgttgatatagacatgaggatgcaaaaggtaactgtgatgggttgggcagaccaaaagaaggtattgaaaacagtgaggaagactggtaggagggcagaactgtggccatatccatacaacccagaataccatgccttggctcgccattacggcaatggtaattactttgcttctgccaagccctcctcttcttacaattattacaagcatggctatagttatggtgaagactttggctactaccacaagccaattggtgcagcaattattgatgagaaggccatgtccatgttcagtgatgacaaccctcatgcttgctctataat

SEQ ID NO: 37049 - DNA, 557 bp, Glycine max
  Peptide Sequence Number=SeqID_153827
ggccaatcaatttgaaggaaatataccctctcaaattggaaatctctcccagttgcagcatcttgatctcagctacaattcttttgaaggaagtataccgtcccaacttgggaacctttcaaatttgcagaagctttatcttggaggtcgtgctctcaaaattgacgatggagatcattggctgtctaatctcatttccttaacccatctttccttcgactccatatctaatctcaacacttctcatagcttcctccaaatgattgccaagctaccaaaacttagagaactgagtttaattcattgtagcctttccgatcattttatcctttcattgaggccctccaaattcaatttttctagttccctttccgtccttgatctttcctggaacagcttcacgtcatcaatgatactccagtggctgtccaacgtcacttccaaccttgttgagcttgaccttagtcataacctcttggagggttccacatcaaaccattttggccgtgtaatgaattctcttgagcacctcgacctctcatataatatattcaagg

SEQ ID NO: 37050 - DNA, 504 bp, Glycine max
  Peptide Sequence Number=SeqID_153828
atgttgctaagtagcaacgtcatccatatctgtgtaagagtgatcatgttggtgcgcatgatccgcactcgtctctttgcagcggcacgggtgtggatatggagcccactgaaagtgacgacgcgtagccctctaaaggcgagggagtgtagccctctgaagttgaggacgtgtcaccctttgaatgcgagggcgtgcaaccctctgaaggtgaggaagtgcagtcctctgaaggtgaggacgtgcagtcctctgaaggtgaggacgtgcaatcctctgaaggtaatggtgtgcagccctctgatggtgaggacgtgtagtcctctgaagatgaggatgtgcagtcctatgaaggtgaggaagtgcagtcctttgaaagtgagggcgtgcaaccctttgatggagaggatgtgtagtcctctaaaggtaagggcgggaagccctctgaaggtgaggccgtgcagtcctctgaaggcgagggcgtgcaagccggggatcctctag

SEQ ID NO: 37051 - DNA, 168 bp, Glycine max
  Peptide Sequence Number=SeqID_153829
atggcaaacaatattacatggcaaaaaagcagtctaaagctactctgtcatcatggacctcatacactgttgacccaagagatggaggctttggaggaagactatggagatggaaatgggaaaaatgaatcaaggcaatatattgaggggttaatggatcttgaatag

SEQ ID NO: 37052 - DNA, 300 bp, Glycine max
  Peptide Sequence Number=SeqID_153830
atgtatgtgtgcatctggagctccatcctctgcaagtgggctgagatggatccaaggaaggtggctgatgtggaggtggttatggtgcatttgctactggatgatgttgctgatcttgctctagctattgtcctgccttggcataaggatattactgagaaggaaagtcatctagatttgtctcaaagtcatcatgttggtgcgcatgattcacgaccacctccctaccatgctccgtacaaaatcacatcctggggaagcaaagcaaataacctatatcctcttcatcaaaacctgtag

SEQ ID NO: 37053 - DNA, 228 bp, Glycine max
  Peptide Sequence Number=SeqID_153831
atgatagcttctaccattacacgctacaccagcatcaccaggacgctagacccttggccttctcctgagcagtttagagccactattgcatggcctggagacaggcctattttacacgaagaggcaaaacctacgggtgctcaaggagctgcccaaggagatggagggagagctgaggatgatgaaaacatggcagatcttgttgattatttcattggaggagattga

SEQ ID NO: 37054 - DNA, 655 bp, Glycine max
  Peptide Sequence Number=SeqID_153832
atggagtttatctctaatgcaatgatactttcattctcaatactattgttgctaccaagtgcatcatattcactatatcaaaagcctgaaaatcatattaagacagctatttttgtaactgggagttttgaaatgggacccggatcaattgcaacaaaaacatttgagaatataaagtttccaaaaggtcatgttggaattaagagttttgatgcggaactagttgaccaagaagggaactctataccttcgtatgaaacttaccttcatcattggtttgcaataaagtaccaccaaaatattaccatgtcacctaatcctaagcttcgtcgtcctgaggatgcttttttccaaagaaacgaaggcacatgtaatggtggcattcttccacattattggggatttggagtagaatcacgaggaacaacctcaaaaattcctgatccttttgctatagaacaaggtaacccaacaaaaattaaaaatggatatgaggagaaatggttgctcaacatcatggtcattgatacacgtggtgcacaagataagaaagcttgcactcaatgtagatgtgaccagatgaatctcccgaaggacttttataatgtcacaagggatatacataaccaaaaattgactacaaattataaaggag

SEQ ID NO: 37055 - DNA, 345 bp, Glycine max
  Peptide Sequence Number=SeqID_153833
atgtcgggtgcgcctgattaccttcatcgcagcccgcttttttctccctcagcagcttacaccaccacgatatctgcccgttttctgtcccgacgttatcccgcggataaatctatccgccacgccacccttgccgccgacggtcaaatcacgttcgtcggcgcgattgttgaaccctcctgtgattatgccgtgacgcgcagcgtctcgctgaactgcacgcgcgaagggattaaaaagagcgaaaccctgcaggttaatggtgccgcgcgtgaattaccttacgcgctgggcaccgcgcgcattacccgggagcgtggtttgacttttctgcaggttgaatag

SEQ ID NO: 37056 - DNA, 330 bp, Glycine max
  Peptide Sequence Number=SeqID_153834
atgaccaaacttggtctctgcttgtcatctgctctggatgacaaaagggtgcggataaccgtaagaatgaccaaacttggtctctgcttgtcatctgctctggatgacaaaagggtgcggataaccgtaagaatgaccaaacttggtctctgcttgtcatctgctctggatgacaaaagggtgcggataaccgtaagaatgaccaaacttggtctctgcttgtcatctgctctggatgacaaaagggtgcggataaccgtaaggtatctccgggtatcatgggtgcagaatgaccaaacttggtctctgcttgtcatctgctctggatga

SEQ ID NO: 37057 - DNA, 441 bp, Glycine max
  Peptide Sequence Number=SeqID_153835
atggataatatctttgataaaactcagctagaagttgatggagagtgggatatgttgtgcgccttaatatccctgcctgtgtcaaaatcttcttatggagagcataaagctggagagtgtgccatccttttaccacttgtgactctagttggaggtgctggaaggaacttcagaggtgattatagggagtttattgcaacaaaaactgagtggagaaatcagcttcttcatgccacggaaggtaaagctttagatctcttatctactctcatatggctggtagatttggatatgtcccatgtggtcattgagcttgactgcaaatgtgttgttgataaattgctccatgctagaaacgatatctctaaacttggtgctatcttgaaagagtgcaaatcaatttcgtccctttttccaaactttgttgttaagtttgcttga

SEQ ID NO: 37058 - DNA, 486 bp, Glycine max
  Peptide Sequence Number=SeqID_153836
atggaatcacaaagagaatatgagaaagaagaagaagcactagtgttgaaaacaacaaaagtggtggagtatttggtgccaaagatgtcaattgagcttctgtgcaagtttccagataactctgcctatgactttgactactctcagagcacaatttggtcccctttgcttccaagaccttacactcccatggatttggatctcatcactccaaagaaactttcctatgacgagaaggtgggttctaagcttaggaagaagttcactgcctctaccttcaatcttaaccttgatttcatcagaaagaatagcaagagcaagaacaagaaggtgccttctgaattttctccaacaccctttagaggtgcttgtaaccccatcatgaacaagcgatgggcaagagcactgaaagctgcctcaaaacagttcaagaaatggaaggtgaagagagaccccattgcccatgtgatgctacccagatcatga

SEQ ID NO: 37059 - DNA, 450 bp, Glycine max
  Peptide Sequence Number=SeqID_153837
atggagattccaaactgtataacacccctaaggacaaagtcatactccaactcattcgtgcccttcccggttagctcaacaacatcccagatgcaatcctaccccccaagggtattggatagaagactccaagaggattgggctagagctactaaagaaggctttggggtttttccttcttttgggccttgtattttggccattcttgatgcaagcttcattggagcttgtaggcctaggatcttcttcatcaatggattcctttgcttcttggaagatgaatggcagcggaatggagaaaggaagagagagaggagacgccacttcaaggagaagatgagtctagaagaagctcaccatcataggaggccatggataagagcttggaggaagaaggagatgaatgaagggagagggagagaagagcacgaaattttgtgctctaaatga

SEQ ID NO: 37060 - DNA, 318 bp, Glycine max
  Peptide Sequence Number=SeqID_153838
atggcacattctccagacaagataaagagcatcgatggctcaaaagaaactcttaaacttagtgtgaggatcaatgatctatggtttattggcacgcctaacaaatctgagcaagctgaaatggtgtttgtggactccaattgtgttctaagggacatcccttttagaaaatacaggtttgctggatttgcggatgttgtggctggccagtttgaacctggactattggttgatgttattggtgttgtggaggaggttgtctttcaccaagtttcaggaaaaggtagaagggtagtctttaaactaaaggaccttgag

SEQ ID NO: 37061 - DNA, 230 bp, Glycine max
  Peptide Sequence Number=SeqID_153839
acaagtttctacagtctgaccgttgggatttcaaaaataataacttttggctccggctaagtgagaatggtgcgctaagcgcaattccaaccgaggggaattgcgccaagtggcccaaagctgcactaagcctaattccaaccgaggggaattgcactgagcagcccaaaggtgcgctaagtgagccctatttcagaggaggctgcgctaagactaaattcttgcgctaa

SEQ ID NO: 37062 - DNA, 612 bp, Glycine max
  Peptide Sequence Number=SeqID_153840
atggacaaggaagagattcctgcttcttgttcaaagagatgttatgcacccaaattaagcccaattgttttgcctttgctagtgtcattagtgcctgtgtggggaaaaatggggcacttcaacattgttcaactcttcatgctcatgtcatcaagtggggctatgatactaacaattttgtacagccttgcagttctccttcaaggaagacaagtgcagtctgttgttattaaaatgggttcagaaaggaatgtgttcgtggccagtgctttgattgatatgtattcaaagggtggtgatattgacgaggctcaatgtgtgttagatcagacttctaagaagaataatgtgttgtggacatccatgatcatgggttatgctcaatgtgggggaagttcagaggctgtgaaactttttggttgtctattgaccaagcaagagtttattcctgatcataatatctgctttactgctgtcttaacaacttgtaatcatgcaggatttcttgacaaaggggtggaatacttcaacaaaatgacaacaaattatggcctgtctcctgatatagatcaatatgcttgcttgatctttatgcaagaaacggaaatttaa

SEQ ID NO: 37063 - DNA, 987 bp, Glycine max
  Peptide Sequence Number=SeqID_153841
atggggaagttatcaatcaaattgcacgataagtgcaagaaccgcaaggaatcatcatcatggccattaacaaagtgttttcagcatggtagtggaagagatgatgcaattggaattacacaagaatggggtattgacttttctaatctcttcattgggcacaagttttctcaaggtgctcatagtcaaatttaccatggtatatacaaaaaggaacatgctgctgttaaattcgtcaaggttcgatataatgatcaaaagggaatcccaaaatcccttttagaggctcaatttttaagagaagtcacacatctacctcgtctccaccatcaaaatgttgtgaagttcataggcgcacacaaagacactgatttttattgcattctcacggagtatcagcaaaagggatctttaagggtgtatttgaacaagttagagtccaagccaatttctctgaagagggtgatagattttgctttggatattgctcgtggaatggagtatatacatgcacaagggatcattcatagagaccttaaaccggagaatgtacttgttgatggggaaattcgcctcaaaattgctgattttggcattgcttgtgaggcttcgaagtgtgactccttgaggggtacgtaccgttggatggcgccagagatgatcaaaggcaaacgctatgggagaaaggttgatgtgtacagttttgggcttatcttgtgggagttggtgagtggaacagtaccatttgagggcttgagtccaatccaggttgctgttgctgttgcagataggaattcaaggccaattattccttcacattgcccacatgttttgagtgatttgataaagcagtgttgggaattgaaaccagagaagaggcctgagttctgccagattgttcgagttttggagcaattagatcaaggctgcagcttcttgccccccaagaaactcaagcaacaccctctttcattacgaaaatggtaa

SEQ ID NO: 37064 - DNA, 1233 bp, Glycine max
  Peptide Sequence Number=SeqID_153842
gcttatgcaacaaaggagaataacagaacccgcaggatggagttgggtagatgatagcaccatatttgtgcgcaccttgaagttagatgtcgatgtggttaatgttttgataactctgtatgtgaaatgtggggatgccaacactgctagattggtatttgacaaaatgccccaacatcatcctgtatcatttcatgattctgcatttcctacactggcctttcacctcgaccacacatggaaccaggatggttttcaaccgaatctagagattcatcttcttcctttactctcaatgaaacctgaggacacttctttagaattcaactcctgggacttgttgttttgtttgaaggatgtcatatttttgcctccttttgtggcaataccagttcgtccaagacctggtgtttgggaatatgtccataataatgtctctgacctcagcgtggagcaattaagcgtttctgaatatctttgcttcaaggaagaacttgtagatggaaagattaatgacaatttgtattggagcttgactttgagccatttaatgccacatttcctcgcccattccacttcgcatacattggcaatgtctgcattagccatggccgaggattatctttctaagcttgctagtggtacactctattcagagtttgaatatgtattacaaggaatggattttgagagaggttggggcgatactgctgaacgggtattggaattatctgatatgctcctagatattcttcaggctcctgatcattatacactagagacttttcttgagagagagccaatggtattcaatgttgatatattatctcctcatggctactttggacaagccaatgtcttgggtttgcctgacactggtgggcaagttgtttatatactaggtcaagtgcgtgcccttgaaaatgagatgctccttcagatcaagaaacaaggacttgatttcactcctagaattctaattgttaccaggttaatagctgatgcaaaggggacaacatgtaaccagcggttagaaagagtcaatggtactgaccatactcatattttgcaagttccattcagatcagagttaggaactctcaaagctgttgcaagtgaagttgttgttgagttacaagggcatcctgcttccatcattggaaattacagtgatgggaatcttgttgcatctttatcggcttataaaatgggagttacccaatgcacaatcat

SEQ ID NO: 37065 - DNA, 1059 bp, Glycine max
  Peptide Sequence Number=SeqID_153843
atggccgaggattatctttctaagcttgctagtgatacactctattcagagtttgaatatgtattacaaggaatggattttgagagaggttggggtgatatagctgagcgggctcctgatcataatacactagagacttttcttgggagagagccaatggtattcaatgttgatatattatctcctcatggctactttggacaagccaatgtcttgggtttgcctgacattggtgggcaagttgtttatatactaggtcaagtgcgtgcccttgaaaatgagatgctccttcagatcaagaaacaaggacttgatttcactcctagaattctaattgttaccaggttaatagctgatgcaaaggggacaacatgtaaccagcggttagaaagagtcaatgaagctgttgcaagtgaagttgttgttgagttacaagggcatcctgcttccatcattggaaattacagtgatgggaatcttgttgcatctttatcggcttataaaatgggagttacccaatgcacaatcatggttgtctatggcattgatgtttttaatcccaagttcaatattgtctctcctggagctgatatgtcaacatatttcccctactatgaaaagcatactaggcttacatccctgcatagttcaattgaaaagctgttatttgatcttgagcagaccaatgaatacattggttcattgaaagacaaggaactggtcaaccttgttgtagtagctggttatattaatgtaaagaagtccagtgatagagcagaaattgtagaaattgagaagatgcataagctcatgaaaaagtatcatttgaatgacacacttgcaatcctttacaaccttgaggacatggttgattttccaaaggagcatcaatttgttattgagaaactcatgccgaagacgaggaacaaccttggtaaatatatgtgcaagctgaagttgcaaggtaatgtggggaagagagacaatacgattatcaagagcctcacgaatggaatgacaatccacttcaatatgtttggtgcgttcatggaagactga

SEQ ID NO: 37066 - DNA, 147 bp, Glycine max
  Peptide Sequence Number=SeqID_153844
atggagaattggcgaacagcgctacgcaataacttcgcggggatccagactcgaagagaatggagaattggcgaacagcgctacgcaataacttcacagggctctagactcgatggtggaggacacatgaacagcgctaggcaataa

SEQ ID NO: 37067 - DNA, 192 bp, Glycine max
  Peptide Sequence Number=SeqID_153845
atgactcaacaatctagtgcgttgcgtgcaacacatggttctcgtgattctccacgcgttcatcgtacggggtcgtcttcagcgcgtggatctcgttcaactagcacacgaggtcgtagagcaggctcgatttcctacttgctagatctagttgtgattgcagcatgcagtggaatacgcttagtgagttaa

SEQ ID NO: 37068 - DNA, 294 bp, Glycine max
  Peptide Sequence Number=SeqID_153846
atgcagtcctctccagaaccttcgagaaggtggcggaggattgctactacgtcgtggaaaggatctagaagcttctcgcgggggctgaagaatcaactctcggtgaaatcttccaacggtgaaacgacttcgttctgcttcaagtcaaaggagttgattgaactgacgaagatgtgcagagatctgaggcacaaggtgctggagatattggaggtggaggtggatccgaagagaggaccaaggattcaagaggcagcaatgaagctctacatttcaaaaagtgcgttcgagaag

SEQ ID NO: 37069 - DNA, 1078 bp, Glycine max
  Peptide Sequence Number=SeqID_153847
atggatcctctctttatcgaggaagatgatgttgtggggcttgatggccctagagatacattgaaaaattggttgacaaagggaagagaaaaacgcactgtcatctctgtggtgggaattcctggggtgggaaaaaccactcttgccaagcaagtttatgaccaggtgcgtaacaatttcgagtgccatgcattgatcacagtgtctcaatcctactctgcagaaggactgctgaggcgtttgttggatgagctttgcaaactgaaaaaggaggaccctcccaaggattcagaaaccgcttgcgcaacaagaaataatgttgtcttgtttgatgacgtatggaatggaaaattttgggatcacattgaatctgctgtaattgataataaaaatggaagtaggattttaatcacaaccagggatgagaaggttgcgggatattgtaagaaatcttcttttgttgaggtgcttaagctagaagagccattaactgaagaagaatcattgaaattgttttctaaggcatttcagtatagttccgatggagattgtccagaagaacttaaagatatatctcttgaaattgttagaaagtgtaaaggtttacctctagcaatagtggccattggtggtcttttgtctcaaaaagatgaaagtgcacctgaatggggagagtttagtagagatctaagtttacacttggagaggaattttgagttaaatagtataacaaaaattttaggtttaagttatgatgatttgccgatcaatcttagatcatgtttattgtatttcggaacgtatccggaggactatgaaattaaatctgatagattgattagacagtggatagctgaagggtttgtcaaacatgaaaccgaaaaaacattggaagaagttgggcaacaatatttatcagggttggtccgtagaagtttggtgcaagtatcctcatttagaattgatggcaaagttaaaaggtgtcgtgttcatgacttaatacacgacatgatacttggaaaagtcaaggatacaggattttgtcagtatattgaggagcgtgagcaatctgtatcaa

SEQ ID NO: 37070 - DNA, 297 bp, Glycine max
  Peptide Sequence Number=SeqID_153848
gcgataaaggggagtgccttggcagattacctggctcagcagcccattaatgactaccagtctatgcatccagaattcccggatgaggacatcatgaccttgttcgaagaggaagtagcggatgaagataagaacaaatggattgtgtggttcgacgacgtgtccaacacactaggccatggagttggagtggttttggttacccccaatgataaatgtatacccttcacagctagattgggctttgactgcatgaacaacatggctgagtacgaggtgtgcgcccgtgggatctaa

SEQ ID NO: 37071 - DNA, 114 bp, Glycine max
  Peptide Sequence Number=SeqID_153849
atggcgtttttcaacgatcaagaacttatcttctgtttttgtccattcctttggcatgggagtgcagatatagaaatattaaacaacccaatattagtgaaaccagaagcctga

SEQ ID NO: 37072 - DNA, 462 bp, Glycine max
  Peptide Sequence Number=SeqID_153850
atgcagcaagccatggatcagcaagagcagaaatatgatcatttgacatatcgatctgctattgcagttgaatgggctatgtcagaactcttaaggcacccaagtgatatgaagaaacttcaagagttaaataatgtagtggtggtcgaggagtctgacttgtcaaagttgccttatttgaacatggtagctagtgaaagaaaccctaaggttatatatcctgctggaccctttctggtacctcgcgagtccatagaagatattactattaatgaggatgatgtcctaggattcattggatctaaccacatttggtctctttttttggctcaattagtgcattgcttcaattgggaacttccatttggtatgtctcctgatgacttagatatgagtgagatatttggcctttcactaccaagaatttttaatagcactttgataaaaaacaggcatctttaa

SEQ ID NO: 37073 - DNA, 587 bp, Glycine max
  Peptide Sequence Number=SeqID_153851
ttaaagagaccttaaggttatatccagttggacccttgctagtgcctcgcgagtccctagaagatatcactattaatgggtattacataaagaaaaagtcaagaattttaatcaatgcatgggctatagggcgagaccctaaagtatggtcagacaatgttgagatgttttatccggagagatttcttaatagcaatatagacatgagaggacaaaacttccaacttataccatttggttctggtcgcagaggatgtcctgggattcaattgggtataactacttttagccttgttctggctcaattagtgcattgcttcaattgggagcttccatttggcatgtctcctgatgacatagatatgactgagaattttggcctttcattaccaagaagtaagcacttgctagctgagttaggactatttgtcaagtcacttgagaaagcagcagcttcacgtgatgttgtgaatatcagcgagcaggttggagagcttatgtcgaatattgttagtaaaatggtacttggccgcagtaaggacgatagattcgacctaaaggggctaactcatgaggctcttcattaa

SEQ ID NO: 37074 - DNA, 177 bp, Glycine max
  Peptide Sequence Number=SeqID_153852
atgccacttgtaggtggaggcagcattattggtgcaaaggtagatggagatgaggaagaaattgatattgctgtttggatctttgtgaaaaagcataaattgaactctatgaacagaaacaaaaaagaatgtagcgcggcaagcagagaagcagttaagctgaatttcgtccaatag

SEQ ID NO: 37075 - DNA, 2022 bp, Glycine max
  Peptide Sequence Number=SeqID_153853
atggaggctccacaaggtggatccggatccggacccgagcgagacaaatccaccgctccctcctcttctccgatctccgtcgtctccgccttctggaaagattttgagttggagaaggagaaatctatactggatgagcaagggcttcgaattgctgagaaccaggaaagcagtcagaaaaatcgccgcaagcttgccgagaacactagagacttcaaaaaggcttcgcctgaggataagttaagtttgttcaattccttgcttaagggctatcaggaagaggttgacaatcttacgaagagagcaaagtttggagaaaatgcttttctcaacatctatcaaaagctctatgaagctccagatccttatccagctcttgcgtcaattgctgagcaagatctcaagatatctgagcttgaatctgaaaaccggaaaatgaaagttgagcttgaggagttcaggacagaggcaactcacttgaagaatcagcaggctacaatacgacgacttgaagagagaaacaggcaattagagcaacagatggaagagaaagtgaaagaaattgtggagattaagcaacgcagtctggcagaagagaatcagaaaacattggaagttttgaaagaaagtttcttaccattgccaaggtggactatagaaaggagtgaaacatgggatggacaccccatggcggggaaagcaaggactgagtgtgggattggatggggtgctaaggcactgcaagatcagttgcagcatgccaaagacagtgtctctactatgcagaaattgcatgaactcgcacaaaaccagttgtttgaactccgtgcccaatctgaggaagagagggcatctaagcaatcagaagtcaatcttctgatggatgaagtggagcgtgcacaatcaatgcttcttagtttagaaagagagaagctgctgagtgctgatgcttttccatgttcaatcagacttgctgtttattctagcgatacttctgtgtctatgcagggggttctccgatctcagttacaaacggcaaatgaagagactgaaactaagaatagtgataattttgactcaaatagtgcacttgagaattctttaaatgccaaagaaaagcaaatctctgaattgaacatggagctacacaatattgaaacagccttatcaaatgaaagagatcaacacattaatgaagtcaagaaacttactgcaatgctcaatgaaaaggaggctgcccttgaggagatgaagaaagaacttaaagcaaggccaacagaaaaaatggttgatgatctgcgcaagaaagtgaaaattttgcaggcagtgggttataattcaatcgaggctgaagactgggaagtggctacaagtggggaagagatgagcaagatggagtctcttcttcttgataagaaccgtaaaatggaacatgaactaacacagttgaaggtcacactttctgagaaaacatccttactggaaacagctgaacagaagatagcagagcttacagcaaaggttaatgaacaacaaaaattggtacagaagttggaagatgatattttaaagggatatagttccaattcaaaagatcgtaaagggaacttccttgatgattgggatctttcagaagctggtgggggtgaggtttctgagaatacagaccaaaggcaagtatccttagaccaagatcagagctcaatgcttaaagtgatttgtaatcaaagagatcgatttaggacccgcttgcgagagacagaagaggaaataaggcagttgaaggagaagattggggtattaacagtggaactggaaaagagcaaagctgataatgtcaaactatatgggaagattcgttatgtacaagactataatcatgagaaagtgatttctaggggttctaaaaagtatgctgaagatcttgaaagtggtttcgcgtcagatgttgaatctaaatacaagaagatatatgaggatgatataaatccttttgctgcattctcaaaaaaggtgacttag

SEQ ID NO: 37076 - DNA, 141 bp, Glycine max
  Peptide Sequence Number=SeqID_153854
atggggactccaagtgttgggactactcgtgttggaactataagtgttgggactatattagtgttgaaacttcttaaggtattactttcagatctggttgtagtaaatctgattgtagcaaattttatcgcaagaaattaa

SEQ ID NO: 37077 - DNA, 336 bp, Glycine max
  Peptide Sequence Number=SeqID_153855
atggctatgttgaggtggatgggcagaaacacctggggccacacgaaattgactgtcaaagagaatctcataaaggaatgtgaggaggaagcgggaatacctagatctatctcgttcaaagccatacctgttggtgctatttcatatttggacattgatgggcatagatacaagagagatgttgaattctgttatgatctaaaacttccaaaaagtttcttacctaaaaatgaagatggagaagttgatagcttcaagttgacctctgttatgcaagttgcagaagtcatacacaagacattttttcaagctgaattgctctctcgtaatcattga

SEQ ID NO: 37078 - DNA, 378 bp, Glycine max
  Peptide Sequence Number=SeqID_153856
accccatctgtgtttcttccacccatctcttcatcaccagatcttaaaccaccttttcagaataaacaaacatttgtattagtaaaagttgacgaactagatttggctcaaaagctcaatcacgcattttcgctttttagggttttggattcgaaaattccggagattcgaacgctcaaattgaatggtggcagtgagggcgttggtatcattggcagtgatcgcatgttgcagctcttcacgaaagtgcttgtacttctgcaggtttgcgaagcttcaaaccaagagccacaccgtgcgcgctggtgtgtcgatgcgttgcactttgatggggtggagatttcgggggaaagggtccaattttgtgatgcgtgttga

SEQ ID NO: 37079 - DNA, 1989 bp, Glycine max
  Peptide Sequence Number=SeqID_153857
atggggtcattgaaggcaattacttatgagtccttaaataatattgtgaggctaatcaacggagtatcagcccttttgttggcactactacctgggaaagctaatatactagaaggtatccatggttgggaactcaagccaactttcaggggaccgcgatttccacgttggatggagaatggtgtatcctctttcaaccagttcatccacgaactttctgtggattctgataattcaagccctgaatactcatctggagaagaagatactgatagatatagtgatagattcgatttccctccatctcccgcatctcagagttctagaacctcagaagctggttttgccaagtacagtaggcatcagatggattggatccagtatatcatacttttgatttggtttcctgtaaagttattgctgtggattccacttcatcttttccggttagtttattatggggtgtcaaaagccatttctgtctctggaaataagcgcccttcacatttaaatgcacatatgagggtgctaagcctcaaggatcatattatccaccgtgctactgataggagacgtggagttgtagaggatcttcatctaggcatagagttatctatagaagctgtcttcgatgttgttcacaaggcagcacatcttcttttttcgccttcagaagcttttgggacattattcaggttgttttcatctcatgaaagtgacactaaagaagattgtgatggtgttgaggacacccccatttatacagctacactaggagagaatgacccaatgcctacggagaggaatgtcaagtatcagcctctgaatacagatgcccggacatgccaggatgtcataacagaccttgggtatccatatgaagccattcgtgtgatcaccgctgatggatatattcttcttttggaaagaatacctaggcgagattcaaggaaagctgtttatcttcagcatggagtttttgattcatcaatgggttgggtatctaatggtgttgttggctctccagcttttgcagcctatgaccaagggtatgatgtgtttctggggaatttccgtggtttggtttctcgggaacatgtcaacaagaacatatcatcacgtcaatactggcggtattccatcaatgagcacgggactgaggatattcctgctatgatagataaaattcatgaagtaaaaactgctgaattgaggcttactaaacctgatattgaggaggaaaccgatgatgatcaactttacaatctttgtgccatttgccatagtttgggaggagctgccggttttcatgacgactctaacatcgttttttctatggcggagcttctattagttttattggctcctgttttgtctcttcttgtgcctgccttttatataccaaccagattttttcgtatgcttgtcaacaagttagcccgggatcttcataacctacctgcagttggaggattggttcaaactttaatgagttatgttgttggtggagacagctcaaactgggttggagttctaggattaccacattataacacaaatgacatgccaggagtatcttttcgtgttgctctccatcttgcacagatgaagcgcactggaaagttcagaatgtttgattatgggagtgcatctgccaatatgaaagtgtatggttcgcctatgcctttggacttgggtgaacactacggactcatagacattcctgttgatcttgttgctggacagaaggacaaggtgataagaccttcaatggtaaagagacattataaattgatgaagggtgccagggtagatgtttcatataatgagttcgaatatgcacatttagacttcaccttctcccatcgtgaagaactcttgtcttatgttatgtcatgcttgttgcttgtggatcctaatccaaaacatcaagtgaatcaaagggttgtaaggtcaaggaggaaaggacaagttgcagctagtgggtag

SEQ ID NO: 37080 - DNA, 507 bp, Glycine max
  Peptide Sequence Number=SeqID_153858
atgagattcattttaagttctgaagagttctatcatttgagtaaaaatttgctcgagttcttaaatcctatattgcattatagagctactaaaaatgactatgaggggggctttactagctcagatattgagcagttattgaagaacatagagttcaattatgagaactgggtttctgccttctccttactagtagtggatccaaatgatgagccatccgttaacaaattcagagagtgcttgaaaaaaatgagagctgaagttccagcttccttggccaagactgtgttctatagtgactacagagatatacttgagaaagttgaaactccatgcaccatcattcagacttccagtgacattgttgttccacacaaagcagcggtttacatggagagcaaaattaaagggaaagttacattggaggttgtagacaccaaagggcactttcctcagctaactgcaagccttcagctagttgatgtgattaagggtgttcttggatga

SEQ ID NO: 37081 - DNA, 4047 bp, Glycine max
  Peptide Sequence Number=SeqID_153859
atgtgtggttgtgatagggatcaagggatcattgggcctaaggagccattggcaaatgagacattaaaaagcccaagggagtatattgtccacactcgtgttggtgagaggaggggaagagcgagaatagtttttgcctatgcagagcatagctctgggacattaggaggaggcgagccagggatggaaggtcgcgttgcatcattggagaatgagatttcgaagcttaaggcttccgttgaggtgttgcgaagtcagtcggagaaatataacaccaaacaagacattattgctgcgaatcaagagaaattgatggatatgttcatcaaaagttttgggaaggataacccagaagatggcgagagttctgcgggaaaaaactcacacggaaagggggccaagggagacgcagagaagtccagtttcagaacgaatacattagacggggacgcattgaacgagtttcgtcagtcaatgaagaagatcgaattaccaaccttcaccagtgaggatccagccgggggtatcatccacttctttaattcattgttgaacgattatgaagatttgacttgggaggatctgaagagggagttgatggagaggtacggtggaatcgaggaggggacggtgtttgagcaattgacgtcattatgccaaactgggatggtggaagaatacatccgacgcttcaagagcttggttgctcaagtaccaaggttgatggaggggcagtattttgcttactttatgaatggtctgagagaagacatttgtgctcgtctgaggattctgaacatggcagtgtcgatatcgcgtgggcgcctcatgaatacaacgcgagcgcttgaggcagaattagagcgtgggtcacgtggatggaaaacgcgtgttgacactctaagaggaggaggtttcgggtttgtgtcgagatcccagcatagtggatcaaacacaggccatgaaggattgaaaggtaagcatttagcctaccaggacttgttggataggcgcaaaaaagggttatgttttaagtgtggtggcccctttgggccactccatcagtgccccgttaagcaactcaagcttattctggtgaatgaggaaatccaagtggaatatgaggaagatgagactccaaacaacgagagaagtgatgaagactatgtcgttttggaagggaaatgcagtgtgttgaccttgcgaggcttggacaccggcaatcgagatttccccagtatgatgaagattagagggaccgttggtggtattccgatcgtgcttttggtggacagtggggcaacccatgatttcgtatcgaagaagttggtggaggcttttggctggggatgggagaatacaaagaagatgaggattttaatgggtgatggtcacaaggctgacacctgtggaatttgtcgaaacatttgtgtggagacagaagctggtgggatgtcaaagacgttgaaagggattgtgggcgaggaaccattgttggcatcacttgagggaattctgaatgaagaaaagggacatagagagggtgagttgaaccagcagaagcgactagagttggaggagattttgaaggaatttgaagatgtattccaggaacctagaggtattcccctagaaagggtgaaagagcattcaattactcttaagccaggagaagcaccggtgaatgtacaaccctataggtacccgtatcaccaaaaaaatgaaatcaaaaggcaagttaaggagctgctggaaaatgggtggataaggcatagtcaaagtgagtattcaagccctgtcatcttggtgaaaaagaagagtaaccaatggaggatgtgtgtcgactatcgtgctttgaacaaggcaacaataccagataaatttccgattccgattattgaggaattattggatgaactacatggggcaaaatatttttccaagttggacctccgatcaggttatcaccaagtgagaatgaaagtggaggacatcccaaaaacaacatttagaaaacatgaggggcattacgagtatcttgtcatgccatttggtttgatgaatgctcctgcgacagtccaatcccttatgaatgaagtgtttagggacttattgaggcgtggggtattggttttcttcgatgatatcttggtgtatcatgaggaatgggaggagcatatagaggggttaagagttgttctgggaattttgaggcaacattgcctgtatgccaataaggagaagtgtagctttggccaaaatgagcttagggtatttggggcatatcatcacacaacaaggagtggaagtggatccaaacaaggtcaagagcattgtggagtggcctgtacccaaaaatgtgaagggggtttgaggatttttgggaattacgggttactacaccaaacccaaatcgcgtttgaagaactgaagaaaaggatcaccacagcccccgtgcttaccttacccaattttgaaaagaaatttgagctagagtgtgatgcttctggacttggaattggtgcaattttgatgcaggaacataggcctatagcttactttagtaaagctttgggaagcaaaaacttagctaagtccgcttatgaaaatttgagacaattattgcagcagcggataaccacagggagtcaacaaaattggttagctaagttacttgggtacaactttgagatagtctacaaacctggtctagaaaacaaaggagcagatgcgttgtcccgaagtttgggggagttgtcttccatggtgtctatgcctgtgtggctggattgtcaggctttagtggctgaggtgcatgaggacgagttatggaagaagaaaatagaagcattgcaacatggacagattgatcagggtgatttcacttacagacatggaatcctgtactacaaggacagattagtaatatctaacaaatctaattggatccctaagttgattgaggaatttcattctacaccccaaagtggacattcgggtttctatagaacttaccggagattagccttgaatccacttctagttcctgcacaaatatgggaagatatttcccttgattttattactgggttacctcgatcaaaagggtatgaagctgtcctggtagttgtggataggctatccaagtatagccactttattccactgaagcatccttatacggcgagaacagtagttgaattgttcataagggaagtggttcgcttgcatggagttcctagttctgtaattagtgatagagattcactgttcatgagtgtgttcttgaaggagttttttagactccaagggactgtgttgaagatgagtacatcttatcatccgcaaatggatggtcaaaccgaagtaacaaaccgatgtttagagacttatctcagatgctttatcggtgacaagcctaggagttgggttcagtgcttatcttgggctgaatattggtttaataccacctatcatgagtccattggcattacatcatttgaggccatatatgggcgaaaaccacctgctctagatcgtgatgagatccttagacaactgaaaatccatctggagagagccagggaaagaatgaagcatcagctgaaaccgtataggcaagcatcagtgacaaaccggatcaatccaaagctatgtgctcgttattataggccttatgaagtgttggaaagaattggagaggtagcttatcgtctgaaattgccagcaacatcaagaattcatccggtattccatgtttcgttactgaagaaagcacatggagggtaccccgtggagactgaattattgcctgatttggaagaaggaactgtggcaatagctgaacctgaggctgtgctagaggaagaagtgctcatgagaagtcaatttctagaattgaagcttgaggacaagcagttgtttttaggaggaggtattgatagggatcaagggatcattgggcctaaggagccattggcaaatgagacattaaaaagcccaaaggagtggattgtctacactcgtaggaagaagatggcaaattag

SEQ ID NO: 37082 - DNA, 1502 bp, Glycine max
  Peptide Sequence Number=SeqID_153860
aatgttgggcggtcaagagccaacatgagaataaagtcggtgtagcggagatgaggatgttgcggtggatgtgtgagaagaccggtagactctgtagtgaggagagtagaccagatggagagaagacaaacaattcgaggcagaggaagacccaaaaagactataagagagttggagattcttcagtatcaactggaacggctgaggatgatgtgttgaaagccttgtctcagatcattgatccagactttggaacagatattgttacttgtggatttgtgaaagatctgctgattgataaagctctaggagaggtatcgtttcggttagagctcactacaccagcatgtccaatcaaggacgtgaaggcaaatgaagtggtggcaatgctcccttgggtcaagaatgtaaaagttacaatgtctgcacaaccagcaagacccatatatgctgagcaacttccagcaggtctacagacaatttcaaatattgtggctgtgtccagttgcaaggggggtgtgggaaaatcaactgtagcagtaaaccttgcttacactttggctgatatgggtgctagagttggtctatttgatgctgatgtttatggtccaagcttaccgactatggtctctcctgaaaaccgactgttagtaatgaatccagagaagaagaccataattcctactgaatacttgggagtaaagttgatctcttttggatttgctggacaaggacgtgcaataatgcgtggccccatggtttctggagtcattaatcaacttctgactactactgagtggggtgagctggattacctcattattgacatgcctcctggaactggagatattcaactcacattatgccaggtagttccattaactgctgctgtaattgttaccactcctcaaaagctgtcgttcattgatgttgcaaaaggagttcggatgttttcaaaacttaaggtgccttgtgttgctgttgtggagaacatgtgtcattttgatgctgatggaaaacgatattacccatttggcagaggttcaggttctcaggcacgaataatgtctttgattgttgttcagcagtttggaatacctcatctatttgatctccctattagaccaactctctctgcttctggagacagtggaatgcctgaagtggtagctgatcctcaaggtgaagtttccaagatattccaaaatctaggagtatgtgttgttcagcagtgtgccaaaatacgccaacaagtttcaactgcggtcacctatgataaatcaatcaaggcaatcaaagtgaaggtaccagattcaaaggaagaattctttctgcatcctgcaacagtgagacggaatgatcgctctgctcaaagtgtggatgaatggacgggggagcagaaattgcagtacggtgatgttcctgaagatattgaacctgaagaaattcgaccaatgggaaattatgcagtttcaataacttggcctgatgggtttagtcag

SEQ ID NO: 37083 - DNA, 1896 bp, Glycine max
  Peptide Sequence Number=SeqID_153861
atggcaaaccaaaaccaaaaccaaaagaagaacaaagaggatttctctctgaaggcgacaactccaaacatcagtgctggaagagcaatcagtagtgataggctccccactgcatttgacttggttgagaaaatgcagtttctgtttgtcagggtcgtgaaagccaaagacttgtctgagaaatgtgaatctcaaccttgcaacccttttgtggaagtgaatcttggaagcttcacaggaagaacaagatgcttggagaaaaccaccaccccagaatggaaccaagtctttgcttttgccaaggagagaattcaagtgctagttttggagattgtggtgaaggacaaggataatgatgaccctgatgagttcatgggacgtgttgcattcacaatttgtgatgtcccagtgagagttcgtcccgatagccccttggcgccgcaatggtacaagcttgaggatcaaaatggggtgaagcttcaaggagagttgatggtgtctgtttggatgggaactcaggcagatgaagctttttctgaggcttggcattcagatgcatcagaaactagtggtgaaagcattgctcacactcgttccaagccgttatcaggaattttcatccaaggtgttttggggaacttagctttgaggagccgtcctatgaagtgtaatgcaagccccatgtggaatgaggatttgatgtttgttgtggcagaaccctttgacgattgcttgcttgtgaccattgagcaggggaatccccacaaacacgaaagcttgggaatttgtgtggttcctttgaagaatgtgcagcagagaattgatgccactccacaagctagtgtgtggtgcaatcttcagaagccaaaggaaaaggagggtgaagaggaggttgggttttcaagtaaacttaacatgaggatctctttggatggagggtaccatgttcttgatgaggccactcactacacaagtgatgtaaggccatcttctaagtatttatgcaagccaagtattggtgttcttgaattgggaatcctgaatgctgtggggctctctccaatgagtaaggaaaaccgcaccgatgccttttgtgtcgctaagtatggtcccaagtgggtgaggacaaggactattgtagatagtctttctcccaattggaatgagcaatatacatgggaagtgtttgatccttgcactgtgatcaccattgttgtgtttcataatggaaacttgaatggaggcaaaaatgccggagggaaaaaggctgaaggagcaatggataggagaattggcaaggtaaggattcggttgtcaacacttgaaagtgataggatttactctcactcttaccctcttataaacttgcacactcaaggagccaggaagatgggagaaattcaattggctgtgaggttttcttgttcatcattgttgaatgttttgcaaacttatgcacaacctttgctcccaagaatgcactatataagcccattgtctatatttcagttggataatttgaggaaccaagctgctgccatcgccacattgaggttcaaaagggctgaaccaccactcagtaaagaggttgtggagtacatgctagacatggggacaaatgtgtggagcatgaggaggggaaaagttcagtttttcaggattgcttgtcttctcaatgttttggtttctgttgctaaacagtttcatgagatacatgcttggaagaattcaattaccacggctgacacagccaccgttgaagaactagaagaagaatttgacccatttccatctaaatttagtggtgataatttgaagaagaggtatgatcgattaagagccatttcggggagggtgctagaaatgatggctgacttggcaactcaaggagagagg

SEQ ID NO: 37084 - DNA, 175 bp, Glycine max
  Peptide Sequence Number=SeqID_153862
atggttttcggggcttccgcggcttccgtaaatacttccgtaaaatttccgaaaaaccttggaaaaatcaagtcgaagtacttccgtaacgcttccgtaagcgattctgtggaaattcttcatcgttcttcaccgttcttcatccgttcttcgttcgttcttcgttcttcaacgg

SEQ ID NO: 37085 - DNA, 1398 bp, Glycine max
  Peptide Sequence Number=SeqID_153863
atggacagaaacatacttgactctctgttcttaaacatccactttcatgggcttgacatgaaagaaggatcaattccagcagcattaatctataggattcagtacaaggtcatgaatacttgtgcttcaagagtccttctaaaaccacaaaaaagagagacaaccttgtttatcaccgatatgacaaaggccaatgtttttctcccaagaaccataaaatgggatgaagtaactcttcccgaaaaatgggtcattgacaaggtcacaccgtcagttccccgacctgctccaaccatagaacaaatcaagcaagataactccgtatacctagaacaacattcaaccaagaacaagaagacgaccaaaagtcgatccaatctccaacttactcctctatgcatgaaccttatgatgttatctgacaactttagcattgataaggatacccttagaaaagacttttattctcctgagaatcaacctcaaaggagatggttttttcaacattttaaggattcaaacagaaaacaaatccaagacaaattcatattttgtgaatttgtcgaaagagtcaaaatcaatgttcttttctttgattggtttcatgcctataccattagagaatacatagattacccgtggaaacaagatatcataggtgatccaacaaccaacgctattaccaattggcaaatcaaagatggtgagttcatccaatcgaaattacctcccacaacacaataccgactaccaaaggtcaaggatagtcatgataaacctgtcatggccactccttttaagacaaaggatgtcaacaaagaggtaacttccaaagatatcaaaagcctaatggaacagataaattataccaataaatatctgcaagttttaggagagtctatcaaaaccaagacaattcctaaacaaaaatctcctgaagaacctccatcaaatatccccatagaaaaatctttattcaaacctttcaagattagcgacaatgctaaacaaaaaattagggaactaaggaaacacaagtcccttatagaaggagtaggtgacaataatagtgaattattaaacaagcttgatagtttacttcgagtcatccctgaaactccccaaccttcagaaagaacgtcaaaaatggtaacaagaaaagaaataggagaaagtaacttcaaaatttttagtgcaaataacatctatgagtggaatatagatgtccaaacggagtacaacatcatgaatacactccaacatatgaccatggtagccatggcttacgaaacatctcatgaatgtccggaggaaacgattattgatatcttagtagcaggattcttcggacaactaaaaggatggtgggataattatctcactaatgatgaaaagtaa

SEQ ID NO: 37086 - DNA, 648 bp, Glycine max
  Peptide Sequence Number=SeqID_153864
atgctggtctatgttgatgacattattgtcactggtaataacccaacagctatcaagtctttagttaccaacctcaattctgaatttgcactcaaggatttgggagatttggattacttccttggtattgaggtgaatcatcaccctaatggctctctcatgctcactcagtccaagtacattcgggatctcttgtccaagacagctatggatgaagctaactctatttcttctcctatggttggtggctgcaagcttacaaaaacaggttctgaggattttatggatcctaccttgtatcgctctgtagttggtgctctacagtatgctactatcacacatccagaaattagtttctctgtcaacaaagtttgccaatttatgagtcagccaacagaacagcattgggttgctgtcaaaagaatccttaggtatctaaagggcacacttcattttgggctgaaactggaaaccactttttctacaaaacactactctgttcatgccttttgtgatgctaactgggcttcagatcctgatgatcgaaggtctacctctggtgctgctgtgttcttaggcccaaatcttgtctcttggtggtccaaaaagcaatctgttgtggccaagtccagtactgaggcagagtag

SEQ ID NO: 37087 - DNA, 1042 bp, Glycine max
  Peptide Sequence Number=SeqID_153865
atgatcggggatccttcaggaaagtctgcagagagaaatcttctggatgaggaaacacttttacattatgtcgactgtttgaaaaatcagctttctcagtttctgaattttgatggagatggagccaataaggctgagttggtaaacaattacgactggatgaaaaacatctcgtttttagactttgccaaaaatgtgggaaaaaacatcactgtaaactatatgatggctaaagattccgtaaagaagagattctcaggggaagccggagctgaagggatgagttttactgaatttacttatcagctgattcaggggtatgatttcctgcacttgtaccagaataataatgtaaagttacaaatgggaggttctgatcagtggggaaatatcactacagggacagaactgatccgcagaaaggcacaaggagaagcttttgcattaactgtttctttgatcacgaaagcagatggctccaaattcggaaaatccgagagtggtgaaaattactggttagataagaagaaaacatcaccgtataaattctaccaattctggctgaatgcaaccgatgctgatgccgaaagatttattaaattttatacattcctgggtaaagaagaaattgaagcattaatagaagagcacaaaacagctccacatgaaagaaagcttcaaaagaaattagcagaagaagtaaccgtatgggttcatggaagagaagaatatgaaaaggctttaaaggcttcagaaattcttttcggccgttccactgctgaagatttagtaagtctggatgaggaaattttccttgaagtttttgacggagttccacaaaaagaagtagcaaaagcagatgtattgggaatcaacattattgatcttctttcagaaaaatcagggtttttaaaatcaaaaagtgaggcccaaagagagatcaaaggaaattcgatttccgtaaacaagcaaaaaataaatgatacttttacagcaaacgaaagtgacctgatcgatggtaaatttttattgcttcagaaag

SEQ ID NO: 37088 - DNA, 159 bp, Glycine max
  Peptide Sequence Number=SeqID_153866
atgactgggtgtaccagcaattttgctgggtgcaggagcaggcaagaactccaaagaaagatgaggtatgatgtgtaccaaggtcctgatgctgagttggcggaaatgctagaaagggatggatgtgttagaaacgtcccctggtgtcagatgggatga

SEQ ID NO: 37089 - DNA, 186 bp, Glycine max
  Peptide Sequence Number=SeqID_153867
gtggcccctgatgtgaacatagatgaagtggctcgacggacagaggggtatagtggagatgacttgacagatgtatgccgtgatgcttccatgaatggtatgaggcgtaagaaagtccaaccaagtgtttctctggctgacattgaacgccatgagaagtggtttgccgaatttggatcagcataa

SEQ ID NO: 37090 - DNA, 514 bp, Glycine max
  Peptide Sequence Number=SeqID_153868
tggctgagagtccgaacacaaggattggattggctcccaaatctaaatactgtgagagacgatgaggttaaagcttcggaagaaagtgatgaggtacaagccctaaaggcagaggttgaaagagcccgggtagtcgaagagaagttcaagtccatagccatcaaattgaagccttggaatgaagaggtgaaaggaatcatcacgggtcgaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttccccgatttctagccaaggccaaagcaatggcggacacctactccgcccccaaggagatccacggacttctcagctatt

SEQ ID NO: 37091 - DNA, 243 bp, Glycine max
  Peptide Sequence Number=SeqID_153869
atgggggatttcatcagcagactctccttccccgaaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacaccttacggttattcgcacctcgtcattcagtgaccccaagtgtgattgacgagtag

SEQ ID NO: 37092 - DNA, 201 bp, Glycine max
  Peptide Sequence Number=SeqID_153870
atgacgttagtctatgcgtgccattggacacgactgtgtctgaatggtgagatggctcgccacctctggatgacaaaaggcacagaagacgacgtcaatctctgcgtgccatcggatacgactgtgtctgaatggcgaaaaggtgtgcgaaatgaccataatttgtctccgcattgcatcgggtccgccgcctctagatga

SEQ ID NO: 37093 - DNA, 264 bp, Glycine max
  Peptide Sequence Number=SeqID_153871
atgagtgaaatagaggaggtgcaagagcagatgaaggccgacatagaggccatgaaagagcaaatgaccacaatgatggaaggcatgatgagtatgagaaaaatgatggaggttaacatggctacagtcattaccgcaagtaccaccactaaggtggacccgactcttccatctggcctcaaccaagtaaatcacccactctcagacatggtaggtcagggaggtgaagcattgggaagtgtgggcggcccccattttgagtag

SEQ ID NO: 37094 - DNA, 144 bp, Glycine max
  Peptide Sequence Number=SeqID_153872
atgggactgtcagcaacaatgcatcacccaaaaaggaaaactctagatgagtattcactgttatcaagcaagtcggagatccagcatgaccacagatcaacctctactccctatggctcacacagacctgggtatagtgcctaa

SEQ ID NO: 37095 - DNA, 1533 bp, Glycine max
  Peptide Sequence Number=SeqID_153873
atggatctagaactccctgctcatgctgcaactgtgaatgaatctcaacaacaaaagtttgctctacctgtggattctgaaaacaaggcaactgtgttcagattattttcctttgccaaaccccacatgagagcctttcacctatcatgggtctctttcttcgcatgctttgtgtctagctttgctgcaccacctcttctccccataatccgcgacaacctcaacctcacagccactgacattggaaatgccggtgtggcatcagtctcaggtgctgtctttgcaagaattgcaatgggaacagcctgtgacttggtcggaccgcgcctcgcctctgcatcattaatcctcctcacagcaccatttgtgtacttcacttccatcatcaactcagccacctcttatcttctagtccggttcttcaccggcttctccctcgccacctttgtgtccacgcagttctggatgagctccatgttctctgctccggtggtcggttcggccaacggactctccggtggatggggaaaccttggaggaggggctacccagctcatcatgccccttgtgttctccctcatccgcgacattggcgctaccaaattcaccgcttggaggattgcattctttgtccctgccatgttccaaatgctcacagcattctcaattctgatatttggtcaggacatgcctgatgggaacttccgccgcttgaagaagtcaggggaaaaagccaaagatgatttttcaagagtcttatatcacggtgttacaaactataggggatggattctggcgttgacttatggatactgctttggggtggagttgaccatagacaacatcatagctgagtacttctatgacaggtttaatctgaaactccacactgctggaatcattgctgcaagctttggcttggctaacatattttctaggcctggtgggggttatatatctgatgtaatggcaaagaggtttggcatgaggggaagattgtgggctttatggatatgccaaaccttggctggtgttttctgcataattcttggcctggtgggatctctaagtgtatccgtggttgttatgatcatattctctgtgttcgtccaagccgcgtgtggaatgacctttgggattgttccttttgtctccagaaggtcattaggggtcatatctggaatgacaggaggaggaggcaatgtgggtgcagttgtgacccagttaattttcttcaaaggatccaagttttcaaaagaaagaggaatcactctaatgggagccatgatcataatatgcaccctgccaatatgtttaatctactttccacaatggggtggcatgttttctggtccttcatctaaaaaagtgacagaagaagattactacttggctgagtggaactcaaaggagaaggagaaaggctctcatcatgcaagcttgaaatttgctgataacagcagaagtgaaaggggcagaaaactgaatgcttcgaccgagcctactgaggaaatcacacccccacatgtttga

SEQ ID NO: 37096 - DNA, 245 bp, Glycine max
  Peptide Sequence Number=SeqID_153874
gtgtcgagggaaggggcccagaatatgaagaacctcaggatttgaggtcaaatcctttccaaggtggaggggatgatgcaatcctacccccaagggtattggatagaagactcccccccatagggtattggatagaattggttacttcgaattttgagctgaaagttttactgaattttctagacatctggaaaaaagttataaagaaagaaccaagtgatttggataaaaggaaaaaatactaa

SEQ ID NO: 37097 - DNA, 411 bp, Glycine max
  Peptide Sequence Number=SeqID_153875
atgattaccgacagaggacaaccaccgtatgggaaaaaggaggtcaaggtgctatggcaacaacgccataagttatgtctttttggttatgtttggacacatcatcaccaccatgcaccaccagtaggagccggagttccaacgcatcaccaccagaaccctcttctttcttcctttcttcaacaacaaccaaaaaccctcttccttcttctcatcaagaagatctgggtttatagattagagaaaataaaacaaagatttgatagacaatggagtagggaaggaagagagcacagggaggatgatgatggcattgatgagagcaatgcgacgtgggaggtgcaatgtgggttgcttgctttttcgatggagatgttatggtgggtttggtggagggtcagatctagttaa

SEQ ID NO: 37098 - DNA, 229 bp, Glycine max
  Peptide Sequence Number=SeqID_153876
atgagggttgcactcgttgcgggacttaacccaacaccttacggcatgagcgacgacagccatgcaccacctgtgtccgcgttcccgaaggcacccctctctttcaagaggattcgcggcatgctaagccttgccaccaccaacaccgtgatcgccaccatgaccaccatagcaatggtagcaacagtagtcatatttgtgacgccaacaatgatcatggcggcgactt

SEQ ID NO: 37099 - DNA, 261 bp, Glycine max
  Peptide Sequence Number=SeqID_153877
atgatgcagttcaaagaagatgaaaacttaccttcaacgaccaccactccatatataaaaatgaaattatcgagctatatagaaaagaaaccgacgagcccttttagcgtcgaggcttgcacatgcgggaaaggatccttcgtgaaccctaataacaccgtgagcaacaactgtgccagatctcaaacctcgcaccatcaccgaatcacagcgacgccaactgcgtgtcgtagaggtggtgaaagggtgaaaggggagtga

SEQ ID NO: 37100 - DNA, 255 bp, Glycine max
  Peptide Sequence Number=SeqID_153878
atgaaaattgaggaggagtctaaggggtgtgccaggagtggccttgagaatacttgtaagccagaagtggatgaaacacatgaatacattcacgacttaagtgcttatgtcttagcacttaagggactctggaccatcctccctccctgggaggctgacttagtacatagggacaaatactttatggatgtcaaaggcatcgattgtcaattccctgaagttggtggcaatcaccatgttatccacctcctctaa

SEQ ID NO: 37101 - DNA, 402 bp, Glycine max
  Peptide Sequence Number=SeqID_153879
atgcaaaccaagttacaattggctattaaggatttggagaaatattctactgaaaaactttgtcttgagttgaaagaggctgatctatgtgaagaagtggagaagtgcatatcaaaatgtgctacaaaggatgttgctacattcgatgatcatgtggatggctttaacagggccttggcacaagttgctgctctttatcctaatgtggacctttttggcaccaggatttataaagatgtggttgatgggaaggtgtgcgaggcgaggctcacgcgtgcgctttccaaaggagaaaagatgcgtggagtcgccaccaacgtttatttgtggaaaacgtcagaaaaaccgaaggaaaccagtcaaaatgaaaattctaagttcgggagttgtatttacgtttga

SEQ ID NO: 37102 - DNA, 402 bp, Glycine max
  Peptide Sequence Number=SeqID_153880
atggccaatgaaagcttgaatcagtcacccacaacaatcgtggccggaaggtgcagagacaaggtatataactttgtaaaattggcagaactttactatgtaggaagccatggcatggacatcactggtccaacaaaaagtccaaagcaagaataccttgcaaaatcccttatggccaaggatcaatttttggattcttcagccaagataatgtacaagttagggatatcatcatcaaagatcaacttgttgcttcccatcctcatggaatttgttgagattacaagggaaggatctttggcacttgcagcacttccatttgatggcatacttggactcggattccaggatacttcagttagaaaagtcacaccagtgtggtacacaccagaacttcattaa

SEQ ID NO: 37103 - DNA, 657 bp, Glycine max
  Peptide Sequence Number=SeqID_153881
atggaggtctttggaactcgatcatacgtacatgccttttcatctctgcacatctcactctcgtgttcaccctgctgtgatctccgcgcatctcactcttgccttcaccctgccgtgacctccgcagtctgccacaacctccattgtgaccttccacaaacccccttcacactctcaggtttacccctttctcgtcccacactcaaaatcaaaccctggaaatcgatttatctttactctcggcctctcagaagcccagcggtgggggcggcacctccatcgtcgaagcagcaggaactctggttcttcctccgcttccacaatgtgccatgtgttcacaccctcgcgcatctcccccaggtcgaatccgtcttgattgcaacaagtaatgctacaaaggagaaggcacaggtaataagaacctacataaagcagctactacttggactcgagtactttcacaaaaatggaatcatgcacagagacattaaggtggatttttatttcactgataataaaggatgcataaaacttgcagactttggggcatccaaacaagtcgttgagttggcaaccatttctggtgccaagtccatgaagggtactccatattggatggctccagaagttattctccaaactgggcatagcttgtaa

SEQ ID NO: 37104 - DNA, 165 bp, Glycine max
  Peptide Sequence Number=SeqID_153882
atgacgctcaatgagcttggagccatcatctccacactgcatctaaagatgaagatccttaccttgataggagagatcgtgactatcaaggcagatcaaatgcaaggacaacccatcccttgtgttcaggaatcattacaacttaagagacccccagtcccttaa

SEQ ID NO: 37105 - DNA, 165 bp, Glycine max
  Peptide Sequence Number=SeqID_153883
atgaaagtctttggtttggaggagttgcatggtggcggggcaggtgttgttgtcggtctcgagccagcgttggatgttggagtggtcataggtgactctggtgcagaggatgacaagggatttcatgaggatgaaggagatagggcacttgaagaacctagatga

SEQ ID NO: 37106 - DNA, 639 bp, Glycine max
  Peptide Sequence Number=SeqID_153884
atgactgaagatgcaccaagattatttgcgttttcacaatttcagatcttgagggcattttggaggagagagcttagttcagaaccagttaatgttatacttgagaggttggagcaagaggctttcgctaaggccttggaagctagttctgaaggcaaaagtgttctagacattcctgaagcacaaacggttcatgagcgactttgggttgataaatatgctccaaaatcatttaccgagcttctcagtgatgaacagacaaatcgcgaggtactcttgtggttgaaacaatgggattctattgtgtttggatctgaaattcgaagcacatcagatgatgttttgtcatctttgaaacgacattcttctattgtccacaatcagaaaccattgaattcaaagtttccaaggatgaatggaggacccaaatggagtaatgggaggaggtatataaatgctagaagtatggatgagagtggtagttcaaagagtattcaagatgtatggaatgcaaagtcaaggaatattggtcctccagaacaaaagccaagtggttattcttacatagccatccatgcatttgtcatttttgagaagaaaatatgcaatagtgccaaattggtagaattgtgctattaa

SEQ ID NO: 37107 - DNA, 864 bp, Glycine max
  Peptide Sequence Number=SeqID_153885
atgtcctcgccatcagaggactacacgtccttgacttcagaggactacatgtcctcgctttcagaggactacaagtcctcacctttagaggactacatgtcctcgccttcagaggactataggtcttcgcctttagaggactacacgtcctcaccttcagaatgctacacgccctcgccttcagaggactatacgtccttgccttcatatggatgtacgcaaacgtttagaggactagacatcctcgccctcagagggcttcgtgtcctcatattcagaggaccccatgtcctcgccatcagagggctgcatactctcaccttcagaggactaaacgtcatcaccttcagaggactacatgtcctcaccttcagaggacgacacgtcctccccttaagaggaccacatgtcctcaccatcagagggttgcacgcccttgcctttagaggactacacgtcctcagcttcagagcactacacctcctcccctataaaggactacccatcctcgccttcagaggaatggatgttctcagcatcagagggctactggccgtcaccttcagaggactatatgtcctcgccttcagaggactacacgtcctcaccatcagaggacgacacgtgctcaccatcagagggttccacgccctcgccttcagaggactacccgtcctcaccttcagaggaatacacgtcctcctattcagaggactacacgtccttgcctttagaggaatggacattttcaccttcagagggatacacgccctcaccttcagaggactacatgtccttgccttcagaggacttcatgtcctcaccatcagaggactacacatcctcgccttcagaggactataa

SEQ ID NO: 37108 - DNA, 756 bp, Glycine max
  Peptide Sequence Number=SeqID_153886
atggtctacgacagatgcttaagtgacggtaaagccttcccattcatcaattcagcttacaatatccatggagaagaatttttgtgcgatggaggggaagatattaagccaaaataccttggtgatgatatagtgctactcatgggccttagtgatgaaaaagcagagaaaatatgcagggaagaagatgacagcaggctgtccatgtttcattcacaggagaaatggagcccacatttgaggactggtttcaggctagttcgggttttgtgctggagaattccattacatgcatgggacttggagaatatcaacaagatagtggcgggagtggaagaagaggtggactttgacgatgatcttgaagatctcaaacgcctggacaaggcacgagtgttactgaaaacaccatggcacccaacaatcaaccacaatgtgctgtctaaacaaatgcagaagcaacaggggtacttagaagggtcattagaggaaatatcgtcagatgaaagtgatgcggggttgagcttgctgtcgggaggaacactgcatgttggagagtctctgatgatacccatggtggtacaggatgagtcagaggatagagaagctgttggtggttgttcacttacaggaaactatctaagaaacaatgttcagagacaaagacacacagataagctgttgggctctagtacaaatggacctgatcctgttttccattcttgctttggtacgaaaggacctgatcctaattga

SEQ ID NO: 37109 - DNA, 660 bp, Glycine max
  Peptide Sequence Number=SeqID_153887
atgatagcgctcgcaaccgttctgctgtgtgggacagcgacccgacagggagctctcttgcagcgtgccgccataatctgcattcttgtcgttgcgttcgtatcgccgctttgtgcgctgacgacggcgcttttctccgcacgggtttcccatcatttcatattgattgccgtccttgcgccattgcttgcgctaaatcttgaaggacgcctgccgcgcttaccctggcggctcccagccctgccggaaattccgtttctcgcgcataccatcgtctattgggcctggcatcttccgccgggttattcattcgcgctttcaaactcccttgcttactggggcatgcagctcgccttgattgtaaccgctgtctggctatggaggacgatgctcgtctctgccggaccgggaaggagaattgcgctcgcacttgcaacgatggcgcagatgggcttcctcgcagccatcctgacatttgctccttatccgctttttgcagagcatctgctcacgaccgagtcttatgggatgacagcgctcgaagatcagcagctttcgggcctcatcatgtggacattcggtcttgtcccttatctcgtcgtcgcgctttcctccgtccggaccatgctgcagatgagggcatggcggggggtggaatga

SEQ ID NO: 37110 - DNA, 570 bp, Glycine max
  Peptide Sequence Number=SeqID_153888
atggagctcacgaagagcccggccggcgcgcaccagtgggtcgcgaaggacgccggcgaagtgattcccgatgcgtacgacgcgtcgaagaagcatcgtccgacgatgctgacgaccgacctgtcgctgcgtttcgacccggcctacgaaaagatctcgcgccgcttctacgagaacccggccgaattcgccgacgcgttcgctcgcgcgtggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 37111 - DNA, 339 bp, Glycine max
  Peptide Sequence Number=SeqID_153889
atgccgccgatgtattcatacccacatgattttcaaccagggtatagttttgcaggcatatttgggtcctctccttcttcaacgggaactccttcatttacccaaagtggtcaagtatcgaccccaaatgccccacttgctggtccgtggaatgtacctggagatatacccgacatggacgacttattaggggtcgatttacgtcatgatttctctgccgaggctgaccaagtggatgaaagggcgaatcctagaagaagaaatcctgatagggcagctagaaattgggaccggccatgtgggacttcgtcgcggcatcacagacatagtgatgattga

SEQ ID NO: 37112 - DNA, 627 bp, Glycine max
  Peptide Sequence Number=SeqID_153890
atgagcaaaggctccaagttcggccgccagcagcaggaagaagcctggcaaaacaccgaagtggacgcgctgtatctgctggccaaggccggggtgcgggtgccgcagccggatatctgcctggacggcgtgctgctgatggagctgatcaccgacgaagaaggcctggtggcgccgcgcctgagcgatgtcatcctgacgccggaacaggcgcgcgccgatcacgccctgatgatgaactacgcggtgcgcatgctgtgcgccggcctggtccacggcgacctgtcggaattcaacgtgctgatggataaagacgggccggtgatcatcgatctgccgcaggtggtggacgccgccgccaacaaccacgccaaaagcatgttcgagcgcgatatcggcaatctggcggaatattatggccagttcgcgccggagctgcgcgatagccaatacgccaaagagatttgggcgctgtatcaggaaggcaacctgacgccggacagcgtcctcagcggccggttcagcgaaaccctgaaacgcgccgacgtcggctcggtgctggaagagatccaggccgccggcgaggagcatcaacgccgcatgatggcgcgcaacgcggaagagtaa

SEQ ID NO: 37113 - DNA, 336 bp, Glycine max
  Peptide Sequence Number=SeqID_153891
atgggcgctgccctggtcgtcggtggtgatttcctcctgacggttgccgaggaaatcgcgccaggcggtgtgcgccagatcggcgcccagcgcgaccgtcttgccgcttttgccgccgttggtcagcaccaccacgcagccgggggcctaggcggtgccggcgcgggagaaggccacgcagtggctgtcgtcgaagtagtcggtttgcgggccgttggcgaaacgctggcgggcggcgatcagcttctccagctccgggatcgccggcatatcaatctggtactcgccgccgtcgcgccccttgtcgcggtagcggcgccatacaggtcgggataa

SEQ ID NO: 37114 - DNA, 399 bp, Glycine max
  Peptide Sequence Number=SeqID_153892
atgacatgggaagaagtggtggagaaatttttaaagaaatattttcctgaatccaaaacagctgaaggaaaagcagcaatttcttcattccatcaatctcctgatgagtccttgagtcaagctttggagcgtttccgtggcttgcttcggaaaacaccaactcatggattcactgatcccattcaactgaatatattcattgatggtttgaggccgcagtctaagcaattattggatgcttcagccggagggaagatcaagttgaagactccagaggaagcaatggagctaattgagaatatggaagccagtgatcatgttattttgagtgacagaacacacattcccacaaaaagaagtctattggagctttcctcacaagatgcactgttggcttag

SEQ ID NO: 37115 - DNA, 204 bp, Glycine max
  Peptide Sequence Number=SeqID_153893
atgcagacaaatgatgtccaagctccactttttccattcattgaaagttgtaagcagaatgtagaatttgaaggaagttcccagaattgtagaaagcaagggacagatgaaacggccacagctaagaatagtgcatcttatatcgggaagagattgttagaaagtttggttgcagttgcagggcttctaatttggctttcatga

SEQ ID NO: 37116 - DNA, 831 bp, Glycine max
  Peptide Sequence Number=SeqID_153894
atggcaattccattcaaaacaaaagatgtcaacgaggaagtaacctctaaagacattaaaagcctaatggaacaggcaaattataccaataaatacttacaagctttaggagaaaccattaaaactaaagtagttcctaaacaaaaatcaattgagggagctccgccaagtgtccccatcgaaattgaaaaacctttattcaaacctttcaaagttagtgagaaggctaaacggaaaattagggaacttagaaaaactaaatccttaactgagggcgtaggtgacaatcatagtgaattactaaacaagattggtagtttacttaaggtcattccagatactccccaaacctcggaaaatacttccaaaatggtaacaagaagtacctccaaattaattaatgttataaatgaagatagtgaccaaacctcagataacacaactgagataggatcagtgtcagaaaagaatataaatccaattaattccaaacactggaaaacaccctccaaattatattaccaacgtccaactgcccctgaccttctattagaagaaagaggtgaaaacaattttaaaagttttagtgcaaataacatctacgaatggaacatagatgcacaaacggagtataacatcatgaatacactccaacatatgaccatggtagccacggcttaccaaacctcccatgaatgttcagaagaaaccattatagatatcttagtggcaggattttctggccagctaaaaggatggtgggataattatctcactaatgaagagaaatcaaaaatttacagtgcagttaagacggatctcaatggaaaa

SEQ ID NO: 37117 - DNA, 330 bp, Glycine max
  Peptide Sequence Number=SeqID_153895
atggctatgaataaagagatggaatctcgtcaaaagaaccaaacttgggatttagttgagcaaccgaaaggcagacgagtagtggggtgcaagtggatcttcaaaaagaaatctagattgtccattaaagaattaatttgttataaagaaagtctagtagctaaggacatagagttagagcaactcgatgtcaaaactgtctttcttcatggaagactagaggaagacattctaatgcaacaacttgaaggttttgaggtggaaggaaaggaaaatgttgtttgtagattgaagaaatctttttatgggctgaagcaatcaccaagatag

SEQ ID NO: 37118 - DNA, 876 bp, Glycine max
  Peptide Sequence Number=SeqID_153896
atggcttccaaaaagagatgtgcttcctcttccaggcctcaggagccttatgacatgtccagatttgtgtttgagaccgcatgggagagatttaagatgaacgtgcatcataggaacattctcccagagagaaacatggagttagcttactcccattatgatgagttcctccgggagctggagcgctgtcagtggcataggaatctcacacgcctgatggagaatcatattaacctggcgttggttaaggagttctactccaacctctatgacccagaggatcgctcccccatacaatgtaaggtgcgggggaagacgatcaagtttgatgcctccatgctaaataccttcctggagacatcggtggtactcgaacctagggagaggtactcagcatactcccgcttctgccacacataccctgaccctcaagctattgcagccaaactttgtttactagggcgtaggtttatcctaaatgttgagggggcactgtggaagctgctgaggaacgatctgaccactctcgctcaaacatggagtgttctatcctactgcaacctcgctcctacttctcacacgtctgaccttaacatggacagagcaaggttggtgtacgacctcatcatgaagatggacatggacctgggctcaatcatttcaggacagatttctaagatggcccaatccaactcccctaggttgggctttcttgcccttatcacagccttatgcatagccagaggagtagtgtttgattctctgactttcgagtcccttaacccagccattaatttggcctatatcaggaagaactgctggaactcggaggatccttccatcacattccctaggtcccacaaggccaaggcctga

SEQ ID NO: 37119 - DNA, 284 bp, Glycine max
  Peptide Sequence Number=SeqID_153897
acatgattttgaaatccccaacggtgggaatgctcgtatttgggttgtgaacctggtgtttgaatttcacgacgatccaacggtgaacgagtacgagatcgtcgtttttctgagacaggttaggattctaatggccgctgacatgggagtcgctatcaaatacaaagatgagattctaatggccgctgacatgggagacatgggagggtgttgtagttgtcatgtttcatttgtagggaaggtgcatgatgtggaatctgaaagtaaccataataatgacgatg

SEQ ID NO: 37120 - DNA, 255 bp, Glycine max
  Peptide Sequence Number=SeqID_153898
atgttggtgcttgaaagctccaaacctgcagattcagttctagagttcttgggtttgatgctcttgtcattctgcaagaaacactctccactcaaggtaactcacatccccacaggttctgaagctgtctctaaggacactgcttcaacagaaaaagctcatgaacttataacgcagacacagttaaacaagccagcggatttgcataccaacttgacagaggataaactaatgaagccctacttgcttccgtga

SEQ ID NO: 37121 - DNA, 1363 bp, Glycine max
  Peptide Sequence Number=SeqID_153899
cgaccaagataccaccgtgtgtggaaataatagtaataacaacgattctaacagtgttgctaatagtgctactaatagcagtagcggtgtttataaggctaatgctatggccttggttctgaacctgagcgagttggcgccgaaaagcgatgggtttttcgtggggtctgtcgagagaaagaacgtgcgtgtttacgggttggctcagtgctgggagtatgtgaatggcagtgcttgtgagagatgtttggcggatgctgtcacgaggattggctcgtgtgccacgcaagaagccagggcgttgaatgctggttgttacttgaggtactctgcgcagaagttttataacaattcgggcgttgtgccaaccgctggaaaacatggaaaacggagactagctaaaattctggctgcgtcttctgctgccttggctcttctgctggtaattgcaacagttgttttctttataaggaagaatgtggtgacaaggagaagagaaagaagacagtttggtgctcttctggacacagtgaataagtccaagctaaatatgccttacgaggttcttgaaaaagcaacaaattacttcaatgaggccaacaagcttggacaagggggatcaggttctgtttataaaggagttatgccagatggaattaccgttgcaataaaaaggcttagcttcaacacaacgcaatgggcggatcatttcttcaatgagggcatggcctaccttcatgaggaatcacatgtgagaatcattcatagagacataaaattgagcaacattctgcttgaagaggactttacacccaagattgctgattttggacttgctagattatttcctgaagacaagtctcacattagcacagccattgctggcacactggggtatatggctccagagtatgttgttcgtgggaagttgactgagaaagcagatgtttacagttttggagttcttgttattgaaattgtatctggcaaaaaaatcagtgcttatattatgaattcgtcctctctcctacatacggtttggagcctctatggatcaaataggctatctgaagttgttgatccgaccctagagggtgcttttcccgcagaggtagcatgccaactgcttcagatagggttactttgtgcacaagcatctgcagagttgagaccatcaatgtcagtagtagttaaaatggttaataacgatcacgaaattcctcagccaacacaaccgccgttcatgaattccggtagttcagaatttggcaaatctggtttacctggatataattttcagcctggatccaacactcagtcttcagggaacaccataagtgaaagtgagattgagcctagataa

SEQ ID NO: 37122 - DNA, 291 bp, Glycine max
  Peptide Sequence Number=SeqID_153900
atggatagttttgcaagtagcagcaaagtttacggttgggataataatggtatgtcagtatggcaaagtgtattcagattttatgagaatagattaaaatgcaagcaaaaaagaagatcaccaatgtgtgcgttgcaaattgtttatttcaaggacggaggacaggggtcggaaggagaaagtttggatgacgatgtgaatgtcgaggctttggccgatgttggtcagtgcacgggcagtggtgttagagatgcaccgactaataaagagcatgttaataactatgattag

SEQ ID NO: 37123 - DNA, 801 bp, Glycine max
  Peptide Sequence Number=SeqID_153901
atgaagcacttcactgacaccctcatcagtgccaacataggaacaaaagctggtaccgggccccccctcgaggtcgacggtatcgataagcttgatgtgccatttcgcggcgaccgcgggcgaagccaggtaagagaggaatttcgcgacgcccttgtaggtcgccgggtccttgccggccagcacccacaggctcgcgccgccgatgatcgcgttctgcggcgcgcctttcacgttcgcgtcgtacggcagcatgcccgtgccgtagctgaacttcgcgaatttctgcacgttcgcgagcgcacccgacgacgtcgtgaggatcccgcagtcgccgctgtagaacttcgccgacgcttcgtccttgcggcccgcgtacgtgaacgtgccgtccttcgccatctgctggaggaaggagatgtgttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 37124 - DNA, 509 bp, Glycine max
  Peptide Sequence Number=SeqID_153902
atggcgaaggacggcacgttcacgtacgcgggccgcaaggacgaagcgtcggcgaagttctacagcggcgactgcgggatcctcacgacgtcgtcgggtgcgctcgcgaacgtgcagaaattcgcgaagttcagctacggcacgggcatgctgccgtacgacgcgaacgtgaaaggcgcgccgcagaacgcgatcatcggcggcgcgagcctgtgggtgctggccggcaaggacccggcgacctacaagggcgtcgcgaaattcctctcttacctggcttcgcccgcggtcgccgcgaaatggcacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 37125 - DNA, 144 bp, Glycine max
  Peptide Sequence Number=SeqID_153903
atgcaacctgacgagcaagttcttgtctctgtggtacttcctgctcttcacgctcaattgcttcccgaagaacttcagcagcgaaaaatggcggttcgtggcggaaagccaaaaatccgccataaaatatggcggatggcgtag

SEQ ID NO: 37126 - DNA, 483 bp, Glycine max
  Peptide Sequence Number=SeqID_153904
atgccttctcaatttgtccagaatcccataaatgcgagtgccattacattgaggtggggaaagcagtatcaaggacctcaaccagtagcatcttcttcatccgcaaatgaacctgcccaacctcactctactccagaaaaagatgatgacaaaaatttaaagagtaagttgcctaacaatttctatgtatgtgaatcttctactggtaattttgacttacagcagcagcatatccctcttccattccctccaagagtaatttccaacaaaaaaatggaaaaggcaaagaaagagatcttggaaacatttagaagagtacaggtaaacatacctcctttggatgcaataaagcaaattccacgatatgctaaattcttgaaagagctgtgcccttataagcggaagcttaaaggaagtgaaagaattagcatgggcaaaaatgtatccacattgattggaaaaatttgttccccaaatccttga

SEQ ID NO: 37127 - DNA, 258 bp, Glycine max
  Peptide Sequence Number=SeqID_153905
atggatcaagttgatccgtatgagtcttacggatcatatgcgaagcttacctcgacggtggaagagcaaaacggcactgtaggtcctcaacgccgacgacgaatcacccaatgcgagacaaacgaacctccaaggaaagcaaatgacgtcaggaggagaagaagaagaagaagctcgaattgcacagccagggcagggaaaagcgaagaagctcgtacggaagaagtgaacagtgcactgggtgtacacaacttttaa

SEQ ID NO: 37128 - DNA, 449 bp, Glycine max
  Peptide Sequence Number=SeqID_153906
atgtatacaggatcatggcttctccacctgcctcgcctccttctcctcttcctcgtcctcctcatcctccttcagacgcatcagcttcatcctggtgctgagagaccagtggtccacattgatcctgctaccggtaaggccgacggtccccataggaagaaattaagaacttatttggggattgtggcacgtgataaggtggacatcacgtacgagaactggaagaaggtctctactgctcagaaggacttgatttgggacgatattcagagacttctgacagtaggacaaaaagaaagttacttcagactatgggcgagagatggagccgatcacgacggtgtggatgacactgtctgtgaaaaatacggcataagcaaggaaaactgggcccagtttcgccagactcgtagagacccttcttgggaggatgtgcgcaaaaaggctca

SEQ ID NO: 37129 - DNA, 246 bp, Glycine max
  Peptide Sequence Number=SeqID_153907
atgaaaattggtagtggaatgctcaaaattaggatgttcaaaattagaatgcccaaaatcaggatgttcaaaattagaatgcccaaaatcaggatgttcaaaattaccaacaacaaaatgctcagattcaccagtaacaaattgttcgggatgctcaaaaggcacaaaatgttcagggatcaaagggttggcaaaaaaggtgggttaaaactacagctatactcaaacgatatccaaattagctaa

SEQ ID NO: 37130 - DNA, 3584 bp, Glycine max
  Peptide Sequence Number=SeqID_153908
ctgagctggttgtggttattgcggtttcctcacactctcactccaccactctcctcgctgggaatattcctgatatatatagtgtaatagtgtgtctcaatggagatcatactgctattggtaataatagtaatgctaagaatttcggattatgcaagttcttccctgttaaagcttttagcattatggatcaaaaaacgtggctttggaggaaaaaatcctcagaaaagacaattatagcagccgacaacacagatctctcttcaaaagaaaatgaagaggcacttgtagctgataaagaagaattggagaaagacttgaaaagattaaataccaaacttaattcggcactttctgatagtaatgctaaagatgagctggtgaagaaacaaacaaaatttgcacaagaagcaatggcaggtttgaagaaggcagacgctgaagtgttgtccatgaagcaagacctggatgaagctttgcagcagcgattagtttatgaagaaagagtagcccatttggatggagctctcaaggaatgtatgcagcagttacgatttgttcgagaagaacaagggcaaaggattcatgatgcggtgatgaaggcttcaaaagaatttgaaagagagcgcatagttctggaggaacagttatctgagacaagtaaaaggcttgcaaaagctgaggttgaaaattctcatcttaataaatccatatttgcaagagaaaatttgattgaagatctgaaaagtcagttgactcaagctgaggcagatcacagtgctctgatgaatagattagagtccactgagaatgacaatacctctctgaagtatgaggttcgtgtacttgagaaggaacttgagatccgaaacgaggagagggaatttaaccgtcgaacagctgatgtttctcacaagcagcacttagagagtattaaaaaaattgccaagttagaatcagaatgtcagaggctgcgccttctggttcggaaacggttaccaggtcctgctgccctggcaaaaatgaaaaatgaagttgacatgttgggacgggattcatttgaaatcaggaggagcaaattgagctcaaccagttcagtggttgaatcttcagttgacacttctcctgagactccaattagaagaatcaatactctgactgagaagttatgtgctatggaagaagaaaacaagactttaaaagaatccctggataggaaaatgaatgagctccaattctcaagagtaatgctttctcgcacagcttccaaacttttgcaacttgagtcgcagactgaggaatcatctaaagctctcgtaactgtggaacagcctagaagttacctcacatcacatgagttctctttggcatccatgtctgatgccggcagcgatgacaaggctagctgtgcggaatcctgggcttctgcattgatttcagaattggagcactttagaagcggaaaggagaaggaaccattgtcatgcaaaagtgttggagcttcagacatagatcttatggatgactttgttgaaatggaaaaattagcagtggtctctgttgaaaaagccactgaaatctcgtctgcttctctgaaagccattagtgagatcaatggcttctcagggattgagacaaaggaaaccactcctgaagtagaaggtaaggagatcattccagtgtctgatcacatttcgactgcgacaaatgagaccacttctgaagtagtaggtatggagatcattccagtgtctgatcagatttcagacctctcaaagtcaaataagaaaacctgttccattgacatatttactggcaatattcctggttggcttcaggatgtagtaaaaatggtattggaacaaaaccatgtcactaacaaaagctctgatgatatactcgatgatattagagtagcattgaggtatgtgaacaatcccgatctgtgtgactttgattcaagcaaaggctctggtcatattgacacacaggatcctccccagtgtattcattgcatctcatgttcaaaaaattctttggtggtaaatccatctggtgatgaaaataatgcagacatctcaccaataaagagaattgaatcacaatctcaggaagatctgagtaaatcaattggaaagataattgagattgttgaaagaatcagcctgcctgctgtggattatgatagttcagatcccttggacaaaggagatggggatatcatttcgtacaagaatgtaggaatgccaacaggctacatggttcgtgttttccagtggaaaacatctgaactcagtaatgttttacggaaatttctacatgtgtgttatgatttactgagtggcaagactgattatgaaaattttgccaaagaactaacaacagcattggattggattatgaatcactgcttttcacttcaggatgtttctagcatgaaggatgccatcaagaaacaatttgattgggatgagacacggagtgaaggtgaaacagagaatgagataagtcattttgcagaggaagacaagttgcatcttctgagaggaagcttgtcaactttacctcaagtaactactttggatggtcatgatcttcagaatggagagatatattataaggagaaagaagaacttacaaataaagaaaaattaatcagtgctgaatctcaaaaggaagtcttggaagggaagattcaatcagctactgataggattaaatccttaatgaatcaactccaggaatcagagaaaattattgacagcttgagattggagatacagtcctataaagaatcaaatggaaaacttgagaatgaaatcaggaatcagcaagtgataatttcaaatcttgaagaacatcatacagaagaagaattaaaggaggcttgtaacaaggttttggctttagaagtggaactggagaaaaagaacagcaattgtaaagaattagaggccaaatgtactgaattgcaggtccagcttgaaagcatgtcaaaggagtgctcaaacaatgatattaatgagaaagataaggcactgtgtaatgactgggagataacagctgcttcagaaaagttggcagagtgtcaagaaaccatccttaatcttgggaagcagttgaaagcgatggctgtgccaaaggatgcttccctttttgacaatgttgttgccacccaatttgacgcaaataccaacactgccaccaccaccactctcaccaccgccaatgtgaatccaagtcctgcccctccaaaatttatgaaagtgaaaagtcgatctctactggatcagatgctagctgatgatactaaagcaaaggttcccaaagcaagcgacggcaacgccaaccccatcaccattcctggcgtaatagagcccctggaaaagattctagttttgaaccgtgtaaacgatcatgaagacagaaccactgataaatctttggccattgtacctgctaagaaaccgggaagtggaactgaagaaggctctattgacattgcactggaccttccttatgagatcttggaggccatgggaaatgaccctaagttcatggacgtcgtgtcgtcgttcaactaa

SEQ ID NO: 37131 - DNA, 465 bp, Glycine max
  Peptide Sequence Number=SeqID_153909
atgtttgggtatcttccacatgagacaaggactccttcttttccttccttccatcgggggaaccaactgattgttctacctcctatcccagccaagagctggtcccaatctattctcctcttttcaagagtgggcaagcaacagatgatccgtgcgctactcttttcgcaccttcggtcaaatgtgtcaaataaatctgccaagacagctaccaccggactttccttgctatggtggtacttccatggtaggcccgctatgccgtttcgagtctgttttatgcggtccaaacctctcgctgaatccttgaccacagttgcaattctgctcaaagaggggagacacccggaggaaaggtatggttttcttcccctgagaggacatcctagaatttcctcaaattcttcaatggttggtaccaattggaagtctccgaacgtgaagcatctcaaaggctggtcgtag

SEQ ID NO: 37132 - DNA, 549 bp, Glycine max
  Peptide Sequence Number=SeqID_153910
gctcattggaatctcgccagaggccaacactactagcaccgctaccataggaggtggcagtgctttttctatcaaagagcatcaacggagtgatcccaggaacagcgacgtcgaagaggatttcctcttggaacagcgacaggccctcattcatgagcctgtgcacgagcatcagcaccttgactgccacgccggctacgctggctacccgtggtccaactctcccccgctagtgccggctatgcctccgacgacgtcgttcatgcctccggtcgcacacgcgagcgctagtgaggaagagcataggttattcctgttagggttacacaaagttggaaaaggagattggagaggaatttctcgaaacttcgtgaaaactcgcacgccaactcaggtcgctagtcacgctcagaagtacttcctccgtcgccacaaccagaaccgtcgtcgtcggagatctagcctcttcgacatcaccataggtaaagagggagagaggagggaggggggagggaagaacaatgaccgtaagaacgacctctcaatccg

SEQ ID NO: 37133 - DNA, 2607 bp, Glycine max
  Peptide Sequence Number=SeqID_153911
atgggtgatcggattgaagctctggagacacagatgggaaatgtcacaacgacattgcaagagcttgctctgcaaatgtcacaacacgctcagcagatgcaacagcagagtttggttttaactgagctcagtaaacaaatcggtcagaagggagcaacacaagaaggtgaggcttctgtgggtgattcatcacagaacgagtctcgtctcgccggaaagaaggtgaaactacccctcttcgaaggtgaggatccagtggcgtggatcacacgtgctgagatctactttgacgtgcagaatacaccggaggagatgcgtgtgaagctgtcacgattgagcatggaaggatccacaatccattggttcaatttgctaatggaaacagaggacgatctttcatgggagaagctgaagaaggcactaattgcgcggtacggtggtcggcgattagagaatccgtttgaagagttatctatgttgagacaaacgggaagtgtggaggagtttgtcgaggcgtttgagctgttgtcatctcaggtgggacgtttacctgaggagcaatacttgggttactttatgagtgggttgaaagcacccatacgacggagggtaaggactctcaaccctgccaatcgtatgcagatgatgagaattgcgaaggatgtggaggaagagcttcgcgaggaagacgatgatgaaaacagggcctctatgaagaagaatgtgggtcgtagtgaatatgggcctggatctaaattccggactgggtccaacctggcccagaaggaaataacccgtttctcaaaatcgggttggactaacccatctcgcaaaactgtttctattggatccacttccaatacgacgtcgtcgttgagttcaacaggaaggaaacacgaaggggatcgtcgtggtggtacgaacgatcggtggagagggattaacagtgaggaaatggaggaaagacgagctaagggcttatgcttcaagtgtgggggtaagtaccaccctactcaacacaaatgccctgaacgttcactgcgtgtgcttattttgggtgatggtgagtctttgaatgatgacggtgagattgtagccatggagggtgaagagtcggaggaggaagagatgacggaggcggagtgtaagttgattggagttctggggaagatgggggagtctcaaacaatgaaaattgaagggaagttggagcatgttaatgtgggtgtgctcatcgatagtggagcaagccatagtttcatctctccagagttggtcactgctttgggtttgaaggttactccaaccactgtgaagaggatcaagttaggggatggtcacaaggtgttatctgaaggggtttgcagaagagttagacttgtcctagggtctaatgagtttgaaattgatgcgttggtattaggactgggtggtttggatgtggttctaggagtctcttggctcagtactttgggcaaggtggtgatggattggaaggatctaaccatgcagttttggcataatggtgaaatgatgactttgaagggtcaaggtggaaggcagttagttcaaggatgtttgcacacatacttagaagggaaggacagagctatgagtcctgttgagttatggtctcttgaagagaagctactggacagtaatgtgaaaattcaaggaaacattggtgatttactgacaacttttcctgaagtgtttacagaacaattatcattacctcccataagaagtcaggtacatcagataaatcttattcctaattatggacctgttaatatgcgaccatataagtatcctcatcaccagaaggaggagattgagaagcaagtggctgagttacttcaagctggagtaatcaggcctagtatgagtgctttctctagccctgttattttagttaaaaagaaagatggctcttggaggatgtgtgtggattatagatccttgaacaaagctacagtgccagacaaatatcctatacctgtagttgatgaactgttggatgagttgtttgggtctacagttttttctaagattgatttgaagtctggctatcatcagatacgggtgcatgagcaagatatccataagacagcttttagaacccacaatggccactatgaatatctggtcatgccttttggattgatgaatgctccaacaacatttcaggcaacaatgaatgatatattcagaccctttcttagacagtttgtgctggtgttttttgatgacattcttgtttatagcaagaatgaacaggaccatttgaaccatgtaaaactagtgctggaagttttggtgaagcattgctttgtggcaaacaagaagtgcagttttggttgttcacaagtggattatttaggccatatcatctctgctgttggtgtgtctgttgatcctagtaaagtgaagtgcataatggagtggcctgagcctaagactgtaaaaggggtgaggggtttcttaggtctcactggttactataggaagtttgttaaagactatggtaaaattgctagaccactcacagatttaacaaaaaaagacaacttcttatggaatgagtctgctagggaagctttttag

SEQ ID NO: 37134 - DNA, 463 bp, Glycine max
  Peptide Sequence Number=SeqID_153912
atgaagcatattgcgcttttttcggtcgcgtttctattttccgcgatattcgtgagcgaagctgaggcgcggaagtcccggttttttgtcatccccggattcggcggcggcgagaccatcgatcttgtttatgatctgccggacagagagccttttcttcgcgacggggaagcattcgacattggttatctcaacagcggggataggagcggttatgtgctgtatcgtggcgagcgttacagcaggctcagcgatgcggacatcgctaggctgaaggcgacgcttggttttgatccgacgacaaaagaccgcatggagcgggcggcgagggccagcgacgcgccctggaacctcgtgattatcatagcggtcgcaattgttggtatcttcgtgcttgttcacaagggcatgcagctagtgcggtggatttcgcgactggcgacgatctccgcagctgcgggaa

SEQ ID NO: 37135 - DNA, 642 bp, Glycine max
  Peptide Sequence Number=SeqID_153913
atgaaagagaccccggacggaagagacgactatcccttctccgttccggcgctacgccacctggaacgcctcgaattcaagacgccgatcacctttttcgccggtaataacggctcgggaaaatcgacactgctggagggtctggcggcgggaatgacggcctatgccatcggcaaccatggccaggtcaagggtgatctttatctccagcatgccgaaaccgtggcgaaggccttctattttgcccgcaaaaaatatccgaagattcgcatgtttctgcgcgcggaagacgtgcttggctatatccgtcgacagaacgaggaagcactggacgattttcgttgggagcgggaaaaggctttaaaaaacggcgagtattttccggaggaaacgccggagacatttcgcgggattgtcaggaacaacagcctcgaccgacgatcgcatggcgaaggcttcctcgatatcatgcatcggcgcctgcatggcgccggcctctattttctcgacgaaccggaaagcccgctttcgccgcaaaagcagctcgaactggcagcccttatccgcgacgccgccgatagcggcggacaattgattatcgctacgcattcgccggtgcttttggcgattcccgaggccacg

SEQ ID NO: 37136 - DNA, 241 bp, Glycine max
  Peptide Sequence Number=SeqID_153914
gatgactcaagtgacgatgctgacaccaaggttgcttgcaaagcatcggatatgcgaaagagggagaataggtggcagttagcagcaggaacaggaccagcaactagggttgttcacagagcagccgtctttccgtctcaagcggagaagacatcaaaagaatctttatctatggctctaccagggaatcctagtttaccttttttctccaactcgcttattatagtgggaagctcggctg

SEQ ID NO: 37137 - DNA, 441 bp, Glycine max
  Peptide Sequence Number=SeqID_153915
atgccctcgccttcagagggcaactcgtcgtcgcctttagagggctacacgccctcgccttttgagggctacatgccctcgccttcagaggactatacgtcgtcaccttcagatggctgcatgtccttaccttcagagggctacaggccctcaccttcagaggactacacgtcctcaccttcagagggctacacgcccttgccttcaaaggactacacgtcctcgccttcaaagggctgcacgtcctcacttttagagggctccatatctactcctttagaggacttaagggatcgcgcccgcaagacatcctgtggacccggagatgtccaacagggtcttggggatggccggcagcggacaacagacgcaccgtcaccacctccaaagcccctcaactcatatacaaaggctggagcgttgcctacgacccgtggctga

SEQ ID NO: 37138 - DNA, 399 bp, Glycine max
  Peptide Sequence Number=SeqID_153916
atggggacaaatcaaaacggcaaaaggttttatcaagtcaaggttaaaggtctagatgtcactagcctcaaggaattgggacgattgatgggacccctccaaaggcaagccttccgcaaagtttacgggaagattctagatttgaccgtagcggaggtatttacggaagctgtcatatccctcgcccaatactatgaccagccattgaggtgtttcacgtttggggacttccaaatggtaccaactattgaagagtttgaagagatactaggatgccctctcggggggagaaaaccgtatcttttctccggctttcttccttccttgagaaaggttgcagctgtgattggagattcagcaaaagagttggatcgcatgaagcaaattcggaacggcgta

SEQ ID NO: 37139 - DNA, 147 bp, Glycine max
  Peptide Sequence Number=SeqID_153917
atgatttataaggagtttgtccatttctcagatccagctataggtcagacaacacatcctcgtcagaagctcgtcggatacgaagaagaagcatcagcattacaccagagattggagatgatatcatgcccaggtcagaactggtaa

SEQ ID NO: 37140 - DNA, 189 bp, Glycine max
  Peptide Sequence Number=SeqID_153918
atgaatgaaactctgaagcaaaatcgtcttttgagagaacgaggggatgataactcattccccaattctccaaacaatagtagtagtgatgcaaatcttcagaaaaatagttgtcttggctggaaaaatctcatcttaagaaattatcttctctttgctaatatttaccagacattgatgctagaataa

SEQ ID NO: 37141 - DNA, 745 bp, Glycine max
  Peptide Sequence Number=SeqID_153919
gctgatttggcaattggccggtttttatgccaggcagcatgatatagggagagtggagggaataggggaactgtccaagccaccgaagatgactgagagagttgaggcgttggtagctaagggcatagtggcagaggaggtgcatagttttactgtggtgattcattggttgagtatcggatggcagcaaggaagtgcagtgcagcgtacatcgaaggaagtgaaggtcaagctgacgaaactcaacatggaagggtccaccatccattggtttaactcgttgtatgagactgaggaccacttgacatggcttgagctgagacaagccatgattgagaggtgggtcggcttccggatgagcaatacctgggctacttcatgggaggactttgcccagatttacggttacaggcttgtttacatggaggaggtgctggagggcttatcatgtgacgacaaaggacacttggggaaagtgggaaacccacagcaactcaaggggttatctgatggggcagttatgttagaagtgaatgactttttgaaaccgaaatcaatcctactgaccagtagagacagcaggggggctaataaagatgctactggggaagatgaactgattttgcacagtcaatttcctcctctcaatcttggggacaaggttgttcttccagcggcaggatgtgatagagcactgaaggagaacactgagagtaaggctgaacaaggcatggatgagtattga

SEQ ID NO: 37142 - DNA, 1218 bp, Glycine max
  Peptide Sequence Number=SeqID_153920
atggaggtaatggagggaggtgttaggaacttagggtttggaagggagtacacacgactaaggcatcaatcctcgttgaggacaattttgtcaactcacacaaagtgggacgtgttggaagcaaaactcaccgaactcaccgtaacaccaaacaaccaccaccaccaccaccaccgtcaatccaaaagcaaacccccaacaccaccctacaccatggactccatcgccggagctccaccccacgccgacgtcacccctccgccgccgcgcccgtcgccgttccccggccgggaagactgctggtcggaggaggccacgttcaccctcatcgaagcgtggggccagcgccacctcgaactcaaccgcggcaacctccgccagcgccactggcaggaggtcgccgacgccgtcaacgccctccacggccacgtcagcgccaaggcccgccgcaccgacgtccagtgcaagaaccgcatcgacacgctcaagaagaagtacaagatcgagaaggctagggtttccgattccggcgactccgccaccacctggcccttcttccgccgcctcgatttcctcatcggcgacaatttccccgccaaaaagccctcccctccgccgccgtcctccgccggagtaacccgtcggagcacccccccggccaagtccccgctgtggcccgtcattcccgtcggccctcgatccggcaccaagaagcggccggcgcaggcgaagccggcgtcggcctcgccagatagtgtcgccgactcgtacttccgccggaatttctcggtgttcgccgccgccgccgccgcggcggcggcggaggccgacagcgagaattcggatgggtcaaaatggagcagtgggagtgagaaagggacgatgaagaagaaaagaggaagaggagattgggaatttgggtacagagagatggcagaggcgttggagaggtttggggagatttatgagagagtggaagaagcgaaacagaggcaaatggtggagttggagaaacagaggatgcagttcgccaaggatttggaaacccagagaatgaaactcttcatggaaacgcaggttcacttgcagaaaatcaaccgctccaaacgttcttctgcttctgagcatgatgatacacttttgctatggaactttcttgaaaaagtgttttctccagatatcttttgttcgtttagagtgctacctggggtttcatga

SEQ ID NO: 37143 - DNA, 705 bp, Glycine max
  Peptide Sequence Number=SeqID_153921
atgaaattgtatgcagttatcttgtttcttggtgcttgcacaaagcctccacgcttgtcaatggtcacagaatatatggagttgggatcattgtattacttgatacatttgaacggtcaaaagaaaaagcttaattggcggagaagactaaggatgttgcgtgacatatgcaagggtttgatgtgcatacacagaatgaaggttgttcaccgtgatctgaaaagtgcaaattgtctagtgaataagcattggactgtcaaaatatgtgattttgggctttcaagaataatgacagagtctcccatgagagattcttcatcagctggaacgccagaatggatggctcctgagcttattcgaaatgaaccgttcacagaaaaatgtgatatcttcagccttggggtgataatgtgggaactctgtaccttgaacagaccatgggaaggagtaccacctgagagggtggtttattctgttgcgaatgagggttccagattggagataccagaaggccctctaggcaggctgatttcaggtccctgcaactttcctttgttacatgttgatggcagaactcaactatcgacttcaactaattactttggttttgttttgtctgcagagtgttgggcagaatgtcatgaacggccaagttgtgaggagattctttctcgtttggtggacatcgagtactccttgtgctga

SEQ ID NO: 37144 - DNA, 595 bp, Glycine max
  Peptide Sequence Number=SeqID_153922
gcacatggctacaccacccaactcacctcctcctcctcctgagtcagcaacaccttcttcaccgtctacgtcaaagaagacaagaaaagcaacacgactcagatcattggctactagaccaattggggtggagagaccagtggttcatgttcatcctgaaattgggaaattcgatggtccacatagaaagaaattaagaatatatttggggattgttgcttgcgataagatggatgttacatatgataattggaaacaagctgaatttgatattcctgaatcatcctatttgaggagaaaaaagaaaatatttcagactgtaggagaacgatggaggcaatttaagttagatttgacttccaaatgggcccaagcacacaacaaggagggcgaggatgacaaagtatgtgagaagtacagaataagtaaagagaagtggacccagtcttgtcagagctgtagagacccttcatgggaggatgttcaaaagatggagcaaaccattcaaaaacaaaacactacccctcacgtattgtctagtgggggttatgattttctagaaaaaaagttgatggaggagaagcaaaagaaatga

SEQ ID NO: 37145 - DNA, 1236 bp, Glycine max
  Peptide Sequence Number=SeqID_153923
atgcagaatgacaaagccggggtgagcgcacaggatgtggcggatcgggcgggcgtgtcgcgctcggcggtgtcgcgcgcctttacgcccggtgccagcgtttctgcagccacgcgtgcccgggtgatgaaagcggcgcaggagctgggctatcacgttaaccacctggcgcgcgggctggtgcgcaaccgcagcggcatcgtctgcctgatcgtctctgaaatcgccacgccttaccgcgccacgctggtgcgctggctgacacagtttttacaggaagcaggcaaagtggcgatgctgattaataccgatcgttccgacaacagcgtctccgccgcgctgctgcaggcgatcaattttcgcgccgacgcctccatcatcctttccggcatgccggatcgcaccatcacccgccagtgctatcagcacggtcagcgcatcatcctgatcaaccgcgacgaagcgctgccgggctcgctcagcatcaacctcgacgcgcaggcggcggccgaaacggcggtgatggcgtttcagcgcgccggctgtcgtcagctggcgttcgccaattcgctggccggtacgccgagcctgatcaaacgtgaagcggcgtttatcgccgtggcagagcgcgccggactgacggtcagcgtggagcggttcggcaccacctcgtatgagagcggtcagattctggcgcatcgcctgctgacgcgtcatcagcgcccggacgcagtgttctgcgtcaccgacctgatggcctgcggtttcatggatgaagcgcgccaccgtttccagctgcgcgtgccggaggatttgtgcctgatcggctacgacaacatcgcgcaggctggctggtcctcttacaatctcactaccttcgcccagccggtggagcgctttgcccgcgacgccatcgcgtggctgacgcagaccgaacaggaggagagtggttttacgccgcagagtgagcagcagcacgacacgctactgtatcaggctgatgtggtatggcgcggatcgcggtgtgcggcatcctgctccagccgcggatgccatagctgtgacaccgtcacctctggcgtggcaaacggtaattcaaacatcgcaaacgccggattatctttgattagcggatggtgcaggcacagcgtatgcggcaccagcgccagccagtcgctgtgcagcgtgagcgcgacggcagtggaaaaagcgggtaccacggccgccacctggcgg

SEQ ID NO: 37146 - DNA, 889 bp, Glycine max
  Peptide Sequence Number=SeqID_153924
atgcgctacacctcactggccatcgcgctgtccctcagttgcaccgcgctgccgtttgctgcgacggccgctggcaatctcaatatggtctgctcggcggacgtggtggtgtgcgaacatatgacgcgcattttcagccaggcacatccggatattaaagtcagcatggtgcgcctgtcagcgggtgaagcctatgcccgcctgcgcagcgaagcgcgtaacccgcgcaccgacatctggtgggccggcaccggcgatccgcatatgcaggcggcggaagaggggctgacgcagccgtataaatcgccgctgctcgaccagcagcaggactgggcgcagaagcaggcggaaaactcaggttaccgtacggtggggatttatgccggtgcgctcggctggggctacaacaccaaactgctggcggataaaaagctcaaagcgccagcctgctgggctgatttgctcgatccggccttcaaaggcgaaattcagattgccaatccgaactcgtccggcaccgcctataacaccctggcgacgctggtgcagatcatgggcgaggacaaagcgtttgattacctgaaaaagctcaacgccaatatttcccagtacaccaaatccggctcggcaccggtgaaagcagcggcgcgcggcgaaaccaccgttggcatcgtgtttatgcacgacgcggtggcgatggaagtcgacggcttcccgatcaaaaccgtcgcgccctgtgaaggcactggctacgagattggctcaatgtcgatcgtcaaaggggcacgcaatctggccaatgccaaagtgtggtacgactgggcgcttagcgccgaagctcagtcgcacatgaaagaggccaaatccttccagctgccgtcaaaccgca

SEQ ID NO: 37147 - DNA, 309 bp, Glycine max
  Peptide Sequence Number=SeqID_153925
atgaaatgcgttttcattcatgtgtcctccaccttcgagttaggagctatcgtggtgattgcttattgtaattctccattctcaaccccttttcggagccccatgaattgtgttttcgttcatgtgtcctccaccttcgagtttggagctatgcgtagtgattgcttagtgaaattctccattctcaacctttttcggagccccaagaattgcgttttcgttcatgtgtcctccaccttcgagtttggagctatgcgtagtgattgcttagtgccattctccattctcaatcttttcggagccccatga

SEQ ID NO: 37148 - DNA, 240 bp, Glycine max
  Peptide Sequence Number=SeqID_153926
atgggatcttcaagctacgatgaagatttgtgtggaaaggctacagttgtcgtcggtggtgatgaagcaatcaacgacggtgaagttgaggttgttggcaaagaactaggcaaacaaccacgctctgatcaacgagttcgatgctctggtgtagcgatcgtggaagtaggaacatgctgtgataacgttgccgagtttgtctctgctggaagagaacaaagcactaataacgaatgttag

SEQ ID NO: 37149 - DNA, 225 bp, Glycine max
  Peptide Sequence Number=SeqID_153927
atggagaacatgcacaggctgtccttacatatgcagatggacccaccgctcatcactccagaggcttatcgtcagcaggttgcctggccaggagaccagccctccactgacaggggggaagagccttctggagccgctgaggatcctgcggtcgatgaagacctcattgctgacctagctagcgctgactggggtccatgggcagacttgggcagaggcagttga

SEQ ID NO: 37150 - DNA, 195 bp, Glycine max
  Peptide Sequence Number=SeqID_153928
atgccactaatctttggaaacactggttctggaagcacaagtcaggtcaggaaatggaacatgaatagtacaaggtgggaagccaagccccaatacaagccaataaagtccttagtgatccacctaaaggttgttagtaaaattgcaaacactgaaccagacacttatgagcagagggaaacaccagccttgtga

SEQ ID NO: 37151 - DNA, 466 bp, Glycine max
  Peptide Sequence Number=SeqID_153929
atgccgtattatatacagagactttataggctgtgcaaggcttccttttcaccaaatggacctgtctcagaagaagccattgcaaaagtttgtgagaagttagatgtcagaaaacttcaaaccttctccttatctcctcttttcctctttagggtttgtccttctgaaggagaaaaaatcaagccgtcagatgtaggtcttgagcaggaagcacaagtggttcgtaattggtctagtcaaatgcctgaatgtaacgggaaccatcaacagccaccaccaatcaaatacctgcatttgtatgaagatgacagcttctctataggaattttttgtatgcccccttcatctgttattcctctccataatcatcctggaatgacagtcttaagcaagctcttatatggttcagtgtatgttaaatcctatgattggattgatttccctggcccaactgattcatctgaag

SEQ ID NO: 37152 - DNA, 150 bp, Glycine max
  Peptide Sequence Number=SeqID_153930
atggggaaaaaatcgaaacagagcgtggaaggaagtagcggagagagaagcgaacctgagaaagccatggagaagaaggtcaagcctcagcaagatgccttattttttctgtgtgactttagagtcgtttttgtaaccgtagctaagtaa

SEQ ID NO: 37153 - DNA, 1167 bp, Glycine max
  Peptide Sequence Number=SeqID_153931
atgaggggtgcaagtgcaccccctaaaggcatcaagcttaacattattccagacgttgacctggagcataaacccagcacgacaaaggatatgataacttttgagtacactgcccagagagaaaacacatccgtcactgttaaagtgaaaatcacgacactcaagtggaagagggaggtcggcgacggctgctacttcaatcggcgccgctaccgaggtctccgtcgcggcggaaaggggcatctccgctccactacggcggctattgactactatgttatggaagattctgatcaacctgccaaatctgctgaaaaccagcaaactgaacaagtgtgtagttttttcagaaagccggttaataaaaagaatttaaggaagcgaactattgaaattgaagataatgaggaggactcaaacaatgaaacttctctgttgcatattcagaagaaaaccttaaaggctgacaataagttgtacttttccaccggctcttcaaaaagctctgcatctgctgaaccaagtgaagaatctggaaaaacagtctttcaatttgagtcttcaaaagagattcaagttcaacatgatagcaaagcaacagcaattctagagaccgagactgagttttcaaaagatgctcgtgccatccgcgaaagagctcttaagcaagcagaggagagtctgaaagggaaaagtgcaagctctgaggataaaaaattatataagggaatgaacagttacaaagactacaaggctggctttcgtagggagcaaacaattgctagtgaaaaagctggagggtcacatggtcctcttagggcttcagctcatattagagtttcagcaaggtttgattatcagcctgacatatgtaaggattataaggaaactggttactgtggatatggtgattcatgtaagtttatgcatgatcgaggggattacaagtctgggtggcagatggagaaggaatgggaagaagctgagaaacaaaggaaaatgagattggctgcaggagaggatgcagatgaggaggagggtgctaatttgactgatgaagatgatgaggattcgctaccatttgcctgtttcatttgtagaaactcttttgtggatcctgtagtaaccaagtgcaagcactacttctgcgagcattgtgcattgaag

SEQ ID NO: 37154 - DNA, 426 bp, Glycine max
  Peptide Sequence Number=SeqID_153932
atgaaagatggagagtttgtggatgacatgtttggaagactccatgttcttctaaaagaatctagaagctcttggacagatatattcaaaggcttagataaacttgaagttgttggacaactttcgttaggtatgggaaccaaagaccacaaccatccaagaagcaagagatctgaaaaaatatggcatgggatgagtagttgggaagttcaaatagatgatagagaagaagggaaagttctaacactcatccgggatgacttagacaatgagaatagtagcaattcagaagatgaacaagtcaacatttatctcatgacagatacaaatgataagatcgagataaaaacttgttctaaatttgatacctcttcgtgtacttcatcaaacgataaaaaggatatgccctatgatgttcttctttag

SEQ ID NO: 37155 - DNA, 234 bp, Glycine max
  Peptide Sequence Number=SeqID_153933
atgagcctcagcctgcagagccagggttttacttcttttccgtgccctactccggatcagttcagggcagaggtcgcttggcctggagattggcctgaggcccgagcaggagaggcacctgcagaggcacctgcagaggcaccagcagaggctcccaacgaggcagatgaggcccgtgaggacgaggagattgccgatttacttgatttcttgggagggagcggggccacatga

SEQ ID NO: 37156 - DNA, 297 bp, Glycine max
  Peptide Sequence Number=SeqID_153934
atgttggcccagcggaatgtcatgcaagaattatattccctcctaggattgccttatctagaagcactccaaagatggtttactgttaaagcgggatatcatcaagctgtcgatgctaattgtaaattcttagcttactctagccacacccctggagatttatggaagacactcaggaagatcaaaactttacagaagtgccagaaccttgcttggacagcttgtaaaaatatcctcacagtaatgttaaatctgaaatctagaggaacgaatgtggatgaaaatgatcgtgcttga

SEQ ID NO: 37157 - DNA, 249 bp, Glycine max
  Peptide Sequence Number=SeqID_153935
atgacagtctctggccaaaatttaagaggggtattctttgttccgatgcaacaagtgattgtcaatcatccagatctgtggtctgctgaaaatggagtaaataagaatggatctccagagctgcacatcatgctcgctgagtacataatttctgaaagtcctgaggtggttttttgggtgggcaggttacatgaagataagaggaatttggaagccatggcgtggatgtttggagactcaaattgttaa

SEQ ID NO: 37158 - DNA, 273 bp, Glycine max
  Peptide Sequence Number=SeqID_153936
gtgctgcaagagcaagaagtggatgggtttcaagcaccctgcaaggaatgtaaaggaagcaagttagctggtcttagaatttggacattggacttaactcaccaattaactaactctaactgcttgaagttggacattggacttaactcaccaccacaaaaccgggttgtaagtcaatgtgggatctcaacacaccctgcgtcatgcacaatcggcacaagacttgaatctggagcatggcccaataacaacaacatctcatgtcacggctaa

SEQ ID NO: 37159 - DNA, 285 bp, Glycine max
  Peptide Sequence Number=SeqID_153937
atgcatactcaacagacccaccacgattcagccccaaagctcgttacttttccctccttcaaggtgaccccacaagcaaaacgagaccccaatgttatgaaaaatcatcaatttcctcgagggaacaacatggctatgctccgacacgacaacctcggagaggggaaaagaagtgtttttttgcgacgtgaggttcgagcttggtcggcgggttcgttgaatctagggtttatggagaaaaattggcagaagaagaagaaagaggaagaagaagaaggaagctaa

SEQ ID NO: 37160 - DNA, 381 bp, Glycine max
  Peptide Sequence Number=SeqID_153938
atgaaatttaaaggcttttatcacctcacagtcttgtttatcatctttctctttcatgctagagctgcaaagcttgtcaaagataccgagatgacagcaccaactgcaacaacagttctgtatcctacccttggagggaacatacatacttttagggcaataactccctgtgcaatctttgatgtgttgtctccaccttattcctcagaacatggaagacactgcacttacttccggaaatcgcagaggaaggatcttccaggtaatcttcagttgaatggagttacagtttctgatgtgacctggttggaagaatttcaacctcccgatgactttgtgatccgtagagggatttacaagggtcctgtcattagaacttaa

SEQ ID NO: 37161 - DNA, 690 bp, Glycine max
  Peptide Sequence Number=SeqID_153939
atgcaaacattcttattttgggaaaaggccaaatcacgatcacgttggaggatggttcaaaaaatttcatctctgatgttttctatgctcctgatccatcataacttattaagtatgggacaactatcaaagaaaggttttaacatgaagattcatgagggctactgcatgttgattgataaaaatggaagattcgtcgccaagtttcctgttgtgaatgttcctaacggagtgtacgagacatgtgaaattggaaagaagcatagagattcattttcaaccggaaaatcttggagggcaagaaagctgcttgagataattcactcatatttgtgcttagttgagattccaacacctggaggtagcaggtgcccaactaaaactgttcgtgacaagacattagaagaaacctggagtggaaggaagaaattggacgataaaggagaaaaatgtattttcactggctacaacactaagtcaaaagccttcaagctttataatccagagacaatggcggtgattatcaacagagatgtgacgtttgacaagaaaggcatgtgggatcggtcttcaaagtctcaacaggagcaaatggtgatcgttgacaacaatgaagaaaatgatgaatggctgctagatccaacacctgataagccaaaatcatctaggaggctatggaggaatccttaa

SEQ ID NO: 37162 - DNA, 756 bp, Glycine max
  Peptide Sequence Number=SeqID_153940
atggatgatgagattcatgctattgagaagaatgacatgttaaagaaggctctgtatgggttgaagcaggcaccaagagcatggtataagaagatcaattcctggtttgttcataatggctttgaaagatgtccttataagcacacattatatgtcaaatctattgatcctggagatattctcattatgtgtctttatgctgatgatctaatcttcattggcaacaattcaaagttgattgtagaatttagggaggttatgataagctgtttcgagatgacaaatttaggcttgatgtcctattttcttgacattgaggtcaattggcgagatgatgggattttcatctcccagaggaagtatgcacatgatattctaaagaaattcaagatggagaattcaaagtttgtttccacaccagttgaagaaaagctgaagctgataagagatgttgaaggaaaaagggtggatgcaactctatataagagtttgattggaagtccgagatatttggttgcaacaagaccaaatattatctttggagtcaatttgcttagcatattcatggaggagccactcattagtcatctgcaagaagctaagagagttcttagatatatcaaagacagtgattgggcaagagatgtggagataagaaaaagcacgtcaggatacgtatttcatctgggttcaaatgtagtgtcatggttctcaaagaaaaaatcattagttgcactttcaacggcggaagcataa

SEQ ID NO: 37163 - DNA, 159 bp, Glycine max
  Peptide Sequence Number=SeqID_153941
atgactagctgcgaggtaaggttcctttctgtagcagctcagggtgcattattagcaagtgggactggttggaatgtttgtgtccccatgcctctcgtccaatttccttcttgcctacatctctccgtgataatctttactattaatgtcattagttga

SEQ ID NO: 37164 - DNA, 774 bp, Glycine max
  Peptide Sequence Number=SeqID_153942
atgcagaagggtagagaagttcgagataataacatttttgaaccaagaggatttggagattttgggggctttggatttcatagaagtatgatgccaagtctttttggagacagggacccatttgatgatccctttttcactgatccatttgatagcttgtttggtccaagttctgcatcaagagcaatgcagaagacaaatagagaaaaaggaatagttatagaagaattagactctgatgatgaggggggtgataatggccctgaaattggagacaaagattttgataagaaaaaatctaaatcgaccacggaaccatcggttgagcatccagatgatgatgttgatgcagagaggaagaacagtgatataacttacaagaatgaccattacatggtggaacccttgaaagctcgcaagttttcttttcagaccagcagagtaacatatggcggaatagatggtgcatactatacatctactagaaccagaaagatgggggctaatggggagttaatggaggaaaacaaagaaggtgacacaacaacaggccaggctacacatagaatcaccagaggaatccatgacaagggtcattcagttttgaggaagcttgactcagatggtaaggttgatatcacacagacactccacaatcttaatgaagatgagcttgcaggatttgaagaagcatggaaaggaaataatatggcagaattgccaggatatgatgtgcatatgaaggaggtcaatgcagaggggatattggtttga

SEQ ID NO: 37165 - DNA, 414 bp, Glycine max
  Peptide Sequence Number=SeqID_153943
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagaagcgtcctcagtggcggaccgggcccaagtccctggaaggggcgccagagagggtgagagcccgtcgtgccggacctgtcgcacacgagcgctgtcggcgagtcgggttgtttgggaatgcagccccaatcgggcgggaagcggatgggggccggcgatgtgtcccggtcggatgtggaacggtgagagccggtccgccgatcgactcgggacattga

SEQ ID NO: 37166 - DNA, 1107 bp, Glycine max
  Peptide Sequence Number=SeqID_153944
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgctcgtgtgcgacaggtccggcacgacgggctctcaccctctctggcgccccttccagggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 37167 - DNA, 285 bp, Glycine max
  Peptide Sequence Number=SeqID_153945
atgcatatgggagaaagacaaggccaaacttcaggggtggcgccagaatggaggagcaacaacaccggtgaaagtgtggccaaaaaggtgttgccatgcagctccacacgaaagtggcgcgtgaagcctctgatggtgacatgcagaccaaatctgtgtagatcggtaaaaggcacaccgatgtcaaaaaatggaaaatggtcatcggaatgcaaaaacatatcaccagaatggatgacatatagaacaaaaacatattccctcggtcaggatctacataattag

SEQ ID NO: 37168 - DNA, 1947 bp, Glycine max
  Peptide Sequence Number=SeqID_153946
atggccttggctttaactgataaaactgaaattttccatttctttgatgaagctaattccatgatgctcaaagatctaatggaagaaaagcagttaaatttgaatcagccacttttatcagtgaggaggttctcatcaacattggcctctgaaacagaccacaaaagcaaaagtcagaactcattagccagacttccacttcctcctgcttacaaatcagagttaaattcagttccagagaggaatgctggaaatgttccttttgtatgggagaaggcaccaggaagaccaaaagatgaaagcaaattacagacacaagattttgagaagcctcccttcacttcaaactttccacctgggagggtatcaaaaactaagcaacaatcacttgctgagatgagaactggaagcacactttccaactctcaaagtgttgcatccttggacaaaaaagcaacaaaaaattcaaaaggggaaactagggagaaggaaagttctgggtcagatgatggagatgaggcctatgaagatgctcgtgactcactttctaggactgaatcattcttcatgagctgtagtgtgagtggcttgagtggatgggatgaacaagaggtccaaccatttggaagtttctcaagtgatcaccaacaaggtcgcaatttcatgattgataggttcttgcttgcagcaaaggcaatgacatcagaaactcctcaatatgcttccaagaaagcacatattggacaagaacaacaaaagcagaaaaagaaagaagtgaatacagaaagtccatgtcccattaaccagcataggccaaaagctttgccacattacactcaagatattgatggggaagaaagtgatgattgcagtgaatatgaaaactacacaactacaacttgtggcctatttcctcggttctgccttttgaatccaatgcctggattaagaatggtggatagggttccaagaaatgcagctcatggaatgcaagctaaatcagctgcttctcacattggatcttcaaaagagcaaggtagaactccttatgggaaaaagttaagggattcccagtctggatttacagaagaaaaagagattttggatattcttgtaaaatctaagcatggcattgacccatatcaaagaggttgcactcaacatgattcaagttatgaaagccatgtacatgagaaaactctatatgttgattctgtacacaaggttaagtctcaaaccaataacatagggggtgattttgagacttcaataagagatagtggcatttataacaattcttcaatagattcaagtcctaaagtgattaaatctaagaagataaattcagaaagtcaagtatatggcagggacaaaaattctgatatcctaactcagaattcagaacttgatttgaagagacaactagctgccaaatgggttgatgaagaatgcactttggctagctcaaaggtgagatataatgggaagattgacttagaaagccaatgtcttacaaagttaggccatcaagaaatatctggtgcaagctgttttggacttcctcttgcccttcctgcactaaaagctccatcagagtcttggcttaagcgcactttacctaccatttgcaaaagaaacatgacttcacagtccaaccttactgcaaacactaaaactcccaagacaacaccattgcatcctaaagaattccttgctatgtttcatggtggctacggagatgaagtaattatgcataaatctggggttttatttttgctgggaatgatttttctgtctctttcggttatatcaatgatcatatttgcttgtggggctgacaattcccacgagtatcgacgaaaaagaaatcgtggtctaactggacttggtggtgatgatggtgggggtggttctaatgacggtggcggtggcggtggtggtggctga

SEQ ID NO: 37169 - DNA, 306 bp, Glycine max
  Peptide Sequence Number=SeqID_153947
atggataatgttcctggtatgcatgaagaatctaacattctcaatcctagttcatgtgttgatgaagtttatgttagtgaagaggagactatgcttactggttttgataatggttcgtctaggagtgaatatgagctagtggataatgatggagaagacaatgaagattatgaaagttgcacctggagaatccatgcatcccttactccggacaagcaaactcttcttgaaaaatacagtgttgaaccaagtgttgaaccaagcagtaacatgcaacttgatcaagctaagagaaaggtccaataa

SEQ ID NO: 37170 - DNA, 1317 bp, Glycine max
  Peptide Sequence Number=SeqID_153948
atgtgggaagcactttctcaggttttgtatttaaacctctctcgtaatcatatccatggtgagattgggactacattaaagaatccaatatctatcccaactattgatctaaggtcaaatcacttgtgtggtaaattaccctatctttcaagtgatgtgcttcagttagatctttcaagcaattcattctctgaatccatgaatgactttttatgtaacgatcaggacaagccaatgctattacaatttctgaatcttgcatcaaataatttgtcaggagagatacctgattgctggatgaattggacatctcttgtggatgtaaatttacaaagcaaccattttgttgggaacttaccccaatccatgggttccttggcagacctgcagtctttacaaactcataacaacacactctcaggaatatttccaaccagtttgaagaagaataaccaattgatatccttggaccttggggaaaataatctttcaggaagtattccaacatgggttggagaaaaccacttaaatgtgaaaatcctccgccttcgatcaaacagatttgccggccacattccaagtgaaatatgtcagatgaggcatcttcaggttttagaccttgcacaaaacaatctgtctggcaatataccgagctgtttcagtaacttgagtgccatgacactaaagaaccaaattagtgtgctactatggctgaaaggaagaggagatgagtacagaaactttctgggtttggtaacaagcattgatctgtcaagtaacaagttattaggggaaataccaagagaaatcacatatctaaatggattgaattttttaaacttgtcccacaaccaattgattggtcatattccacaaggtataggtaatatgagattattacagtccattgatttttcgaggaatcaactttctggtgaaatccctccaaccattgcaaatttgagctttctgagcatgctagacttgtcttataatcatttgaaggggactattccaacaggaactcaattgcaaacctttgatgcctccagcttcatcggcaacaatctatgtggtccaccactgcccataaactgcagctccaatgggaaaacccatagttatgaaggaagtcatgggcatgcatatggagtgaattggttttttgtcagtatgacaattggatttattgtgggattctggatagtgattgctcctttgctgatttgtagatcatggcggtatgcctattttcatttccttgatcatgtgtggttcaaacttcaatcttttcgcttaggtagtatcactgtttag

SEQ ID NO: 37171 - DNA, 489 bp, Glycine max
  Peptide Sequence Number=SeqID_153949
atgctgaaggccttggccatagttattgtgttcttgatgatgattatgagagtccctgcaatgcagatcaatgaacaagaaaatggtgggaggaaaaatattgttgttggtgctgaagatgataatgatggaattcttggagataagaaaactgttcgcgttttaaatgggatgaatgatgggattcttgtgtatctccattgtaaatcgaaggatgatgattttcaccaacatgttcttgccgttggagagtaccaagaatggtccttcagagataacattgctggcacgactctttattggtgcaccatggatgcaaacactttgcatgcaagttttgaaatttataatgccaaaagggatgattcaaagtgtgatagccaatgtaatcgaaccatgaaaaacgatggaggctatttttataatcagttccaaggtcgctgggagaagatgttgttttggaatattccaaaactaacacctgtctaa

SEQ ID NO: 37172 - DNA, 150 bp, Glycine max
  Peptide Sequence Number=SeqID_153950
atggattttgttgctgtgacaatgagtgagcaagaagaatcaaacaaggctgcttcaaatgataaagcatttgcttcaagaataattcaagagtgcttcaacaagcaaagccatgtttcaagattcattaaagaccaagccttgccttaa

SEQ ID NO: 37173 - DNA, 468 bp, Glycine max
  Peptide Sequence Number=SeqID_153951
atgatgaaggccttgttcatcacaattattgtattattcttgattatcagagtccctgcagtgcaaatcagtcaacaagaaaatggtgggaggaaaattcatgtggatgacattcttgacggaacgaaaattgttcgtgttacaaatgcgatgaatgatggcattgttgtgcatctacattgtcaatcgaaagacactgattttcacgaacatgttcttgccgttggagagcaccaagaatggtccttcaaagacaacctttttggcacgactctttattggtgcacgatggatgcaatcaatgtgcatgtgagttttgaagtttataatgtcgatattgaggagaatatttgtaatgtccaatgcaatcggaatctaaaaaacgatggagcctatttttatcatcagttcgaatctaagtgggagaagagattggcatggtatgttccaaatataacatctgtttaa

SEQ ID NO: 37174 - DNA, 123 bp, Glycine max
  Peptide Sequence Number=SeqID_153952
atggctaaccatgacagtataaccaacgaatgttccatagcttctcagagtatgcaagataagcaaagattgattcatccgaagtacaaggtgtactcgggagaaaacggggggcctcattaa

SEQ ID NO: 37175 - DNA, 258 bp, Glycine max
  Peptide Sequence Number=SeqID_153953
atgagggagagagggttcaagaaaagtttggggacaatttttgtgcttgtgcctaatttgcaatctgctattccgatgatagtgaccacgcctgagaaatgggataccattacacgcaagagcagtgacatatcattgtccatggtggtaaagctcttaattattgatgaagtccatctactcaatgatgatagaggtcctgtgatagaggctctagttttcaggaccctacggcagacattggcttatgacagctag

SEQ ID NO: 37176 - DNA, 486 bp, Glycine max
  Peptide Sequence Number=SeqID_153954
atgttgaaggccttggtcatcacaattattgtattattcttgatgattatcagagtccctgcagtgcagatcagtcaacaagaaaatggtgggaggaaaattcttgctaatcatcaagatgatctaggtctgcatgatggccttcttgatgggaagaaaactgttcgcgttttaaatgggatgaataatggaattgttgtgtatctccattgtcaatcgaaggacgatgattttcaccaacatgttcttgctgttggaaagtaccaacaatggtccttcagagacaacattggaggcacgactctttattggtgcaccatggatgcaaacaatgtgcatgagagttttgaagtttatagtgtcgaagttgaggagatgatttgtgatacccaatgctatcgaattctaaaaaacgatggagcctatttttttaatcagttccaatctaagtgggagaagagattttcatggtatattcccaattaa

SEQ ID NO: 37177 - DNA, 246 bp, Glycine max
  Peptide Sequence Number=SeqID_153955
atgagagattctaatcgaatttcggttcaccgtattctcggtgaaggtttacttgctgatgtggtgttgtggaagaattggcgtggagcgattgcggtgctcgtttctgccaccgcattatggtacctcttcgagcgtgccgttgctaaccttctcaatgtagaagcaagcttcacgatgatgaatcaagttgattcaagtagttttgatgatgacaaagatgatgacaaaaagcccaaagaatga

SEQ ID NO: 37178 - DNA, 240 bp, Glycine max
  Peptide Sequence Number=SeqID_153956
atggcttcttcaaaaaatttaacgcagcaaaaattgaaggttcaggggaaaggctataaagataaatgctatgagcaaataaggaagactgtagaaggacggtttaacaagcttctaaatgagcttgtgtttgaggacctgaaagcagctttagaggaagcacgagcactaacagtagctggaacttgttaccatgagtgggaccaggatcttgttctcaaacagtgtaaacataaatag

SEQ ID NO: 37179 - DNA, 231 bp, Glycine max
  Peptide Sequence Number=SeqID_153957
atgagggacagaagaatttcctcacggctgaatggtgtgaaaagaaaagttcgtaatcgattcatggtccttgggtgcaaatcgcaacacggttacaagggttctgagggtggccaaggtgagtccaagagggttagtcttggcatgcaaggcagagaaactattcttgagaggggtgtgcgtgaggtgaagcaagaaacattaactgattctgagggtcctagccgttga

SEQ ID NO: 37180 - DNA, 270 bp, Glycine max
  Peptide Sequence Number=SeqID_153958
atggggcaccccctgatcctggaggagggccaactatgcaaggatcgcgcccacaagacacccagtggacccggaggagcccaacagggccctagggtttccaactctggttacgggcctttggatcgtgcccgcaagacacctagtggacccggagaagtccaacagggtcttggggtttccaactctgattacgggcctctgtcagttctacggagtgcttgtcacaggcaggcgcagggcgagacaccccagttgtggcgtccctaa

SEQ ID NO: 37181 - DNA, 243 bp, Glycine max
  Peptide Sequence Number=SeqID_153959
atgtacatggtgaacgacattttcacactatctaggcacaaggaaaacatggtgcagcccaaaccaagtgctggccttaaggggaaacctcaccaacatgctctcactcatcatgccttcttgtatttcaacgaacaaaagcttgggccccctaggcctaagtcatgttttggcatttatcctaattctcgcaagctgtccgcatccaaaaaatggtatcatacatacacaaatccaatctaa

SEQ ID NO: 37182 - DNA, 267 bp, Glycine max
  Peptide Sequence Number=SeqID_153960
atggggaataagtgggaagcttataatgagcttcaaacacaaagaaaggggaacataggctcaaatgggctatcaaaggaattaattcaaggtaggctcatttggctagaggcttataagaataaaatgcctaaatcatctcccaacatgcatgtgaagcaagaagtatcaacaagagtcaagccaaggctattgtgcaagcaatcaatggggcaaaacacactgaatgaaatagatgatgatggctcaaattcttaccaagggtaa

SEQ ID NO: 37183 - DNA, 651 bp, Glycine max
  Peptide Sequence Number=SeqID_153961
atggtctgcattgaccaggcagatatgaccggcagactgcttgtcggctcattgacatttgattgtcgcatcatgcactatatcattgttagaattttgatgcctcgttcttctaatctcgctcaagcctctgaagaggacttgattctgatgtgggctttcttgaccggtcatccaatcgactgggcccatttgattcattaccgcatgcataaggcattacggtctagtgcacctctaccttaccctcagcttgtgactttgcttcttcgacattttgaaattcctttggattctgagccttttgtgcaagttaaatgttcctttgctattggtgccggtgcggtaacctcctttggctaccgtaaggacatggatgggcaatggttgaagaaggatgcacaacctgcgcaagacgaacgtactccctctcctctgcctcaacgagatgactcctcagccctcatgcatgaagttctttcggagttacgaggcctccgcacctatgttggtgaacgctttgattccttggatggtcgtatcgatgccattgatgctcgctttgaaggaatggatacccacatcactcagcttgaggaggatgtgagttatcttcgtcggtgcttcaaccttcctccaccatcttcatag

SEQ ID NO: 37184 - DNA, 714 bp, Glycine max
  Peptide Sequence Number=SeqID_153962
atggaattttattgcaattctctcttgttccgggatctgagtttggatcctagagtcagttttttggtaactggatgggtggttgaatacaaagataatctgattgggcttggagtcgatgagtctctagcccaagtgtgttctgagagtggtgcaatggatcctcttatgaattcttatgttgagagaatgcaagctacgactaggaaatggtacttgaatattttggaggctgatagaacacagccccctaagaaaactgaagatgggaagctatataccccagctgctgttgatctcttcaggatacttggtgagcaagtacaaattgttcgggataatagcactgatctcatgttatacagaattgccttggcaatcattcaggaaaataaaggcaaactggacagaacttggaagttggaagacccacagatcgagagaaagaggacacatacaccatcaagaaacaacattgaaaagcctacatggacaccatcaaaagtcaaatcaatgatagatggaggtgttgacgccaaaagggtggtggcagcagtggaggtggagatggcggtgtcgcggcttcattactatggtttaatcaatagagaaggagtggtgcggcagatcaagaatcaggaatatgcatccttcttccaaaaactgaaagtgaagacaactaaacgcagagagaaagaacctttgtcaccgtga

SEQ ID NO: 37185 - DNA, 353 bp, Glycine max
  Peptide Sequence Number=SeqID_153963
atggtcatctgcacccttcccgaagatgtcagcgtcttaaggccgagaccgcgaaagagtctcaatttggctatcgtgatccaagggtccgatagcacgcggacacaccttatggttatccgcacctttcatcagctagaggcaagcgagcccgttgacacgcagagaccaatgtggtcatctgcatccttcccgaagatgtcagcgtcttctggccgagactacgaaaaaaccaatgtggtcatctgcacccttctcggagatgtcagcgttttccagctgagaccgcgaaaaagtctcaatttcgctattgtgacccaagggtccaatagcatgtggagacgccctatacg

SEQ ID NO: 37186 - DNA, 318 bp, Glycine max
  Peptide Sequence Number=SeqID_153964
atggtgggttcgagatcgacaaagacaacacacgagacgtgctttccgaattcgatttcattgaagaaggcgttgtgggccacactgagggtgatgcgtaggcgaagattgcactgtgaatcgtttgctatcattggaccttatgggatctcagtgacacttaaaattagaattccacaacttgagagtatatcgatgttagcagcagtagaagcaggagtgaagattcaccacctgcaactcacgagggacgaccacgaagaagcaccatgcgacctaagcacttggacgattacgtataaggacccgaacacgtga

SEQ ID NO: 37187 - DNA, 354 bp, Glycine max
  Peptide Sequence Number=SeqID_153965
atgaggaatttttctaagatggtttatgctaaaaaagaagggattaaagctgttaatgaacgggtgactgattggaaattcatcaatactctctatcctttctcagatgaagaatgtttgcaagagtttgacaaatataagcaatcacctgagaacaagcgtgttaacaaaggcatgaagattgaagaattcaaattcatatactggatggaatatgcacatcgtatggggggaagggcactaggagttatgtttgctttgccatattcatattttcttcataaagggctgggtgttgggcagggtctcataggttggtgggtggtcaaaagtggtttagaggttggaacataa

SEQ ID NO: 37188 - DNA, 207 bp, Glycine max
  Peptide Sequence Number=SeqID_153966
atgcagcatgcaccaggtcctgaagctagtgcggcggattggggaggaaaggagggcacggtggagatggtggcgatgactggtggcaaggagagggagggtgacaacggtgccaactgccaacacaaagaagtagtgaagaagttggtggtggcggtggtggaggggatggatttggattgggtgtgggggaaattcgaaaagtag

SEQ ID NO: 37189 - DNA, 438 bp, Glycine max
  Peptide Sequence Number=SeqID_153967
atgggtattgcatataaattctatggcttatgggtattgcatataaatatattaattttcattttgtcttcgcccgaaaaagaaagggggaagacgaaagacaaagaagaagaaccattcgtctatgatagaaaaggtacctttggtcatggtcgcggtgttaatcttggtggtgcaatcctctctagtgttccacgggcgttgttggggatcgctaggaagaagctccagcgactcccgcacgtgttcagctgcgtcctagagcttcccttccgctttgatgccgacgtggcggtggaggaggcccctaacttcttccggttcatggcggagactgatggaatcgacgatgttagggcgcacacagtggaaatccaccccggcgtgacgaagatcgtggtgagggagggtggctcggtggagctctcgctcaactag

SEQ ID NO: 37190 - DNA, 179 bp, Glycine max
  Peptide Sequence Number=SeqID_153968
atgaaatttgagaacgatggaaacaacaccattgaggcagaagtcattgatgagggtgttaagcgtgacgacgtcatagggaggttgtgcttgagaagcttcccaaagatggagaaggcaagagtgaccctgccaatgtggcagaagcagttgatgcgggtgacatggcagggggcgac

SEQ ID NO: 37191 - DNA, 561 bp, Glycine max
  Peptide Sequence Number=SeqID_153969
atgagagattctaatcgaatttcggttcaccgtattctcggcgaaggtttacttgctgatgtggtgttgtggaagaattggcgtggagcggttgcggtgttcgtttctgccaccgcattacggtacctcttcgagcgtgccggttacaatttcttgtccttcatcgccaatgtcatgttgcttcttgtcggtacatcctttgtggtacaagtagagggtacatctacttgggttgttgtaactgagaacaagagaggatacatctcttgtggatcagttcaagtggagggtacatccacttggttgttcaaagagaacaaggaagggtacatcccttgtggatctttgcttgtaaaggcttttacaaggttgaaaagaaatctcaaggaccgcaggccacttgatccaacactcaataaaccttttcctcctctccccgatctggagatctcaaaggaaactattgccagggttgctgatgcactacaaatttggttgaatctagccttgtctgttgcacatgacatagcgattgagaagaattttttgctctgcctctag

SEQ ID NO: 37192 - DNA, 198 bp, Glycine max
  Peptide Sequence Number=SeqID_153970
atggatcctacaagatggatggatgatgagaaggcagtttttctttatgctatatcatcattcgagaaggagtttgcaaaaatagctcggataaagagacaagcgacactgtatgcaatgtgttgctctctacaaatggggaccataaccccttatattggtaattgccatcatttacctcaaatttcacaattataa

SEQ ID NO: 37193 - DNA, 690 bp, Glycine max
  Peptide Sequence Number=SeqID_153971
atgaacggtcttttaggcagaaacgtctttggactcaatagactctctatcaaagtaccacaaacaaagttgcacgctgatctggtggaaggaggtggcaacgcaacagggagggaaggtggtgggagagaggaggaagaagtaagacgaggcccagtagcccatagccacgaacaactaactccaaaccctaactcaataaattcccccaatccccaaaccctaatcctgccgcaagcagagatgacaacccgatttaagaagaaccgcaagaagcgcggccacgtcagcgccggccacggccgtattggaaagcaccgcaagcaccccggcggccggggaaatgccggcggcatgcaccaccacaggatcctcttcgacaagtaccacccggggttcttcgggaaggtagggatgaggtactttcataagctccgcaacaaattctactcccccatcgtcaacatcgacaagctatggtctctgataccccaagacgcgaaggacaaagccctaaaatcgaaggacactgcccctctaatcgacgtcactcagcacgggtacttcaaggttctcggaaaaggtgtgctgccccaaaaccagcccattgttgtgaaggccaagcttatttcgaagatcgcggagaagaagatcaaggaagccggtggtgctgttcttcttacggcttag

SEQ ID NO: 37194 - DNA, 729 bp, Glycine max
  Peptide Sequence Number=SeqID_153972
atggaaaggagatggatccttgccgaggatagcattgaaggagagtgtgaaattgaaatacctcaagatatgttgattaaaaattcaaaaaatgctttggatgaattaactgactttgcatattctaatgcgttacaaactttgaataatcctaaatatttcatggaaagaagcaccttgtgtcctacattggatgttgatggaaaaatagaagctgaggtcaagctcacgggaattctcagtttaggagcattgcaaccaggtgaaagtcgaaaatatggcacgactattgcacctggattatatgcacctgtatggacatggcagttgattgcaagcccggtgaagcatttaatcagcttgcattctgtaacagaagtaacagtcctcttccctctccaggttgtcgaggtggatgccaaggttgaagagccaggaaagaataatgtttacaacaatgcattttatgcagaggaaaaactgcttaaatcagaattggaagcaatgcgtgattgtaaccctttatctgctcgacactggatcgttaggaacacaaggaaggtacctggttcaaattgtttacccttggctggttcagaggccaagtttctgaggagatcagctttcttgaagcacaatctttgggtcactccttatgctcccgacaaaatgcatcctggaggagagttctctaatcagaatccacgcgttggagagttctttgattag

SEQ ID NO: 37195 - DNA, 453 bp, Glycine max
  Peptide Sequence Number=SeqID_153973
atggcaataattcagcagtcgagtggagttttttcaagggacaaaactacttgcaagcaacatactgaaagcagagatgaagaagaggcgtgcaaacttataacacttagtggagttgccctccaaggctccttaaacaccattcaaatagtttacgttactcccaaacaagtcacaagtttccactttggggccctttctcaagtcccgaagaagttcttgcctcactgggttgcaattgggccagttccaaacacctactcattggcggcaattactcaaagcacatcatttttttttggcttggtgtaccctcaaaaatttgtaaagtcttcatcttacccttttcatctcactcgctctcttcatctctccatcttcctcttcaccacagtggcacttgtgcagatcctctcgactggaatggtggcggcttcgatcaaaccacaatga

SEQ ID NO: 37196 - DNA, 1056 bp, Glycine max
  Peptide Sequence Number=SeqID_153974
atgaagcaccgaacatggcctcgcgccttctcctccctcccttactccaaccgttccgaattctccgccgcacgctccacgcgcctctgtgcgcgtcctcctccgccgtcccctcccggcgtcggcggcgaattctcgtcgctcccctacgacgtgctggcgaagatcgccgcctccttcgacgaccccaatctccgcgcggcgtcgctggtgtgtcgcgcgtggtgcgaggcgctgcggccgctgcgggaggccatggtgctgctccgctgggggaagcgcttcaagcacggccgccgcggcgtccgccccaacgtcgacaaggccctagactccttcaccaaagccgccgtgcgcggctccgccctcgccatggtcgacgccggcctcatctactgggagcgaggcgagaagccgaaggccatggagttgtatcttaaggccgcggaactcggaaatccttctgctcagtgcaatttgggactttcctatctccaagctgaacctccgaacactgagaaagctgtgaaatggttacgtaaagcttctgtttgtgggaatgttcgtgctcagtaccagcttgcactttgtctgcatcgaagtggtgggagggtccgtagcaatctgaaagaagctgttggtgctctatccttttcctctcctcttctaattttgagtgaagtagtgaaccttttctttcaggggtgcgctaaatggtatatgaaagctgcagagggtgggtatgtccgtgctatgtacaatatctccttgtgcttctcctttggggaaggactggcaagtaatcatcaactagcaagaaaatggatgaagcgggctgcagatcgtggtcatagtaaagctcaatttgagcatggacttgctctcttttctgaaggagacatgatgaaggctgtggtatacttggaacttgctactcgtgctggagaaaaaggtgctgctcatgtcaagaacgcagttcttcatcggctgtcatcagtttcacgtgatcacgctatgcatctagctaacagttggcgcgcattgccatcaagttga

SEQ ID NO: 37197 - DNA, 1836 bp, Glycine max
  Peptide Sequence Number=SeqID_153975
atggcatcatcggagcaggagaagcgagtggaggacgagttgtcgtaccctattatggtggcggagcgagttcgctcggcggtggacgagtccgactcgttcaaactcgagtgctccgaggttgggaagcacgtcgatcgcatcctccaaatgctccgaaccctcgttcgcttcgccaccgccaccgccacctccgccgccacgccgcccctctacgatcgtcccatccgccgcgtcgccgcggagacggcgaaaaacctcgagcgcgccctcgccctcgtcagcaagtgcaagcgccgcagcatcctccgccgtgtcgtctccatcgtcggcgccgccgatttcctgaaggtcctcacccacctggacgcctccggcggcgacatgaagtggctcctcagcatcctggacggcggcggcggcattgtcgtctccctccctccgatcgccagtaacgaccctattctctcttgggtatggtctttcatcgcttccattcaaatgggtcaattaaacgatagaattgaggctgcgaatgaacttgcttctttagcacaagacaatgataggaacaaaaagatcatagttgaggaatgtggggtgcctcctttgttgaagcttttcaaggaaggcacttcccctcttgctcaaattgctgctgctaatgctttgtgtcatttggctaatgatttggatagggttagagtcattgtgagtgagcatggtgtgcctgctgttgtccagattctcagtgactcccccatgagggttcagaccctggctgccaatttggttgccaggatggccaagcatgaccctgtcgcacaggaggatttcgctcgggagaacgccattaggccgctcgtcacgctcctgtcgtttgatacctttgtggatgatccattggggcatttggggaagcagagtattcactctattgttcagattaataaagagttggggaagggtggtcagggagggtggaagttcacgagttcctactcgaattcatatttgtttatggaggggagtagccggggagggaaccataggaaggagagggggaatgaggatcctgctgtgaagcttcagctgaaggttagttgcgctgaggcgttgtggatgcttgccagagggagcgtgaccaacagtaggaagataaccgagaccaaagggatgctttgtttggctaagattgttgagatggagcaaggggagctgcagcttaattgcctgatgacaataatggagataaccgctgctgctgaatccaatgctgatcttcgtcgtgcagcgtttaagaccaactctccgcctgctaaagctgttgtggaacagctgctgaggataattaaagaggtggacagcccggcattgcaaattccagcaatgaaggccattggctcattggctaggacgtttcctgttagagagacccgggtaattgaacctctagtgacacagatgggtaatagaaacacagaagtagcagatgaggcagtggctgcacttaccaagtttgcttctccggataattacctacacatcgagcattctaagacgataattgaattcaatggaatcccggcactgatgagactgctaaggagtaatgaagttacacaaatgcatcgcgggctaacacttctttgctacctggcactgcatgccggcaacagtgagtccttggaacaagcaagggtgttgacagttctagagggtgcagacagaacagttcttcctccgcatataaaggaattggtctccagggcaataatccacctcaatttgtatcatgcaggaatgaattctcaaaggatatcatacttgccttga

SEQ ID NO: 37198 - DNA, 222 bp, Glycine max
  Peptide Sequence Number=SeqID_153976
atggagaactactccaggtacgtgtttggtgtgacacatattccccgattggaagactggctagttatgcctgtggaacgcattagctttacgcttatgccacatgggtttttcaattgctccccagctgtagattttcccccaagtgcaagtgatttggatgataaggagaatgggatgtctgcaaagcctattcagaatgggatggttgctttgctctaa

SEQ ID NO: 37199 - DNA, 1101 bp, Glycine max
  Peptide Sequence Number=SeqID_153977
atggtggagtcaaagaagctctggtacctcgccggccccgccatcttctccttcgtctcaaagtactccctcggcgccttcactcaaatctttgccggccacgtcggcaccattgacctcgccgccgtctccgttgaaaactccctcatcgccggcttctcctacggcataatgcgcgttggaaacgctgtgcggacaagcggtgggggcagggaagctggacatgctgggagtgtacatgcaacgatcatgggtgttactcctcagcacggcctgtgtactgtgccctttgtacatcttcgcgggacaagttctgaagttgatagggcaagacaccgaaatttcggaggctgcggggaccttcgccatttggatgattccgcagctgttcgcttacgcgctgaattttccggtggcgaagttcctgcaggcgcagagcaaggtgatggtgatcgcggcgatagccgggatggccatggtgctgcacccggtgctgagctggctgctcatggtgaagctggagtgggggctcgtgggcgccgccgtcgtgctcaacggatcgtggtggttcgtggtggtggcccagttggtttatgttttcggagggtggtgctggccggcgtggaacgggttctcgtgggaagcgtttcggagtctttgggggttctttcgcctctctcttgcttctgctgttatgctctggtgagtgcttgcaaaacacatccactggttgccgtgattacttcggttttgatcggagttttactcgctattgttttgatgatctcgcggaatgagtacccttccctgttttcaaacgacacagaagtgcaagatctagttaaggacctcacaccatttttgtgcttctgcattgtcattaataatgttcagcctgttctctcaggagttgccattggggcgggatggcaggctcttgttgcctatgtaaacattgcatgctactacctttttggaattcctgtgggtcttgtattgggttacaagcttgactggggagtcaaggagaaatcaagaccaatcttaatacttgtggtgcccaccaacaacactgtatcagaatctttcctatcattatga

SEQ ID NO: 37200 - DNA, 321 bp, Glycine max
  Peptide Sequence Number=SeqID_153978
atggaaggcaaattgtttttgatcctaatcatgtttgttatggctcatggtttattggcaataacagtccatgcatcttcacaacttcctgcagcatgcgatgggtatgaactaatgattgacacttgtaagcctgatttgactgtgggattcgatccaactactgattgttgtttcgtatcatattatgcacttaatcttgccatgtctgacaaaactggtaaaggacttcctgacaaatgcaggattaaaatttcttttcctattagcatgtgtgtattttggccaactgtccctccgacccttgtaccaaaacaatag

SEQ ID NO: 37201 - DNA, 201 bp, Glycine max
  Peptide Sequence Number=SeqID_153979
atgttggggaacttgtttgtttgtgccagcccacagactttagttcgtgctgtacgggttgttgaaatgcaagaaatccttgatcaacagattgcagaagaagcagctgaggctgaaggggatggcgcaatggcatcagttgcaaatcctcgtaacaccggcatgtatgttataatattttctgatattgaaaatctataa

SEQ ID NO: 37202 - DNA, 273 bp, Glycine max
  Peptide Sequence Number=SeqID_153980
atgtattcaagtttcatcattattgggaggatatcactagaaatccatgaattgctcctcatagcgcaatgtgtagtgcttactccttatatcggtagctttgtgatgattgattttcaagcagctgaaaagaagagactagaagaatcagcttctgaaattggtgtggaacctttatgtgctatgattaacaacaatttgcgctgctatgaccttgcaatggagctaagtaatagcaccatagaagcccttccacagaactacgctgagcag

SEQ ID NO: 37203 - DNA, 355 bp, Glycine max
  Peptide Sequence Number=SeqID_153981
atggcgattgaaaaaaagaaaaatgtttgtgatagtgtcattgggacactccttaacattcaaggcaagatgaaagatggtttgaatactcatcaagatctagctgagatgggtatacgagcccaattacatcgaagagaaatcaaatgttgtggtcccatttatttgcggtggatgcacccggtcgagcgatacatgaagatcttaaaagggtatacaaagaatctacactatccggaagcatctattatggaaagatacattgcagaagcagctattgagttttgttcagagtacactgaaaaggaaaaacctgttgagcttcccgagtctcagcatgacgaaagagtgagag

SEQ ID NO: 37204 - DNA, 348 bp, Glycine max
  Peptide Sequence Number=SeqID_153982
atggctactagaccagttaggacaaagagaccccgggtccatgtggatcctgcaactgggaaaaccgacggtccctacagaaaaaagttaagaacatatttggggatcgtcgctcgcaataagtctgatttgacatcgaaatgggcacttatagccgataaggacggtgtcgatgacactgtatgcaaaaagtacgacattagcaaggagaagtggacccaattttgtcagagccacagagacccttcatgggagttgatggaggagaagaaaaagaaacaattggaggaagccgttaaatccggaagcactgacaccatcattgatcctccatctcccatcaaatga

SEQ ID NO: 37205 - DNA, 336 bp, Glycine max
  Peptide Sequence Number=SeqID_153983
atggcacctggatcattgagcactgaccacgttattgcttctgttgtttttctttatacatgtccttctaaaagtgaggttgaccttgatgaagtctctcaagtccttgagccgcccttgactgctctagtggagctaatgacatggaagacaaatgtagtagacattccttatggaggagcaaagggtggcattagctgcaacctaagggagctcagcgttaacgacttaggaagtctctctagtgttttcttccaaaagattgatgatctcattggcattcagagagatgttcctgcccctgacatgggaactaatgcacacgttcttatttaa

SEQ ID NO: 37206 - DNA, 1085 bp, Glycine max
  Peptide Sequence Number=SeqID_153984
gcccagcaacagctgtgcttgatgcattggcaccgacagtagcacttgatgatgtgctcaccaatgacagcacacctgcgctcactggtacagtcaacgatccaaccgcaactgtggttgtgaatgtggatggtgttgactacccggcgacgaacaatggcgatggcacctggacgcttgcagacaatagcttgcctgcgttaacagacggtccacacaccattaccgtgacggcaactgaccctgcaggtaatgcaggaacagatactgcagtggtgacgattgataccaccgcaccaaatgcaccgctacttgatccaatcaatgcaaccgatccagtcagcggtacagcagaagcgggttcaaccgtaactgtcagcttccctgatggcacgactgcaactgtaatggcaggcacagatggcagctggtcagtaccaaacccgggtaacctggtggatggcgatacagtcacggcaacagccactgaccctgcaggcaatacgtcattgccaggcacaggtacagtctctgccgacatcacagcccctgtggttgcgcttgatgatgtgctcaccaacgacagcacacctgcgctcactggtacagtcaacgatccaaccgcaactgtggttgtgaatgtggatggtgttgattacccggcgacaaacaatggcgatggcacctggacgcttgcagacaatagcttgcctgcgttaacagacggtccacacaccattaccgtgacggcaactgaccctgcaggtaatgcaggaacagatactgcagtggtgacgattgatactagtgttccagttgtatctttagatgatgtgactaccaacgacaccactccagctttaacaggagcaatcaacgatccaacagcaacaatagttgtgaatgttgatggcactgactatccagcagtgaacaatggtgatggtacttggacacttgcagacaatacattgcctgcactgactgatggtccacatacagtcaccgtaactgcgacagatccgctggaaatattgcaactgatacagcaacactcactattgatactgtaccggcagacctga

SEQ ID NO: 37207 - DNA, 291 bp, Glycine max
  Peptide Sequence Number=SeqID_153985
atggagcattttcttgtgcaagtagcctggcctgaagctcaacttctattggtgagacccaatgaggctgctccacctgagcccacactttcgcaggttgatccagagctagttgacccacaatctccagtggtgaatccactgtcttctcctgagcgtgaagtagttcccccgtctccacctctaattatcatctctgatgcatcatctgatgaagctgctgctcctcctgattcaccatcttgcaacatagatgatggttatgacttttctgactggatggactgctga

SEQ ID NO: 37208 - DNA, 258 bp, Glycine max
  Peptide Sequence Number=SeqID_153986
atgttgctccaatacctaaccaaagggcaactacagtaccaatcaggtggatggtggttgcagatggacagcgaaatgggttttgtaccgaaaccattaaaagaacgcccaataacttattgggcactgtacgaagtatttgaaatacgggaaagaaataccattcgggtaatatttccaaaggagttgcaaatggatccgcgggttccccaatcatggatggttctagaaccgctaagcctacgttacaggcaatag

SEQ ID NO: 37209 - DNA, 291 bp, Glycine max
  Peptide Sequence Number=SeqID_153987
atggtggtctcagatgaagcatcctatacctgttggggtacttgggctgtgggaccttcaccttccatatcaagagaaggttgggccccaggccaggctaccctctctaagaactactctactaataggatggatcctggaggagctaccctctttgcagaagtagatgctggagtaggtgttggagctgtagaagtagatgaaatatcagttggcctcgccctctccctcctagcccctcaaaaagcaactgttagatcatcaacgttccaacagttcttcctgatgtag

SEQ ID NO: 37210 - DNA, 471 bp, Glycine max
  Peptide Sequence Number=SeqID_153988
atgaattgcgttttcgttcatgtgtcctccactttcgagtttggagctgtgtttcatgattgcctaagtgcgaacccacaaggcagtcctccattctcccccttttttcggagctccatgaattgcgttttcgtttatgtgtcctccactttcgagtttggagctgtgtttcatgattgcctaagtgtggaccctcaaggcaatcctccattctcccccttttttcggagctccatgaattgcgttttcgttcatgtgtcctccactttcgagtttgcagctgtgattcatgattgcctaagtgcggaccctcaaggcaatcctccattctcccaattttttcggagctccatgaattgcgttttcgttcatgtgtcctccactttcgagtttggcgctgtgtttgatgattgcctaagtgcggaccctcaaggcaatcctccattctccccctttttcggagcccgatga

SEQ ID NO: 37211 - DNA, 548 bp, Glycine max
  Peptide Sequence Number=SeqID_153989
atgtcattgcctagcgctgttcatgtgttctccattatcaagtgcgaagcttctggtgactgggaagcacgttattctgttgttttccagatcggttccttcgccaaaagaaaaaaaaaagaagaagtagagatgagagtcgtcatcgcgaaaagggcaggacggacgaaatcagtgtcctatctttgctttactcttatctccgataagagtcccgagacgtctcagaaatctaaaggaagcaggcttgcgcgatccgtgaaattccgtaatgtggcggaagtcgaaaagaggcgtttttgcgcaatccgcccacttgggccttccagaagattcctccagaaggctgttgcttctggaggaagcaacctggctcgcctgggcgagctgggcggcaagcttctcccctattttgctataaataggggaagaagtgaagaagaaaagccgaggcgcttccgtaacgtttccgtgagaaattacgcgaagattctcgaccgttcttcaagattcatcgttcgttcttcgttttcttcagtcttcaacgg

SEQ ID NO: 37212 - DNA, 642 bp, Glycine max
  Peptide Sequence Number=SeqID_153990
atgctgaagcgtgttgttcactcgttaggcctagtggataaaaatccaagaagaaagagcaaagtgagaggaaccatgacaccttctgactttggcttgagatcaaaggagttatatgtgagggtagttcatcagggtggacaacaagaggtgtatcaccatgcatttccggcatccaagttgacggcgaagtatcccggtatgtgtgttgcaagagcacaagtcttcatggctcctcatcaggcagtgctaaggcctgaagagcatttgctgcttggtcacaagtatgtcgtaatctcgtgtacagatgtggagaaactgaagcgtaagcatcctcagcaatgcaaaaccaaagaacataatggggtggtaacatcggaggtaaacatcattagtgaatgccatcttagtggacacaaaccaaaagagaatgacaaactcagtgtcccaaatgagatgattaacacaaggataactctatctcctactcccagtgaatgcaaaattcatgagaatggtgaagttaaagagccaaacattctagggaaagagaaagtgaatgcagagaaggatgtgtgtcaaggtggagaagatgtagaagttcatttgctctgcaaaggacttttatgtaggcaaggataa

SEQ ID NO: 37213 - DNA, 2025 bp, Glycine max
  Peptide Sequence Number=SeqID_153991
catcccctcctcctcctcccaagtgcgcctccatcaacgggaatctctgtcccgaacaacccagaagcttccggagaacaacaagtctatagtgcttccgggcttctcgaccggattcggaaatgggtcgggtttttaccgtcgattcttcccggcggacggtggtgggagttctccggcgacgtcgacgttcaggtggtggcgcagccggtgaccgtgtggcgcgcgctcgggaaaatgtgggaccttgtcgcgcgtgacagatgggtcatcttcgctgcattctctgctctcattgttgctgcagtttcggagatttcgataccgcatttcttgacagcatccatcttctcagcacagagtgcggaccttgctgtttttcaccggaatgatatatcgttttttgacaatgaaacagtaggtgatttgacaagtaggcttggagcggattgccaacaagtgtcaagagttattggaaatgatcttaatttgataatgcgcaacgttcttcaggggggaggttcattaatctacttgttgattttatcttggccacttggtttatctacattggtggtatgctccatattagcagcagttatgttacgttatggaaggtaccagaaaaaggcagcaaggttgatccaagaagtcactgcttctgcaaatgatgtagcccaagagatgttctctcttattagaactgtgcgagtttatggaacagaagaagaagaacatggaaggtataagtggtggctggagaaattagctgacataagcttgcgacaaagtgctgcatatggagtttggaattttagctttaacattctttatcattcaactcaggcatctgtagtgcaacatgtgaactttgttgtccatcctggagaggtggttgcaatagttggacttagtggtagcggaaaaagcacattggtgaatcttttgctccgtctctatgagcctacaaatggtcaggagatttccgacggcaatgtcttttttcttcctttcctcatcacctccactccgacaccaacaacctcatcgactagcaactctaaggaagaccaatattgtgagatcggaatccctctctcttcccctcgtcaaccttcgttccaactcctcgcgttgtccgttgagcaaaactatgggtttatttgcagattattgatgacatgcattgtgcctgactgtgggtttgactttgggttccgattttatggtgaggttgttggagatgttgatgtggtggcaatgatggaggaggaacctgggcgcaggatcaggctgtttggaggtggaggggcagtgaggttggagcggtggcaaccagagaggaaggaggagagggaggatgatatccctcttaaagacttggacatcatgtggtggagagagagaattggatttgtgggccaggaaccgaaactcttccggatggatattagttcaaacatcagatatggatgcacccaagatgtaaagcagaaggatattgaatgggctgcaaagcaggcctatgcccacaattttatctcagcacttcccaatggttatgaaacacttgttgatgatgatctgttaagtggaggacaaaagcagcgaattgctattgctagggcccttcttagggacccaaaaatattgatccttgatgaagccactagtgcactagatgctgaaagtgagcataatgttaagggtgttcttcgatctgttagaagtgattctgcaaccagaagtgtcatagtcattgcacataggctttctaccatacaagcagctgacaggattgtggtgatggatggtggggaaattgttgaggtcacggattcaaaacctggaaacagtctttcttcttacagggataagagtacccttcctagacccacttggtgggaacctcgtgcactgaatcatccttatatttttatccgtttgttcgataatggggaacttctcttaaaagatggtttgtatgcacggttaaccagaaaacaggctgatgccatggcatga

SEQ ID NO: 37214 - DNA, 282 bp, Glycine max
  Peptide Sequence Number=SeqID_153992
atggcacagaccaatcgatactttcgtagagggagatcggcattgcggtcgctgggcagaatgttgctaagtagcaacgccatctatatctgtgtaagagtggtcatgttggtgcgcatgatccgcactcgtctctttgcagtggcacgggtgaaatcttgccccggtatgcacagtagctacgcgatagcctcctcctctggttgtgctcgcatagttggtcgcccttcaatatcaggggatggcccaggaattgataaaaggaaactactcgccccttaa

SEQ ID NO: 37215 - DNA, 561 bp, Glycine max
  Peptide Sequence Number=SeqID_153993
atgtcttccaacaagaggaggttcatgagagccctatacaaagcaaatggaggctgtgggtgtagcaaaccaaaatcctctgacgtccacgaacccaccccaaaacccaaaatctccatttaccaaaacacaaaccctagcagcctcaattcatccaccacttccggtgaccgcaacgacgacgatgaagtctttacttccaccaccatctccgaacccgacacaaatcaacaaaaccccaacaacaacaacagtatgccaaaaccaaacccaaaactcgttgacagcatcgccgttgagaaggactcaaacgacccacataaggatttccgagcctccatgctccaaatgatcctcgagagagagatctacacagaaaccgatctccgagagcttctcgagtgcttcctcaagctgaacgccacgtgccaccaccaactcatcgttcaagccttcatggagatctgcgaagaagtgttcccgaagaagagcatggtcaagggtggtggcgctcctgatcaacaatgtcgcaggaaccagatcacaagaaagagtcggtga

SEQ ID NO: 37216 - DNA, 336 bp, Glycine max
  Peptide Sequence Number=SeqID_153994
atgattgttgtggtggttggttcgatagtgacgtcgttggaggtacacgaggtacgtgggttgctgttgctggttttcgttctatatggatcagttgatccgtatgttgaaattaaagttatggattacatgatccgtataaaatgtacagatcgtgttatccgcctaggatctccttcatcaatggattcctttgcttcttgcaagatgaatggcaacaaaatggagaaggaagagagagaggagacaccacatcaaggagaagatgagtctagaagaagctcaccaccatgggaggccatggataagagcttggaggaagaaggaaatgaatga

SEQ ID NO: 37217 - DNA, 207 bp, Glycine max
  Peptide Sequence Number=SeqID_153995
atgggtgtcatgcatttgaaaggttttcttgttgggttaaaggtggagttatgtacatcaaaaggaaagggaagtatatggtctagacattttgagcaagctaggcatatgtcacaacctacccttcggcgagagggcgacgcgagactcactggtgcatcatccaaggaaggaaaacgcgcggagttgccaccaacgtttatttga

SEQ ID NO: 37218 - DNA, 417 bp, Glycine max
  Peptide Sequence Number=SeqID_153996
atgggatcaagtcaaaagccttcacttaaaaagaggttctatccagtcaaggtcaagagcctagggatcaccagtctaagagagttagggcagttgatgggtcagctccagcagcaagcttttcgtaaagcttacggtaaaatctgggacctagccatggtaaaagtctccacagaggccattgcctccctcgcccagtattatgatcagccgttgaggtgcttcatctttggggacttccagctatcaccaatggtggaagaatttgaagagatcctaggatgtcctctaggaagaaggaaaccatacctcttctcaggatattcttgcactgttgattttcgggggagtcctctttccgaatgtggatgggttggtggacctggcagcgatcgacgcttttctcgcctatcataa

SEQ ID NO: 37219 - DNA, 234 bp, Glycine max
  Peptide Sequence Number=SeqID_153997
atgccgtcgatcgactccggtgatggccgcaccgtgctcctctctgtggtgggactcaggtcggagccaggtgttaagctgccggcggaggccggtgcgaaagtggactatcgagcccaaagtggcggtgtcgcgacaatgggtcacaaaaccctttctcccaacttgaaaatgcatcgaactagtcctagggctagtgattttcaaatctctctaaatctctcccagttttga

SEQ ID NO: 37220 - DNA, 1144 bp, Glycine max
  Peptide Sequence Number=SeqID_153998
atgtggtataatgaaagaatatcaaaacgtaaaaatagtacaagcccgaggttcagcttatgttgtggagatgacaaagttgaacttccattattacaaaattcgcccaaatatctccaccgacttctctttgatcataattcagctgatggtagaaattatcaacaaaacatatgcacatataacatgatgtttgcatttacttctactagtattaagttagacaaatcaattaatcatttgagaggaccttctacaattagaattcagggtcaaccatgtcaccggataagcagtttattaccaatgtctggaaaagaacccaaatttgcacaattatatatctttgacacagataatgaagttcaaaatagaattaatgtcatcagccagcatgatggaattcaaccgcaaattatttcaagtttaggtgaaatgctggatgaacataatgcgcatgctaaaagttttaggatgactagagatagattggcaaatagtgatgtggataatgtcagattaagattgataactactcgtgaaaaggatggtcgtacatacaatgttccaactgtttcagaagttgctgcacttattgtaggtgattttaatcccaactcaagaagagatattattgttgagactcaaaatggacagttacagagaatacatgaattgcactctaactatctaggcctacaattccctctgcttttaccttatggtgaagatggatataggcttgacatacttcaccgtgcaacactagacaacaaaaaaagaaagagaaatcgtcttactatgagagagtggtttgcttatagacttcagtccagaccaaatgaagctcaaactttattgcattctagaagactatttcaacaattcattgttgaagcatatacgatggttgaatcggaaaaacttaactacatcaggaacaaccaaaagaaactcagagttgacaaatattgtagcttacaaaattcactagatgatgggacaatccaaggtttaaataaaggcaagagagtaatttggccttctacctttgttgggagcccgcgctacatggatcaactatattttgatggtatggcgatatgcaaccacgatttcccaaatctttttatcactttaacat

SEQ ID NO: 37221 - DNA, 444 bp, Glycine max
  Peptide Sequence Number=SeqID_153999
atggtttacaataatggcataaacttgaagatattgatgagtcatcagagacatctaacaacagatttcaaaattgccccatgtgtggtgtcgcttggtcatacagtgctcaatggaatgccccagggctcctctatgatatgcacatgttgcgttcaagtcgtatcctcgaaaaaatggaggttgaggaaacctagcaggggttatgggctaccattgaattatcgagtagatatgagagcaagtttagcatatgacaccggaatttggggtgaatcctacaggctttttcgttgcgaaattccttccttggttggtgttttgacaggttttgtggttgatttagggatgacttttgtggataattgggtggtggggaaggagaaggtttgttattggctgagtaacgacattgttgggttggtgggaaacttcgctgtatag

SEQ ID NO: 37222 - DNA, 309 bp, Glycine max
  Peptide Sequence Number=SeqID_154000
atggaggccacgaaagaacaaatagccacaatgatggaggccatgatgagcatgaagaagataatggaagccaatgcagttgcagttgccgctaccagggctgttgctaaggtgaacccgatgcccccatctgatctcaacccaatgaatcatccaacctcagatatacacgccttcccgccatatggattgcctctcaactatacgccacccaatgtggcgtacactcctaatgagaatgtcaataactccactcctatacccattgagagccaacaaccccaaattgatcatgcacatgtctcttaa

SEQ ID NO: 37223 - DNA, 318 bp, Glycine max
  Peptide Sequence Number=SeqID_154001
atgaaggcaacatatgctgacatgtctataaaggacattattgaaggtccaaaaactgctttcaaaatagcctgtagacccttgattagtgttgatggatgccatttgaaatcaaagtttggaggacaactgttgattgttgttggtagagatcccaatgaccagtacatgcttattgcttttgttgttgtagaaacaaagactaaggaaacatggagatggtttctgattttgttgtttgaggatattgggattacaacaagtttttctggaatttccaaccccgatagagctgaaagatttgatgatgggagctga

SEQ ID NO: 37224 - DNA, 1011 bp, Glycine max
  Peptide Sequence Number=SeqID_154002
ttggacaagctctttgatgggtttgggacctctgtcggaggtgttgtctcgcagatctatgtcaaattcactgtccaggctggattggtagacggtcagggctcaaatttgagacctttcagccgatgtggggtgaggcatggcaagctcccggatgggaggatatggtgctaccttcaagctctttacatatttgatggtgaatctcctggagagcttgccttgaacgaaggtgatcatcaagttcactctatggaaggttttccaatacaagatattagtggaactgtcctggtcgatgaggaccctggacaccatgaagtttgctatgattatgaagacaaccacaatgttatcttggttgacaaggttgatgcccttgaagtccctgtccgtaaaggtgataggagggagacttctctgaatcggtgtgttgacaaaattgatgttatcgcttacgccactgtggttggtgtctttgtctgcctcgatcttctgctcttcttttgtatgcttcttggttcctatgttgctcctatggatgtccttagggtcttggttcttcttggtggttgtctgacggttgtgcccccaaatgtgttcatgaagtttctgagggactcgtcgtctgcttgttgcagactgaccaaggcagctgaggtcatgcggttcgcttgtgtcatgaaggcatctagatgctcgtttggatctgttgtctcatcatactgctcgaggttgagtggtttctaccccaagggcaaggtgtgggcggattgctcgttgtcatggggacgtctgacacgagtatctagctggtcatggccaacctttagatttttcaattcttcttcgtggtgtcgctccatctccacgataccgagtgccaacatgagtgaatgtgagaggattgacgagaggcaacggggtatactttaccgtggccccatggtgcctttgacaggaggggggacgtgcaaaacaaatgactctgacactcaagtaagaatatga

SEQ ID NO: 37225 - DNA, 417 bp, Glycine max
  Peptide Sequence Number=SeqID_154003
atgaaagaagttcacgaagggatctgcggtctccataccggagggcgctccctagccaccaaagcggcgcgagctggctattaccggccaacactcaggccaggcgccctcaactttacccgaagatgcaaacgatgtcaagagtttgcaaatgtgccacgcacttctcctgacaaccttcacagtctgagctcccattcacctttcgccatgtggggaatagaaatactgggaagactgccaaaggccttgggagttgtcaaatacttactagtcatcatcgactacttcaccaagtggatagaagcaagaccaatgatgcccaagacctcaaatagacatttgtacataaagaagaagggtggacgactaggcaccaccctaaaaaacgggaagtcatcactcccgcaagcctaa

SEQ ID NO: 37226 - DNA, 579 bp, Glycine max
  Peptide Sequence Number=SeqID_154004
atgaagacacaattcatgcctaactttctggtaaaattcgttggaaacgacacaaccatcctaaaccagtggaccttttacattaacggtgcgcccaacgtaaaaggaagaggagtagagatcatccttaaaggccctgacaatatcactctagagcaagccctcaagctcaactttaaagcttcaaacaatcaggcacagtacgaggtgctcattgcaggtctgaatcttgcaagagaagttggagccaaaaggctacgatgctacatagactttcaatttgtccaaggacaggttgccaacacataccaaaccaatgaaacagtgatgctcaagtactatcatatagcaaagtctctcatcgaaaatttcaaatgtttcaaaatgtactacatcctcagggaaagtaacactcgaatggagctactctccaatataacaagcaccaagaaagtcgagaacctcaagaccatcatccaggacacactccaaactcccaacatagatgctgaggaaattatggctggagaagaggaggaaccaaaccggatgaccccctacaagaacttcctaatttag

SEQ ID NO: 37227 - DNA, 222 bp, Glycine max
  Peptide Sequence Number=SeqID_154005
atgttggtagggctgagcatctccagtatgatagtgcatttgtcggggttggcttcaatcctccggtgtgtgatcatgaagctgaggaacttgtcgccgcctatcccgaaagccaaatggaatgaccctatggcgaaagttggcatctttagtgatgaatgtcattttctcctcgtctggaggatgcattttgatctagttgtatccggagtaggcatctag

SEQ ID NO: 37228 - DNA, 129 bp, Glycine max
  Peptide Sequence Number=SeqID_154006
atggttaagagagagagagaaagagaccttggtgtcctcgttgatggtggaattgagatcaaagaggagatcgaagcagaggagtggcaactccaaatcgataactccaaatcccaaaccagtgaattt

SEQ ID NO: 37229 - DNA, 552 bp, Glycine max
  Peptide Sequence Number=SeqID_154007
atgacggacggtcatctcttcaacaacatcaccctcggaggccgtggaggcaccgttttaaattgcggttatggttgggggtttgttgtggttcttgatatagcaggaaattacccatcagagaccccgaaaaccttgatgatgcggaacaagcggagtatgtatagcccctactcagaattgcattgcttgttccatgtcaagtttttatcagtttcattgctttttgataaaaataatccagggcagataaaaatatatcctggaggaattatatggaagagacagggtggtggtaaattaattgaagttgataaatctgacataatgggggtgacatggatgaaggtgcccaggagtaaccaacttggtgttcaaatcaaagatgggttgtactataagttcacgggatttcgtgaccaggatgttgtaagtttgaccaattttttccaaaacacctgtggaatatcagtagaagagaagcagctttctgttagcggacgtaattggggagaagttgatctaaatggttggggaaattacttgaactga

SEQ ID NO: 37230 - DNA, 863 bp, Glycine max
  Peptide Sequence Number=SeqID_154008
atggcggaaccatcaaagaagcgaaagggtgtttcgagtcaaagtcaacggcattccaagactcaggagacacagattccctcctccatttcctcttcctcattgttctcatccgaagaacaacggatacgatacacaaaccttttctcttctttttccattattgatccaaaattcattgatatggatttcttttccaatgagagttgtgaatgcattcaggcatttgaaaactccaatctcattcctttcatgtctttaaaatttcctatttacactgaattggttaaagccttctattataacctagaaattcaagaaggcactttgatttctgaagtttatgggattaaaatgaaatttgatttctctgtgcatgatgcccgccagttggtttgcaccaaccaagcggatatgaccggaaggcttcttgccggttcattggattttgaaagctgcatccttcattatctcattgtgcatatcttgcttccaagatcttcaaaccttgcacatgtttctgaagaagatcttattgtcatgtgggcttttcacacaggccgacaaattgattgggcagacttagtccgatatcgcatgcataaggcattgcgattaaatgctccattgccatgtccacacctagtcactctcttctttcaacactttaacatccctcttgattctgaaccttatgttccaatcaagagatcctttctaataggcgctgctgtgattgcatcctttggttatcgaaaagagcatgatggctcttgggtgaaaaatggtgctcaaccaattgatgaagaaggacatttacaaggtggagaagattcctctattcttcaaaagattttggaaag

SEQ ID NO: 37231 - DNA, 396 bp, Glycine max
  Peptide Sequence Number=SeqID_154009
atggtgcttcttcaagtgggttctatgccatcaattggtccttcgggatctagttttagagagagaaagggtcatggagagaaacccttgatttctgtgtgtagtaattcagtgtctagcttggaattagcttgcctgggcaagccagttacttcaggagtaagtattagctcgcctgggcgagctgccattgccccaagtgtccattttcctataaataggcgtactagggaggttgaggggaggtttcaaggttcagaagtggagggaattgagagaactaagaaagaagaagaagaaagaagagaaaacgaagttgaggcgttgccgaatcatgattgtgatcaatctctacatcgttccttgttcagtgttcttcgtgcaaccgtcagttag

SEQ ID NO: 37232 - DNA, 252 bp, Glycine max
  Peptide Sequence Number=SeqID_154010
atgaaccctaagagaataaaggtccttcatgagtggcccactacaccaagtgttgagggaaggagcccagagtatgaagaaccttgggatttgaggtcaaatcctttccaaggaagcttctcaaataagtttctcaaggaagtttctcaaggaagcttctcaaagaagcttctcaaggaagtttctcaagaaagcttctcaaggaagcttcttaaggaagtttctcaaggaagctacctagtctataaatag

SEQ ID NO: 37233 - DNA, 631 bp, Glycine max
  Peptide Sequence Number=SeqID_154011
atggtcataagagaggagctagctgctggctcaaggtccaagagaagcttgtctcagcgtttatacgagacagagaccaatatgttagccatcgtcagcaagtaccaagaagaattaaatctagccgcggcccacgagcacaaagtggcagacgagtatgctcaagtgtacgcggaaaaggaggctagaggaagggtgatcgacgcgttacatcaagaggcaacaatgtggatggaccgatttgctcttaccttgaacgggagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 37234 - DNA, 167 bp, Glycine max
  Peptide Sequence Number=SeqID_154012
caccactcattgagttggtgaggacccatgttccctcatgggaagatgtccatgaaaggagtgtcaagggaaagagcccagagtatcaagaacctcaggatttgaggtcaaatcctttccaaggtggaggggatgatgcaatcctaccccctaagggtattggatag

SEQ ID NO: 37235 - DNA, 473 bp, Glycine max
  Peptide Sequence Number=SeqID_154013
atgcgaattctaaagcaaacgtgcaccactcgcaacagaaccatcattctctccattcaccaacccagcttcaagatcctcgcttgcattgataggatcttgctgctctccaaaggaaccgtggttcatcatggtagcgttgccaccttgcacgcgttcttgcactccagtggcttcactgttcctcaccaactcaacgcgctggaatatgctatggagattttgagccagttgaatgaggtgaagcctgttactcccccgagtattcctgaatcgcctcaaagttcaatttcaacgagttccgtttctgagggtggagctaggagtagtagagagatcatcaggttttggaagattatctacagaactagacaacttcttttgcccaacacagctgaagcacttctcgtggggcttgtgttgggaactatttatatcaatatagggtttgataaagaagggattgagaaaag

SEQ ID NO: 37236 - DNA, 549 bp, Glycine max
  Peptide Sequence Number=SeqID_154014
atgcgcgaggcgagtgttggaaaggtgcgtgagtcggagttcggagaggagggaggagacggtggcggcgaggttggaggttttgggtttgaggagctttgcggcgaagaggaaggtttcggagacggtgaggagggggaggcagtggtcgtgttgggggacataggaggagagcttgcggaaggtggaggggacgagaggggcggagttgaggaggagggtgccgtgggaggggagggtgcgggcggcgaggatgtcgaggagggtggattttccggcgccgctggggcccaccacggccaggatttgggaggggagggcggtcagggagatgtctttgaggatgtaggttggtggggtgttggtgcatgcggtgaagaaaaggtgtttgtggcgctggtggtgggggtggtggagactaatctgaggggtcttccatggagggttgaagtgagagagaagagctatggcgttgggattgaaacaaggatcggttcctttccatgtgttggagtttataaaccttggtgcatggatgatacagagtga

SEQ ID NO: 37237 - DNA, 207 bp, Glycine max
  Peptide Sequence Number=SeqID_154015
atgacgaaagataacaattggtacctcaaagccttacactggggcaatgagaggcatcgtgcacgagcctcaagcccacttgggccctccagaatattcctccagaaggctgttgcttctggaggaagcaaccctgctcgcctaggcaagctgggcggcaagcatctcccctattttgctataaataggggaggaagtgagaagtaa

SEQ ID NO: 37238 - DNA, 1678 bp, Glycine max
  Peptide Sequence Number=SeqID_154016
aattctgcctgccgagctgttctctctaaagatgacacattttgtagaaggtgctcttgctgtatttgccaccatttttgatgataacaaggatcctagtctttggttggtatgcacatgtgaatcttctcaaggggactcttgtgggttgtcttgccatattgagtgtgctcttcaacatgaaaaagtaggagttgttgatcatggacaactgatgcaactagatggtggttattgttgtgcatcctgcggtaaagttactgggatacttgggcttttggatggtacttcaagatttaaagaattgcatgaaatggtaaaagaggcaaaggctaaactggaaactgaagttggtccagttaatggggtttctgccaagatggcccgtgggattgtcagcagactccctattgccagtgacgtacaaaaactctgctctcttgctattgagaaagctgatgaatggttggccactgttcccaatgtacatccagaatccagagagggttctcttcctgctgcatgcaaggttgtgtttgaagaggtaacagcttcctcagtcaaaatcattttaattgaaatgtcaaatgcatcttctggggacattaagggatacaagctctggtattacaagagtagggaggagtcgcacactaaagatcccgtttctgtgtttcccaaagctcagagaaggattttgatacccaacctccagccttgcacagaatatacatttcgggttgtatcttttacagatatgggtgacctgggtcattctgaggccaagtgtttcaccaagagcattgagatattggaaaagaattcatcgtcatcagttgccatgaataaaaaaaaggagaaccttcaaactgaatgcaattcttctggctccaaaatggagcccaatcccacaatggaagactctggatttaaggttcgagaccttgggaaaattttgcatctttcttgggctcaagaacaaggctgctctgaggaattttgctgcgctgacaagagaaaatgctgtgggcaaagtgaaacaatcaagcctaccaatccacaagagctgttgccttcagtttctcgcgaccttgatctaaatgttgtttcggtgcctgatttaaatgaagagcttacacctccattcgagtcttctagggatgaagataatggttgcactttgcagcaggctgttgaggcagatgatgatgctgcttcgcatgatttagaaaaaaatttagcaagatcacacggtagtggtggttcccaaacttggaaccatggacctactggtgaagttccagcagttgactctcgtggagatgcatgtaggaagagggtagcaagcacaaatgaagagacacatgattgtgacagcactttgataaatgattctcctttacgtgcatctgatggtccattctccttagatgagaactttgagtattgcgtgaaagtaattcgctggctagaatgccagggtcatatcaagcaggaatttaggttgaaattgctgacatggtttagtttgaggtcgacagaacaagaacgtcgggtggtaaatactttcattcaagctctgattgatgatccaagtagtttggcagggcaactagttgactcattttctgatattatatccaacaagaggccaagaaatgggttctccaataaggct

SEQ ID NO: 37239 - DNA, 192 bp, Glycine max
  Peptide Sequence Number=SeqID_154017
acttatatccataaggagacacactttcggtgtcggtctttggaggagattaagaattacgagaaatatggaagtcttcctcggtgtcacaaagtgaaaatacaagacaaagaagaaagcaatgacaaaacccgaagtgaaacagaatttactgacaactacaagctcatgaatacgactgagagtgattaa

SEQ ID NO: 37240 - DNA, 1773 bp, Glycine max
  Peptide Sequence Number=SeqID_154018
atgagggaaaagcacatcagagctaatcggagaccccgatcggtgaagccggacccggattcttgcgacaaagatgccatatccaaatccatagccgagtctggcctcaagcccttcaaataccatctgggcctcaacgattcttcccagagtccgaattcgatccctaatgctgaggaaaccgggtggggttactgtacagaggaacaattggaagagattctgttgaaaaacttggaatttatatacaacgaagctgtttcgaagcttgttgcgttgggatatgatgaggatgttgctgttaaggccatactgcgaaatggacattgttatggtggcatggatgtgctgacgaatattttgcacaattccttggcttttttgaatagtaatagtgatagtggtggtggtggtggtggtgctggttataatagtaatggtgggaatttggatgagtctgaccctgtgttctctgatttgaggcagttggaggagtactctttggcgggtatgctgtgtttgttgcaacaagtgaggcctcatttgagcaaaggggatgccatgtggtgtttgctcatgagtgatcttcatgttgggagggctagtgctatggagattccggagccgggcaatgggagcactgtgccggctgccggtgaggttggtgccaatttggttggtgctatggcgccagctttgtgtaggtttcatggggggtggggatttggaagtgggggaggcttggaatttcctgtgaatgggatattctcttgtggtgcagagatgaatttgcagctgcaacgagacattgagtttccgaagaggtttaatctttctccttcaatgaagtccttgttgaagagaaatgttgctatgtttgctgctggttttagggcaaactccaagcaattgcaggcacaggtgaaggtcgttcccggccggagtacagtgcctagtttggattcttcggctgtatctgggacagaagtcccggctgagcagtccggaggaaattcacagaatcttgatagccaagatgctgtgaattcggtgcagagtaaatttggtgatttgaatcttgatgagaatttggagttagtggcggaggatcagaaggatgaggtgatagttactttatttcatcagattaaggatcttgagaaacaggtcagtgagcgaaaagattgggctcatcagaaggcaatgcaggcagcaagaaagctaagcagtgatctgactgagctcaaaatgttgcggatggaaagagaggagactcaaaaattgaagaaaggaaaaccagtgcttgaggacacaaccatgaagagactctcagagatggagaatgctttgagaaaggccagtggtcaactggaccttgggaatgcagctgtgaggagactagaaactgagaatgcagaaatgaaagcagagatggaggcttccaaattaagtgcatcagaatcggtgacagcttgcttagaagttgcaaaaagggagaaaaaatgcttgaaaaaacttctagcttgggaaaaacagaaagctaagctgcagcaagagattgctgatgaaaaagagaagatattaaagacaaaagaaatattggttcagattagacaatgtcaaaaggaagctgagagtaaggttatcgattggacttgcatctcgcatgtcagaataaaagtaacatacttcaaccacaagggacacgccgatgcccaaacagggatcagtccacacccgagagggggtggaatcacctcatggccttactga

SEQ ID NO: 37241 - DNA, 183 bp, Glycine max
  Peptide Sequence Number=SeqID_154019
atgaataaaggggttggaataggaaatattgggtgtggaaaaagtggatccagatcgaaacttgatggaagggaactgagagaggtggatgaggatcgagggttatttggttcaccgttattggttttaagagtgctcagtgctgagaaatcagaacctcgattggtgcctgcctgtggatag

SEQ ID NO: 37242 - DNA, 210 bp, Glycine max
  Peptide Sequence Number=SeqID_154020
ggaagtttggttggaaaaattcactcttattgcgaattccttaaccaagcaagggtcgtgaggaaaccaacatcacatgtcatgactcatgtgaaaaagacaaatcatcccaagcaaagcaagagaagaaagcttacagatgagtggtcaaaaaggctcaagatcgctctcttcttacccacaaatgctatcaactatacaatgaagtaa

SEQ ID NO: 37243 - DNA, 1974 bp, Glycine max
  Peptide Sequence Number=SeqID_154021
atggctaagtttacttcacaagaagttagtgcacttcaagaaggaggcaatcagcgtgcaaaagaaatttattttaaagaatgggatgcccaacgtcattctttccccgatagcaggatgcatcattcatttattctgattagcatggttggtgccagtaatgttgacaggctccgagactttattaagcatgtttatgtggatagaagattcactggagataagaccaatgacaaaccaccaagagccaagccgggtgacaaggatgatttttatcaaggaggatctagaagccctccctatgaggacacatatgaacgccgttataatgacagatctagtccaggtggaagaagtcctggatatgatcaagaaagtaggcaatatggtgattataagaaaagtcctggtcgtcctccactaattaatgattggcgtcgtgaagatcgcagaacatctgatggagattataagttggaaagccaatctcctgagagagccaaagatgtggattcttccagcccacctgtggtccgacctgttagagatattttgggagaaaatgtggtgcctcttcggataagtgaaccacccaaaccaaacagtggaagacctgctgatagctcagcaccgacacagagaactatatcttccagtagcttggcttctggcaatgaaaacccagtagatgttaagcttgagactactaagagccttattgatttttatgctgatcctgagcctccagtagctccatcaaatcttcaagcccaacaaactactgtacctcaacctgttgtgcagccagcaaactccagtaatgacaattgggcctcttttgatgttgctcctgcaacaagtgcaactccaagctcctcaaatttaaatccacttgaatcgatgttgtcccaattgtctgtgccagcatctttacctgctcaagtttctggagtccaaggacctattccatcatcatctcttacttctacttctggagttgcaagtgttagcggtttctcagctttcccacccagcaatgcttctgtaccatctcctggattgacatcagtgtcgcctcttaataatgcaggacaatgggccaatttacagcagcagaaacaaccattgttccccgctgctgttggtcagtctattgcacaacaatttacacccctattaggtggagcagcaaataatcagccatggaatgtaccttctgcacccacagtgcaagggcatccaagcacaccaatgccacatacgtacccttatgcttcaaagcctgccaatgaggctatatccagtgttgtttcacaacctccggcttcagaagttaaagcaagtggaaggaaagaacttcctgaggatctgttcactgtaaaatattcttccttccctgctccagtcgtaggttggcaaatgggtgttccccatggcatgggtatctcaatgcaatacaataatgtggtgcctgtgccaagttttccacagccatcaaagtcaataaatccatttgatgtcagcagtgaacctaccgcaaatcaagccccaacttttccttccatgtcatccttgcaaggtgccctgcctggggtaccacctcctggtgcagtgcacccttcaagcatgggtaatccaacacatggctggactcctctgtcatcatcatttctgcctgcacagacacaaatgcgtgcaactgcattgggaccaaggccatatatggggcagcaaatgccgactaacatgccaatgccaaggcaagaagttgggaattttggtaaccaaggagctgttttcggcttgtcaaatccagatcagcagctgactggaatgaaagacaatctaccttcttggaagaggttaatttgttattatgaaaggctaatatgctgctgccgtaggggctgttgtgctgtagagaatccaagtcccttggaagaggggaaaggagttgagataaagaacggatga

SEQ ID NO: 37244 - DNA, 165 bp, Glycine max
  Peptide Sequence Number=SeqID_154022
atggcgagtcgcatgaaggaagatgagaagaacgagcgcgtgattcggggtcttctcaagcttcaacataatcgcagatgcattaactgcaacagtctggttactggactgtggttttgcctgttaatggcatgccaatgcgaaccactgagtctttcatcttaa

SEQ ID NO: 37245 - DNA, 177 bp, Glycine max
  Peptide Sequence Number=SeqID_154023
atgacagtcactgtggtgctaacaactggttggattcataatataacaggatgcatactacgtatgaacagcgattgctatcatggcagactgtggcatcatggcatgggtgaagcggccgtgatcgcgcttctggggcagttttgggtccgcatcactgaagtccacatgatgtag

SEQ ID NO: 37246 - DNA, 510 bp, Glycine max
  Peptide Sequence Number=SeqID_154024
atggggaaactagggagggtgttggataccttctgtctttcttttggttcaaacacctgtttctgcatgaactccatggagtttgaagatgagtttgagaaaaagcccttgatagtaagtgacagtgatcataaactgagattgaaggatgttgtagatggaaagcaaacgttggcttttcaactaaaaccccagatagtgacattgagggtgtccatgcattgccatggctgtgcaaaaaaagttgagaaacatatctcaaagttggaaggagtgagctcatataaggtggatttggaaacaaaaatagtagtggttatgggtgatattcttccctctgaagtgttgcagagtgtatctaaggtgaaaaatgcggagctttggaattttcaagctatgaccggaactttgaggccactggaaatactgacatatggtaacaaggtagatagttcaagcagtggtcaaagtttgacttcaaactcttctggggtggccactggccaatga

SEQ ID NO: 37247 - DNA, 462 bp, Glycine max
  Peptide Sequence Number=SeqID_154025
atgacaagtgtatctcttcacccaaaagtgaatgctggcattttaagtccagggttgatggggctttatgttgtcttcctttgctggtgtgcaattagaagtgaacctgcgggagctgaatgcatcaggaagtcagaatctgcaaacaaaacagactggcaaagcatcattagctttgttgttgcaatactagcacttgttgttgcaacattttctaccggcatagattccgaatgctttcaggttctccaatgcatatctaacaaatccttacagttcaggaagagtgattcgccagcagaagatgatgttccatatggttatggcttcttccatttcgtttttgccacaggagctatgtactttgcaatgctattgatcggatggaatagtcatcattctatgagaaagtatgatcccatcttgcaattggctcataacatgttatgtgcatcttattaa

SEQ ID NO: 37248 - DNA, 453 bp, Glycine max
  Peptide Sequence Number=SeqID_154026
atggagactggtgaaagcaacagtactagtagtaaccaaagttgtgcagtgatgaaggattctaaatggtacactcaattcagaaatgtatccaatccttggatggcaagatatgtttatggcttgattttcctagtggccaatctgttggcatgggctgcccgtgatgaactttctagtcttagtgctttaacagaaatgaaggggttaaagggatgcaaggttggaaaagactgtttgggtgcagatggtgttctgcgtttttcaaccttaattcttgatcagttattttatatgataatgttttggtcgactgctggcacttctaaattgaaggaaggcagagatgaatggcaatctggatggtggttagtgaagattgttgtcttggtccttgtgacaatattcccatttatactcccttctgagttgattgatctctatggtgggtaa

SEQ ID NO: 37249 - DNA, 422 bp, Glycine max
  Peptide Sequence Number=SeqID_154027
ggtacatcctttgtggtacaagtagagggtacatctacttgggttgttgtgactgagaacaagagagggtacatctcttgtggatcagttctagtggagggtacatccactaggttgttcaaagagaacaagggagggtacatctcttgtggatctttgcttgtaaaggactttacaaggttgaaaagaaatctcaaggatcgcaggtcgcttggggactggatgcttcaattcgtttatattgcatcctgtgagactgagacgaaggatgaggagaaaggaaacgatttgggtcctgtgagactgagaaaggacgaaggatttcaaatgacagttgcaatgccgacagtaagggagtttcagcaccacaagaggttgcaaatgagagtgcgaaagcattcgagtgagagtgagagcaatag

SEQ ID NO: 37250 - DNA, 237 bp, Glycine max
  Peptide Sequence Number=SeqID_154028
atgtcattttcccttggaagcaacaataccataagcaaatggggaagaggtggtggctcaaccacttgttacactccatcagtttctcaagttgcattggaaacttccctagaaaaatgtggtggtcgtgtgagaatggagggatatgagggtttgggtgttgtggatcaagggttaaatatgcaacaacaagtggttggagaggttgttgagaagcctcaggtcatcaacccctag

SEQ ID NO: 37251 - DNA, 657 bp, Glycine max
  Peptide Sequence Number=SeqID_154029
atgggctctagcagacgacaaggagggcgagatgataaagtatgtgaaaagtatggcataagcaaggagaagtggaaccagttttgtcaaagccacagagatccttcatgtgaggattccctggaagagcagggctcacagggaaactttgtcgcccatggacgtcaggatgtattgactactgcccttggtgtcacaatcaaacaatactttgaaccatcttcaagcagctcctgcacgtctatgtccatggctcccgaagacctagagcaactgacaaaaaatcagggaccagctggaggaggactcgaactgcctcctaagcctgaggttggtccttctattgcttgtgtcagcacaaagaaaagttatgtcgatccctcggggcaaaactcagacacaagtgacttaaagaaatataggttgtatgtcgatgaaaatcctccctgcctagttgcccttataagagtttatgaggggtcgaacatcgtccacaacatccctttgggaaatgatcaagtcaaggtcggtgttgaggaagaatattggaagagggttgcagaagcaacatctgctcagcgtgctcagcacgtcaacatccgctcacctcaaggagccaacttggaggccaggtttagcccgcatctagcgacttag

SEQ ID NO: 37252 - DNA, 714 bp, Glycine max
  Peptide Sequence Number=SeqID_154030
atggaaatgtttgatcaaattcacattatcgattttgatatcgggcttggggtgcaatggtattctcttatgcaagtgcttgccctaaggagtaacggtgtgccttcgctcaaagtcactgccattgtatcacccctcacttgtgatgagtttgagatcaatattgctcaagaagagttgaaccaatctacgaaagacatcaacatgtcttttgagctcaatgttttaaggattgagtcattaaacactcatttatgtccactctccgtccagttctatgataatgaggcaattgttcttaggccaaaagtggtggtcactctagatcaaaattttgaccaaatcgatgtaccattttcctccaatgtagtccatgctcatcactgttactcaaccttgcttgaatcacttgatgttgcgaatctgaacctagatgtcctccaaaatattgagaaccatttcatccttccaaccattaagaagattatattaagtcccctcggcttgcaggaaaaattacctacttggaggaacatgtttttgcaatatggcttctctcccttcccatttagtaacttcacagaagctcaagctgagggtttagtggagaaggaacctgtaaagggatttcaattggagagaaagctctcacctcttctctatgctagcagaggaaagaactcaacacagtttcaacttagagatgctgagtag

SEQ ID NO: 37253 - DNA, 411 bp, Glycine max
  Peptide Sequence Number=SeqID_154031
atgcacagatgcccaagcagttattcgtacaaacgatttctgttaatcctgacccgggaagtcaggtggcaggcggagatacccaagcggttatccgtacaaacgatttctgttaatcctgacctgggaagtcaggtggcaggcggggagacaacgagtctgatgacatgcagagggtaccttatggttatccgcacctttcatcaaccagaggttttactttcgtcatccagagacattcaagtccaacaacacgcaagattcttctctgttaggaagggggtgccaatagcaaccaggcccacttgggccttcctgagggttccaaaagaaggcggtgccttctggtggaagcaacccagctcgccaaggcgagctgggtggcaaccacctccctcttttctcctataa

SEQ ID NO: 37254 - DNA, 102 bp, Glycine max
  Peptide Sequence Number=SeqID_154032
cgtgttagcagctcaacagtgagtgacccttctttcttaggagaccccactgttccttcttccgagggcaaggatggaaattctcatcctggcggttcaggg

SEQ ID NO: 37255 - DNA, 480 bp, Glycine max
  Peptide Sequence Number=SeqID_154033
atgagatggctacacgccctcgccttcagaggcctagacgtcctcacctttagagggctgcatgcccttacctttagaggacaacacgtcctcgcctttagagggctacacatcctcaccattagaggactacacgggctcccctttagagggctatacgtccttgccttcatagggctacacgccctcatcttcagaggactacacgtccttactttagaggaggactacacatcctcgccttcagaggactacacatcctcaccatcacacgccctcgcctttagacgtctacacgtcctcctcttgagagggttacacgccttccccttcagagggctacacgtcctcgccttcagagggctacacgccctcgccttcagaggactacgcgtcttctcctttggagggctgcacgccctcgccttcataggactccacatctacgccttcagagaactcaaggtcctctgcccttaa

SEQ ID NO: 37256 - DNA, 423 bp, Glycine max
  Peptide Sequence Number=SeqID_154034
atggattttataaagatagtgaaaatctcaagtgggttgcttgagtactggatcctatccctcttaagattattgaggccacaaggtctaacaactacacgtcctcgccttcagaggcctacacgccctcgccttcagaggactagacgtcctcgtcttctgagggctgcactccctcaccttaagaggactacacgtcctcgccttcagaaggctacacgccctctccttaagagggctacacgccctctacttccaaggactacacgccctcgcctttattggactacagtccttgccttgagagagttgcacgctatcgccttcaaacgactacacatcctcatcttcagaggactagacgtcctcggcttagaggactacacgtcctcgccttcagagggctacacaccctcgaattaa

SEQ ID NO: 37257 - DNA, 126 bp, Glycine max
  Peptide Sequence Number=SeqID_154035
atgctaaaggtagctggttttgataaatattatcaaattgcaagatgtttccgtgatgaagatttaagagttgatagacaacctgagttcacccaactagatatggaaatggcctttactccttaa

SEQ ID NO: 37258 - DNA, 159 bp, Glycine max
  Peptide Sequence Number=SeqID_154036
atgtcttccgaaaatgaccttttcgtaataggatcaagttttacatgtttacgaatttggtcatggttgcgcggtgttgtttgcgtggtggttgagacaatgttgtttgggttgacggtggtattggctggaggcagggcttacttgggagaggcataa

SEQ ID NO: 37259 - DNA, 1617 bp, Glycine max
  Peptide Sequence Number=SeqID_154037
atgagtcacaactccttgaatggaactattcctcctcaaattggttccttatccaatctcaacactcttgacttgtccattaataacctctttggtagcattcccaataccattggtaatctctccaaactcttgtttcttaatctttctgacaatgatctctctggtaccattcctttcaccattggaaatttgtcaaagcttagtgtattatctatatcctttaatgaactcactggaccaatcccagcttccataggcaacttggtcaatttggacgacattcgccttcatgaaaataaactctctgggtccattcctttcaccattggaaatttgtcaaagcttagtgtattatctatatcctttaatgaactcactggatcaattccttccactattggaaatttatcaaaagtcaggacattaagatttattggaaatgaacttggtggcaagattccaatagaactgagcatgcttactgctctggaaagtttgcagctagctggcaataattttataggccatttacctcaaaacatttgcattggtggaacgttgaaaaattttgccgctgaaaataacaacttcataggcccaattccggtgagtttgaagaattgctccagccttataagagtcaggcttcagcgaaaccagctaactggggatataacagatgcttttggtgtacttccaaatttggactacatcgaattgaacatgagtctgagccaaaatagcatcaatgcagaaacttcaaattttgaagaaatagcatcaatgcagaaacttcaaattttgaagcttggatcaaataagttgtctggcttaatcccaaaacaactaggaaatttgctcaatttattgaacatgagtctgagccaaaataattttcagggaaatattccttcagagcttggcaaactgaaatttcttacgagtcttgatcttggtgaaaattcattgagaggagcaataccttcaatgtttggagaattaaaaagcttagaaacactgaatctctctcacaataatctttcaggtaatctctctagcttcgatgatatgaccagcttgacatctattgatatatcatacaaccagtttgagggtccacttccaaacattctagccttccacaatgctaaaattgaagcattgagaaataataaaggtttgtgtggcaatgtcactggcttggagccttgctcaacatcaagtgggaaatctcataatcatatgaggaagaaaataataatagtaattttaccccttactttgggtattctaatactggcattatttgctttcggagtctcgtatcatttatgccaaacctcaacgaaaaaagaagaccaggctacaaatatacaaactccaaacatatttgcaatatggaattttgatggcaaaatggtattcgagaatattattgaagccacagaatatttagacaacaaacatctcattggtgttggaggacaaggatgtgtttacaaagcagtgctccctgcaggtcaagttgttgctgtaaagaaactccattcagttccaaatggagcgatgctcaatctgaaagctttcacatgtgagatccaagctttgacataa

SEQ ID NO: 37260 - DNA, 209 bp, Glycine max
  Peptide Sequence Number=SeqID_154038
gatctggtcccattaggcacatcatcaggcttacttccctcgggttttctgaggcagaggaagagaaaggattaattgctgagattgctgacaaaattgaaacttatatcaaagaaaaaggacctcctctagcattgttgtctaaatttagagaaggcagtgctttcttaaaagatgatggatccgttgatgcattgaatgacctataa

SEQ ID NO: 37261 - DNA, 126 bp, Glycine max
  Peptide Sequence Number=SeqID_154039
atgtgttcttcaccgtcaagtgcggaccctcttgactgggaaatgtggtctttgttatttttcccgattgattccttcgccaaacataaaaacgaaggagtagagacgagagtcgtcatggactaa

SEQ ID NO: 37262 - DNA, 216 bp, Glycine max
  Peptide Sequence Number=SeqID_154040
atgggggggcaattacgtgcgcaactggtggtctcgacgaactctacatggtttcctaagtgcatgcatcattctgtgcagtccttattggatccatggatggatgatgagaaattgttgaatatggatgatggcgatgaggcgggtcgttacaaatctaatcagcaacagggacagtggagaactcaccctggtaatcagttcaataaagactaa

SEQ ID NO: 37263 - DNA, 330 bp, Glycine max
  Peptide Sequence Number=SeqID_154041
atgtctccatgttctatttgtttctaccacatgggtctttcccttgtcgtctctctcttcctcctttttgttaaccattttgttttgctaaagttcaatgatgtcttctatatactctctcaacatcttccatgtcttcttcaccttcacctccgtgacaattcacgcactcatctttctcttgagcaagatagcataaagtggcactgcatgccttgttcaacatgggaagagtctgcagcagagtgttaccataccttgattaaggttaagcttcttctttttcttgctattgatctttttgtgcgtttcaattattccataatgtga

SEQ ID NO: 37264 - DNA, 306 bp, Glycine max
  Peptide Sequence Number=SeqID_154042
atggccactctccttctacccctcaactcctattctcccacaccaattcgaaaccctaatctatcttctcttaaaatcaaagtcaaccagcgtcactctcctttccaaacccgacgacttcatcgcaccccattcgttcgtgcactggaggaagattcgaaccctgaaacagtccaagatggcgaagtgaacagtttaggagtcaaggttgcgctgtccatgttgagattctaccagaccacaaacttaacggttcggactaatcatgtggctgctgcgatgcggattgtgactgttgcggcgtga

SEQ ID NO: 37265 - DNA, 365 bp, Glycine max
  Peptide Sequence Number=SeqID_154043
atgctgttcatgtgtgcaggggaaatttcaccaattttgccaaagagctgtcgatacattccaacctgcagtgagtattccatggaggcatataagcgatatggagcggtgaagggtacagttttaactgcgtggcgtatatgtcgttgcaatccccttggtgggcatggttacgatccacctagatggtttggggagacgttcttccggaataaattccggaagaaggttcttctggaagaagaaggtgggcttccgaaagaacttcctgaagaagtttcggaagaatgtcttctggaacttcttccgaaagatggttcttccggaagaccaatttcttctttcggaggaaccttcttccggaa

SEQ ID NO: 37266 - DNA, 207 bp, Glycine max
  Peptide Sequence Number=SeqID_154044
atggcccttctccatcttgagagtatgttcatcttcttgaagaagctatgttcaaggctttggagtctcttactgaagttcttcatgactgagcccatgttgaaaaggaagcatagaagtggaaaatctttggtgattactacttcaagaagcatactaaaggagaatcttctagtgactccaaagatgagtttctgtgcaacatag

SEQ ID NO: 37267 - DNA, 732 bp, Glycine max
  Peptide Sequence Number=SeqID_154045
atgaaggttccgaagtggaaaaaagttgtccttgaggagatgaaagctcttaagaagaaccgtacttggagtgttatgcctttgccaactggaaagaatatcgtgggttgcaagtgggtgttcaccgtcaagtataactctgatggacacactcagacctatggtatagactactcagagacctttgccccaatcgcaaagttaaacacggttagaattctcctatcacttgctgcaaacttagattggcctttgcaccaattagatgttaaaaatgcattgtcaatggcgacttggaggaagaggtatacaaggatagtcctcatggcttcaaacacagatttgggacaaaggttaaaaaagaacttggtagcagaatttgagatcaaggacatgggatccttgaggtactttcttggcatggaggtccctcactcaaaaaggggaattgttgttttccaacagaagtatattctagacctcttggaagaaacgggaatgagcggttgtagaccagcagatacccccatggatcccaatgggaaactttggggaaaaggaagtgtttcggttgatgttggaagataccaaagattgggcagggtctgttacagacagaaaatctacttcaagatattgcacctatgtgtggggaaatctagggacttggagaagcaaataaaaaaggagttgttgccagaagcagtgcagaagctgaatttagagcaatga

SEQ ID NO: 37268 - DNA, 204 bp, Glycine max
  Peptide Sequence Number=SeqID_154046
atggtggagagtttgagaaggcaaacaccatcttgcattttatcacccattgaggaaacagttcactcgctaagcgcatatcatgtgctgagcgcatcttcgtttttcgctaagcgaggtgattggctcactaagctggccatgggcgagcttagcccaattcaattcgatctgaattgggctaagcgagagtacattcgctaa

SEQ ID NO: 37269 - DNA, 474 bp, Glycine max
  Peptide Sequence Number=SeqID_154047
atggtgaagaagcaacaaccatgccgtcgaaagcaagaacgcgcaaagcccagtcgaggtcgcggaagcaagaaccacgcgcagaaggaagaagaactgaggtcacggaaggaaggaaggagactaataggcgcggaagaaatttgtactgctgggtgtacaaattttaaaaaaattgccaggggcatcaaactcaagcacttatcatttttctatactcaccagttcgcatttcatttccagttcggccgaagtcactacccatcaaagaagctaaagattcaaagaacttctgactcaaggttagggaaaaccattgatggctttagcttcctaatcaaaattgaaggttatttgataagacatgcatacaggtccagattagtatgtccactgaaaataaacctctacaaatataaagaaatcaccacaatcaaaatttcccagtattccaacaagatgacagtgaaataa

SEQ ID NO: 37270 - DNA, 372 bp, Glycine max
  Peptide Sequence Number=SeqID_154048
atggttaggaccagaggattaggtcatgccttaggttacgttacgggcagaggtgtgggcagaggagatcgtgatgattacgatgacgctccacagcgtcaacggcctaccacatccgcacggaggcagcgagtacctgtgactgcggcacacgatgagccagtgctccctgcgccagatgtagaggctgatgtattttcggatgacccgatggcaccagctgatgtagaggacactagggcagacattcctgcagacacaagcacccaggctgctgaggatgagcatgagggatttccgggtggtccgagcgacccatccgtgttgacccaatatacggatatcgttgcttgcaatgtatggacgggagag

SEQ ID NO: 37271 - DNA, 504 bp, Glycine max
  Peptide Sequence Number=SeqID_154049
atggctgttgtttggtctatatggaagatgcggaacagaattatcttctccaatgaatctttcaacggtagcaagctcttcgacgatgcaggtcaggatgaaattggtgcttcaccaatagagattgctagagcatatatggattcccgtgcattagaagcaggtccctgttctaagaacatgattcatactgttgaaagcactatgttgcatggtgatgaagctgcaataaaaccatatgatccatcaccatcaaagaaatcgtcaacatgttggccgggtgctgtggtgcaggatgcttacataacaccacaaagtcagagaaacagatatggacttcataacttcccccgtactccttattccagaactcttttaacaaagtccaagtccaagttgattcatatgaaaggagatagcagccagatttcatcaactcccgtccgtcaatcacatactactatgtatccggaggtatctttcggtaatgttatcctttcatga

SEQ ID NO: 37272 - DNA, 720 bp, Glycine max
  Peptide Sequence Number=SeqID_154050
atggcttccgcatctcaaggtttcggatcacacttgtttccgacgacgatagctaagaaacttgatgatctaactacctacactggcgaaaacatgtcgaaccagtcatcaaatcgcataagctgcagaggaccaaacactccttgtttggcttcaatcgacgctctcgaaatttgttctcccatgcgttttaggcttgaatcactcctatcaggaaaatcgatggatgagtatcttcacaagattaaaggctatgtcaacgagcttgctggtgtcggagttccgattttccatgaggagcatgtcgatgctattttggaaggtctaccttcagattatgcgctagtagtttctgtaatcgaaagcaagaaacgtacgccatccattgcagagattgaggctttgttttatggttattcacatggaagttcatataaatttagtgattctggtggaactagaggaggttatggtcgaggtattggcggtcgtagtactccatctgatcgcagtggaggtcgtggtggtcctggcagaggtcgcagtggaggaaggtcctcaaacacttgggttaatcctaaccccaagtctgttgctcaaccaactagtcaacctagtggtatgcagacaaactcggcatcacagagcaatggtcaaactagctcaacctggattccagattctagagctagctttcatgtgactggtggtgaatcatag

SEQ ID NO: 37273 - DNA, 333 bp, Glycine max
  Peptide Sequence Number=SeqID_154051
atgcggcaatttggatacacccaggccattcctactccacctgtcgattcatgggtgtcgtacgatgatatacacgataggtggatgcactattcggatcatatgattcaagcaggtgaggggtgcattgtgccaggtcagtgtgccagcgactacatagactggttcttccgcatttcccatcctttcatgacaccaggccaagcatcaaatcctctgccagatggtcatgctccacagccccgagtcgtccctcaggccccagagactccctcacgtgccggagccaggagcaccatcgacatctgcaaggcccgctatggagtagcctag

SEQ ID NO: 37274 - DNA, 384 bp, Glycine max
  Peptide Sequence Number=SeqID_154052
ggtaatccttgtggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtctaccctgacttatcttccttcaccggaagtggcgtcatccaaaccttcgtagcctgtatcaaacgatccgccccccaacttattgttttaaattcatacaatattaatttacattattttaacaacaatatgcatatgactaagacaagtatgcgagtggggaatgccgatgtctatggattcctcaagccacaatccatacagagatttgggcaatcataa

SEQ ID NO: 37275 - DNA, 651 bp, Glycine max
  Peptide Sequence Number=SeqID_154053
atgttgattagaggctttagggaagaagaaataaaggaggcaatatgggaatgtggaaactcaaaaagtctgaggctcgatggattcaattttaaattcataaaggagtgttgggatatattaaaggatgatgtgattaatttcctacaagattttcacttttcagggactttctctagagcggaaggattaagtggtttaatgagggaagctcaagttaaaaatcttttttcagggttcaaagtggggagtaagggggtggaggtaaacttactacaatatacggatgaaacaatctttgtgggagatttaacgatggaaaatgtggtggtggtaaagagtatgttgagatgttttgagctagtgtccaagttgaaagtgaatgttcatatgagtagatttggtggcattagtggtgggagagaaactattaagagatttccaagatatctaaattgtagaatcttgacatttccatttgtgtatctagggattcctattggggtcaatctagggagaattgaaacatgggaacctatcattgtcaaattcaagaaaaagcttgcatcttggaaacataaacatctttcatttgccgaaagaatcacgttgattaattcggtacttacctctctacccttattcttttag

SEQ ID NO: 37276 - DNA, 387 bp, Glycine max
  Peptide Sequence Number=SeqID_154054
atgtaccctgcggaagaagcttccgcaggttcttccgcgacaacaaaatgtagcctgcggaagaaggttctgcaggatcttccacgggatccgcggaagacaacgttcttccgctggatctcgcagaagatcctacagaaccttcttcggttggatcacgcggaagatcctgcaaaagcttcttccacaggaatccgcagaagaacctttcacacttcttctgcgggagttcccaaaagcccatttcctacgcgcggaagaaggttcttctcgcggaagaaccttcgtcttcaacctccagcaccacaggtcactaatgtcgtctatcctaagtttcctacagccatttacgccatacaaacagttacgaggaggttagaagactaa

SEQ ID NO: 37277 - DNA, 800 bp, Glycine max
  Peptide Sequence Number=SeqID_154055
atggaagaaagttcagggtttcctgtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatgccccaagagatctataaagaaagaaatatatgaagatgtgctgggaatttcttattccacggtgagtcaatcagagaaggttgtggcacatgatctgaaagagccacattctggtgcaataaagaccatgtcagctagcaggaagctgaacacaggagaaaaaactgtgctttcgtggatgattgaaactggaacaatactacaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 37278 - DNA, 546 bp, Glycine max
  Peptide Sequence Number=SeqID_154056
atgtgtggaatatttgcgtatctgaattacaacctcaacagagagagacaatacatcttgcaggttctcttcaatggcttgaggagattggagtaccgcggatacgattccgcaggcatcgcaatcgacgattcctcttcttctcaattctctctttcgcctcctcctctggttttccgtcaggaaggaaacatcgaatcgctcgtcaaatccgtctatcaagaagtgggagaaactgaactgaacttgggggaatgcttcggcacgcacgcgggaatcgcgcacactcgctgggcgactcacggagagcctgcgccgcggaacagtcaccctcagagctctggtcatgggaacgagttcttggttgttcacaatggagtcatcactaattacgaggttttgaaggagacgctgcttagacatggcttcacctttgaatctgaaactgacaccgaggtcatccccaagcttgccaagtttgtccacgacaaggcgaatgaagcgtccgctgatgtgatcccagttgtggtcacgatgctgtcgtag

SEQ ID NO: 37279 - DNA, 1155 bp, Glycine max
  Peptide Sequence Number=SeqID_154057
atgggtgtgaataacattatggttttgggtgatgttagcttgaagtacatttccaattatcttgcaggaggtcaggttgttaccttcagtcaagttgttcttgaagttatgaggcatcttgaaggagcttatgcccttattttcaaaagtccacattatcctaatgaattgattgcctgcaagcgtggtagcccactgctgctaggtgttaaagaattggcagaaaataaagaacatggttcagcatttgaggataacaaattcctatcaaaagatggaaagcccagagaattgtttttgtccagtgatgccaatgctgtggttgagcatacaaagaaagtgctagttattgaggatggtgaagtagttcatctcaaggatggtggggtttctattttgaaatttgagaatgacatgggagaacatggtgcttctctttccagagctttctccgtgcgacgtgcattatctgttcttgagatggaggttgagcaaataaataaaggtaattatgagcattacatgcaaaaggaaattcatgagcagccagagtctctaacaaccacaatgagggggaggcttatacatcgaggatctaacaaatccaagtctgttctgctgggagggctgaaggatcacctcaaaacaattaggcgaagtagaaggatacttttcattggttgtggtacaagttataatgctgctttggcagctagacccatattggaagaactttcaggtgttcctgttactatggaaattgctagtgatctattggatcgagagggaccaatataccgggaggatactgccgtttttgttagtcaatctggtgaaactgcagacactttacttgcactgcaatatgctttagacaatggtgcattgtgtgttgggataacaaacactgttggtagtgcaatagcaaggaatacacattgtggtgttcatataaatgctggggctgagattggtgtggcaagtaccaaggcatacacaagtcaaatagtagtgatggtcatgttagctcttgcaataggaggcgatacaatttcaaatcaagccagaagagaagctatcatagatggtctttttgatctgccaagtgagtttctactggctgagaattttgtacattttgcagtggatggttaa

SEQ ID NO: 37280 - DNA, 357 bp, Glycine max
  Peptide Sequence Number=SeqID_154058
atgcgatctgagaagaaaccatggtcgccagtcctctgtgacgaactcatcgaggaaatcttgtctcgtattctcgtgaaacctttgatccaattcaagtgtgtgtgcaagggatggaactccttgatgtcagatccctatttcatcaaattgcaccttagcaaatatgctgcgaagtacgatttggaacaccttcaactgatgaaaaatgtctgcctcggatccatccctgaaatccacatggaatcgtgtgatcgaaataccagaaggataccgtgtttgtttctggaacaaggcgaaaagggtgatatccagagaatcgccaacgctgtctttttccccgggcattggtcgtag

SEQ ID NO: 37281 - DNA, 366 bp, Glycine max
  Peptide Sequence Number=SeqID_154059
atggtcaaggacctagtaagggaggatggaaattggaactacgagtttattcagcaactgttgcctcatggcatagttcttcgtattgtggatgtgttgccgccatatgaagatggagggatggataaaagaatgtggcctgggagtaagttaagggagtttactacttctaatgcttattacaagataaatttttttgctgatttacaagatgagggtatatggaaaaagatttggaggatcaaagcccttgataaagcaacggttataagacttggtcatcagaagatatttcagttacactggaataatggtcattctattgagaacaaatatagcggttgcaagctacaagccttaaaataa

SEQ ID NO: 37282 - DNA, 228 bp, Glycine max
  Peptide Sequence Number=SeqID_154060
atgtcaggacatcgtgtccgacatcgtggatcctgcagcttcacttctgcacttgacttttatcttgcattgtacagcaactccagtattctcgggcaggatcaactccagtattctcgggcaggatgtcaggacattgtatccgacatcgtggatcctgcaacttcaattcttcatttgacattttatcttgccttgtgcattgtgcagcccgatcttattccttga

SEQ ID NO: 37283 - DNA, 219 bp, Glycine max
  Peptide Sequence Number=SeqID_154061
atggtgaatcctccccaggccggaatttttattgagagtgaggacaacttggaaacaagtggtactaatgaagtgattgaacctgaaggaatccctttcaggtctacaccggcaggcccaagggttcaaaaagtccaatatcctagcctcaattctgctaggaggaaggatagtggaagtaagttagagaagagagaaattatgcagagagtctcttaa

SEQ ID NO: 37284 - DNA, 543 bp, Glycine max
  Peptide Sequence Number=SeqID_154062
atggactttatagagggtctactcctttcgaatggcaaacaagctatctttgtggtgctggatcgtttgagtaaagctgcacattttatacccttatcacatccatatactaccagcacaatagctcaagcttttatggatcatggtgtgcaattgcaactatctagtgcctatcaccctcagacggatggacaaactgaggtagtcaataggtttttagaaacctatttgaggtgtatgtttgttgattctcctcaacaatggtctaagtggttacctttggcagaatggtggtacaataccactttccactcagctattcagactacaccgtatgaggtagtatatggtcagccccctcctattcatctacactatttgcctggtgaatcaaaggcctataggcaagtgtccattgctccaagagctaatgagaagctagcacctaaatactttgggccatatcccgtgattagtagaattggagaggttgcctatgaattgaagctgcctgatcatgcaaaaattcacaatgtctttcat

SEQ ID NO: 37285 - DNA, 318 bp, Glycine max
  Peptide Sequence Number=SeqID_154063
atgttagctatcatcaccaagtaccaagaggaactaagtctagccacggcccacgagcatagagtggcggacgagtatgcccaagtgtacgcggaaaaggaggctagaggaagggtgatcgactcgttacatcaagaggcaacaatgtggatggaccgatttgctcttactttgaacggaagtcaagaacttccccgatttctagccaaggccaaagcagtggcgaacacctactctgtccccgaggagatccacgaacttctcagctattgtcagcatatgatagacttaatggcccatatgattagaaaccgctag

SEQ ID NO: 37286 - DNA, 735 bp, Glycine max
  Peptide Sequence Number=SeqID_154064
catgatatgcaaagtagcattctgctggctttgacgggatcattcatgatcatgaaaggaagttttatcgattgcttcaacggtagttgttgtgatacagatatcttgcatgctgaaatccttgctcgtcatgggattcacatttgtaattggagtaatatcaccgtcgtggaatgcttttcgatattatttaatccctctgtctatctccctcacacacattttctttgtatctctttctcttctgagaatatcatctgcgcgccacgccttctagctccgaagcaacagtgtcgtccaagtatttgcataggggagatcggcaaccaagttgacaccgcacatggccatgactcacacatgtgccgcctgagcatgcttaaacacaacttcactctagacgaaactgaactggagttgcacaaggctagaccacgtggtcagatcagagaaggggctgatgagagagaaaatggtgttgctgcggaaaatgatagtcagtcaccggtagcggcgagtttcccttgtgtcccttctgacttcaatttctccttctctttgttgcttgcatttgatgaaggctttattgttaatgggcttgtctgggtgttgtgtgggcctggttacagagggggcgatgggggattaagagccattctaaccgatcaaaataagttggttgtagcagtttgtggagtgactgctctggcagcagggaggggtctacactgcaag

SEQ ID NO: 37287 - DNA, 828 bp, Glycine max
  Peptide Sequence Number=SeqID_154065
atggcatcctcgttggcaccagctaccaaagccgccactaatttgcgcctcacacactctctccgcttctctcctaaacccaacaacctacgctttgccaccaagcctggtaatacgctgttatgcacgagggttaaggcccaattaaatgaggttgcccttgatagttcctccaatgctacttctcctcctatgaaagccaaatcaaaggaggaaccacccgcaaagcctttagcagaaccatcttcttcagtgttggcaactcaagaatcggtctctcagtttattactcaagttgcaagtcttgtcaagcttgttgattcaagagacattgtggagttgaagctgaagcagcatgacgttgaagtaacaatcaggaaaaaggaggctatgcctcagccaccacctgctcctcaaccttctgtggtgtattcaccccctccaccagcgttgccaccaccacctgtaccagcatctactccagcacctactctagctcgtgcaacccctacaccaacttcagcccctgctgtgaagtcagctaaatcatcacttccgcctcttaaaagccccatggcagggacattctaccgaagtcctgcacctggtgaaccttcctttgtgaaggttggagacaaagtaaagaaggggcaagttgtatgcatcattgaggcaatgaaattgatgaatgaaattgaagggattctacatgttatacctttatgtgggcacttatttgatgcatctactgcctcttttcatttctgtttgcattatcaaaatgttgaattttgtgatctagagtctagaacttgtaccacagaatga

SEQ ID NO: 37288 - DNA, 375 bp, Glycine max
  Peptide Sequence Number=SeqID_154066
atgggtcaagtggcacaactattggactccattttgcagctcagttggcaagttgttagaacgtatataggggagcaagtaaggaaagttatggaggatttgataactgcagcatttgctcactgggatgcttgctatctgggagagacaacaatgttttataatgagtctaaaatgatcagagacaagaattggaatcaccgcccaattatccaagccagcaagaacagatcagaagccactaaagcaaaaacaccaggaattccgttgttggagtggccacaagcagaagtacttccaccttcagcaattgggaagatagtgacaccatggcatccaatgaaaaaggaaaaatccatatctgtcctattgtga

SEQ ID NO: 37289 - DNA, 1302 bp, Glycine max
  Peptide Sequence Number=SeqID_154067
atggatgcgatacggaagcagctcgatgtgttgatgggagcgaaccgtaacggcgacgtccgtgaagtcaatcgcaagtactacgatcgcgacgtctgtcgcctctacctcgtcggtctctgccctcacgaactcttccagttaacgaaaatggatatgggcccctgccctaaggtccactccttgcagctccggaaagagtatccttctagatctctagggttaggatatgaggaggcgaaagcaaaggggaccgataattatgacagggagttggaggatgttatagacaagcttattggtgagtgtgacaggaaaatagggagggctctaaagcggctcgaggatgacgatgcgaaagctgcgattgcgatttcggtctctgaagttactcaaacagatgaggtgcttgagttgtcgaagcaaatcaaagagaaattgaaagaagctgatcaatatgatcttgaaggcaagtcagatctcaagattcgagctttagaggttgtagaggaacttagaactaagagagcggacaagcagtctatgcttcttttagatgccttcaacaaagatagggcatctttgcccacacctctgccaaatccaccacctttggcacctcttcctgtagttgctcctgatgctcgaacacaagagatgataaatgaaaagctgaagaaggctgaggatcttggtgagcaaggaatggttgatgaggctcaaaaagcactggaagaggctgaagcacttaagaagcttcctgccaggcaagagccagtgttggattcttcaaagtatacggcggcagatgtccggattactgatcagaagctacgtgtgtgcgacatttgtggagcatttttgagtgtttatgacagtgatcgccgtttagctgatcattttggaggcaaactacatttagggtatatgcagattcgcgagaagttagctgaacttcaaaggaaggatcttagaccatgttttctggctcaggaagaaagaaacaagagccgaaagactgatcggcttgatgacaggagatcaaaagaacggagtagggatcgagacagggagtcgagtagggaccatgaacgtggtgatagtcgtgaacgagggcgagaccatgatcgtaggagcagagatcgtgataggcattatgatagagatcgtggatatgatcgcgaccgtgacagagactcagaccgcacccgctcctatgactcaagaagccgtcggaggtcacgctctagatcccaagagcgatctagagattatgatcgacataggtacagacttccttga

SEQ ID NO: 37290 - DNA, 252 bp, Glycine max
  Peptide Sequence Number=SeqID_154068
atgactaatgttggttggggttgcatggaggttgtgacggttacaaagggggcgatggtgtgcttgaagtggagattcgctgaggcagaaaatgaataccatcgagccaggaaccaagaactagtgaatctgcaagaggaatcatcaatcagacaggagcaaactcgacgtgcaacagaagaaaaaattcaagctcaaagaaggaaaactgaaagagagaaggctgagattgaacatgaaacaatcagatag

SEQ ID NO: 37291 - DNA, 969 bp, Glycine max
  Peptide Sequence Number=SeqID_154069
atggccattgctatgaaggccacgcctatcacggcttcgggcttcgtttcaacaagaaattccacacttccaccctttaaatcatcatttctcagataccgctcaggagcattggaagttcctggcatgcgggtaacctactcagatagattgaaatgtaattgtcatggtggcggtgcccttggcactcaaatgaatctttttagcagatttgctagagttatcaagtcatatgctaatgccattataagctcctttgaagaccctgagaagatattagaacaagctgtgctggatatgaacaatgatttgatcaaggttcgccaagctacagcacaggttctagcatctcaaaagcagttagaaagcaagtacaaatccatagaaaaagcttctgatgattggtatcgaagggcgcaacttgctcttcagaagggagacgaggaacttgcccgtgaggcacttaagagaagaaagtcttatgcggataatgcaactgctttgaagatgcagcttgatcagcaaaagaatgttgctgatgatcttgtgtccaaaacacagcttttggagagcaagatacaggaggcaaagtcaaagaaagataccctcaaagcaagagctcagtctgcaaagacttcaaccatagttagtgagatggtgggcaatatcaacacaagcagtgcccttgcagcttttgataagatggaggaaaaggtattaaccatggaggctcaggcagatgctttgaatcagttgagtactgacaatcttgagggaaagtttgcactactggagaactcttctgtcgatgatgatcttgcagagttaaagaaagaattatctggaagctctaagcggggagaacttccacctggaagaagtgttccaaccagtaaagaaattcccttccttgacttggagcttgagaaggagcttaatgagctcagaagaagagcaaaggggtactag

SEQ ID NO: 37292 - DNA, 348 bp, Glycine max
  Peptide Sequence Number=SeqID_154070
atgatctgtttcttctctctctctctctctctttctccctcatttgctgaactaacaattctgcctttccgaatccagcgatgtcttccaggggatggattggaggagcattttgtaatacaaatggaaggtgttaacatcttggctgtcagttatggtgccccaggggcttgcccttatccccgacaactgaagcttcctggaaagtggtctttcaagtcacacacagttctaaaaagcagtgaacaggcaccaagagctccaatatttactgaagaggcacttggcgggctggagggagacggtgaggctgtacagccaatagaaaggtccttttgggctaaatac

SEQ ID NO: 37293 - DNA, 144 bp, Glycine max
  Peptide Sequence Number=SeqID_154071
atgaatgctgttactcaagctatgaatatgcccgaggaacaagctggcggacaacctggtgctccggcacagcagcaaccaggatctgcagtacagcgtggaccaagttctggtgctctgtgcccaaatgaaaagaaattttaa

SEQ ID NO: 37294 - DNA, 940 bp, Glycine max
  Peptide Sequence Number=SeqID_154072
atggatggcgaagtaggtgggtgaaatcagactggaaaagcagtgagggcaaagcaggttcattcaagcacacagctggaaaatgggctggtgatccagatgacaaaggtattcaaacatccagtgatgccaaacactttgccatctctgcaaaaataccagaattcacaaacaagaacagaacattggtccttcagtattctgtaaaatttgagcaagagattgaatgtggtggagggccagatgccacatacagtgtcctggttgataatagagagagagattctggaagcatgtatacagattgggatattcttcctccacgaaaaatcaaagatgtcaaggccaaaaagcctgcagactgggaggaaagagaatacattgaagaccctgatgatgtcaaacctgagggatatgattcaatcccaagagaaattcctgacccaaatgctaaagagcctgaaaactgggatgaagaggaagatgggaaatggaaaccaccaaagataccaaatccagcatacaaaggaccatggaaaagaaagaaaatcaagaaccctaactacaaagggaaatggaaaactccatggatagataatccagagtttgaagacgaccctgatctttatgtgcttaagcctatcaagtatgtaggcattgaagtttggcaggttaaaggcggttcagtttttgacaacgttttgatttgtgacgaccctgattatgcaaaacaagttgttgaggaggtgtttgccaacagggagattgaaaaggaaggttttgaggaagcagagaaagtgagaaaagccaaagaggaggaggatcctaactcttatttttgcaggaggctcaaagagcaagagaagaaggtgaaaggcgtagacgagagagaggtcatgatcgacgatatcgggacagatatagagacaaatatagaagg

SEQ ID NO: 37295 - DNA, 873 bp, Glycine max
  Peptide Sequence Number=SeqID_154073
atggatcatatcgtggctgcaaggtctgatcatgaagctgtgactgaatgggagaagctaaagatattgggagagggttcttatggaaccgtctccctagctgtgcttactgccccggaagaagcaaaaggagagctaatagctgtcaagacttcaaagcctcacggtttagattcattgcagaaagaagaaaccatattagattcattctttggctgcaaagaaattctccgatgcatttggagcctattcaccatggagaatggtcgttttgtctacaatctcctcatggagtttgccccttgcggttctctgggagacttgatcagaaagaaaccactctcggagagccaagtgagagtatactcacgcatgcttctcaaagggctttctctcgttcatcgattcggggtcgttcattgcgatttgaaaccagacaacattcttctctttccttcgggcgaggagaatgatgtggattatcaactcaagatcgcggatttcggactttcaaggaccaaagacgaggtgtttgatgcagacttttggaagatcaagttcagaggctccccattttacatgtcaccggaatccgtcatgggccgaatcgaaacaccattggatatatggtctcttgggtgcatggtaatcgagatgatgaccgggtttccagcatggaaccacattcctaccacaagggacttgatgttcaaacttgcattcctcaaagaagcaccaccgttgccttctgggctgagttctctttgccaagatttcttgaacaagtgtttcgtcaaggattctgctcagagatggacggccaacatgcttctcgaccatccttttatttctgctgcaaaatcatacatgtga

SEQ ID NO: 37296 - DNA, 186 bp, Glycine max
  Peptide Sequence Number=SeqID_154074
atgtattactcaactaagagacaacaatttttaattgatcaaggttacaactttaaggtaattactagcttgcctcctcctgatgaagggcctaatttgagctatcatcgtcttcaggatcaattggcacttcttggaaaggttaaatatgtttttacatcagtgcttccgttaaaaacgatgtag

SEQ ID NO: 37297 - DNA, 294 bp, Glycine max
  Peptide Sequence Number=SeqID_154075
atgaaccccaccaaaaatgttcatgatgagaaggcatcccaaattgcaatgttagtgaggagggatggcaatagagttcctaaacgtgtaagtgagtgggtggctacaattggaacctgggatgaatggcagcggaatggagaaagggagagagagaggagacgccacttcaaggggaagatgagtctagaagaagctcaccaccataggaggccatggataagagcttggaggaagaatgagatgaatgaagggagagggagagaagagcacgaaattttgtgctctaaatga

SEQ ID NO: 37298 - DNA, 573 bp, Glycine max
  Peptide Sequence Number=SeqID_154076
atgtttggacgcttccaaaccattctgaatgagcttcactctctaggtagacattatgataattatgatcacattgataaaatattacaaggtatatctagaaaatggagaccacaggttacaacattaagagccatcaataatctttattcaatgactcttgaagaacttgttagaattcttaaagtccatgagcaagatcttgctaatgattcaagatcaaagaaagggaaatttctagcccttacggttcaaagaccaaaatgtaactttgtgtccaaagagtcattgtccaaagcccttgctactaatgatgtgttagaagaagaatctaatgataatgactctgatgaagaagatgatgagctaaatctgatcacaagaaagataaaaaaatatgtggaaaaacaagaactcctccaggaagaccacatgagcacttgggaggacctagaaaattcatcgtctgacgaggacaccgaggaagaagccaacttgtgtctgatggctgatgcgtccaccggtaaagtagaactagcactggacacaagttcagatgatgaggactcttag

SEQ ID NO: 37299 - DNA, 273 bp, Glycine max
  Peptide Sequence Number=SeqID_154077
atgactgtggaagaggccattcacgtaagacttaatgacaataagcctaacactacaatgttggagctagatgagtcttctactgagatgaaagtagaaaatatcgtgaaatatgttgctaggtccaatcatctagagtcccagatcattggtgatcctaaggacaaagtcctgacaaggaactctttcaagcatagaactttgcttttcgagatcaagccaaagtacatagatgacgctatgtctaatgaatactgggttaaagcaatgtag

SEQ ID NO: 37300 - DNA, 147 bp, Glycine max
  Peptide Sequence Number=SeqID_154078
atgcttgagcttggagatgctggacatgatgtcgaaggttttgtaaccatcgtcgtggtcatcaaagaaagtggcggagaggtcaaggatggtggtaaaaatgacatggacactcacataaatgagtatttattgattaagaactaa

SEQ ID NO: 37301 - DNA, 1269 bp, Glycine max
  Peptide Sequence Number=SeqID_154079
atgcgtttttgcccgtgttttggatccgaggaggccaagggggtggcggatcgcgacccggtcctgctggtttcgggcatgggcggctccattgtcaattccaagcccaagaaattcgggttcaccactcgggtttgggtcagactcctcctcgctgacgtcgagttccgaaacaagatttggtccctttacaatccccaaacaggttacactgaaacgttggacaagaagtctgaaattgtggtccctgacgatgatcacggcctctatgcgatcgatattttggatccgtcatggtttaccaagtgtatacatttgacggaggtgtatcattttcatgacatgattgacatgcttgttggatgtggttacaacaagggaaccacactctttggatacggatatgatttcaggcaaagcaataggggattcaatcccgcgacctctccccctttccttctcccttcaccactagatcagccttatatctccactaagtttgtcatgattggcaaggtaatggaaggtcttaaaagcaagttggaaactgctcacaaagcttctgggggaagaaaagtcaatttgatttcccattccatgggaggaatcatgatatcgtgtttcatgtcgctttatagagatgtgtttacgaaatatgtgaataagtggatttgcttggcttgccctttccaagttgtcgatgtagaagaggaggctgagagaagtgacagacaaatgaagagtaggattggatgggaggttacagagttgaaacacatgctgcacaagatattgaatgaggaggatgatccccattcaactgagctggacaagaacaacatggagagtgggtcagaatgtggcgaagcaaaggctagttcttcgacaagaaaggtggaattacctacctttgatgggaacacagaaaggttaactaactcaaagagtagcattttgagtgatggtgatccattgcaattcttgaagtcaggaaatagaagtaaagaaggatcagtgatcaagaatcacacctcttctcttgtgccactatattcttacgtcgatggagatggaacggttccttctgaatctgccaagggtgatggacttgaagccactgaaagggtgggagttgctgcttctcaccgtggaatattacgagatgaaacagtgtttcaacatattcaaaaatggttgggtgttgagccaatggttggcaagcattctaaaacatcaaaagtggcagatgctcagcctatggttctatga

SEQ ID NO: 37302 - DNA, 315 bp, Glycine max
  Peptide Sequence Number=SeqID_154080
atgagaatttcgtgtgctgtcatcgagtgctgtctcaaggatgggctgataataccagagagagtgaaacaaagaaatggttggaaaccaatatcttaccttgttcaggttggggaatctgtctgcagttctgaaagaggatacgctgaagttggatggttattcatcggaaaagaagaggaaaaaggaggaaagaagaagaaacccaaccagacgcgcttgaatgagaatgaaggagaccaccatgatgaggaagaagcacgacacaaaggaagaagaagcattgcaccggaatcgtatggacgcgcactgtag

SEQ ID NO: 37303 - DNA, 186 bp, Glycine max
  Peptide Sequence Number=SeqID_154081
atggaggagatacatggagaagacgatgaaatagaagcagctaaagaacatcacctagatgaagatgctttgataccacctaatttggctccgtgtagagcatgtaggccttggatcttcgtcctcaatggagtcctttgcttcttgaagatcaatgacagtagaatggagaaggaggaaaggtga

SEQ ID NO: 37304 - DNA, 162 bp, Glycine max
  Peptide Sequence Number=SeqID_154082
atggatttccgtagttttaagcaggctgtggcaaatttcatgtcagaagtgagaggtgggagagtgagatttgatcctgaccgtatattgatgagtggaggggccacaggagcaaacgagctaataatgttctgtttggctgatgctggagatgcttttctg

SEQ ID NO: 37305 - DNA, 276 bp, Glycine max
  Peptide Sequence Number=SeqID_154083
atggatttccgtagttttaagcaggctgtggcaaatttcatgtcagaagtgagaggtgggagagtgagatttgatcctgaccgtatattgatgagtggaggggccacaggagcaaacgagctaataatgttctgtttggctgatgctggagatgcttttctggttcctagcctttattatccagcatatgtgccctctctttcatcacgcctgttttcattcaatgaatcacactatttcacacccatcaaaacgttaaaagtggacacaaattaa

SEQ ID NO: 37306 - DNA, 283 bp, Glycine max
  Peptide Sequence Number=SeqID_154084
accggcgattttgtacggaacagaatgttgggcggtcaagagccaacatgagaataaagtaggtgtagcggagatgaggatgttgcggtggatgtgtgagaagaccggtagactctgtagtgaggagagtagaccagatgaagagaaggcaaacaattcgaggcagaggaagacccaaaaagactataagagagaaatcggatatttctacatcattgctaaggcgagaaacgacgttgaaagcccaggttactacatcggtgctggcgagaaacgatattga

SEQ ID NO: 37307 - DNA, 2640 bp, Glycine max
  Peptide Sequence Number=SeqID_154085
atggcatcgccgaccgaggttatcgacgtcgacgccgaaaacgctcctactcctactccacctcctcctcttccaccgcaagatccgaaatcgaatcgcgccaagaccatcatgcggaagcggaagaaggttccctcgttgctgcaaaacctaaagagctacgaggagaagcaagcgcacatcgaaaccctcgagaaggagctcgacgcgctgttccgctactaccaagaagccatggctcagaaagtgcgtgtcgagctgagccagtgcggtggttcgcgaaatgttgtcgtcgcggcgctgatggaggagagcgaccttccactgtcgaagctcgtggacgagattcacgacaagttgaacgaagaagtaagtaacggcgcaatcgtgctggcggagcctgtgacctacgcgacggtgaagagtagcgcgttgtttgtgggacagagagtgtcgtacggcgtgccaaacgctgatgctgatgtattggaggaccatgccgagtcgtgtctctggtgttgggagactagggatttgaaattgatgccaaaatccgttcgaggagagctcagtgttcgacgcacttgccggagaaggatccatgagaggattatggctatctctgaaatgatagcagctctgaaaaagctagagagtgaacctgattacaatcaaggcttaattaaggcatcggcaaagctcaataaagcttttcccgaagcagatatccgcttgttagtggatggcttgttgcagaagaacagtgaagacatggacaagaaaagaacaagccaagaaaataaattgctaattaagcagttggagagaaatagaaaagaagctgaaaaagagaaagagaaagaaagcatgcacaatgaactgcaaagagaaacactgctcaatgaatcagatttaaaattgtcacaagatgaggcaagaaatggtgagaaatcttctgaaaagaaaaaacagataaagaaacaggtagatgaggcagaaaaggatcaacggcgtagagagaaagcagaagctgaattaaaaaagaagcggagtttacaaaagcaagcctcaattatggagcgttttctgaaaagaagtaaaattattccctcatctccatcatctgagaaggacatagtttcaactaaatcaactgcatctgatttgccaagcagcaagagtgaaagtttgtttgagtcagctacactttcaatggattgtactcttgcatcaagcagggatgttatgcttgaagatattcgcaagcaagtatctttttactgtgttttaccattcttttttatactagtagttttgttttcagatcttactaaaaatgtctcacttttcaggacacaattttcttcatggcgctctttaggacaatcattgcgctcaaacagaaaacagagatggggcttacgccagaaacctcggactgaagtttttaaggaacttaagctgagtgccattaaaactgctgttcaagatgttgagttggacacggagaaacatgttgacagattgggagaatgcagttctgatatcagttcatgcccaatgaatgcagatagttctcctgatgccaagtacagtcggggtagacaattattgcagtttgataaatctcatagacctgccttttatggtgtttggcctgcaaaaagtcatgttgttggaccacgccatcctttaaggaaggatccaagcctggattatgatgtcagcagcgatgaggaatgggaagaggaggaacctggtgaaagtctttctgattgtgataaagatgaagaggaatgtcaagaggaatgtacaaagtctgatgaagaaagtgaagatgggttctttgtaccagatggatatctttctgaggatgaggtagagggtgcacaagtggacagaatggaaatagatgatgacattgacggggctgatagctcccctagctgtaagaatgacatagagagcgaggaattttgtgctttacttcggcagcagaaatatctaaataatttgacagagcatgctctccggaaaaatcaacccttgattatatcaaatttgattaatgacaaggacctttcatctgatcacaatattagtggtactcctaagctggagcagatgtgcttgcaagccttgagtatgtatgtaattcctggcatctcatgtatagaaatatatgtggataaaatgcaagacgaggaccaagaagtctgcctctctactggtaaaagtggtgctagtccaatatctggtgtagctgtcatacctgactcagacctacccataattgtgactactattcaaagttgttctcaaggtatgaataaagtgttagtgtctttgcaacagaagttcccttctgtatctaagtccttattgaagaataaagtgcgtgaagtatctgactatgttgataaccgcttgcaggtgaagaaagaagttctggataagcttggctcggcagttaaacctgaaaaaagcagtgggggaccaaggagcattgctgcatttttttcaaaaaggtgcttgcccccgactggggaaggttcgaaacctggtgaaacttcaccactgccacccctgaaatcatcttctgccattgatgaacgacctcaaagttcatataacatataa

SEQ ID NO: 37308 - DNA, 372 bp, Glycine max
  Peptide Sequence Number=SeqID_154086
atgttgcaaaaccctcctcctccttcatctccaaatttgtctaagcctcctccgagtcgaagaaggaagcgcaactccaatccatccacgacaggctcaaggaaaagccttctttcgagtctagggtttcgagcagggatagggacagcaatagaagtagaagatgaagcaggagcagagaaaaatgtaggaaaagaagcaaaagcggtgatagatacagggaaacatgaagacgaaataggagtagagagagacataaggatagtcaaagagggagacggaaattgggttattttccttaattgttattctccttcactgtgctctttgttttcccgtaggagcttctttcatttggtgccgcaaatctag

SEQ ID NO: 37309 - DNA, 1170 bp, Glycine max
  Peptide Sequence Number=SeqID_154087
atgctcaggagcagcacgctaacacagagtgttacagtcacctgtgttcatcacagtcacagacaatggttccaatcaattcccgtaaattatagattctgtgacgctgctcggaactctctatcatccaactccgccatcttcaagtggaaaagaacggctaattataatcgtaaccgttctggaatgggaaccttcaccacgcgcgcgttggcgcagccgctccagaacgccgacgaactcatcgattccgtcgagacatttattttcgattgtgacggagttatatggaaaggtgacaaattaatagaaggggtgcctgaaacgcttgacatgcttcggtcaaagggcaaaagattagtttttgtcaccaataactcaacaaagtctaggaagcaatatggaaagaagtttgaaacacttggcctgaatgtcagcgaggaggagatttttgcatcatcctttgcagctgctgcatatctgaagtccattgatttcccaaaagataaaaagaggaggggatatgtgcgattcatgtacagagaagggtatctgggtgtaagggcaatccataaagtttatgtcattggagaagatggtatcttgaaggagcttgagcttgctggatatcagtaccttggtgggccggaagatggtgggaaaaagatagaactgaagccaggatttttgatggagcatgatgaagatgttggagcagttgttgttggatttgatcgccacttcaactactataaaatccagtatgggacactctgtatacgtgaaaaccctggatgtcttttcattgctacaaaccgagatgctgttactcatctcacagatgctcaagaatgggcaggtgggggctcaatggttggcgctatcagtggatctactcaacgtgaaccattagttgttggaaaaccctcaacgtttatgatggattacttggcaaacaaatttggcatttcgaagtcacagatatgtatggttggggacagattagacactgatatcttgtttggacaaaatggtggttgcaaaactcttcttgtgctctcaggcgtcaccacactggccatgcttcagagccctaacaactccatacagccggacttctataccaacaaaatttcagattttctttccctgaaagctgcagctgtatga

SEQ ID NO: 37310 - DNA, 2256 bp, Glycine max
  Peptide Sequence Number=SeqID_154088
atgaaactgcgaacccaaacgcaaaaaagcaacgcgatttcaccccaccgtgaaaggagcacgtggcttcttcatgtcgttgttgctactgttgcgattctgtgtggcatctgcgcagctgaaagcaatgaaggagttacgcacgtcagaggaggccccgattctgtggtttgggtggttcagctttccgatcttcatttcagcgttcaccatccaaacagagccctcgatttcgccaatcttgtgggccccgctctttccgttatcaacccttccctcgtcctcatcaccggcgacctcacagatggtaaaagcaaggatttgctgacaatgaagcagaatgaggatgaatgggtggaataccggactgtactggacactgttattaagagaagtagactccagaagagcttgttttttgacctcagaggcaaccatgacagttttggtgttccggttgtcggtgcttcctttgatttcttttctaaatacagcatcaatgggcagttaggaagaaatgggagcgtcaatagtgtaacccttgagactcgagactggaaacatctctttgttgggtttgatagcacaatgttaactggcttacgaggtccaacgaatctttttgggcatcccactgatcaattactaaaggacctagacttggaactctcacagtgggattcacagtcagaaaaactagttaccaaaatttcctttgggcattttccactctcattttctgcaccctctagttctggaaggacattggaagatgttttcctaaagcattccatatcagcttacctgtgtgggcatctccatactaaatttggtatgaacttaaagcggcaccatcaactggatgatcattcatcatccttgcagaaactttttcagtttaatatacaccagagttcttttgaaagtactgcaaactgttcaatgggagccccaccaattcaagagttttgggagtgggagatgggggattggagaaagagtagagcttttcgaattctagccattgatagaggccatgtttcatatgttgatactgatttcaaatctgggaccaaacgtgcaattatattgcccacttttccattagactctcgcttcatgttaacatcttcatgccgtcacaactatgaatgtcaatctgtggccccttcatcttatgagacaatccgagctctggtattttctctttctccaattgtatcagttgtagctagagtctatgattcacgatctggaaaccttgatttagttctagaaactcagatgatcaagcattctggtgataactccagggggaacctctatgttgctccatggaattacagagcatttgaggatgcttctcctgataggttttggcttcaaatcgaagcaaatgacatcgcaggcagatcaactttgactgaattgaggccgttttctatcaatggtcatagcctcaaactttcatggggctggaaggagtttttggtcatgggatgtcaatgggcttccctttattacccattattttggtctgctctttactttttgttcatcttccttcttcttccaaaagctcttcttgtttttccaaagaagatatacacttacaagaacttcatcgccaataaaggcatagtaaatggtgtattatggtttctccaggagctctgcaggatccccacattatggtttggttggataggatacctattttatcttatgttgtgcccctggtttatggggcaagtttttactgaagggaaaaatatggtatacatgacctatatgggttgggccatagagacttctaatggaaaggggaaggttgagtatgttgggtctccagatattatggtggtggttcttccccatctattatttgtggttttgcctgcaattttggtcactggtgctctgacggctgaaagagcaatttaccgggaacacatgttagcatttttggtaaagaaaaaagatgatatttgtatggactctagaaaatctgtattgaatggcagcatgtgcggtcattgcaagcaacactgtagacaaatagtatgcatcaattatagtagaggagcccaaaggatagttaataaaggatgtagtgcgttaaccaaatcaaaacagaattgcagaactcttctaaaagcttatgagatgaacccagtactccatttcttaggctatggtatatcaatccccttgttgttggcacatgctatcagcaaaaccagaagtgctgaatga

SEQ ID NO: 37311 - DNA, 186 bp, Glycine max
  Peptide Sequence Number=SeqID_154089
atgagaaaaagaaagaagatgagaatattactcaagtggattttattgattatcgaagtaattttgaaagaagtgaaaattaaaattaagggtttcctttctctcgatctcgttacaggcgatccacctcaagaggagagaagtctaagaattgagatagaggaagcactcaagaatattacataa

SEQ ID NO: 37312 - DNA, 1467 bp, Glycine max
  Peptide Sequence Number=SeqID_154090
atggagccttctgtatctaaagaaacacctaattcagggaaaactgatatgcaacttgagagtcagatatttagtaataaagtagaaagtattaacagatctgctgctactgacatgccagagcctgaaaagttgctctcagcttaccaacatgatggtgaagcaaatgatttgctgatggcatctactcctgacaatcagggtgcaactgaaggccatacaggtgctgcaggagaaaaatacatctccggtaaaaaacgtagctacacagaaagtactcttacagtgcagagtatggatttgattgaatcttacacgggagctcaatccaagagaactgctgagtctgttcccgatgatgatgatctactgtcatctatattagttggtagaaagtcttcagtcttgaaaatgaagcccagtcctgcagcccctgaaatagcatcaatgaagcgtgttcgttctgcttctgcaccacgtactagtgccttaaagaggaagacatttgatctgactggaatcaaggttattgagtatggtttagatagttcttctgtagaaaaaacaaatgatcaagagtcctattctagaacacatactgaaattcatggagtggagggtaataatgaacctatggcagtccaactccaagaagatgcagaagtgcaacctactgaggtacctgttttgtctgagagtcatcagtctaaggttaacttgggatctcatgatattgatgctcatgggcacacgagtattatttctcatgtggaggagcttgacagttctcaaaatgttgaattgaacaatctcagagcaaatattgcagtttctgaagctgagaattgctctgttggccctgggcatgaatcttcatccttaactgaagtcttcgaaaatgattttgctgcatcactggctctcatggataaaaccaatgatctcgttgattctatccattcaaatatattgagcattccaaatgctgagaatttgaatacaatccctattctagaggatgactttgtggaggatcaaagtgatagaaatggagtaggtgctattaagtgtagcatggaaactggaacacaagttcaaacagatggtgtggatgccaatgatttatatacatccttggccactggttctacagaaactgatgaatttactaatattcaggcttcctttaatggtgacctaccattggaggaaaatggaaacagcttgctagggcagttaaatgaggatcaaattgttgcttctggcatggattgtgatgacaaggatgcaaggcctgactgcatatttattgaaaatgctaaagtagattgcttacaatctgaagcacttggattagatgaaaaagagagtttgttgaaagatgaagaaatccctgtctgtcaggaagctgaactacaaagtacaatgtgccctgaaattaggagtcctttagtagatcagaatgat

SEQ ID NO: 37313 - DNA, 378 bp, Glycine max
  Peptide Sequence Number=SeqID_154091
atgcagattgctcactgccatagtttcttcccctcggtccaaatgaaattcctgaagttgattgttgtacgtgaacgtgctgcatttgattccattcttttccctgaagtaccaattgcactccgtttgtccagccatcttctacttggtgtggtgaggatatattctagaaaggtgaattacctttttgatgactgcagtgaagccttgcttaagattaagcaagcttttcgttccacagcagttgatttgccacctgaagagtccactgcaccttaccattccatcaccttacctgagacttttgatcttgatgattttgaactaccagataatgacattcttcaagggttagttcctaaatacttgattatatga

SEQ ID NO: 37314 - DNA, 208 bp, Glycine max
  Peptide Sequence Number=SeqID_154092
atgctcaatttcaattcttctctcgctccgcgtttcggcgaacgaatgacgccgttctgtggggaatttgtgaagctaagagggatgttttactcacagtttattttggccaagaaagggccacttgggactatatggatagctgcgcatttggagaggaagctccggaagaaccaggtggcagataccgacattggcgtctccgtag

SEQ ID NO: 37315 - DNA, 614 bp, Glycine max
  Peptide Sequence Number=SeqID_154093
gcataggaaaaggtgctactcgatctactcgatcccctataagtgtgttacaagacattgaaaaagttgataaggccattgatgggcgtaacgtgtacaacatactagagccatgctaccatttccccgatgctgccacagccaaagaaaatggaaccttaccaaagagtttcaagcaattaggggttattgagaggcatctcctagtgagaaagagaatgtttggtagagcttggccttttagagcaccagtcaaacctgagcagagtgatgaagtagcaagttcatggctaaacaacgttgcagtcaggaaagccatccatgctgaatcggaaaaagtggcgggtccgtgggaattatgttcgagtaggatagagtaccatcacaatgctggaagcatgattccttaccacaagaacctaaccaggcttggctatagggcacttattttcagtggcgaccatgatatgtgtgtaccgtttactggaagtgaggcttggacacgatctttgggttacaagattgtggatgaatggaggccatggaactcaaataaccaagttgctgggtacttgcaagcgtacgagaacaacctcaccttcctcacaatcaag

SEQ ID NO: 37316 - DNA, 207 bp, Glycine max
  Peptide Sequence Number=SeqID_154094
ggtattatcatcaaatctttaagccagaggtagttaaatacatcaagcacaccataggagtatggcacaatgatattgtcaagatcgcatcagatctaataggcaataacgaattcttcatgcagcccgacgtgggaacgctcgaaagcagtggggcctctgggacagggactagacctgagtcgctaacatttgggaataagagaa

SEQ ID NO: 37317 - DNA, 252 bp, Glycine max
  Peptide Sequence Number=SeqID_154095
atgcctaaatcatctcccaacatgcatgtgaagcaagaagtatcaacaagagtcaagccaaggctattgtgcaagcaatcaatgaggcaaaatacaccaaataaaatagatgatgatggctcaaattctcaccaaggagaaaaacaaggatttcaattcacaaaatgccaagaaactcctatttcaaaaacaattacccattacctgtacataacctataattcaaagagaaacaagcaatgttgtacataa

SEQ ID NO: 37318 - DNA, 636 bp, Glycine max
  Peptide Sequence Number=SeqID_154096
atggatccaaccatcgatttagatgaagttttagatcaaatgatagataaggaattggaagataacagcgatgaagaaatcattaggttgatacttgagagccaacaacaactacatggcaacaccactagccgtagccaaagaaggagagtggtacatcataatcatgaagaagaaaatcctgtgtacacagagattcaattccgaagaaggtttcgtatgcaaaggcatgtgtttctccgaattgtaaatgcacgcagcaaccatgacgaatactttcaaatgagggtcgatgcactacgtcgaaaaggcttatctccattgcagaagtgcacaactgctattcgtatattggcttatggatcacctgctaacagtgtcgatgaatatgttcgaattggcatctgcaccatatttgggaatgaatacttgaggagaccaaataatgaagacatcgaacgcctactacaaatgggagcggaacgtggatttccaggtatgttaggttccattgattgtatgcactgggaatggaaaaattgtccagttgcttggaaaggtcaattttgtcgaggtgatcatcgcaacccaacaatcattcttgaagccatggcatcacaagatttatggatttga

SEQ ID NO: 37319 - DNA, 350 bp, Glycine max
  Peptide Sequence Number=SeqID_154097
ataaacctaggagaagtggaagttcagagaaggatgttttggctgatgctcatatgatttactcacaagatacagagacacccattgaagtcgaagaatatgataggccatcaccaatgtctcgcccaattggacaaaaagcagcaaaaaggaaaagcaaaggaaaagaatgtcataacactctcaatttatctagcatagaaagtgaggcacaggaaaagcgtcttcaagaacaggaacgacgtatggagtatgaaatcctcatgaaggatatttccaacatgtctgaacaacaacgcaaagaccatgaaaagtattgtgaccatattaggaaaaaactaggatattaa

SEQ ID NO: 37320 - DNA, 252 bp, Glycine max
  Peptide Sequence Number=SeqID_154098
atggctcatggcagtcaccgggggtcaatggtagtggaggaggagcctgcaagactcgcccaggcgaaatttggctcgcctaggcgagctgatctagctcaaattttactacttcggttaaaatatcatatctcatccttaagatgttatattgcaaatcccaacggtcagaaagtgcaaaatgggtttcaagcctacagtccaaatttgaaagcgatccaacggttaaaaagtccaggattgcagttttag

SEQ ID NO: 37321 - DNA, 372 bp, Glycine max
  Peptide Sequence Number=SeqID_154099
atgacaagccgcctaagtcagataagagaggggcatacaaagttaggccaaagacgggaaggtatttacagacctcaatttgataggccacctcgtaacgaactacgtgaaagattgagaaatcccaatcgttatcaaagaagaggtcgctccaagagcattctccgaggtccttcaaacaatgctcagaagagacatgcaggagaggtattgcctgttgttcatggtggaagaaactgtgaatcaaataaaagaagacccccaccattgatctttgatgacaagagcattgacatatcagttgtaccagaccatgatgatcctttattggtgaaagctttcataaacaataaactccaacatcgtcaatga

SEQ ID NO: 37322 - DNA, 813 bp, Glycine max
  Peptide Sequence Number=SeqID_154100
atgtcatcgggcccgccgcctctggatgaaaaaaggtgcagaatgaccataatttgtctctacgtgccatcggacacgactgtgtctaaatggcaaaaggtgagcggaatgaccataatttgtctccgcgtgtcatcgggtccgccgcctctagatgacaaaagacgcagaatgaccataatttgtctctgcgtgccatcggacacgactgtgtctgaatggcaaaaaaagagcgaaatgaccataatttgtctctacgtgtcatcgggcccaccgcctctggatgacaaaagatgcagaatgaccataatttgtctctgcgtgccatcggacatgactgtgtgtggatggcaaaaggtgagcagaatgaccataatttgtctccacgtgtcatcgggtccgccgcctcaggatgacaaaagacgcagaatgaccataatttgtctctgcgtgccatcggatacgactgtgtctggatggcaaaaggtgagcagaatgaccataatttgtctttgcgtgccatcggatacgactgtgtctggatggcaaaaggtgagcagaatgaccataatttgtctttgcgtgtcatcgggctcgccgcctctggatgacaaaagatgcagaatgaccataatttgtctctgcgtgccatcgggcccgccgcctatagatgacaaaagacgcagaatgaccatactttgtctctacgcgtcacatgaccccagggtcagtatgacagagattgtggggcggccgacaaaagcaaggctcttgctcctacgtatcctcaatgaggaactcagaccgacgtag

SEQ ID NO: 37323 - DNA, 909 bp, Glycine max
  Peptide Sequence Number=SeqID_154101
atggtgttttttgtatctctgcactacataggaagagttaaccagggatggaatgagaggggcaagtgtgcccccgcccttcctcctcattttcttttaaaaattattcatgtagactctagtttttatatcaaaaaagctgtactcttaagctaccattacataggcatagatgagagacatgaagagcgtgttatcattattagttctaaggacaatgatgaaaaagttactgatgcagagaaagctcttgagcaaatagcccatttaattttaaaggaagatgatagcagtcttgatgcgtcaaaagttactgcaggacatgtggctgccaatacgataagacttttgattgcagggtcccaggcaggtggattaattgggacgtctggtcaaaacattgagaagttgagggactcttctggtgcctctattactgttcttgcaccaaatcagttgcctttatgtgcttctgctcatgaatctgacagagttgtgcagttatcaggagatgttcctgcagtcatgaaagctttggaggagataggttgtcaactaagggaaaacccaccaagacaagtgatttcaattagcccaacatacaactatgctgcaattcgaccatcccagccatatcttgacccaacttcagttgattatgttacattcgagatgctgatttcggaaacgatggttggtgggttgattggccggtgtggctcaaacatctcgaggatcagaaatgagtctggagcaatgattaaggtttatggtggtaagggtgaacagaagcatagacaaattcaatttggtggtagtgctcaacaggtagctttggcaaaacagagagttgatgaatatatatactctcagttgatacaacagactggcacccaacagtcagcgtaa

SEQ ID NO: 37324 - DNA, 1023 bp, Glycine max
  Peptide Sequence Number=SeqID_154102
atggtgggtcccggctcaactccgtgtctgatcctctgcaataattatttcctacagccatcatcatgcagcatcacagtctttgataaatcatacatagtaatccaacggtcctggttccttctacagagaaaactttgcctagaagacccaagctcgtgtctaagcgctacggtttatgtgatgtcttcgtctattcccaattccaaattcaagaaattttttaaacttgacatatctgctatcaccttttccgtttcttgcgattcgacgatggccgatcaaaagctttcagaaccggcgcttaaacgtgagcagcttgatgaattcgtgagtagtctatattttgaacaacgaattcttgaactccgacttcttcaagacctcgagaacaatgatgaatgtaggaaaaatgggagcctgaaaaggttaaatgaccagagtgatgtctgtggatttagaagttgcttcaaaaatcattatgattcgcttccgaatcagaggtgcttgaggaatcgagaagaagtgattcaggagacgatggaaatggagttggaaaatatgatggaactgggcaccctcaagggcaagaaaacatattcttttaagtggagtcgacgtcctgaagaaccaatcctcgataacaatgatgaatgtagaaaaaatgggaacctgaagaggttaaatgaccagagtgataatggtacaagaagtgcgttgaaccttgagaacaccacaagatcctttctagataacaataaatcaaatgataataactggaatggcgaaatgactttacccctgctagtagacaagtccaccgtctgtatgttaaacaaggatgaggaagtagacgagcccctcagtccgggcaaacacatgaaaactgcacaaagtgttttatcacttttgatagcgactattgcgcttctttggattctcaccgacactatgcagcctgttatcaattatcaagcttcagccagaacatggccccctccccattcggttttctttgcttga

SEQ ID NO: 37325 - DNA, 1062 bp, Glycine max
  Peptide Sequence Number=SeqID_154103
atggtagagaacacgcgcaatcaagcttccctttgtgaaatggaagaacgtctcagcagcaaaatggaatcaagatttgtcaagctcactgcttccatgcaacaaacaatagatggaatgtttcagcagaggcagcaagattctccagcaacaagcaatccacctagagatgaagaggagggctctagacctcaagaaattgatgctaatgtggttagtgaacatgattcagaacctttaatttctatgaatgcattaactagagtagctaattttcaaactatgagagtcactggttattgtgggaagaaacctctccatattttaattgatagtggaagcactcataactttttggacttacacatagctcaaaagatgggttgtcagacagaagctatggacacaatatctgtcactgtagcagatagaaataaagtccagatttcttccaaggtcccaaaattttcttggtcaattcaaaataccaactttacttttgatatgatgttgttacctcttggttgttgtgatttagtattgggaattgaatggctagtaacactaggggacatcacatggaatttcaacaaattgacaatggaattttttgttcatgggaaaagacatgtcctgagaggagctacccctacaaatctggccactgctagaaaacaacatcttcataaaaccatctttaatggtattcacctctccctgcttagtttgcagtctaaagttgaaggctccttgctccactctttgactactcatgctaatcaacagttactgccacctgatattgatagcttgttactcgaatttacagatgtttttcaggagccatcgggtcttcctccttgccaaattggccatgatcacaagattcctttaacgcaaggagctaaccctatcaacaagaggccttataggtatgctaaacaacaaaaagatattattgatggcttgattcaggactatttgaagtcaggaattatacagaatagtgatagtctttatacaagtccagtagtgttggtgagaaagaaagatggggcctag

SEQ ID NO: 37326 - DNA, 435 bp, Glycine max
  Peptide Sequence Number=SeqID_154104
atgaagcaattgaggagtttcttgggtcttttcggttattacagaaggtttgtaagtcgatatggtacaattgcaaaacccttgactgatatgttgaaaagggataattttagttggtcttctacaacaaaagaagcatttcaggaattgaagcaaaggttagtaacagcaccagttttggccctaccaaacttttctaaggaatttgtagtggaggtggatgcttctggcctaggcttaggtgctgtgttaatgcagaatcaccacccaacttccttcatcagtagaagtttgaacaagcagcaacagtccttgtcaacatatgagaaaaagctattggcagttgtgtttgcagtccaaaaaaatggagtcactacttacttcccaagaagttcatcattagaattgatcacaaaagttttaagtacatcctag

SEQ ID NO: 37327 - DNA, 1053 bp, Glycine max
  Peptide Sequence Number=SeqID_154105
atgtttgtattttctaagaagacaaagcaagccatctcaatcttgaatcctccatcagatctccctgcgaatgctgctgcccaagaaaacaacccaaacccaaaacgcacccacaacgcagaaaacggcgtcgtatgcaacccccaaatgaagtgcaagaaacatacctcagaccttagcagcaccgttggcgtctgcgcctcctgtctaagggaacgcctcatagccctcgtcgccgcccgagtcatctcacgcgcctccgacgaatattccagaaactcagaccctaaccctccgccaccgttaatcttccctcgctccgtttcgccctacgtctctcgccggaagcccgactacgccgccgcctggcacgacgaccgccgcgacaggctcttctacagcactccgcagctcggtcccaccttctgcgccggcgattccgcctaccacgccgacgcgaagtcgttcaagaaacgcttcaacaagttccgcatattcgcgaagatcttcaggaccagatcggagaagttccagtcggatccgtcgtgcgagcaagcctcgtacgcatcgccgtcgtggttctcggcgttttttcccacgcgccggaggaacaaggatcggaccggaacgacggaggaatattcctcctccgccccgcggcggcggtaccgcccgtccgatcgcggaatgtcgccggtgacgaccgaggatttcggcgacgagtgcgatcagtcaccatcgggaagcggatacgtctcagaggcttcgccgtggtggcggagatcgccgacggtggcgccgtcggcgcggcggtcgaggttagggcacacgaagagctcgtctggttcgggtatggcgctttggctgagtcctctagttcgggcgagtccgaaccggaggtggaaccacaagggattgccgccggagatggcggcagcggcggaggtcagagccgcggcggcgaagcctcatctctccgccgcggcgtcgttttgcgccaaccgttccaggaagcttgcggattttggacgagtcaacaaccataaccgttga

SEQ ID NO: 37328 - DNA, 396 bp, Glycine max
  Peptide Sequence Number=SeqID_154106
atggcactgagggcagccgtactccgccacgttcgtgtgccactccaagccgctccgaaactgcagccatggcgtgccatgtcatcacacggcgacgatcatctctccaaagaggaggtcgtcgaaagagtcctcgctgtcgtcaaagatttccccaaagtcgatccttccaggttgaggttcactctctcatctcccggaactcggcatactcctcatgtgagtccagatgtacatttccagaaggatttgggtttggatagcttggacaatgtggaaattgtaatggcactagaagaggagttcaagctagagatcccagacaaggaagctgataaaattgactcttgtcatcttgctattgagtatatttctaaccatccaatggctggttaa

SEQ ID NO: 37329 - DNA, 579 bp, Glycine max
  Peptide Sequence Number=SeqID_154107
atggaggattcgttggagaattggatttcactgttggaaatggaagaatatcatgatgggtcatttgatgaggaagagttcctaagagagatccttaaggaggagcagcagccagaaaatttgtggcctcaaagagatcaaaagctctccaacaccagccccactgtgtcctttgatgaggcaattagcttttgtgggagtggcactctacataaaagcaacagctccaactccatcaagtctttgaaaagatcatcatcaagtgtctcaccagccaccactacataccttctttcttttgatacctcaagtgctaaaccaatcacacttaaaccttcccctaagcttgatttggcacttggatcatccaataaaaggagtactagtactgtaactgtggtgaaagatgggtgtgaatttgaaccattgatgatgccccaaagccaagcaaggaagaaggttagaaggtcatgtgagacacagcatcacattattgctgagaggaaaaggagacaggaactgacagggagcattatagcacttgcagcaactattcctgggctcaagaggatgaaatga

SEQ ID NO: 37330 - DNA, 750 bp, Glycine max
  Peptide Sequence Number=SeqID_154108
atgggtggtgatgatttcttcaatattcaaagccatggccacatgagccctttcaatgaagaagagtactcctcgggagagagagacatgattgttcagcaacaagttttctctcccaatctctcttcttcctcccttcaaagcaacttggaattaccttactcatcatctccaacgggtaacgttttgtcttttgataacccccttgtaggatcacttcaccctcaaaatgactccgctaaaagcatggaacaaagccattgcgttgaaccaaaggcgtacccacgaacaaacgcacaagttcacatactggccgagagaaaaaggagagaggagctgactaggtgcatcatagcactttcagccaccattcctggcttaaagaagacagacaaggtctctgtactgcgtgaagctgtgaactatgtgaaacaacttcaagaacgtgtgaaagagctagaaaatcaaatgaggaaggaatgtgtgaattcaataatacttaccaagaaagcgctaatttgcaaaaatgatcgtgtggaagaactcctcgaggtgaaagtaactgtgttagataaggaagtgctcattggagtccattgtgagaaacaaagaaaatctttgctcaaaatattgtccttgcttaataatctccatctttctataaccagtaccagcgtattgccatttgggagttccactcttaagattaccattatctctcagaaaattggaatcgcttgggatcactag

SEQ ID NO: 37331 - DNA, 192 bp, Glycine max
  Peptide Sequence Number=SeqID_154109
atgatgacaagaaaaatgcaactgagacaagcagttgttgctgttgcatggacaataggaacattaggggaaaaaacatggtgtttagcacagaagtactcatccttaagccaacacaaaacatcatggggtgggaaaaaaaaccaagaagagcatgctatgcaagcaattacatacaacaaaacaaggtag

SEQ ID NO: 37332 - DNA, 1068 bp, Glycine max
  Peptide Sequence Number=SeqID_154110
atgtttgttgttttccctattgccaatgatgctgatagaagtgaagtgtcatctgatactgcaatcaagacatcgtattcagaagccgataagatggttgatggtatggactttggtgagctttgcaatgagtttgagtgcatcagcagtcccttggtagaatccactgcaagacaacttgcacgagatatacttgagctaagggagggaaatcgagcacttggaatctttgctgtttctgtcgcatacaagagtcacatttttggcacaaattttgatacaaagttaaaggcagccatggctaacccacaaaaggatcctattaggagctttaccggtcgtgaaaagtataaaagacgactatgggcaaccggtgcactagacaacccatctgtggaaatggtgatgctgtcaaccagtgttttaagtatcaagtggacaataagagggaaaccaaaatctgtgttaggaggagatctgataattagagttacttccaaatttactcttaaccaaattagtggccaagtcattgagcatgaagaattctgggacttatcagcttcatctgctagtgctcaggcatttttctggacatcacgtgctctctttgctgctgttgaatctgtcaaagatttgggtgacagtgctaagaatttgagtagtaaaatgtcaaccaaaaaagagaacttggagatgtatccagatccttcaggtgatccaaccaagacatttatttggaagtttatccaagcagggtcaaagtcacaaaccattttcttaagtttaaccagacataccttcataatgaatcaatcaggttgttcaaatctctatgccattgcattccttaacatgttgttcttccagagggacgacagttttcaacaggatgcataccagattgcactactcctggcagttatttatttggtggatgtgtgtgatagtttgcttaatgaagataagttttacttcttgctggtgaaagtcaaaacaaccaaaagtggggagaaaaatctatggaagtggaaccttccatcaccctacccctcactttttcaatga

SEQ ID NO: 37333 - DNA, 546 bp, Glycine max
  Peptide Sequence Number=SeqID_154111
atggagtcacaagaaatcacctccaatattacatgtgacggccacgttgaagaaaaatattcaccaccaccatcactactagatggttctaagcgagagaagaggacctatagaggagtaagaagcaggccatggggaaaattcgcagcagaaataagagaccccacaagaaatggggttcgagtatggattggaacatttgtctctgctgaagaagctgctttggcttatgaccaagcagctttcttgacaaggggtgttctggctacccttaacttttcagtgcaagtggtgatggagtcccttcaagacatgggtttcaaggcattgaaaaatgatctctcacccgtgttggcactcaagaggatgcacgtgacgagaacaaaatctagggctagtaggagtggaaacaaaaaggttaaaagggcttgcggcagcaacgggaaatgggacactagtactcaaaatttgttggtgttggaggatttgggtcctgaatacctagaccaacttttgagcttcacttgccctggttcttggtgctga

SEQ ID NO: 37334 - DNA, 417 bp, Glycine max
  Peptide Sequence Number=SeqID_154112
atggcctgtgaacacagatggaattttgatcttcatttcagtccttcgctcgaacaacaggcatatggcagacccctaccagcatttagaatgcatgtctggactattgaactcactcagtccctgctttgtgatcctaaaccactgatgcttccacctcttgcagcaatacgccttccttcttgtggtttccatatgaccattttaagaaaggtcgggcctccattacaatggcatgtcgtcccagttggccctggatttcacggcaagtatgttgccgacccatggtaccgatttcttgctgaaggtgattttgttcatggagacgaacttttattctattacagaagtcatgaggatatttgggaaatggttattaggaaacagaggaattggggtgacaacgatgattggtga

SEQ ID NO: 37335 - DNA, 105 bp, Glycine max
  Peptide Sequence Number=SeqID_154113
atgaatgcaatgtttgctttgacccagaggggtggctttgttcaacctgacaaggatgatcccaacctacctctagatacagctcctattaagcatgtcacgcag

SEQ ID NO: 37336 - DNA, 390 bp, Glycine max
  Peptide Sequence Number=SeqID_154114
atgaacattactgtttatgctttcgagtctgacattggtggaaagcttctaagttggcctttgagatacaatcaagtgtcaagctttttagcaattatgtgctttgcaatgacctatacatgttatgaagcaaatggtcccgaatcaggtcacttgtgtggcccttgcaaagtgatggctccaaagtttcaagaattatctgaaaagtatctggatgttgtctttctaaagcttgattgcaaccaagacaacaggcccttggcaatagagctgggaattaaagtggttcccactttcaaaattctgaaggacaacaaggttgtaaaagaagttactggagctaaatacgatgatttggttgatgccatagacaaagttcgatctagctaa

SEQ ID NO: 37337 - DNA, 270 bp, Glycine max
  Peptide Sequence Number=SeqID_154115
atggggctccggataagattcgttggtggaggatgcacgaacagtgctaggaaattaattcgtggggccctggactcgatgattcattggtggaggatgcacgaacaacgctgggcaatcaattcatggggctccagactcgatggtggaggatgcatgaaggacaatcaattcatagggctccggacaagattcgttggtggaggatgcacgaatagcgctaggcaatcaatttgtggggctccggactcgatggtggaggatgcatga

SEQ ID NO: 37338 - DNA, 324 bp, Glycine max
  Peptide Sequence Number=SeqID_154116
atgactatcaccttggatgtcgttgcgtcgttgctacatctgcctattgtaagggtgttccatagcttcaagctacttcatgtcgacgacgttgtcgaaatgttggtggaattactcgaggtcagcgctgcagagtgttggatctacgatcatttttcgtccgttggttccgctgttcctgccgagaattatgatgagaggagccgcgtgcatgtcgatggacctttggcaagacactgcccgtttccacgtatcagaggcgtctggatagaccgacccttgatgcggtgtgctggatttcgtatggtgaccaccgttctttag

SEQ ID NO: 37339 - DNA, 2326 bp, Glycine max
  Peptide Sequence Number=SeqID_154117
gaagcaggagaacttaatgaacgagctactaaagctgaaactgagactgagtccctaaagcaggaacttgctagagtagaagctgaaaaggaagctacccttgttcaatataaccagtgcttggagacaatatcaaaactggaggagagaataaaagaagctgaggagaatgcaagaaggattaaggagcatgccgatatagcagaaaaagaaatcgaagctttggaattacaagttactaaacttaatgaagaaaaggaagatgctgctctccattatcagcaatgcatggagataatttccagtttggagtataagctctcttgtgctgaagaggaggtgcataggctaaattccaagatagttgatggggttgaaaagttacagagttcagaacagaaatgtcttctcttggagacatcaaatcacactctgcagtcagaattacaatctttggcacaaaaagtggggtctcaaagtgaagaacttaatgagaagcagcaggaattgggtagactttggggttgcatacaagaggagagactgcgattcattgaggctgaaactgctttccaaactcttcagcagttgcattctcagtctcaggaagagcttagatctcttgcttctgaacttaacagtaaagtggaaatactggggaatgtggaatctcgtaagcaggctttagaggatgaagtacacagggatgagattttgaatttgagggagacaatagagaaagttgaacaggaggtggagcttcgaattgatgaaagaaatgctcttcagcaagaaatttactgtcttaaagaggagcttaatgatgtgaataaaaaacatgaagccatgatagaggaagtccggtcaactgacttagacccacagtgctttggatcatctgtgaaaaaattgcaagatgagaacttaaagctgaaggaaacatgtgaggctgacaaaggagagaaagaagctcttttggtaaaattggaaaccatggagaaacttctggagaaaaatactgttttagagaattccctttcagacttgaatgctgagctggatagcgtcagaggaaaggtaaatgtgttggaagaaacatgccaatctctactagtggagaaatcaaatcttgctgctgagaaggccaccttgttttctcagttacaatccacaactgaaaagctggagaagctctcagaaaagagcaacctattggaaaattcactatttgatgtgaatgctgaacttgaagggttaagggtgaagtccaaggtattagaagacacatgtcgatcacttgaccatgagaagtccagtatctgtcaagagaaagaaaccttagtttcacagttgaacataactcatcaaacactgaaagatcttgagaaactgcacagtgaattggaattgaagcatttggaactaaaaggagaaagggagtctgcacttcaaaaggtagaagagctactagtttccctatattctgagagggaagagaattccagagttttgaaattgaatgaagatgaattggctgagaaggaattacaaattcttattctacaagaagatgcaaattgcaagaaaaaggaatatgaggaggaactggacagagctatacatgctcaacttgaaattttcatcttgcagaaatgtattgatgatttggagaaaaagaacctctcccttctagttgagtgtcagagacttttggaggcttccaaaatgtcggacaaaatgatatctaaattggagactgaaaatgttcaaaagcaggttgatgtgaattctctgtctgagaaaattaaaatactaaggattggcttgattcaggtgttgaagactcttgacaataacagtgggcatttcggtgaggatatgcttgaagaagaccaaatgctcctgaaccacatatatggaaaacttcaggagaggcagaaatcttttgacacaattttcaatggaagccaacaaatggccattgagaattcaattctgattacattcctagagcagttgaaactaaaggtggaaaatcttgtgacacaaagagacacccttgatgaggagttcaatatccagtctaagcagttcttggcattgcaaatagaggtccaaaagatattgcagaagaatcaggagttggagttgacaataagcaaaggagaagagagaatggaagtaatgacaattgagacagacaatctacgaaagcagttgtcagacttggaaaagagtcacaacaatttacaggaggatagttgcaagatattggaagagaagaagtccttgacaagaagatttctagatctgggtgaagagaaaa

SEQ ID NO: 37340 - DNA, 401 bp, Glycine max
  Peptide Sequence Number=SeqID_154118
gtagcgttcgaagggtacacgtcctcactttcagagggctacacgtccttgccttcagagtgctacacgtcctcgccttcagagggctacacatcctcgacttcagagggctacacatccttgccttcagagggatgtacgtcctcgcctttagagggctacacgtcctcgcctccataggactgtatgtcctccgccttcagagggctacatgccctcaccttcagagggctgtgaaaaagaggcaaagtcatgaagtgccaaaagtgacaattgagcttagctcatcagtgtattcagccaggctcagcgcccaactggtgctaagcccgaatccacttacccgcgctaagcgcgagggtggcgctaagcgcaacgtcacgaattcagagcctatttaa

SEQ ID NO: 37341 - DNA, 300 bp, Glycine max
  Peptide Sequence Number=SeqID_154119
atgactctcatttacattttgaagacgacaatgtcttcagtcattgcatgccttcaaaggcgacaatgtcctcatctacatcttgaagacgacaatgtcttcagtcattgcatgccttcaaaaggcgacaatgtcttcatttgcatttcgaagacgacaatgtcttcacctcaaaaacttcaatatcctttttccctgtgctttgtaggactcgacttcctttgtttgccttcacgggttttactgcttggatttgcactagtggtcagtcgggtaaagatccagctcaaacgaaattag

SEQ ID NO: 37342 - DNA, 577 bp, Glycine max
  Peptide Sequence Number=SeqID_154120
cggaagcgagaatgtcggcttgagtaacgcaaacgttggtgagaatccaatgcctcgaaaaccaatggttcctccgcaatgttcgtccacggaaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtgagataccactctggaagagctag

SEQ ID NO: 37343 - DNA, 1155 bp, Glycine max
  Peptide Sequence Number=SeqID_154121
atggctccaagcttgttaagtgtcttcctaccgattaaagcaaagtatgatgcgtttgcttccataagtagatatcttatggtgaagctcctggagagcttgtgtttgaccaaaggtggtcatcaagtccacatagcctctagtctcttctttcttgcctgcaaagacgaggagtcaactgacatgaggatggacaatgtcaggggagacctcaagtctctaaaaaaccaccacgaggttgtcttggttgacaaggttgatacccttgaattccctatccgtgaagatgacgtggagatggaattttcgggactagctgtactgtcctccataggaaaatctgcccgcgatggtgttattgctcgcaccgctgttgctggtgtctttgtctaccttagtctttcgctctttttttgtctgcttcgtggttcctatgctgctcctcttggtgtcctatggtatttggttgcatctgaccctggcttgggaggttttgtcaagggtagcctgatgggtacctccaagctgaaagcttccttaaaattgtatcttagtacttctttctcgcttgtcgtacttgcgttcgacatttcggacttcgttcctgaatctggacatttcttccatctggatggcgagaagcatggaatgaaacgctacctcaaggttaagattttggatctggacggctgtgcacccaaatctgcccatgaattttctgatagaggcatcgtctgcttgtcgcaggcaggtcaaggcggtcaaggtcatgcagtgagacctgctggttgcgtactacgcgctgaaatattcgacgaaggtgtcgaacctatctatggaactaggtttgcctatgtcaggaaggcatccaaatgtttgtctggatctgttgtcccatcttaccactcgagattgagtggtttccatcccaagggtatgtctgcctccataatgggatcgacaaaaggatgtcgacaagtagtccgccctgctagatggaaatgtgttagtagagtgttcgtcgccctagggacatctaacacgagcccccagctggtcatgagtattggtgtttttcatagctatctgataaggatgggagtcttcgagaagggtcttgcatctgaggccaaatcgagtgctaaccatggatga

SEQ ID NO: 37344 - DNA, 606 bp, Glycine max
  Peptide Sequence Number=SeqID_154122
atggcttcgccttttcgacaagctttggcaggaacctacacagggatgctagcttaccgttcagcttctgaacttcttggatgttggtggggctacgcatctctagcacatgtcatatttgcagagttcctcaaagacttgttccaggtccgccacatgctggactatgctttgagacttgacgaccatgtcgcccatatatacctcgatgtttcatctgatctgttgtttaaagactcggtccatcagtcattggtgtctaggaagcttagcacctggaacccggacgctccatcgacgagcttgtcgatgttgggtagaggtgcacattctctattttccattggcctttttgaccatgacgacattggcaagccaaatggaatacctgatttctctgatgaacacgtcggtgatgtgccaatgctcatggctggtaaggtccctactaagccgtgtgcactgtctgagtttaggtttgagttgcagcttgacaagctcttcgatgggtttcaggcctctgttagaggctcccttgtaggaggatatgatgctacctcaggctctctgcatagcgttgtcgtgcttgcttttggtcagccttga

SEQ ID NO: 37345 - DNA, 681 bp, Glycine max
  Peptide Sequence Number=SeqID_154123
atgagtacgaccggccttgggaggcactcggtcctccggattttcaagggccgccgggggcgcaccggacaccacgcgacgtgcggtgctcttccagccgctggaccctacctccggctgagccgtttccagggtggccaggctatctgcaccgacgaccgctccgcccgggctcgcgccctgggttttgcagcgaccgccgcgccctcctactcatcggggcttggtccttgccccgacggccggaactcgcccgcgggctccagctatcctgaggaaacttcggagggaccagctactagacggttcgattatctttcgcccctatacccaagtcagacgaacgattgcacgtcagtatcgctgcggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatga

SEQ ID NO: 37346 - DNA, 500 bp, Glycine max
  Peptide Sequence Number=SeqID_154124
atgcctgagcggggcgaagccagaggaaactctggtggaggccgcagcgatactgacgtgcaatcgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctggccaccctggaaacggctcagccggaggtagggtccagcggctggaagagcaccgcacgtcgcgtggtgtccg

SEQ ID NO: 37347 - DNA, 138 bp, Glycine max
  Peptide Sequence Number=SeqID_154125
atgaagaacaagttgaagcatttcaaatcaacacacattgagctagatctattatggttggcaatgaggaaatccagtggtgttgctggtctatcggaggctaggttgaagtctagtgaggaattggaaggttgttga

SEQ ID NO: 37348 - DNA, 557 bp, Glycine max
  Peptide Sequence Number=SeqID_154126
atgtttggaagcaaaggtgagaaccttgacaagtcaagacgaataggccccgttcatggacgtcctggcactcttgatcttcaagcgattaatgcttttctcgccttttacaaccgtaaggaaagcccgattgtcactatcttagctggtctatatgacacattcgaccgaagatgtgagaagaacagtgcaaggatcatttgctgtacaccagccctctacgtatggggcaccaacacgggggtgcttcagagggcccgcaaggcatgggaaagggtgcaaaagaaggacgaggaacttaggggaagtagcaacgggcccatcggcagttaccataggtggttgaaagcctacgcacaaggtctggattggctcccgaatttgagaactactaaagaggtggagggtgaagcttcagaagaagatgaaaaggtacaagccctcaaaacagagcttgagagagcccaaacaaccaaagaaaagtccaagtccatagctgttagcatccgaaaagagaacgccgaactaagagacatcaacatagccaccatcaaggc

SEQ ID NO: 37349 - DNA, 267 bp, Glycine max
  Peptide Sequence Number=SeqID_154127
atgcggttatccgcacgctcgatgagtgataaatgcgcagagacaaattttgcgccctttatcattcaggaacaacaagctaagtgggtaaacgcgcagagacaaactctgcgccctttatcattcaggagcagcgagtcaagtggtaaacgcacagaaacaaattatgcgccctttatcattcagaaacggcaagcagattgggtaaatgcgcagaaacaaattctgtgccctttatcattcaagaacaacaagctgagtgggtaa

SEQ ID NO: 37350 - DNA, 942 bp, Glycine max
  Peptide Sequence Number=SeqID_154128
atgatttgggttcgcggagactctctcggcactggcagcttcgccaccgtcaacatagccatacccacaaatacttccattcattttccttctcccaccgccgtcaaatcctccgatgttcactcctcgtctatgctgaaaaacgagaaggagatactcgattgccttggagcttccccttatgtcaaaagacacggcgggaggcttccggagtcttacgttcggaggtgtacgaggtcgatcgtcgaaggtctaaaacatattcacgacaacggttatgttcactgcgatgtgaagcttcaaaacattctcgtttttgagaatggggatgttaagatcgccgattttgggctcgcgaaggagaaaggggagaaacaggggacgtttgagtgcagggggacgccgttgtttatgtcgccggaatctgtgaacgacaatgagtacgagtcgccggcggatatttgggctttgggctgcgcagtcgtggagatgctgaccggaaaacccgcgtgggatgttcgcgggtcgaatatatggtcgttgttgattcgaattggggtgggagaagaattgcccaagattccagaagagttatcagaagagggaaaagattttcttttgaaatgtttcgttaaggatccaatgaagaggtggagcgctgagatgcttttgcatcaccctttcgttaacaatgaaacggtttcttttcacaaagttaatgagccgttgccgttaccgtctccgtcaccgaggacacactttgatttaactcactgggcttccaccgtaacgacgtggcttccgtcttcccctgattctgatgagtggcgtatggcggaattcgggtcctcgtgttcgccggagaatcggtttcggcggctgctcaccgatcagacgccggcgaattggtcagaatcggatggctggacaagcgttaggtga

SEQ ID NO: 37351 - DNA, 843 bp, Glycine max
  Peptide Sequence Number=SeqID_154129
atgagggacttgaaaactttaaaggaattggtggcaagcgttacagattggaagtcgcttgagaagatgtcttgcaaaccctttaagccttccattttgcatttggcaatatcacaagatgcgccccacttatatagcgaagaacagttgattcaattaaagaatttcagcaaactactctcgagggctgaatcgaagccaaatacaaacaagactgacaagagggtggccaaaaaaagacaaattgaggagaggcctaaagaggaaagaatcatgcccgcaatgattaaaaaaccaagaaaaataatcttggtacagaacggaccatcaccagatttgtccagaaggatagtcttgggacatagtggaacatcatcagatttgccaagaaggataatcttggaacatagcggaccatcaccagatttgcctgtacaattcaagaatcgagtcactgagttgagtggtcatgatcttaaatatttgatgcacaagagactcttctgttcagatgtgaggccgaacaacaatcgtctctcgatgcccatgaatgagattatgtgtgaatttctcacacaagacgagattgaaaaattggatgaaagagatggaagcaatggaaaaggacggctggttggtctggaagtgactgtgttagacccatgtctgagagaatttagtttagcattgaagaagtggagcatgcaaaggactgacacctataacctcgtaacaaattggaataggatcgtatttatcaatgagttcgaagaaggccacgagctccaaatttggtcttttagggttgataacaagctatatcttctactaaacaaactgtga

SEQ ID NO: 37352 - DNA, 402 bp, Glycine max
  Peptide Sequence Number=SeqID_154130
atggctccaaagaagttttctgctaaaagggctaggaaggccaccacaggggagggatctagtgcagcctcgcaagcgaaaattgagtttgacaggcactggcatccattgatcttagaagaaggacaacattgtgaatacgttgaaagaataagccaagcctcaggttttgatgaagaggccataagccagctactgtgctccccgggacatgattgtgcacagagcatagcagggaggcgggtacggatcatgcgcactagcatgaccactttcactcagatctgtatgacgcttctgctcagcaacatccttcccagtgaccataattctaatctcccgcttcctaaatgccagttggtctacgctatcctgacccagatcagtgttcatgtagcatag

SEQ ID NO: 37353 - DNA, 220 bp, Glycine max
  Peptide Sequence Number=SeqID_154131
agcaaaaacgagcagtcgccctaagcggaccctatgggctcagcgcgcatccaccgctaagtgcagcttcagtgcgcttagcgtgacaagggaatctggcagagcacaagtatcaaggctgcatgctaagcatgagatcaactcgctaagtgagatgtttgtctttagccaggctcagtgcatgactggcaccaagcccaaatccacttacttgcactaa

SEQ ID NO: 37354 - DNA, 357 bp, Glycine max
  Peptide Sequence Number=SeqID_154132
atgggcccgaaatctaccctaagggtcgtgagaaccctaaggccttctcttgcatctctggctcaatcttcttggagtcttctatccaatgcccttggggctgtctctagaatatttccattggatttaatgatgaaatctgtgcaatttcagttgagcttagctcatcagtgggctaagcgtgcatccaccgctaagcgtagcttcagcgtgcttagtgcgacagaagaatctggccgagcatcaatatcaaggccgcgcgctaagcacgagattagtgtgctaaatgcaggagttgtctttagccaggctcagcgcacgactggcgctaagctcaaatccacttacttgcgctaa

SEQ ID NO: 37355 - DNA, 633 bp, Glycine max
  Peptide Sequence Number=SeqID_154133
atgtgggaatacctagacaacacctcgtctgataaagatgatgaaaaagccaacatatgtttgatggcggatatagcttttgaggggtttgaatcaaaccaggaagatgaggatctaaagaagttgaatgaacttcataatcatcaaaaagaagaaagatatgatctttggagagattatgaagacctcaaaatgaagacacataatttttgggtagaatgtgaagaacacaagaaattagtgagtttcttgaataatgagcttattaagaatcaagaatttaagggtaaacctcaagatcttgccaaacttcatgaggaaacaagaaccttaaagactacatcatccaaatttgtcaatggaaaatataatcttaagaaattgttaggatactgtagaagttctttagaaaaatatagaaatggatttgatgggaaagtatatgttcatgataaggaaaccattgtatgttatttctatggaaaaattggacatatgatgattaaaagtagggatcatcctatgaagggttcacccaatcctttcatgactaacacaaaaggacccaaaaagatttgggcacctaagaaaaggatttttcgtggtgcagatgtctttgatagttggaaatag

SEQ ID NO: 37356 - DNA, 480 bp, Glycine max
  Peptide Sequence Number=SeqID_154134
atgcgtactggcactgtgagtaagaaaagtcaaattgtaaaccttaatctgaactatgtgaaatggttaacgatgttgccagccaacgcctattacgaacttaattttggtgcccagtattcaccagataatttgacgttacaggatcaatttacaataggcgatcgttggagtgtacgtggttttcaaaacagcgatggtatctatgggaataaaggtttttttatacaaaataccctgaatgtggtgactggatttgacggtatcaccccttatgttggcacagattatggacaaataattggtaagttaccttcacaagacctgagtgggaaaaggataatgggtggagtcttaggagttaaaggcgcggtgaaagctgtcgagtatgatgcttcgttatcaacaccttttctctatccggatgatttcgatgtggataagtataagtttaatttcaattttgcgtaccagatttaa

SEQ ID NO: 37357 - DNA, 447 bp, Glycine max
  Peptide Sequence Number=SeqID_154135
atgcgggggtatattatggttatccacaccttttgtcatcccgagacggcgagtccgatgacatgcaggggcaccatatggttatccgcaccttttgtcatcccgagacaagacgacaagtccgatgacatgcgagggtaccgcatggttatcttcacctttcgtcaaccaagggcaaacgagcctgttgacgcgcagagaccaacatcgtcttccacaccttttgtcatccagggacaacaagtcaggtggcaagcagagataccttatggtttttactctcgtcgtccggagacattcaagcccgacgacgcacgacattcttctctgttgggtggggggcgatcaagttcgatggcgtggggaaatgtcgtggttgtcccattttatcgctttcaagacactgaagttttgttgacgcttctgatgcattttctctctttctga

SEQ ID NO: 37358 - DNA, 921 bp, Glycine max
  Peptide Sequence Number=SeqID_154136
atggcaaggatggaaattctcaccatgggtccagatttatggtggtttgaggttttggctcaaaaggcttgtagaatggctggacatgatatgtgccagggtgttggtttggccagcggttcagggataaagtggcggcggtccgtctatagcccgctttcggccatccccaggctgctgtggtgtctcgccctgcgccagcctgggggcgcaatacttcttgatgaaagcttggttagtagggggcctgatgaccttgctgggggcgacaggcacttcgtagaactgacagaggcccataatcatagctggaaaccccaagaccctattggacttctccgggtccactgggactggcagaggcccgtagccatagttggaaaccccaggactttgttggactccttcgggtccactgggtgtcttgtgggcgtgatccctacaaatagtggatggcatcagaaatcagttgagccacgtggggagatcagagttgtggtggtgcgcatgatccgcactcgtctccctgtggtggtctgggtgaaatcatgccccggtaagcatagcagctgcacgatagcctccctctctggttgtgctcgcaaagttggtcgccctccaatatcagggatgcggagcactctgaaagcgaaggcgtgcacccctctgaaggtgagggcgtgcagccctctgaaggtgaggacgtgtattcctctaaaggcaagggcgtgcaaccctctaaaggtgaggacgtgtagtcctctgaaggtgagggcgtccagccctttgatggcgaggacatgtagccctattcaggtgaggacgtgtagtcctctgaaggcgagggcgtgcagtcctctgatggcgaggacatgtagtcctctaaagggcgtgaagccctctgatggagaggatgtgtag

SEQ ID NO: 37359 - DNA, 337 bp, Glycine max
  Peptide Sequence Number=SeqID_154137
aatgaccaaacttggtctctgcttgtcatcgggcccgccgcctctggatgacaaaagggtgcggataaccgtaagaatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaag

SEQ ID NO: 37360 - DNA, 1066 bp, Glycine max
  Peptide Sequence Number=SeqID_154138
atgtggtatggtgaaagaatatcaaaaaataagaattgtcagaatccaaggttcagtttatgttgtggagatgacaaagttgaattgccattattacaaaatccaccccaatatctccaacaacttctatttcatgatgatacaattgatagtaaaaattatcaacataacttacgagcatacaacatgatgtttgcctttacttctgctagaattaagctagataaaacaattaataattcaagaggacctcttgcaatcagaatacagggccaaccatgccatagaataggcagtctattaccaatgcctgggaaaaaccccaaatttgcacagctatatatctttgacacagaaaatgaagtgcaaaatagaattaatgtcatgagtcaatattccggaattcagaatcatattgtttcaactttaagtcacatgctcgatcaacacaattctcatgctaaaagttttagaatggccagagatagattggtaggtgatcaagccaataatatcaaattgcaactcatagctgctcggggaaaagatggccgtgtatataatatgcctaatgttccgaaaattgctgctcttattgttggcgattttcatccaggctcaaaaagagatattattgttgaaactcaaaatggagaattacaaagaatccatgaacttcatcctagctatctaccactacagtatcctctactttttctttatggagaagacggatatagagctgacatacttcaccgttgtacttcatccagcaaaaaaagaaagcaaaaccgtctgacaatgagagagtggtttgcttatagacttcagtccaggtcaaatgaagcacaaactttattgcattctcgaaaattatttcaacaattcattgttgaaggttataccatggtggaatctgaaagacttagctatatcagaaacaaccaaaagaagcttagagttgataagtattctagcttacaaacttcattggatactggaacagctaaaggcttaaccaagggaaaaagagtcatcttaccctcaacgtttgttgggagcccac

SEQ ID NO: 37361 - DNA, 354 bp, Glycine max
  Peptide Sequence Number=SeqID_154139
atgttgtgtcgtgacgactcccgcgggacaccgtctccgggcccccgggagtcgcacttaacagatttgagttccttggcgcacgaagcgccggggtttgtgtttgtcgcgaggacgaggaggccgggcgcacggggcgccgtggtcatcccctccctcccgacggttcagtggacttctcacaacgtcgcgggcagcgaactcgctcacgtcgccgcaatccgaacacttcaccggaccattcaatcggtaggagcgacgggcggtgtgtacaaagggcatggacgtagtcaacgcgagctgatgactcgcgcttactacgaattcctcgttgaagaccaacaattgcaatga

SEQ ID NO: 37362 - DNA, 476 bp, Glycine max
  Peptide Sequence Number=SeqID_154140
atggaaaggctcaaacttgagggaaagaaagcaatgcaaatactagcaaaactgaggcaaaccctgcatcaaaggaagcagacagttcaaaccttgcaactcactcttcaagctgtgctactggagtcggatgcagtggaaaaatcttctgccaaagctcttcaacagatcaagctttcagaaaatcagagatgttgtgcagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 37363 - DNA, 918 bp, Glycine max
  Peptide Sequence Number=SeqID_154141
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccggaaacggcagcatcgacggcaccggcaacgaacttgccaacgtcctgaccggcaacgagggcgccaaccggctcgacggtggcgccggcgatgatcagttgttcggcggccaaggaaacgaccgcctgctgggtggcagcggcaacgacgtgcttgatggccagtccggtgacgatcacatggagggcggtgccggtgatgacatctaccacgtggacagtctgctggacagcatcgtcgaactcgcggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 37364 - DNA, 561 bp, Glycine max
  Peptide Sequence Number=SeqID_154142
atggcgaggattcctgacaagattaggtctattgatggatcaaaagatacgcttaagcttgctgttaggatcaccgatctttggttcgttgggactcccaacaagtctgagcaagcggaaatggtttttgttgattctgagggtgatcaaattcatgctatttgtaaatcggaccacctcaagccttggaaagctgatttgaaagagaattgcacttatgttatgcataatttcaaagttgtcaagaatgatggtcaatttagagtgtgcgaacataagtacaagttattttttattggagtgacggttgttagagaagctgatttgcatgaactgccttttaaggaatttagatttgttgaatttgcaaatgttgttgctggcaattttgtgtctggcctgttgtcttgcacactttgggagaattactgtactcagttcctatcctatttgaatgaacgtggggatgatgggccgatggttattatattgacacataccaaaataaaagatgcgcagggaagttatccagcttcagtgagcaattccttcaaggcgtaa

SEQ ID NO: 37365 - DNA, 1026 bp, Glycine max
  Peptide Sequence Number=SeqID_154143
acttagccgccattgatgctttcctcgcatatcaccatagcaaggaaagtccagtggtagctatcttggcagatttgttcgacacctttgaccggagcacgatcaattggtttcctcggtggaaggaaggcaaggaaggagttcttttctcgtgtggggactatcctaatgttccactgatagggactaggggttgtattaattataatcccgcactcgccataagacaactagggtatcccatgaggggagcgccaaccgaagaaagtctctcgcctttccttgtgagggatctaggcacgcaaggtctcaaggttatacaaagaatccacaaggcgtggaggagtccgttgaggaaagacaaggagcttagaggcatccaaaacggcgtcatcggagctccggaggaagatgaagaagttcgagctctaaaattagagctagggaaggcgagactcgccaaggagaagttcaaatcagctgctacacacatccggaaagaatgtaccgagttacaagaggaaaacgcggtcactgtaagagcccttgaacaagaaaccaaaagggcccgcaaggaggaatatggccgagagaaattccgaggagcattgtggggtagcaacaatgagctcaagctccgaagaaaggagagagatcggtcacgggtgcatggcatgatcttaaaagaagagttaattgtttgcgcgaggtccaaaagaagtttggctcaacacttggaagccacggagcaaagcatgctagctatcatagggcaatacaaggaagagttgaaccagtctgtcgcccatgaacaaaagctagtggaggattttgcacaagtgtatgccgaaaaggaagcaagggggagggtgattgatgcactgcatcaagaagcgactatgtggatggataggttcgccttgaccttgaatggaagccaagacctcccgcgtctattagccaaagcaaaatccatggccgaagtgtgtactgctcctgaggagattcatgggctaatcaattact

SEQ ID NO: 37366 - DNA, 453 bp, Glycine max
  Peptide Sequence Number=SeqID_154144
atggcaacaagaaaccaacccaaggatgttgcaaagggaagtggatgtgatattggggatagcttggctagttatgttaggagaggtaaaggtaaattggagaaccctgaatatgaagtttgcgcatcaaggccaggatataagaataaaaggggatcccaacttggaaaaatccataatatctgtcaagaaactgttgaaactaacggaaagcgcacactcacaaagtcaggaactcaaagtcagcagctcttggtccagtggcagggcaagttgagtgatgaggctacatgggaaggaagatgcagagatgatcagcaaccaattcccagatttcaaccttggggacaaggttgtttctggggaggagatattgttagaccagtgtctgagtttcccaaacagaccctgcaggtttattatagaaggaagggcaaaaggggaaataaatag

SEQ ID NO: 37367 - DNA, 498 bp, Glycine max
  Peptide Sequence Number=SeqID_154145
atggctagtgctgatgacatcagtggtaaactgaaaagcagttcagacttggttctgtccaaacaagatgaaaaagtagaaaaatctgataaaaatgggctttctgatattgagcagctggttcaagggaagaaattctctagagttgaatttgatcgtttagtggcggtactaaattcaagggtgatggacctttctaatgttgaacaaggaaaggaaattacaaatttgagttctaggaaagatgatgaggggcttgcgatgacacgtggacttccgaaagtttcaaatgagcaaaggcttgaagagtcaactggggccatatggggaacctcaacacctcttggtctgtcaaagagtttgagagagaaaagaagaaagctggaagatattattgttgattcagaattgaaaggatggttacaaactgattccgtttctctatttatagagagaacaaatacgattacacataacctaactaaggcagttaactaa

SEQ ID NO: 37368 - DNA, 1194 bp, Glycine max
  Peptide Sequence Number=SeqID_154146
atgcctcaggctatagtgaacttcatagtgcaaagtcttggtaatttactcattcaagaaggaatgttcctatatagggtggaagacaaagtgttgcaactgcaaactgaattgaggatgatgaggtcttacttgcaagttgcagatagaaagcaagatggtaatgaaagcctaaggaattggatttcagaaatcagagaagctgcttatgattatgatgatgtcgttgagtcatatgcccttagaggagcttcaagaagaaagttgactagtgttttgagcctcatcaaaaggtatgctttaaacatcaacaaattcatagaaacccataaggtgggatctcatgttgataatgtcatagctaggatttctagcctcacaaggagtttggaaacttatggcataaggcctgaggaaggagaagccttaaattctatgcatgggaagcaaagatctttgagctcctactcacatgttattgaagaggacataattggtgttcaagatgatgttaggattttggagttatgtttggttgaccccaacaaaggctatagagtagtagccatttgtgaaatggggggcttcacatggatcaacttgatccgcaggaaactacgcggccaaaaacgtatgcggatctacttttgcctactgtggatcatctacctctatgaagaacggaagaatgaagctcatggaagaagaagagacactcgcaggaagaagaaatggctcgcgggagagcaccaggagaagaacaatgctcacggaaaaaggtgctcgcaaaagaaggtgctcgccgaagaaggaagcggaatggttgggaatggaatgcttcaatgtaattcttcatggcctttgaaaaagccttgtaaagctcttaagcagactgttggagtgggtgttcgtccacactctgggatactacttgtttgtgtggatgccaaatctatcggcaagtgcaccaggcatttgcaaacagaaatcatgattgtgaatgagagtaaaagtatgttctattctaattacaaagcaataaatgtgagcaacgccaaactcgcgctaagcttggaaggtgacaaacgactcgttgagcgagctcatgatgcattaagcgcgtgtctacgtgacagattcccttccagattcctcctatccactaaacgcattgatgcctcgcttagcggatga

SEQ ID NO: 37369 - DNA, 438 bp, Glycine max
  Peptide Sequence Number=SeqID_154147
atgaagatcattttgagccttagaatgaggagtgtcaagttgatgttggtgtcaactgctcagaatgaagaagaaggagctctgaaagaggcaactgaaaaagctgaagatgtccatccttctaaggataaagcactagaggcagaggttggtgaaccttctagggttcacaaggatgttccttatgttcacattccaactcctcttgttgttgttgttattgttactgttgaaccctcatctaggtcaacagaatcaagattaacttttctagagaagcaagtaagaccttccttgatccttgaagtagtagctatgcagcatgaaccaccatcacttccaagagctaaaactatgccttcctcatcttcaaaaattcatctcctagcaagcatgaatgattttcctctttggacctcgcttttgttttttgattga

SEQ ID NO: 37370 - DNA, 249 bp, Glycine max
  Peptide Sequence Number=SeqID_154148
atgaaaacattcctaagatcatacaagatacctcaaagtatcctagagacacacaatagtgatatgaatgctaataagatattttgcagatattctaaccctctttcccaagttaaagcttactgccctaacacatcaaacccaatggagaggacacatcagattttaccactgaatacaaagtccactttccatgggaacgaaacagccatggaacggtggcaaacagaggtcacaggccaggcttga

SEQ ID NO: 37371 - DNA, 225 bp, Glycine max
  Peptide Sequence Number=SeqID_154149
atggagaggaaatccaaaggggagagaattcagaggccacaatggaaatggaaatcggaaaaatgcaaaggcatgaacagtgcagacccaaccgaaactcgaaaagataaaacaataagttcagcgttgctggaaacgaaaaaatgcattgaacatttttctccttcgattcaagcatttatttatttgatcatggagatgcgtttaatatctgcaaagaaatga

SEQ ID NO: 37372 - DNA, 363 bp, Glycine max
  Peptide Sequence Number=SeqID_154150
atgggacctatccatagacgtcgaaggtcggttgttacaaccagaaggcacatctttatcgctgatgtcacgcaagagatgatggaacataacaaccctttggttcttcccgcaacagctttaaattttttgtttggatcaaaaaaatatgttcctattcaacgtgcatatggaagacgtaaacaatggcagatcaccgtgcacaacggtctgccatctattgcagaaccatggttccaacacctctctcaaaataatttaatggcaggagatgaagttatgttcttcttcaggtttgacgaacatgtatgggagaccatatttaggaaacaagttatatgggaagaagacctcccggtttga

SEQ ID NO: 37373 - DNA, 333 bp, Glycine max
  Peptide Sequence Number=SeqID_154151
atggattcgttctcaaatcaatcgagagggtcgtcgagccaattatctgctcaggatctcaaaaaccagttgaagaaccaacttgccattgagtatgctcaacaatttcttgagcctgggctagaactaggaagaaagaatctgactcataagctaatggcactattcattttttcgatgaaagtcattcgagtatacggaggaataggaatcgcactaggagaaaggagaaaacatcggtgggtggaaggagaaaacagtaatgggatgtggcagaggggagaattttctcgcatgggagtagaggagaggcataagaaatttaggccttga

SEQ ID NO: 37374 - DNA, 699 bp, Glycine max
  Peptide Sequence Number=SeqID_154152
atgtatgcaggggcatattcagcaacattcacagtcacaaacaattgtgcattcacaatatggccagccactctcacaggaggtggcaactcacagctaccttcaacaggctttgaactaacctcaaaagcctcatccacaattgatgtcacagctccatggtctggcagattctgggccaagtctcaatgctcaacagacacatatgggaaattcacttgtgccactggtgactgtggatcaggtcaagtaccatgcaatggtaatggtggaacccctccagtttctctagtggaattcactttggcttcaaataaaggacaagatttctatgatgttagccttgttgatggcttcaatctgccagtgttggtgatcgctcagggaggcttaaggggttgcaacacaactagctgccctagtgatgtgaacaaagtttgtcctccaaattttgctgtcaaagggtcagatggaagtgtcattgcttgcaagagtgcacgtttggcattggaccaacctgagtattgttgcactggaccctttgcttcagctgacaagtgcccaccaaccccttattcagttatttttaagaatcagtgccctcaagcttatagctatgcctatgatgataggactagcacttttacttgctctggggagcaaactattccatcacattttgcccctaaaccaaaatga

SEQ ID NO: 37375 - DNA, 486 bp, Glycine max
  Peptide Sequence Number=SeqID_154153
atgtcagctgggcctggacttgaatctcttgtagatcagacaatttcagtcattacaaatgatggacgaaatatagtgggagtcctgaaaggttttgatcaggcaacaaatataattcttgatgagtcccatgaacgagtttattctaccaagatgttagatatatctgagaccaagaggaatttgtctatgattaagaaagaccatttgttgagaagctggttttataatcccaacaacaatacccttatcttcctaggagagttggttacatggatacattacattattgggtttgcaagaaccaacttcatgcaatatacttcttcatcaatgcctctggaaggtgtacaacaacttgttcttggtttatacatcatcaggggtgacaacataagtgttgttggtgaactagatgaagaactggattctagtctggatttgtcaaaactcagagctcatcccttgaaacctgttatccattga

SEQ ID NO: 37376 - DNA, 297 bp, Glycine max
  Peptide Sequence Number=SeqID_154154
atgacttccttaggcttgtccttgtacctaacatggtaccaacatcatagtcatatgtggcaccagcaattagcgatcaatttgtgtggcgggatccttcatggtgtggtcgtgcgtgttgaaactgaggcacgagaagaagggcacaaagaaagcctaggcgtggagagcgttagtgtcgcgaaggttggtgctaaaatagtcttcaaggaccctctcgatgagggaatatcgatgtcgatgatggggggagtaagcggggcagtgattacagtaaggtgtggtggaagcgcatga

SEQ ID NO: 37377 - DNA, 549 bp, Glycine max
  Peptide Sequence Number=SeqID_154155
atggaagcagcggaaaacgacagcgtcgtactcgaaacgacggagccttccagttcccacggttccgacggcgacgatcacctccgacagagctccgacgtgctggccaaaggcttgtcttcgatgctctcttcggtgattagcgatttcgatttcagagctcagcaaactctccaaagccagaaccacctctcttccgtcatcgatcgtctcaccggagaacttgatcagttacttgaagatgcacctttaccattcataatgcagcaagctgccaagatttctagtgttaggaaaagagtttcatcactgaatttacttctaaaatccatacaagggcggattgataatatagatcgcatgctatctattggccccactcatggtagcccagaagcatcacggctgctctggcttgataaggaaagtggtcagcatgcattatcagcttctagggccactgaagatgttgacaaccctattagttatgatatctacgatatgattctgacaagaaccataggacttgaggtactgtccctgcaataa

SEQ ID NO: 37378 - DNA, 420 bp, Glycine max
  Peptide Sequence Number=SeqID_154156
atgtgcattatatatgctcccaggaaacagaagatatccactttggtaatgatactcattgccgacattggaggtttggccttaaccatgttaatcatcatcacctttgctgtgaaggccatcaaccgtgttcatgctgttggatggatttgcgccatttctagcatcgcagtgttcgctgctcccttaagcaaaatgattccaaatgtgctaggatttctgtttggcatctctcaaatgatcttatacatgatatacaagaatgctaagaagaatggagaaaccaattgtacagagccagcaagaaagggagggcacagtgaactccaaacagcacagctgcaatggcaacaaattcgatttcccatcagtggtggaaatgaaagagaatcaactcaatcaagtttgatgttatgttga

SEQ ID NO: 37379 - DNA, 648 bp, Glycine max
  Peptide Sequence Number=SeqID_154157
atggagcggcctaaaacgtatcaaataccacctctggaaaattgtgtgatagcaagtaatgcgctaagggttcatagacatattcaggagtcaatgggtggccaggaaagaggaattgctgcagtcttatgccttaacctatctttcagtttacaggcctttctgtatcctgtgattaccccaatcacaacaattcttccatcaccattatcatcatcaagactattatctgtgactgcaccaccatcattgaaatcattttcttcatcgcagaacacaatgttcaactctcctagtattgaattaaaaacatctctcatgcacaacatgacctaccaagagttgttcctcaaagcatcatccatgatttcaggtactcaagattttaccgagcaaaccgttccaaaagtggccttcatgttcttggcaagaggtccactacccctggcacccttgtgggagaaattcttcaaaggccatgatggattttactccatttacctgcaccaacatccttgtttcagtgaaaccatgcctgaagattcagtattctatggaagaaatattcctagcgaggttagcttgccattgcttatattcatttctcttcaaacccatcataagcacggtgtaattcatgcaacatga

SEQ ID NO: 37380 - DNA, 555 bp, Glycine max
  Peptide Sequence Number=SeqID_154158
atgactaggatttcctctattcaagtgttgatagctttagcttccaaacataagttggtggttcaccagatggatgtaaagactgattttttgaataatgatctagaggaagagatctatatgactcaacctaaagggtgtgttatacttggtcaagagaacaaagtatgcaaactcttaaaacccctatatggacttaaacaggcacgtaaacaatggcatgataaattcaaccgtgctttgcttgatgatgtccttaggactaaagcctttctttcttctaagtttgacatgaaagatagaggagaagcaagtgttatcttagaagttagaattataaggaagggtgatagtatccaactatcccaaggacattatgttgagaaatttcttaagaggtttggttaccatgaccttaacccaatgagacaaaatccactggtggttatgtgttcacacttggcggaggtgcagttgtatggagatcaacaaagaatccataattgcaagattaacaatggaatcagagtttgtagctttggagttagttggtaa

SEQ ID NO: 37381 - DNA, 309 bp, Glycine max
  Peptide Sequence Number=SeqID_154159
atggaggattggggaattttctccatcgaatccttgaggaggattctgagggttatgctccgattaagatattcctcttggtgtgggggtttggcagcaagcaacgatggctcgtggcagccaccggtgatcgtgggtggtggagaaggaggtgttaggtgtgcaaattctcactcagtgcaacttcctctgcactatggctcgctcagcgtaattccctctcgggttggaattgcgcttagcgcaccattcgcgcttagcgagacagaaatatttgttattttcaaaatcccaacggtcagactttga

SEQ ID NO: 37382 - DNA, 321 bp, Glycine max
  Peptide Sequence Number=SeqID_154160
atgttattggaaacaaaatcagggggaattggagcaagagttgtcttcgacgaaagacaaaaacatgattctaactctccaattaacctagatttgaacgaggaagtgataatgtggctctttgtgagcccgatcggtcaaacctcatccacaacactagccattgttggtcttcttcttcgccttcgtcgacgtgttattgttggtggcgacaatgaaacgggaggttgcgaccgagatgggagggggcaggggagcaatagtatttttgggttgacagtgaaaggcagagcggaggaaggagaaggaatccttacctag

SEQ ID NO: 37383 - DNA, 2148 bp, Glycine max
  Peptide Sequence Number=SeqID_154161
atggatccaattgaagagtgtgcaactgtgtacatcacacactcaactcaatcctcttccatctggaagcagctaacttcaacaaaggtggctccctctgtgcccactaacatcccatctcacttgggtctcaggcttcttaaggcagctctaaatgtgggtgatttcaggcgtgcccaacaactgtttgataatattcctcaaccagaccccaccacttgttccacattaatttcagcgttcaccacccgtggacttccaaatgaggccatacggctctatgcttcactccgggcacgtgggatcaaaccccacaactcggtgtttctgactgttgccaaggcttgtggtgcctctggtgatgcctcgagagtcaaggaggttcatgatgatgccattcgatgtgggatgatgtcggatgctttcctgggcaatgcattgattcatgcctatgggaagtgtaaatgcgtagaaggtgcaaggcgggtttttgatgatttggttgtgaaagatgtggtttcttggacctcgatgtcatcatgttatgttaattgtggattgcctaggctgggcctggctgttttttgcgaaatgggatggaatggggtgaagccgaattcggtgactctgtctagcattttgcctgcgtgctcagaattgaaagatttgaagtctggaagggctattcatggatttgcagtgagacatgggatgattgaaaatgtgtttgtttgcagtgcacttgtgagcctgtatgcaagatgtttaagtgtgaaacaagctaggctagtatttgatttgatgcctcatcgagatgttgtgtcttggaatggagttttaacagcatacttcacaaacagagaatatgataagggtcttgccttgttttcccagatgagcagcaaaggagtcgaagcagatgaagctacatggaatgctgttatagggggctgcatggaaaatgggcaaacagagaaggcagtggagatgcttaggaagatgcaaaatttgggatttaaacctaatcagatcacaattagtagtttcttaccagcttgctctattttagaaagcttgaggatgggcaaggaggtacactgctatgtctttaggcattggttaattggggacttaacaacaatgacggcgctagtatacatgtatgctaaatgtggtgacttgaatctttcaaggaatgtttttgatatgatatgcagaaaggatgttgttgcttggaacacgatgatcattgcaaatgcaatgcatgggaatggaagagaagtgcttttgctctttgagagcatgcttcagtcagggatcaagcccaattctgtcacttttactggtgttttgtctggttgtagccactcaaggctagtagaggaaggactccagatatttaattcaatgggtagggatcatctagtagaaccagatgctaatcactatgcatgcatggttgatgtcttcagccgtgctggtcggcttcacgaggcatacgagtttatacagagaatgcctatggagccaactgccagtgcttggggagcactacttggtgcatgtagagtttataagaatgtggagttggcaaaaatttcagccaataaactctttgaaattgagcccaacaaccctggaaactatgtttcattattcaacatccttgtcactgccaaattgtggagtgaagcttcagaagccagaatattgatgaaagagagaggaattaccaaaactccaggctgtagttggcttcaagtgggagatagagttcacacttttgttgttggagacaaaaacaacatggagagcgataaaatctataattttctggatgagttgggtgagaaaatgaaatcggctggatataagcctgatactgattatgttctgcaagatattgaccaagaggaaaaagctgagagtctttgcagccacagtgaaaagcttgctgttgcctttgggatactcaatttgaatggacagtcatctatacgggttttcaagaatctgagaatttgtggtgactgtcacaatgccattaagtacgtttctaaggttgttggtgtgacaatcattgttagagactccttgaggtttcatcacttcagaaatggaaattgttcttgtcaagacttgtggtga

SEQ ID NO: 37384 - DNA, 420 bp, Glycine max
  Peptide Sequence Number=SeqID_154162
atggtgggatcaatgaattctacaagtaggcaaggggataatagctcaaaagggcaaatgaatagaggtacaatgaatctaatagataatggtgcaagccacaattttatctccataagccaacaaagtcttatggagtcagattatgggatgcaaataggaagaggacctaagggtgctgcaaagaaacctctcacaatgaagttcatgcaacaagaaaaggttaagaaaataagaggggatccggggttgtccaaaactttgatatctcctcaggcttggatgaagatgatagagataaaggctttctcaatgttgtgggtgatggaatctgagctagctgagtcaatgaggctaaatcaagtccagtgtgatatgttagaggggggagcaataacaattaaagtcaattctggatga

SEQ ID NO: 37385 - DNA, 333 bp, Glycine max
  Peptide Sequence Number=SeqID_154163
atgacggagagtttcttgcaccaggaagctatgatggcaagcaatgctaaggtctgggatgtttatggaaatatgaaaggtacattggaaggtcctggtcctgaaggggacattgtgtggctcatgtggcacccaagtgaacataaagttgtagctggttgtgtggattccagtgtttggatgtggggtggtgttacatttgcccatcttaatacttttcttggtcatggtgatcttgtgacctatggtgattttactcctaatgatactaatttctcttcgtttggtgcattttttgtttacagttactaccttcattcctattatatataa

SEQ ID NO: 37386 - DNA, 1716 bp, Glycine max
  Peptide Sequence Number=SeqID_154164
atggcttcactgctgaatactgtgtcaccagccgcaaatttatctcacaaaacaaaaagacccacttgtggcggtttcttgcactcccaggttccaaatctccacacttttaccctccacaagggtttttctagggtttcggcatcgacccagattgccatttccccaaaagataccatttttaatctccccaattggaggattgggaggaatgaccaaaagggtaaagagctgaggatctatgatgcatttctgcatttggagtatttggtgggtaagggccaaaagcctgaggtaaatcaagcgactcagcttttgtatgatctttgtaaattcaacaaagctaggaaagctgttagggtgatggagatgatggttggttcaggtattatacctgatgcagcctcttacacacacttggtcaattttctgtgcaagaggggcaatgttgggtatgcaattcagttggttgagaagatggaggggcatggctttccaactaatactgttacctataacactcttgttaaagggctttgcatgcatgggaacttgaaccagagcttgcagcttttggataggttgacgaagaagggactcgtcccaaatgcattcacgtattcgttccttctcgaagcggcatataaggagaggggggtggatgaggccatggagcttttggatgatataattgccaagggtggggagcctaatttggttagttacaatgtgttgttaaccgggttgtgcaaggaagggagaactgaagaagctattaagcttttcagggaattgcctgcgaaagggttcagtcctagtgttgtgagtttcaacattttgctgaggagtttgtgctatgaagggcggtgggaggaagcgaatgagcttctggcggagatggataaagaggatcagcctccctcggtggtcacttacaacatattgattacttcgctttcacttcatggaagaacagaacaagctttcaaggttttagatgaaatgacgaggagtgggttcaaagcgagtgctactagctacaatccaatcattgcccgcctctgcaatgaagggaaggtggatcttgttctccagtgtctagaccaaatgattcaccgacgctgtcatcctaatgaaggaacgtacagtgctatcgcaatgctgtgtgagcaaggtaaggtgcaggaggctttctttataatccaaagcttgggtagtaaacaaaacttccctatgcatgatttttacaagaatttgatagcaagcttgtgtaggaaagggaacacatatccagcctttcagatgttatatgaaatgataaagtatggattcactccagattcttacacttattcatctctgattagaggaatgtgtagagagggaatgctagatgaggctcttaacatattcaggattttggaagaaaatgaccacagacccgatattgataactacaacgcacttatacttggtttttgcaaagctcagagaacagacttatcaatagagatatttctgatgatggttaacaaaggatgtgtgcctaatgagaatacctataccattcttgtggaagggcttgcttttgaagaggagacagatatagcggctgacctgatgaaagagttatatctgaaaaaggttctgagccaaagtactgttgaaagactttgtatgcaatacgacatcaaggaattagtagcaacagggtag

SEQ ID NO: 37387 - DNA, 1452 bp, Glycine max
  Peptide Sequence Number=SeqID_154165
atggcgaaaacaactaatatagcagtagtttcaatccctgcgtttagccaccaagcctccattgtagggttttgcaagaggctcgttcatctccatgaccacttccacgtgacctgcatcttccccaccatagatgctccgatccccgccacactcgccatgcttgaatcacttccttccaatatcgactacaccttccttcctcccgtgcagaaacaagacctaccccaaaacgcttcctcgttggtgctagtccaaaccgcagtatcttactccatgccatctttccgcgacttgttaaggtcactcgtatcaaccacgtcatttgctgctttagtcgctgatcctttcacgaacgaagcggtagagatagcgaagggggagttcaacctcttgtcttacatatacttccctatctctgccatgacgatgtcactattgttgcatttgccaaaactgcaccaacaagttttatgtgaatacaaggatcacaaggaggctattcaaattcctggttgcttgcctcttcagggccatgacctccccagcgattttcaagatcgatcttgtgttgattatgagttaattcttcaacggtgcaagaggttaccactcgctgatggcttcttggtaaacagcttctatgagatggagaaaggtacactggaagccttgcaggaacattgcaaagggagcaacaacaataactcttgtgtgtatctggtgggaccaatcatacaaaccgagcaaagtagtgaatcaaaggggtcagagtgtgtgaggtggttggagaagcagaggccaaattcggttttgtatgtgtcgtttggaagtggatgtactctgtctcaacaacagctcaatgagttagcttttgggttggagttgagtggtcagaattttttgtgggttttgaaagcacctaatgattcagcagatggtgcttatgttgttgcttctaatgatgaccctttaaagtttttaccaaatgggttcttagagagaaccaaaggacatggttatgttgttacttcttgggcaccacagacccaaattcttggacacacttcaaccggtgggtttctcacccattgtggttggaattctgcacttgagagcattgtgttgggagtgcctatggtggcttggccactgtttgctgaacagggaatgaatgtggttttgttaaatgagggcctcaaagtggcgttgaggcccaaaattaatgagaatggggtagtggagagggaagaaattgctaaggtgataaaaggtgtaatggtgggtgaggaaggaaatgagattcgtggaagaattgaaaagctcaaagatgcagctgctgatgcgttaaaagaagatggatcctccagaatggcactttaccaatttggcactcagatggagaatgttggaaaatgccttagttattcacttatggaggttactaaataa

SEQ ID NO: 37388 - DNA, 231 bp, Glycine max
  Peptide Sequence Number=SeqID_154166
atgcttcaaaactcagataagtcctatgtctcatctctttctccattgaatttagattttttaaatgttcagcaagtgtggaaagctgtaggtctttggaggaaaattagtgaccaaatgcatacatcagattcagctaaagacctcattttcgagttgcttcaatcacttcccatggaggaaactcacatctttgttatgactctggtgtatttggaagcggtggaatga

SEQ ID NO: 37389 - DNA, 1848 bp, Glycine max
  Peptide Sequence Number=SeqID_154167
tcattccctcctcatggacatgaaagagatgtagttcttccgataagtcaggaaaagctcatatctcttgttactgaagcaaagggtaaaaataatgcacatcaatcatggagtgaacccactgccagaagaatgccaatgccccatgacggtccagctaaatggaattcatcttgcctatcatcaaggaccctagaggatgatgcatcttcttttgccttaaaacacaaaactcaaacacaagaacagatgttaagcagtgaaagatattcatctggatctacaacaagtgatatgcaagtaaaaagggtattgtcatctatgagtgctgtgaatggaactaaagactttgttgctatgaatagaagtctaagtggccgatcaaggatgaggtcacctaccaaagcggatagttccaaatttgacctagagaaaaaaccttacaatcgacagcagagttccttgtctcatggaaggacattagagagaaaaagaaggatccctaatgtcacacaactggaaggcgcgggttctgtttattcagttgatgcaaaacagagaaatctccattctggtggaatgggtggcaaaataagggacttcaatgcttcctccctgaacaattctattgtaaaaaataaacaagttggtcaaggagaaagatttattaaggttaatgacaataagatcaatgtagtgtcatttaatccccccttgaagcaaaagataggaatccatggcaagagggaagagacaagcagtgataatgagagtatgaggtatttccgaaggccttcgcctctgagagttgatgctttaggtgcctttctagaacaaaaattgaaggaattaacctctcaaagagatgaggagttggctacaggtgctccacctaaaaaatcgagtgccatgattcttcaagagctgatatctgctctaagttccgagaatctgatctgtcatgatgatcatcacatgtttaatgaaaatgttggtttccattatggggcaaaacaagaaaggttattaggaacctcttgcaatggtaatcatctgagtcctggatctgttttggaagcttctttttcttccagtagtcttgatgaaagctcagggcatggttttcaccctgattccatgaattactcatattatggtcaactggaacatgatactgaactttcagattctgcaacatcctttaaaaaaggaagcacaggtgagatgctgagtgatcttatcaaccaaattcccagggcattagaaagtttgctcactttggggacagaattgacaagaagcaagcttggccatatgaaggatattctcttgcatgctgagttagtgcttggaattgcaactgatcgcagagaggatgaagggccacaacttctaatttatcggtttcttggtgatgatcttgacagtatggcgagtgatgctatgtggactgatgctaatggcgttgttgtgggttgtgaggattctaaacagagaaaggagctaaaggggtttctccttgattgtgttatagaatatctagaatcaaattgctgccaatattttaactctggatccaaggcatggacaaagctgcccttatgcatgaaagctgagatgttggctcaagaggtgaagagggagatcaatgagtggttatctatggttgggatggtacctgatgaaattatagaatgggaaatgagccactccttggggaaatggactgactttgatattgaagcatttgaggctggtgttgatatagatggggatatacttcaaattttggttgatgaagttgttcaagatcttgcaggttgcaagcaaggcaccatttccttctaa

SEQ ID NO: 37390 - DNA, 2141 bp, Glycine max
  Peptide Sequence Number=SeqID_154168
attctgcagttgaatgggcacacaaagatgatgttcttaattggtatcaacaaaatgcttatgataatgaaggttctttggatggcagaagaatgtcatcacaacctcattcttctctttctcagttacatgaaccaaaggccctgtacagaacatcctcttatcctgagcagcaaaggcagcaacaacatctccagctccaacctagtgaatcggctcccaactggattgatcaacatttgtatggtacggaaaccactcaggatggcaaacgatggtcatcaaaaccacattccaccattgcacacttaccagagtcaaggcccttgcatagaacatctttatatcctgacaagcagcaggaattttctcatctttctagtgaaccaattttggtaccgaactcctcatttacttcttatcctccacctggtggtagatctcatcaggcttctccaagtcagaattcaggccacttaaaccttccttatcatgctacaggagctcagatggcattatcaccaccaaatcgatctcatttccccaattctgcattacagttgagtggaataaaccatgggccaccttttggtggaaacatgcgtcaattttctactggttcccctcttaatcagataattcagaatcaattggtaaaccaggcagggttatatcctggagatcaccccaatatttcatcaggtatacccatgattaacaaatatgatcagatgcttgggctgatggaattgcgggatcaaattccaaaatcagctcaattaggtagacagaatctccggtttcccccacagggttttgatatgggtggcctgagaagcaatagtggatggccccgatttaggtcgaagtatatgactactgaggaaattgagaatattcttagaatgcagcttgtagcaacacacagtaatgatccatatgttgatgactattaccaccaaggctgtcttgcgaaaaagtcatctggtgctaaattgaggcatcacttttctccagctcaaataaaggaactccctctacgaccctcttctaatgctgaaccacatgcttttcttcaggttgatgcactagggagagttccattctcatcaattcgcaggcctcgtcctctactggaagttgatcctcccaattcctctcatgcaggtagccctgagcaaggcatttcagagaaaccccttgaacaggaaccaatgcttgcagctagggtcactattgaagatggtatttatcttcttcttgatgtagatgatattgaccgtttcctacagtttaatcagcttcaagatggtggtcttgtgttaaaaaggaaacggcaaggtcttctggaaggacttgctgcctcacttcagttagttgatccactgggaaagaatggacatacggttacacttgctgcaaaagatgactttgtttttctcaggatagtttctctacccaagggtcgaaagctacttggtaggtaccttcaactgctatttcctggtggtgagctcatgcggacagtctgcatggccatctttcgtcatttaaggttcttatttggtggccttccctccgatccatctgcagcagaaactataagtaaccttgcaagggttgtttcaaggtgcattcgtgaaatggatctcagtgcaataagtgcttgtctagcagcagttgtttatacttccgagccgcctcccttacgtccccttggaagttctgctggagatggggcttcccttattctagtatctgtgcttgagagggcaactgagcttctaactgatcctcatgctgctagcaactacaatattgcaaatcgttcgctttggcaggctacatttgatgagttctttggccttctgaccaagtattgtgtgaacaaatatgatagtgtcatgcaatcattccttatacaagggacaccaaatatggcttccattggttcagatgttgccagagctattagtaaggaaatgccagttgagctcctacgtgcaagtctacctcacactgatgaccgccagaaaaaacaattacttgattttgctcagcgttctatacctatagttggatttaatagtaattcggggggtcaaggtcaccatgtgaactcagagtcagtcctgagttaa

SEQ ID NO: 37391 - DNA, 951 bp, Glycine max
  Peptide Sequence Number=SeqID_154169
atgaatgattcctcggtgaagaatttggctatcacggagaagaaggtgcagcagcataagcctggtggttgtgttggcattttctttcagctcattgattggaagaggaaactctccaagaagaagctcttctccaagaagcttcttcctcctgctcgtgcaaaaaagtttaagggagatgaaaaaatgccgaattccaagcttcacttgattgctaatgagaatagtggaggttttcctagtgctaaaaaaggtgggaatcatggtgtagatggagagcaaaagagtgacttgcgagttccgagtctggtagctaggttgatgggtctagaatctattccggctgctcagcgagataagtccaagaaagccgtgttggctgatgtttgtgctgatgggaagaaggagtcttcggctgatcatggtgagttggataggcaaggtgtcgatttggaaatgggagttgtaaaacatgattcaagacctcagaagcttcagaaaaccggggtgtatgagagaagggcagtgactaggtttggagctgaggcactgcaaattaagagtgttttgtcgcgagcaagaaaatataatcatcatcatccaaagcttgcttcttctttgaaaagtccgagagttccttctggaaaaagtgcttctcgaagcgctaggttaataggagcagctacaaaaattttggaacctggactgcaaagcagaagtagagctaaaaattctctcacatatcctgcttccttgtatcctcataagactggcattgtgtcaaatggtgtggaagatgggtcagcgattatgcaaaatcaatcttgttataaaaccagcccatgcaaacaattgatggggcagacctcttgcaaaaactgtggtaatttgctagatgttgttgactgcaagcttgaggttgggggacagcctttggttcctccgcccatt

SEQ ID NO: 37392 - DNA, 207 bp, Glycine max
  Peptide Sequence Number=SeqID_154170
atggggcaccccacgcgcaagaaagcattggtcaaatacattaatgttagtgttatcgggacaacaaccggaaacagaggttcggtttgttgggtaatgttgggtctacgtctgtctgctattctgtgctgtgggagcgtcaattcgttgcttttcatgcggtgtaactcacgcgccgtcaatgcactcgccccaaccaacctgtaa

SEQ ID NO: 37393 - DNA, 2541 bp, Glycine max
  Peptide Sequence Number=SeqID_154171
atgaattcagaaaccactgttattaagcggattaccccgaccagtggactgggaactggacctatggccggttcagttttattattggattgggttttgatttcatccaactggcttcgaactggattcaaccagtatgaaccgtcaccaagtgaaccattccatttgttgaacaaggttgtgagtggaccaaggagtgcaggtgttattggtgaacggggatcaagagaaaattctacttctgaatggtcacaaagggaagatagttttaactggtatgatcagaatgcttatgatagtgaaggttctacagatggcaaaagatggtcatcacagcctcattcttccctagcccatttacatgattcaaagcccttgtacagaacatcttcatatcctgagcagcaaaggcaggagcaacactaccacctccaacattgctctagtgaaccagttcctaactggcttgatcagcatttttgcgacgcagaaactgctcatgatcatgatggcaaacgatggtcatcgcagccacattcctctgttgcacatttacaagaatcaaagcccttgtacagaacatcttcatatcctgaaaaacagcaggagcttcctcgtttttctagtgaaccaattttggtaccaaagtcttcatttacttcttatcctccccctggtggtctatctcagctgggttctccaagccatagtacaggacacttgaacattccttatcatactggagcagctcagatggcgctatcatctcaaaatcgttctcatttatccaattctgcactacagtcaagtgcattaaatcttgggtcacattttggtggaaacacacgccaatttcctactggttcccatcttaatcagcgtatacagaatcaattggtcaaccaggcagggttgtatcctggagatcattcaaatctccttaataatatgttacagcaacaattacaccttcataatggatcggtatctcctcacttgatgactcaattacaacagcagcagcatagactgcatcatcctggtcagcgatctgcaggctacttatctggcttccagtcccatttattcaatccccacccttcctctggctcatctgtaattagcaaatatgaacatatgcatggaatcgccgatggtagagatcatagatcaaaatcaactcataaaggtaaacatagtcttcgtttttccctacatggttctgatgccggtagccaaaagagtgacagtggttcatttcagtttcgttccaagtatatgacaagtgatgaaatagaaagcattctcagaatgcaacatgctgtgactcatagtaatgacccatatgtagatgactattaccaccaagcttgtctggcaaaaaaaacttctgtggctaagttaaaacatccattttgcccaagccaaataagggaatatcctccacgatcccgtgctaatactgagccacattcatttgttcagattgatgccctagggagagtttcattttcttctattcgtcgtcctcgccctcttcttgaggttgaccctccaaacacttctgctagctctgatcaaaagatttcagagaagccccttgagcaggaacctaggtttgctgcaagagtcacaattgaggatggtctttgtcttcttcttgatgtggatgatattgatcgttacctacagttgaatcagccacaagatagtggaacacatttaagacgaagaaggcaagtcctgttggaaggactagcaacttcacttcaacttgttgatccactgggaaagaatggacacaaagttgggcttgctgctaaggatgatcttgttttcttaaggttggtatctcttcccaagggacgtaagctccttgcaaagtatcttcagttgcttcctcctggcagtgagcttatgaggatagtctgcatgaccatatttcgtcatttaagattcttatttggtggtctcccctcagatccggcagcttcagagactacaaataaccttgccaaggttgtttgccaatgtgtccgaggaatggatcttggtgctcttagtgcctgccttgctgcagttgtttgttctgcagagcagcctcctctacgccccattggaagcacttctggagatggtgcttcccttattttaatttccgttcttgagagggctactgaacttctaactgatccacatgctgcttgcaacttcaacatgggtaatcgttcattttggcaggcctcatttgatgaattttttggccttctcaccaagtattgcatgaataaatatcatagtatcatgcaatccatgcttatacaaagtacctctgatgtggatgacattggcccagatgctgccaaatctattggtagagaaatgcctgttgaactcttgcgtgctagtctccctcacactgacgagcgccagaggaagttattgctggattttgcgcaacgttccattcctgtggtaggatttaacagcaacactgggggtagtggcagtcatgtgaactcagaaacagtgctaagttga

SEQ ID NO: 37394 - DNA, 138 bp, Glycine max
  Peptide Sequence Number=SeqID_154172
atggatgggtttagagctgggggtcatgttgggggaactcccaacacagaggatcttgggcaactgggaaatgctcccacagtttacatacagcagccttttaagcttcacgttccaagttcttacatggcccgctga

SEQ ID NO: 37395 - DNA, 210 bp, Glycine max
  Peptide Sequence Number=SeqID_154173
atggtttgcatcatgaagacaaattggtacaaagagatgtatgtgaaggtgatggacacgaatgatacaatgcaagcacatgttttggggcacaaaatgactgagtttgacgcgtttctcttcagcactcagttgttcttgttgcatattatgcctaatcaagatgcgatggttttgttaagttccaatgcggcactcactgtcctctag

SEQ ID NO: 37396 - DNA, 271 bp, Glycine max
  Peptide Sequence Number=SeqID_154174
ccacagaaggaggcacactaggtgtaaccttgacaacatcaacctcgatagtgtcaacaatgttgagctggtcgaccctagcttcaattggatctcctccccctccagagggttcattgacattgactggggaaggggcacgtcaccatctacaagcaaggacaagatggctcgcacatcaagcaatgccggcaattgttccaatattgttgtgtctaccctctctgatggaagcttgcttgtggagcttttatggaggctggatctttga

SEQ ID NO: 37397 - DNA, 398 bp, Glycine max
  Peptide Sequence Number=SeqID_154175
agggtacatctacttggattgttgtaactgagaacaagagagggtacatctcttgtggatcagttcaagtggagggtacatccacttggttgttcaaagagaacaaaggagggtacatcccttgtggatctttgcttgtaaaggtttttacaagagtcaaatgcaagtattgtgcaaaaactataagtggtggagttttcagattcaagcatcattttgttgagactagagaagattatgagccttgtgctacggtgccagatgagattaaattgccgattatgaaaattgttgttgaatctaaagcaacaaaggaaaataaaaggagattgaatagtattaatgaagatgaagaaagtgctgagggggtggaagcaagtcaggcaactgacttgtag

SEQ ID NO: 37398 - DNA, 317 bp, Glycine max
  Peptide Sequence Number=SeqID_154176
cactgtattcttccatcattgatggctatgggggaatagaggacatgggcatggtgggagttactggcgaggcaaaggagagagggagaacctttcacgtcaggcttgaaggtgtcgaagtcgtcgcaatcgataaaggtcagggaggagatagaggagtgggtttgaaaggaacgaagttagagatggtaagggagtggatctgggatggtgaacacagtttttatactggttcggcaaagtccgttgcctatgtccagtccccaagcaaccctcttgggagttccactatcttgcaaatcctttacaacttctga

SEQ ID NO: 37399 - DNA, 219 bp, Glycine max
  Peptide Sequence Number=SeqID_154177
atgatgaaaattggaagttgtgggagtcgatttggtgaagaaacgagtgagatatggtgtttggaagtttggggaagaagaggcgcaacgagaaaaggcgtggctgcgcagcgctgctggttcacatcatcttttataaagaggacaactgcacacaatctcccttcagagcatgatctcttagaaaatggtgccgaatttctatatccttggttctag

SEQ ID NO: 37400 - DNA, 186 bp, Glycine max
  Peptide Sequence Number=SeqID_154178
atgagagaaggaaaaaccgtgaattcaatggttcggatcttggaatcaggtttaggaaaagatgacactactgtcagaaaatccactccaaacccaccaaaccccacctgtcaaatgcacataacagtaataagtaactatgctcataatgatgggatttccggggagaggaagaatagaatctga

SEQ ID NO: 37401 - DNA, 534 bp, Glycine max
  Peptide Sequence Number=SeqID_154179
atgaatcgagatgagggatatgagacaataggttcccaaggttgtagatatggtgaaatttgtgtacattggttatgtttgcttcagttttcttcagcttggtggttgtgcaacgtgatgatgaagaagcatccaacaggcaagttttcgctgctccatggttttgcaacgtcacccgcgaggaagtatccagacattgactcatattcctgcacatcagcaaagagagggagcaaagatacctcaagaaggtttagaagggtgcaagcgaaacacagagcaatgaacaatatcaatgattatgcagaatccctctttcagatgtgcctagaaaatggtgcgaggccagaaagagatgaacttgattttgagtttttgggaaacaaaacaggagagccttatttgattcagactaatgtatacaagaatgggactggtggacgtaagatgaggcacatgctttggtttgaccccacagaggactaccacacctattccattcacgagggaagaattagaatgagatcatgttaa

SEQ ID NO: 37402 - DNA, 141 bp, Glycine max
  Peptide Sequence Number=SeqID_154180
atgtttttggcggtgccaaatgcccttgccaaacaaagtgaaaatgagaaatctccctctcccactagcaaaatctcatcagagctacgatgttggagactgaagaaattccccacaaagtgttatggagaatccaaataa

SEQ ID NO: 37403 - DNA, 159 bp, Glycine max
  Peptide Sequence Number=SeqID_154181
atggcagaaaaacaaaaactaaactttggaacccaaatgatgtcttcagattctgttcttcctctccccgaaaatcccatcattgtggggtttggtggggttggagtggattttctagcagtagtgccaacttttcctaaacctgattccaagatctga

SEQ ID NO: 37404 - DNA, 324 bp, Glycine max
  Peptide Sequence Number=SeqID_154182
atggagaatacacagtgtagtgttaggacagcggaagtaagattcaaaacttcacctacaatagaagaagaaacaatgcaatggaagctcaatatctcgtgtgaggaagataagcagaagaagataaccaatgaggaagataagcagaagaagaagaagaaagcatgcatacgaagcatgcatatctcgcgttttataaaaaattttttgaatccctgcacctgcaaatcgcctgcaccaatggcgatttcctctctgcaaatcgcctgcaccaatggcgatttcctctctgctgcactgctgcactgccatggcaggaactag

SEQ ID NO: 37405 - DNA, 231 bp, Glycine max
  Peptide Sequence Number=SeqID_154183
atgtctacccaaacatgctctggtaaatccatgaatctagactcattaaccgttggattgtcttcaaaattgaactatttctgcccagaaaccctaacccctcctcttccaccactcacgaccactggtggccatcaaaagtcttcgttgcttgtccttgaaccaccacacggagaggaacactttaatcaaagcggaatcctcagaatccacctcaaggatttagtatag

SEQ ID NO: 37406 - DNA, 126 bp, Glycine max
  Peptide Sequence Number=SeqID_154184
atggccaaaaggaccgacctgctctggttaattaggcaagctttggaaagtgttgtatttcaccttctcgctaagccaatctgttggcttagcgagcgtccgctaagtgcaacactcttgggctaa

SEQ ID NO: 37407 - DNA, 429 bp, Glycine max
  Peptide Sequence Number=SeqID_154185
atgactagaggcaatccatctgacttacaaccctttgatcctgagatagataggacatttcatagattagttaggcatcattttgtaccttttgagcatcttgagcattctattactggtgagtctgtgcattctgttattggtgattttgaacatcctgattttgagcattataattttgaacattctgattttgaacattctgagaacatggcacaacctccaccccgtgagaggactctaagggaaatggctgcacctgatttcacctacgaaagcttgtgcatccaataccctgatgaggatgtcccatatgttcttaaaactagactgatccatttgcttccaaagtttcatggccttgcaggtgaagactcgcacaaacatctgaaagaattccatattgtctgctctaccatgaacccctag

SEQ ID NO: 37408 - DNA, 225 bp, Glycine max
  Peptide Sequence Number=SeqID_154186
atggtcgtcaaagatcgaatgacgcctgagaaggaacagagaggtgcgcccaacactggagaaggaatagggttgttttggtggggttgggggccaaagccgataactatcgtcaaaatcaagagcagtgaccaaagtccaaagggatgtccaactagtggacaaaacagtggttttgacaatgatgaggatcaaacaaggagcaaaaacataaaagaagaatag

SEQ ID NO: 37409 - DNA, 1236 bp, Glycine max
  Peptide Sequence Number=SeqID_154187
atgcagctgcaattgcagttgtcatacggtcatggtgactctgaaatctttgaccttgctgccaaaattgtggtctgtgactctaaaatctttgacgttgtcctgaaattatggttgcgaacatttcaaaaccttgttaatggtctctttgattttctttctgctgtttgtatttttgagtttcctgctgacgcaactaggcgaggtcggtctcctccacctcagtctaagagagcttcacctcccccaaggaaaccttctcctgtacgcgagtcacttgttcttcatgtagaaaagctcagcagaaatgtcaatgaagggcacttgaaagaaattttcagtaactttggtgaggttataagtgtcgagttggcaatggatcgaactgtcaatcttccaaaagggtatggatatgtgcagttcaagacaagaggggatgctgaaaaggcattattgtacatggatggtgcccaaatagatggcaatgtcatcaaggcaagatttactctacctccaaggcagaaagtttcaccacccccaaaggcttctgctgttgctccaaagagagacacccccagggctgataatgctagtgcagatgttgacaaggatggaccaaagcggcaaagagaatcttctcctcgtagaaaacctcctccctcaccacggaggagatctcctgtacctagaagagctggatctccaagacgaccagattctccacgtcgccgtgcagattctcctgttcgtcgccgattagactctccttatcgtcgtggaggagacacacctcctaggaggcggcctgtgtctcctggaagaggtcgttctccatctccacctagacgccttagatcccctgcaaggctgtcacctagaaggatacgtggaagtccaggtcgaagacgttcacctccacctcctcccaggcgccgatcaccacctagacgaccacgtagtcctcctagaaggtctccaattggtcgtagacgtactcgctctccaatacgtaggtctgcacgctcacgctcaaggtcattctcacctcgcagaggtagaccaccagttagacgtggaaggtcatcatcctactctgattcacctagtccacgcaaggtatcccggagatcaaagagtcggagcccaagaaggcctttgagaggaagaggcagtagcaacagcagcagcagcagttcaccaccaccaccaccaccaccaccaactcgcaagccatag

SEQ ID NO: 37410 - DNA, 519 bp, Glycine max
  Peptide Sequence Number=SeqID_154188
atgtttgtagttgctgtggaattggccacggttgcaagtgaggttaaggcaggagatataaaggtcttatttgtgaagccacttgtttactggactcgattttttatcatagctacagcattttctcgtccccagattgatgctatcgggtccagaattagagatcgagctgagaagaaatatggaaaaattccaaccggagacacaaaacccaactcatggactctgttggacttcggtgtcatcacattccaacctcccttcaaacaagcgctatgtagtgctgccactcaagttgacccagatgggacaaactggaagttgggttacggtgtccaactgtgtgctaacctagaccccacaaaggatgttggtcgattaagacaacaggaagatacacctctaaagacaaaacttgttaaaattacacattgtactccaacaagatgcataatcagcagcctaaatacagcgaatgtcaagatgttaccctctttgatcccaccaaaaccgttttaa

SEQ ID NO: 37411 - DNA, 1332 bp, Glycine max
  Peptide Sequence Number=SeqID_154189
atggcagatagtgaccctccatctttaggtcgtgtgaagcttactgatttagtcccttggaacgggctagcatctgattcctataaaatatcagtttcaattttgtcacattctctggctcagttttctgcagtcatcgtacagtttccagcaagtgacggggctattctgcgatctggtttagaatctgctcgcatgtatttccaccaaagggaaacgtatccacctgcagatataatcaatcctgggttgccagacatatttgccttatttggaaaagcagcaagggatattctggatgcaattagctaccatttgaatatacgcagctctccgtttgtagaaatagtggataatgttccactgagaaatagggaaatttcatcttctgttttgtctgtttgttgtcatgcaaggccatcatttcaggggccacagcatcataataatataactactacccaagaggatggccaaatgattatgtatcctgaccatgatcaccaagttgataaaagcttgctatcgcttgttaagtccgatagggctggtttacatgtaagagactctcagggccggtggattcttgtggacggagatctgggacctcaggaagctattgtttttcctgggcttgctctttatcaagcaactgcaggatatgtaaaccctgcattgctcaaaactgagattaatatggaggctaatatgtatggacgatgttctttagccttcaaacttttgcctaaatcaatgaccaatttggattgttcagaaatgcgagcagcaggttacggaattgaagctcagtttcagcttcctgtcccagtggatgattttatgcaaagatctcacccaacagatcatctctttaacaggcctagtttgcagtgcttcaatttccaaccaacacatgatgagagaaggaagcaaaatcccaaaagcaaacctttgccaccttccaagaggttaaggcttgaggctcaaagagttttgaaagaaagggtccaggatattgctgataagaaaggcatcaagctgcggttctgtaatctcaaggaatgtgaaagtcacattcacagcattgatagcccatgtgcaaatatacgaatggagatagggtggccacttggtgttccatttgtccatccccatgatttacctaacaaggcaaagctgggttttcttgaagcgtatgaacctggttggacagaagcccatcaaaactcagacaggctagtcaacactcagctaactttaactgcaactctccttttgcaagtttcatgtccatatgataatgcatattctactttatatttaaaactgtaa

SEQ ID NO: 37412 - DNA, 396 bp, Glycine max
  Peptide Sequence Number=SeqID_154190
ggaactccagtaacattttcgagtcgatccaacggtgaacgaattggaacgaagggaatgttactggggtatttgagtaagaaaaactgtggtattgagattgatggggacctggtgttgagaggaatgaggataagggctacgtgggagtacgtgagctcagttaagggtgggcaactagggatggtgggttcatgcgtgatttgtggatgtggagagttgttttgcaccatcgcccgatcgccacctagtaccacatgtgacggagtggtacctagagatatgtcgcaggggtcaggagaccttggggacgtcaggcgagctcctggcagtcaaccgataaaagaacaaagaccacaaagcaaggaggcttatgtggtggctggccagctgtga

SEQ ID NO: 37413 - DNA, 414 bp, Glycine max
  Peptide Sequence Number=SeqID_154191
atgctaccatcatccactgtcctgtctctcgccggaaccggcgccggcgttccggtgagcttttccggcaaactgggtcacctcgaaaccaagttttctccaagacccagaaaggttttcagccgttcgtgcataaaggggcttcctttacaacaaaacaccgtcaatggtttaaaatcgaagaagagaaacacacattcgagcttcgcgttgggtaaaaatgccgaagacagctttttatcggatgtaaatggagacaccgatgagatgtacgatgaattaattaataattatggaaaagtggtatttagtagaaaagacaaaaagcctgctagcgcagagattgacgatgatgctgaaagcctgtcatataaggtttcttctttaagaataatcatctgtcagattatgtga

SEQ ID NO: 37414 - DNA, 1414 bp, Glycine max
  Peptide Sequence Number=SeqID_154192
cctcgacatttcgaataatgagatttcgggacctttgccaaacttgtccagaatctcaggtctgaacatgttccttgcacaaaacaatcatcttagaggaaccataccggcctttgatttctccaattttgaccaattcaatgtctcctttaacaattttagaggccgcattccaaaaaacgtgtatggctatttctctgctgatagcttccttggtaatcctgaactatgtggagatccgctaccaaaaaactgttctgatcagtttatgtttcttagtgagactcaggcaaaagaagaatcaaagggtccttctaagcagcagattctaatgtactcgggctatgctgctttgggtgttatcattgtcctttttgtagtcttaaagctgtgtagaagagagaagggaattgaagcattgaaaaacggggtaggggccactgatggtggtggtattgaaaagcacagcaatgtttcaagtgaatacaaagatgaggtaagcagatccgagttttcagtggcttctgaaagtcggatggtttcacaatcactcatagttctttcaaggccagcagcaattgaattgaaattggaggacttgttgagggcccctgcagaattgattggcagaggaaagaatggaagtctttataaggtgatacttgacaatgggataatggtggttgtgaaaaggatcaaggattggactatttcaagccaagatttcaagcaaagaatgcaaatactaagtcaagcaaaggaccctcatgtattgtcacctcttgctttctattgctccaaacaagaaaagcttttggtgtatgaatatcagcagaatggaagtttattcaagcttttacatggtactccaaaaacctttgactggaccagcagacttgggatagcagctacaattgctgaggctttatctttcatgcatcaagagctaggccatcatggtattgttcatggtaacctgaaatcctccaacattttgctaaacaagaatatggagccatgtataagtgaatatggtgttatgggtatggatgatcaaagaggttccctttttgccagtcctattgatgccggtgcattagatatctttaaggaagatgtttatggctttggtgtgattctacttgaattgcttactggtaagttagtgaagggcaatgggattgacttgactgattgggttcagtcagttgtcagggaagagtggacaggtgaagtctttgacaagtctctaatatccgagtatgcaagtgaggagaggatggtcaatttgcttcaggtggctataagatgtgtcaatcgttcaccacaggctaggccaggcatgaaccaaattgctctcatgattaatactatcaaagaggacgaagaaaaatccttgatctatgaactgtga

SEQ ID NO: 37415 - DNA, 225 bp, Glycine max
  Peptide Sequence Number=SeqID_154193
atggaagtccatgaggatgaagcttggggcctcttatcagcaatcaagttcgtttcatctttggatttcaacaatgttatgtttgaatttgatagcaaaggagtggtggataaaataaggagttcaactactaatctttctgaattagaggagataataattgaatgtagaagtttgttagcccttaatccaacttatgtaattggtttggctaagagacaatag

SEQ ID NO: 37416 - DNA, 1266 bp, Glycine max
  Peptide Sequence Number=SeqID_154194
atgagttggagcgtaacattacaatcaagcttggctatgctaatgcaaaaatatacaagtgtgaagatgaacggtgtccaaggcctatgtgctacaagtggggcttatggaagtggaaaggaagatagtcctatgtgtgatgtgccaggatttgaaaacagcaagatgaaattgctgagacatgtttcatttgtggattgtccgggacatgatattcttatggctacaatgcttaatggagcagcaatcatggatggagctttgctactcattgctgccaatgaaagctgcccacaaccacaaacctctgagcatttagctgctgtggaaattatgcgtctacagcacataataattcttcagaacaaggtagacttgattcaagaaaatgtggctatcaatcagcatgaggcaatttcaaagtttatacaaggaactgttgctgatggtgcaccagtagtacctatttcagcacagttgaagtataatattgatgttgtgtgtgagtatattgtgaagaagatcccaatccctgaaaggaactttgtttctcctcctaatatgatcgttattcggtcatttgatgtcaataaacctggttatgaggttgatgaaataaaaggaggtgtagctggtgggagcattttgagggtcaatcaattcattgaagttcgtcctgggattgttgttaaagatgagagtggaaatatcagatgcacgcccatatactcaagaatagtttcattgtatgctgaacaaaatgagcttcaatttgctgttcctggaggcctaattggtgttgggacaacaatggatcccactttgacacgtgctgataggttggtggctatgcctaattatccatttatgcctcctgccatgaatgaggataatgatccttataaaatatcttcattcatctcttttgcttgccaatctggtgggattgggtcagtggtaaactttttcctgcttcggcggctccttggtgtccgaacaaaagggtctgagagacagggaaaggtatccaagctggctaaaggagagatgttaatgttgaacattggatcaatgtcgacgggggctagagtagttgctgtgaagaatgacttggcgaagttgcaactcacttcccctgtgtgcactagcaagggcgagaagattgcacttagtcgtcgtgttgagaagcattggcgtcttattgggtggggacaaatccaagctggaatcactcttgatgtccctcccgccccccaactgagttga

SEQ ID NO: 37417 - DNA, 219 bp, Glycine max
  Peptide Sequence Number=SeqID_154195
atgaatcaccaacaacaatctcctgtgactgcatatccagcagtgagtcagagcaacccagcagctccaccaccacctgtgggttatcccacaaaggatgatgttccttcccaacaaaatgttccaatcaaaacctctactaggggtgatggcttttggaagggatgggaatcaatcacatggaccattgttgcaattagaaaccataacccctcctaa

SEQ ID NO: 37418 - DNA, 435 bp, Glycine max
  Peptide Sequence Number=SeqID_154196
atgaacaagttaaagcaagaagataggcacacacccaaaagaaacataactaaccttcaagatcccaaacaggatccagagattagagaagcaacactagaggtcgagctagaagtcaccaagggagcgtttcaaggaactcaaggccttgacatttgtcggcgctcagaagctcctttagatacttatcataccaacgggggcattgttgctagtagaatggacacaaaggatttcccactgaatcgaatacaaaaaggtacaaaaaagaggacgttttggtatccaaatcaaggatatccatcgagctttgtcttgtggacgactgcaaaagtagtgcagaaagggtttaggcgttgtcagcacaaaactatacaagcaaaaagcatggaaggcttgcatggccgcccacccattcggatgaagttgtattag

SEQ ID NO: 37419 - DNA, 771 bp, Glycine max
  Peptide Sequence Number=SeqID_154197
atgaacgccttacgcttgacctgtaggactaggattgttaccattgagggtctttccccaaatcctactctcaatcaaacactagggccatgcgatgcaccagctaatatggtgcctcctcccgaaaaagatcctaagggcaaggacagacacaagaagaggagtcaccacgaacaccaaagaggctcgagggaaccttctggtcacaaggatggtaactcccgagagaaaagactcaaacaacaaatggttgaatttctgccagtcacaaccttggccaacctatcggcgctagccaaccaaggtttttttatcaaggattttcaacctgaccgtcttatcaatccgcagatgattttcgatcatgggcggaaagggtctccgaatgtcgatgccctgaaggatcagctgtcgaaggttgatgactctttgaacttggtgcttcaacctaacaccatgttggtgggggataacaagaacttggagaatcaagtgctttccgtgacaactgaggtgaaggggttagagatgcatcttgtgaatgatgatgccttagttatgtctcaaaatgatgagatttctaggcttcggtctacaaccctgagtgtctttgatattaagaaagatgtataccacggggagctggtgcctattgaagaaattctgaaagatggagctcctacactagagaggccgatgacccaggcagaggactttcatgctgaaggtatcgaggctgatgataaggagaatggagaccataaggattga

SEQ ID NO: 37420 - DNA, 158 bp, Glycine max
  Peptide Sequence Number=SeqID_154198
atggatgttgttggagggcgagagcatccttcaacaaaatacgcaggagaaaatccaagccgaagtgcttccataacgcttccgagacgtttccgtgagcaaatccgtgaagattttccgtcattcttcaccgttcttcgttcttcgttcttcaacgg

SEQ ID NO: 37421 - DNA, 288 bp, Glycine max
  Peptide Sequence Number=SeqID_154199
atggattcactcggtgggagtcgtcccctcaatgctccaccaaaaattgaaattcatggtggaggggtacttagtcattgttttgggggaggaagatgttctgggcacgactatgagcttggaatgggcttgggaaagaataatgatggcatggccagcttagtggacatcaaggaaaattgtggaaagtttgggcttagctataagcccacgcagactaatagtatatgcatatatgttcttggtagaagtaggagtagtgggggcaagatacgcgggttaggctaa

SEQ ID NO: 37422 - DNA, 540 bp, Glycine max
  Peptide Sequence Number=SeqID_154200
atgactaccttgacccaaatatggatgacactgctgcatagcaatgtcttgccgagcgaccacaactttgacctccctctgcctaagtgtcagttggtgtatgccatcctgacgcagatgagcgttcacatggcccaagtgattgctgatgtcatttatttgtttgcaggaatggcgcctactaggcaccctctggacccagagaagtccaacagggccttggggtttctggctctgatcacgggcctctgccagtcctacggagttcctatcacccccagcaaggtaatccgaccactgatcacccgagccttcatcgagaagtactgcacgcctaggcaggcgcacgacaacgcacatcaggacacgggcgcaccgccaccacctcggcaagccgattcggttgggccactgtgcgtggagcggtatatatatcatttggttcgccagctggcagccaaacaccatggacaggtgcagatacatgagtgtctctaccggttcagcctcagtcagcagggccaggggtccgcccctttt

SEQ ID NO: 37423 - DNA, 215 bp, Glycine max
  Peptide Sequence Number=SeqID_154201
tcgtgggtgctcaaagctcaaagctttctacgctgccagttaacaagttgattgtgctttttctggttttcaagcttgacgagagttacacgccgagcaaagtttccatccgtgccggtgatggttttcacaacttgaaggagattaagaccgtggaactcgtgaaggcaactgggtgggcttatctatccttgtctggagctgatcctagataa

SEQ ID NO: 37424 - DNA, 393 bp, Glycine max
  Peptide Sequence Number=SeqID_154202
atgacaaagttgtggaattacgtgaattacgttatatatgtgaggggtagagggtgtcacacagtggacccagaaaagtccaacaaggcactaggtacagcaaccaaagcaggttcaacaaccttggctagcagcagatgccccatcaccacctccacaacaatcgccatcattcgagttcatctcagcacacttgcagaggatggagctccagatgcacacatacattttagagccactgttgcgaggcctagagacaagcctatttttcaggaggaagcaagtcctacaaatgctcaaagagctacccaaggagatggaggacgagtagaggaagatgaagacatggcgggtcttgttgattattttatgggaggaaatggatcttcctag

SEQ ID NO: 37425 - DNA, 456 bp, Glycine max
  Peptide Sequence Number=SeqID_154203
atggcgattgttgtggaggtggtgatggggcatctgctgctagccaaggttgttgaacctgctttggttgctcctaggagagcagacaaattcgcccagacgagctgtagctcgcccaataagatccttagcccaggcaagctggttgctagccagggcaaatttgagcatgcagcccaatctgggagcagtgaagcaatcattgatccttcatctcccattagacgaaacatgaagtggaagctagctcgcacaaaaaaatcaggtcggatgacatctgaggctacacgccaaatagctgataggatttctatcactggaaaagtgatgaggcaactaatgttgtccttcatccagatgcagttccagggaattgtacatctatttgagctagcagttgttcctttcggtgcccgtgtcaacacaaagggaagttgtgttgatcccttaggataa

SEQ ID NO: 37426 - DNA, 114 bp, Glycine max
  Peptide Sequence Number=SeqID_154204
atggaggcttccctcatttgggaaccctatcagagcaatcagaggaaaaaattgaggaatctcaggaaattgctagagatgccgctatcgctgtcagaagacacggatccttag

SEQ ID NO: 37427 - DNA, 159 bp, Glycine max
  Peptide Sequence Number=SeqID_154205
atggcagtaaaaggaagcttaagattcgtgtacgctcattttccgatcaaagctagcattggcaacaacaacaagtccatcaagatcagaaatttcctcggcgagaagaagcgattcaaactggtgacactgcgtcagactcttggtcgaaaccactaa

SEQ ID NO: 37428 - DNA, 360 bp, Glycine max
  Peptide Sequence Number=SeqID_154206
atgttgtcagcttgttcacgtagtgctaaattacaccttagagatgctacacgtagtgctatgttcaacggcggggacgtcacttgctttgcaagaataattgggaacttgattgtatatctgataacgtggctaatggaagctcctctttatttcccattgttgcagcagctgactctttctttggctaatggaagctcctctttatttcccattgttgcagcagctgactctttctttggctccttccctgttgccttggtgctcgatcatattttgaaaaaagggaagcttcacttgtatggagttacagacatgcagctttcagatgatgctaagatacttgtatatagcatttga

SEQ ID NO: 37429 - DNA, 324 bp, Glycine max
  Peptide Sequence Number=SeqID_154207
atgaccaggagtaggaccaaacattcagaggatatcctccaacaaatgaagaggacttttggcattttgacaatattttgtgagatcttctctctgggttccttgttgaatcaacctcaaacttatcaaggagctagtgatggtggtggtgaatatcatcaattggacggatctcagtgtttgttattagacgtgatgactatgcaaatgcaacatttgctgagccgtaaaaatgaaaagctctacgaacaaatagaaggactggagaaccaactgaatcagaatgttggaagactaatatggtgggaacagagggggcaatga

SEQ ID NO: 37430 - DNA, 576 bp, Glycine max
  Peptide Sequence Number=SeqID_154208
atgagggtggaatatacaacaaggacaattaaaaggaaaggtgaaagttctcttccactcgctgtcccgcgattcacgccgtcaggattcgattccaccgtcgaagagcaagagttcggcgacctccacggaatgcttttcatgttctctaataaatttactaaactcagcaatgttgaggttcatcgcgatcccggggagcatgttgaggttaaaggtcgggggatgggtaggattcagcctttgcaatcatcggggaggggggagtttgatggcgaagtggagaagatacagggatttgattttgctaattggttgaagaagacagtttcaaagaacgattttgttgtgatgaagatggatgtggagggtactgagttcgatctgattccgaggttgattaaaactggggccatatgtttgatagatgatattttccttgaatgccattacaataggtggcagagatgttgccctgggcagaggagtgcaaagtatgagaaaacatatgatccatgcttgcagctcttcaaatcccttagacaaagtggagttcttgttcatcggtggttctaa

SEQ ID NO: 37431 - DNA, 697 bp, Glycine max
  Peptide Sequence Number=SeqID_154209
ggtacatctacttgggttgttgactgagaataagagagggtacatctcttgtggatcagttctagtggagggtacatccactaggttcaaagagaacaagggagggcgtgttcgtgttttagttgaaagattcaccgagactgttgcggtctccccttcgtcatctagagacaatcaagtccgatggcacgcaaagacaaatatggtcatctgctccctttgtcggagactcaatgtctttcgatcgagactattaaattctccccttcgtcatccagagacaatcaagtccgatggcatgcagagacaaatgtggtcatctgctccctttgtcggagactcaatgtctttcaatcgagactgttgcggtctcccttttgtcatccagagacaatcaagtttgatggcatgcagagacaaatatggtcatctgctccctttgtcgaagactctttcaaccaagactgttgtggtctcccctttgtcatccagagacaatcaagtccgatggcacaggcaatcaagtccgatggcatgtggagaccatcatggtcattcgttttcgttgtttcgagactattttagtctcctttaccatccagagacaagcaagtccgatggtgtcggagacgatgatggtcatctgtttttaattgtttccgagattattgcagttccctctgccatccaaagagaa

SEQ ID NO: 37432 - DNA, 561 bp, Glycine max
  Peptide Sequence Number=SeqID_154210
atgctagaactgcactactctgttgttgctcccccagcgcttttaatgcatccgagagtctgtccacacttcgtttcggtgcaagctgtttgcagggcgaaacatataaaggagtctcctcgtatcaattacagtgaagaaaaatgcgacacaagttccagtgctgcttctccttctccatctggcgacgagtcaagtgctagaattttgaacaagttgagggaaaaattgaacgttgaagatgtcaagttactagaggaattattaatacaagagggcattctctttgaacctccatcagtggaagaagagtcagacatagaagaccttaccttgcagataatatcctcattacaaacatccgtggagaagctcacggctactgctgatgagctgaaaagggagaatagaattctcagggccaatgttgatgcctccacggagtctctgttctacaagggagcaaataatggttcgatttttcaaaatatgattttgcgtatccctactttcttctttcgctggttgggttacacttcttctccaacaggatggcagtaa

SEQ ID NO: 37433 - DNA, 396 bp, Glycine max
  Peptide Sequence Number=SeqID_154211
atggtgtttttcctgattcaaaagtttgctatgcgatttccaacaatctatgaagcagagtcatttatcaatgttttgaaggagattctgaaaggtgacaaagacccagaacctttgaataccgactttggttctgaaatttcgtcgcagtcagagttcatgtcaacaaacaagctctcccacagcagagcttgtgaggatctgagctttatgactccagttgacaattacattccacaattgccattatatgcaaataatgaggtggggcgacctttaggatctcaagaaaagggaacaacatctggtcacaactttgaaggcatgctcccagccttgccacccagtttttccacactacttatggattgctctcagaacaaccatggttcgtga

SEQ ID NO: 37434 - DNA, 423 bp, Glycine max
  Peptide Sequence Number=SeqID_154212
atgtctgctgctccgagtgatggtgtggagtttgcgaacgtaagtggaagcccgttggagactagggcaaaaggctttattgtaataagcaatgggatgcgaattctggagaagaacaacacccatggctgtgccagaagtgtctatctcgatggtgaaggaaagggagaaatcaaggggagaagagggaacaggctagtcaagcatagcttggatttcagacaggttcgtagcaacgccgtttgcagacacgatgtggccgaggaggtggatgtggtgggtgatgactcgggttggtgggatagtgtgagatcaatggcagtagaatggagaaggatgaaaggtgattggagatgccacttcaaggagaagatgagtcaagaacaaactcaccaccataggaagccatggataagagcttga

SEQ ID NO: 37435 - DNA, 615 bp, Glycine max
  Peptide Sequence Number=SeqID_154213
atgaaatatgaaacccagaaacccaccagattgcttcagtccttaccaacaccatcggttgtatgggagaatctatccctcaatttcatcatgggtttgccattatccagtggagtctcgactattctagtcgttgttgatagattttctaaaggcattcattttggcacccttctaccacattacaccgcttacaggacaacatttcttttccgggatatggaattgttccgattaagtggtactaagcttcgcgtgagcacagcgtaccaccctcaaacgaacgggcaaacagaggtcttgaatcgggtccttgagcaatacctgcgttcttacatccatgacaagccttctcagtgggtcaaattcctttcgctagctaaatgttgctacaacacatctgttaactccagtactcgtttttcctcctttgaggtcatctatggcaggccgtcgccatcaattccacactacttggtaggttcttctactatggaggctacaaatgctctactctcgaccaaagctgatatgcatgcgaccctgcaacgtctcctccttaagacacaaacgaccatgaaagttgcagcagatgttcattgtcgtgacatttag

SEQ ID NO: 37436 - DNA, 264 bp, Glycine max
  Peptide Sequence Number=SeqID_154214
atgtcgaatattactgtgtgcgcgcgctttaggccttcgaattcgaaagagaagcaaaatggcaacgactctggctgcattcggaacatagactccgaaactttcattttcaaggacgagaaggatgaagaatttgtgtttagctttgatagagtgttctatgaaaaatccgagcaatctgatgtctatcaattcctagctcttcccatcgttagagatgttgttgttgatgcattcaatgggacaattatcacttatggccaa

SEQ ID NO: 37437 - DNA, 306 bp, Glycine max
  Peptide Sequence Number=SeqID_154215
atgtggaatgaaaactacgacgggttttacttaaaaaccgtcttattcccaaaattaaagccctacctctctgcagctgtgactccgtcgaagagcactactgaatgcaatttctccctcgacctctctccaagttccccagcctccatcaaccactctgccctccctcgcgcactcactcactctgctccgacgcacgtcactaatatcgtaagtctctccctcgagtttatgagtatgaagcttgtttggcatcggcattgtcttcaaaacattttcagttctttaaattttgggtttttataa

SEQ ID NO: 37438 - DNA, 320 bp, Glycine max
  Peptide Sequence Number=SeqID_154216
ggcagagtggttgatggaggctggggaacttggagagaggtcgagggagaaattgcattcagtagtgctcttcgacggagtcacagctgcagagagtcgtaaaattggaagtgatggatatggaagtgtttattttggagtcttagggaacaaggagtttgctgtgaagaagatgaggtctaataaatataaagagttctatgctgaactcaaggtggagctgttgggatatgccaacggagaagatgacctctgtttggtgtatgagtatgttccaagtgaatctcttagtgatcatcttcatgatccattacataaag

SEQ ID NO: 37439 - DNA, 189 bp, Glycine max
  Peptide Sequence Number=SeqID_154217
atgacactacagcctaggagcgacaatgttggacttggtactggtgacacaatgcaaagtgagtgtgagaaggaaatgcaattggaacatgttgatatggacctcaaaattaaacttattcggtccaataacctaggtttagacataaaatatacctcatttgatttagtaaagcctatgaaaccttaa

SEQ ID NO: 37440 - DNA, 1203 bp, Glycine max
  Peptide Sequence Number=SeqID_154218
atgatcgtggttatcagcctggtggtggccgccggggcgctggcctatttctacgttaacagcacgagcgaggtgacgctggtaaccacggtcatgaatgaaacgcgcaacctccgctcatccagcggctacggtaccgacgattacgtgccggcgctggtgaagggtgggagcatttcgaaaagctacaccattaccaacaacctgatttacaacaagtcaggtggacagctgaccgttaaaggcaacggcgtggggttcatcgtgaccgacgccggcctgccgcagcgtgactgcgtgaaagttgcgcgcagcatcggcaccgctgaccttgcatccaccaaaatcaacaacaccaccttcaccgctgaagtgaccgcagccgacgccgcgaccgcgcgctgcgggcgctttgtgagcaacgtcatcaggaaaccgggcgcaacgagttctcctgcttttacgacggcaggctttaccgcgccacggtatcccgtgacctactggggcgcacaggtctggtgctgcgtcagaccccggccactctgccggggggggggtgacgtccccctcagcacgccgctgcgacgctccgtggagctacccggggcgacgggcctgatactgatcgccggtgaaatgggcgcgggcaagactacctcagccgccgccattctcagccggcgcatcgcggtcaccggccacctcggcgtgtcgattgaggatccggcggaaacgctgctgcagggccgccacggtgacgggcgctgcatccagctggaggtcggtgaaaatgaagggtatgccagcgccacccggaaggcctatcgcatgggggcctctgcgtttctgctgggtgaaatccgcgacggtgccacggcacatgaagtgctgaaggcctcgctcagcatgttcgtggtgtcgaccatccacgccgcatcagtaaaagaggcgcttgagcgctacgtgatgttctgtgaggaaatcagcccggccgcgaaggccaacattgccagcacgctgtacgtgctggcgcaccagaagatgcgggtgaatcccacaaataaccagcgtcaggtggacattaccggcttcaacctgcggcatgctgctacggccgacaccatccgcgccaaaatcacgtcggggcagttcaactttgacgaccagttcaactccatcacctatgactttaaggaatag

SEQ ID NO: 37441 - DNA, 284 bp, Glycine max
  Peptide Sequence Number=SeqID_154219
atggttgtcgccctgcaggtgaatgtcgctcacgtcgttgcgcgcgcaccagaccataaagcctcgcagcgcgtcggcgttcagcccgttgctgaaatcataaagttcaagttccgtggctggcatcagcgcttctccgtgttaatgaccggcttccacttcgttttgtcagtgacaaagccggcgcgtgactccaggcgccgttcgcgatcgcccgtcgtcagcttattgctgtcgccggtgaccgtctgctggcgctcggtcaccaccggcgcggtgatgag

SEQ ID NO: 37442 - DNA, 834 bp, Glycine max
  Peptide Sequence Number=SeqID_154220
atggccctgctgatggacgaggtgttttcaccggagctgcggccgcaggtgcgcggcggcgtgccggctgaccgcgcaatccaactggacggggacatgaccggccgctgggggctgaaccgcggcgagcgcatccgctttcgcgtgaacctgctgcagggctccgccgggcgtcaggacagcaccatcggctggacgctgcgcgttattccctccgagataccgccgcttgaaacgctcgggctggagccggagctgatggacaacctgctgccggcaaagggcgtggggctgtggggcgggatcaccggctcgggcaaaagcacgtcgctggcctcaacctaccgccactgcctggacacggaccccgaccgtaaggtcacgaccaaagaagacccgatcgagttcatcctggggcgcccgggcgacgtgctgccgccgctgcagtcgcaggtgggtaaagacattcccgactttgcgaccggcatccgcgctgacctccggcgcgcaccgtcggtcatgggcgtgggggagatgcgcgaccttgagaccatcgaggctggcatacgcgccggtcagctcggtcatctgctgctctccaccacgcacatccactcgcctggcgaggtctttgcgcgtctcatcaacgaattcccgcacgaaagccgcgacgccatggcgttatcgctgctgggcgtgctgcagtacgtggtggtacagacgctgctgcgcaccaccgacgggaagcgcgtggcggtccgcgaattcatcctttttgactactacctgcgcgagaagcttgccggcatgccgtggtcgaagtgggggcagcat

SEQ ID NO: 37443 - DNA, 175 bp, Glycine max
  Peptide Sequence Number=SeqID_154221
gttttactctagtcgtccggagacatgcgagcccgacgatgcacgagattcttctttgctaggcgggaggcaatcaagttcgatggcgtggggaagtgtcgtggttgtcccactttatcgctttcaagacactgaagttttgatgacgcttctgatgtcttttctttctttctga

SEQ ID NO: 37444 - DNA, 1296 bp, Glycine max
  Peptide Sequence Number=SeqID_154222
atgtgtgtggaccgagggaaactcccgaataaaccccaccatccaaccttaccacacctatttgcatgtcattctctcttcagttttctcccactctttgtatatttttctttctcccttcttccttcacatccattgctctctcttctctcacccaacaaaaactcattccttttaagcacaatagaagaagaagaacaacaacaacaacagcagcatatctcagatatcatcatggccgttgaagcgcgccatctcaatctcttcccttctcaactcatcaccaaccggcaagtgatggattctggtgaggcgaatatgatgaacatgtacaacaacagcactccgattggtggttactcttcgtttctgccgttatccggcgccgtcacggagacggcgcttccgtcctcggttttcaaccattctctcgccaacgccgtcaaatccgaaagcggcgttacctacaacaacaacaacaacaacaacaacgtttctgtttctcccatgtcgagaaagcgttcccgagataataacaacaattacggttacaacaacaacaacaacgattcattttcgtttctcggccaagacgtttctctccagatccagcagcagcaactcgacatcgagcatttaatcatgcaacgcatggagaaggtgagaatggagattgatgagaagaggaagaggcaagcgaggaggatcattgaagcgattgaggttggagtgatgaagaagctgaagacgaaggaagaggagatagagaaaatcggaaaactgaattgggcgttggaagagaaagtgaagcatctctgcatggagaatcaggtgtggcgtaacatagcggaaaccaacgaagccacagcgaatgctctgcggtgtaatttagagcaggttctcgcgcagcgcggcggaatggcggcggaggaagacgtcggcggaggcgccaccgtgtgcggcggcgcggagatggacgacgccgagtcctgctgcgggagcaccgaggaggacggtttagaaaaggaaacggggggttggcgcacgttagcggggtgcgcaggggtgaaggataaggagggtggtggtaatgggaggttgtgcaggaactgtaggaaggaagagtctttgggacccgcggtggatctactagataatttccccagcagagaaactaggaagaggattggcgcgcgtggtgaatggcgcgtggggtcaacgagggtggggacagacagtgacaggtggaagattatggatcagttttggggagtgaaaaagaaaggtggtggttga

SEQ ID NO: 37445 - DNA, 387 bp, Glycine max
  Peptide Sequence Number=SeqID_154223
atgcatatttgggctttaggttcgagtccacaaaaacaaaaagcctacacgcttccgttctacactggcacaagtgaattagcaacccatgtgccaataaacaggcatgcggggactgcaagagaaacaaacgaaaacgctgtgatgtaccaacaattgttcatacaacacaacaagcaccaaagataccatttcataaaatggagaaataaaagcaagactacatttgacttcatggaagacaaggctgacctcatcattggaaattacagtgatggaaacttggtctcatccttaatggcttctaaacctcgagtcactcaggttgttttgtggtttcatagggctacttgtagaagcaagcttcatgatgatgaatcaacttga

SEQ ID NO: 37446 - DNA, 306 bp, Glycine max
  Peptide Sequence Number=SeqID_154224
atgtctgttgaatccattgcatccctcgctcaatattacgaccagccgctaaggtgcttcatgtttggagactttcagttagtaccaaccgtagaagaatttaaagggatcttgggatgcccgctaggaggaaggaagccgtatctgttttctgggttatacccctccatggcgagaatagccaaagtggtcaaagtcttgattcaagaattagaccgagtaaaaaaaaatagaaatggggtggttgggataccaaagaagcacttggaagagaaagcgaaagctttggctgatcaaggagaatga

SEQ ID NO: 37447 - DNA, 402 bp, Glycine max
  Peptide Sequence Number=SeqID_154225
atggcgctcagagacatattatggtcattctgcgcctttccgtcctgggtcgatcgtgtccgatggcacgcagagacaaattatggtcattctgcacccctttgtcatctagaggcggcgagcccgatgacattcggagacaaactatggtcattccgcacaccttttcaccattcagaggcgatcgtgtccgatgagacgatcatgctcgatgacatgcagagacaaattatggtcatccgcacgcttttgctatctgagcagcgagtcgagtggtgggcggagacaaattatggtcattccgcacaccttttcgccatccaaaggcgatcgtgtccgatggcacgcagagacaaaatatggtcattctgcgcctttccatccaggcccgatcgtgtctga

SEQ ID NO: 37448 - DNA, 2034 bp, Glycine max
  Peptide Sequence Number=SeqID_154226
atgtcggcaacactggatggcgagcgcctggcacgcttcctcgacgcgccgcggctgagcagcgagggccgcagctacccggtcgcgatcagccatttcccggcgcgccgcgatgaggcgctggaactgcaggtgcgccgctcggtgcagcaggccttggccgaacaccccggtgacctgctggtgttcctgcccggccagcgcgaaatcgcgcgcgtgcaggccgggctgcaggaatcgctggacggcaacgtcgaagtgctggccctgcacggtgaactgccggtggagcagcaggcgcgcgtgctgcaggcggccagcgatggtcgccgccgcgtggtgctggccaccaatgtcgccgaatcctcggtgaccctgcccggcgtgcgcgtggtgatcgacagcggccaggcgcgcgagccgcgctacgaccccaacagcggcttcacccggctggacgtggtggccatcgcgcaggcgtcggccgaccagcgcgcgggccgcgccggtcgcgtggccgagggcgtggcctggcggctgtggccgcagtcgcagcggctggagccgcagcgccgcgccgagatcgaccaggtggaactggcaggactggcactggaactggcggcctggggcagcagcgacctgcgcttcctcgacccgccaccggccggcccgatgggcgcggcacgcgaactgctgcagcgattgggcgcgctgtccagcagtggcgcgatcaccgcacttggccggcgcgtgctggcgttgggcacgcatccgcggatggcggcgatgctgctggcggcgcccgatgcacgtgcgcaggcgctggccgctgatctggccgccctgctggaggcgcgcgacccattgcgccagggcggtgacgcgctggcggcacgctggcgcgcactggccgcgttccgcaatggccgcgcaccgggtgacgccaaccgcagcggtctggccgccatcgatgcggccgccaagcagtggcgacgtcgcctgcgctgtgatgccgcgccgcccgccagcatcgaggcccacgaactgggtgacctgctcgcacatgccttccccgaccggatcggtttccagcatcccagcgatccattgcgctacctgctggccaatggtcgcagcgcgcgcctgcacgaactgagcgacctgcgtggcgaaccgtggctggtggccagcgagcttcgcttcgaggcacgcgatgcgctgctgctgcgtgccgcaccggtggacgaaggccagctgcgcaaggcgtggccggagcgcttcgtcaccgaagatgtggtccgctgggacagcgagcgccgcgccctggtggccctgcgcgagacccgtttcgaccgcatcgtactggacagccgctcggccggccgggtcgatccgcagcacgccgcgcaggcgctgaccgacgcggtggccgagctcggcctgcaggcgctgccatggaccgaaggcctgcgccagtggcaggcacgggtggaatcactgcggcgctggatgccggagttggatctgcccgactgcagcgacgcggccctgctggccaaccgtgcgcagtggctgcagcccgcgttcgccggcaagagccgtctggatgcgctggacgagtccagcttcggcgaggcgctgaagtcgccgctggagtggtcacagcggcagctggtcgaacgccatgcaccgacccgcatcaccgtgccgtccggactggagcggccgatcacctacgagttggacagcgaaagtggcgagccgttgccaccggtgctggcggtgaagctgcaggaactgttcggcctggctgatacgccgcgcatcgccgatgggcgcgtgccgctgaccctgcacctgctgtcgcccggtggccggccgctgcaggtcacccaggacctgcgcaacttctgggaaaacacctacgccgaagtgaaaaaggagatgaagggccgctacccgcgccatccgtggccggatgacccgtggacggccacggccacgcaccgggccaagccacgcgggacctga

SEQ ID NO: 37449 - DNA, 977 bp, Glycine max
  Peptide Sequence Number=SeqID_154227
gatgcatcgacggcacagtggtgaatgtcaatggtgtgaactacaccgtaacagcagctgacctgaccaacggcttcatcaccgcagcgattcctgtgacaggcgaaggcccagtcgcgatccatgccgaggcagttgatgcgcaaggtaacgtggatgttgcagatgcagacgtcaccgtcactgtcgataccttaccggcagacctgatcggagcgatcacgatccctgaagacttaaatggcgacggaatcctgaatgcagacgagctaggcacagatggcagcttcaatgcacaagtggcgttgggaccagatgcaatcgacggcacagtggtgaatgtcaatggtgtgaactacaccgtgactgcagctgacctgaccaacggcttcatcaccgcagcgattcctgtgacaggtgaaggcccagtcgcgatccatgccgaggcagttgatgcgcaaggtaacgtggatgttgcagatgcagacgtcaccgtcactgtcgataccttaccggcagacctgatcggagcgatcacgatccctgaagacttaaatggcgacggaatcctgaatgcagacgagctaggtacagatggcaccttcaatgcacaagtggcgttgggaccagatgcaatcgatggcacagtggtaaatgttaacggtacaaactacaccgtgactgcagctgatcttacaaatggctttatcacagcaactcttgcggcaacagcggcagatcctgtgactggtcagattgtgattcacgctgaggctgtagatgcgcaaggtaacgtagatgttgcagatgcagacgtgaccttaaccatcgacaccactccacaagacctgattacagcaattacggttcctgaagacttaaatggcgacggtatcttaaacgctgcggaacttggtacagacggtactttcaatgcacaagtggcgttgggaccagatgcaatcgatggcacagtg

SEQ ID NO: 37450 - DNA, 297 bp, Glycine max
  Peptide Sequence Number=SeqID_154228
atggctccattcttattcttgatggtgttgaagggcttagccgacttggtgagacaagctttggctagtgggaagctgaaagggatccaaattgtggcctccggtcttaaagttaacttctataagagcaatcttattggaattaatttggagtataacttagtggataggaataaagaacatcaaaattttcaatatggctttactgtcaaaatggaaatggaggcaatggtttgcctggcaagtgcccttggtggaagatttcctataaaagatgcacttggtcatgttacatga

SEQ ID NO: 37451 - DNA, 467 bp, Glycine max
  Peptide Sequence Number=SeqID_154229
aggatacatcctttgtggtacaagtagagggtacatctacttgggttgttgtaactgagaacaagggagggtacatctcttgtggatcagttcaagtggagggtacatccacttggttgttcaaagagaacaagggaggatacatcccttgtggatctttgcttgtaaaggcttttacaaggtttgaaaagaaatctcaaggaccgcaggtcgcttggggactagatgcagagtacggatgcgcacgtgcaaacactttcgatggtgacctagggtttcaggtacacaatgtgggtgaggttcagggtttgaggtacaccatatgggtgaggttcaaggagacaaggtcaaaaaccgtcgttgacttctttgtccttaattacaactttgacaccaccagacattctaagacggttatttataaccaccttagaatgtacgacgtgaaaaataatttttccccctaa

SEQ ID NO: 37452 - DNA, 360 bp, Glycine max
  Peptide Sequence Number=SeqID_154230
atggctgggaaaagcaacgaaaagaagggaggaagaagagggagagcgtgcgtggtggttttgggagacattggacgaagccctcgaatgcagtaccacgctctttcactcgccaatcaggcttccctggaggttgacattgttgcatatggaggttcagagccccatactgcacttcttgccaacccatctattcatatttacataatgagttggaactttctcaaattttcagaagcagtggttaacagccagtcaaagcttaccaaagatacttcgaccaataatgctattgttgaagccattggttcaattttgcatgcttctttggttcctttgtgtaaaaataccatctcctga

SEQ ID NO: 37453 - DNA, 234 bp, Glycine max
  Peptide Sequence Number=SeqID_154231
atggtgaaaggggaaaggaatgcaaatgggttgaaagggatacttgactatggctgggaagaagatccgagtcaagttgaaaagaaaatatactctttctttaaagagcggtttgaagagcaaagtgggaggagacctaaatttgatggcaacccatttagtcatataacggtggaggacaatgtcaagttgtgtattccatttgaggagttggagattaaagaggctatttag

SEQ ID NO: 37454 - DNA, 153 bp, Glycine max
  Peptide Sequence Number=SeqID_154232
atggagatgagaaaccaaccttgtatgaagagagtgtgtgatctgaatcaagcgagaacaaaggtcgtagccattatgagagtatgcaatctgaacaagggagtgagaacgagggtcgcaagggagagtgtgtgggtggagaggaatgagtga

SEQ ID NO: 37455 - DNA, 1428 bp, Glycine max
  Peptide Sequence Number=SeqID_154233
atgatgagtaggctttggggtgagaatttctttgactctgctaccagaaagtggactaacaagcacaccggggtaaacttgaagtcagaggaaaaggagttgacaggaaaggctttgatgaagcatgttatgcagagttgggcaccggcaagcagcgcccttctggagatgatgatatatcaccttccctctcctgccagggctcagcagtatcgtgtggagaatttgtatgagggtccccttgatgatcaatatgctactgctatcagaaactgtgatcctgaaggtcctctgatgctctatgtctcaaagatgattccagcatctgataaagtagctatggtgggtttggaccacttcatcaccaataatgctacattgacaaacgagaaagaagttgatgcacaccccattcgagctatgaagttttctgtctctccagtggtaagtgttgctgttacaaccagggttccatctgatcttcctaaacttgaggagggcctaaaacgtttagcaaagtcaaaccctatggtggtctgcacactgccagagacaggagagcatataatatctgctgctggtaagcttcatcttgaaatctgcttgaaggacttgcaggatgattttatgaatggagcagagatttcaatatctgatcctattctctctttccgtgagactgttttagagaggtcttgccatacagtgatgagcaagtcacctaacaaacacaaccgtctgtacatggaagcaaggcccatggaggctggacttgcagaggctattgatgatgaaaagattggaccaggggttgaccccaaaaataggtctaaaatattgtcagaagagcttggttgggacaaggatctggccttggccccgatggtaaaggacccaacatggtggtggatacttgcaagggcatacagtacctcaatgaaatcaaagactcagttgttgctgggtttgagggagcatcaactggaggtccaatggctgagaggtggtcagatcatttcaactgctagaagagcctgctatgcagccatgctgacagcaaaaccaagacttcttgaacctgtgtatctggtggaaatacaggcacctgaacaggctcttggtggtgtatacagtgttcttaaccagaaaagagggcatgtgtttgaggaaagccagaggcctggcaccccactttacaatgtcaaggcatattttcctgttattgagtcatctaaattcaatgaatcactaagggctaaaactgggagaaaggctttcccccagttagtatttgaccattgggatatggtgccatctgatccactagaacctggcactcctgctgctgctcttgttgcgaagataagaaggaagaaaagctttgatgtagaaatgaggcctttctttgagtttgaggacagactttga

SEQ ID NO: 37456 - DNA, 527 bp, Glycine max
  Peptide Sequence Number=SeqID_154234
ggaggttggatgactctggtgagattgctctagaatcaacaacgacaatgggtagccatgaaaagttgagtgtggatacatttttaagcaccactgacaaggagacacaggcattaaatgctaatagaagagagaacaaaattttgggaggaagtaaccaatcacaagaaaggggggaattcttcaaggagaacatgccaaaagaaaatcaaccatcacagtctgagaatcaacatgtggtgaccaacgagggtcatatgggacaagataatggagaagatatttgtaagaaaggagcaactaagaagttggaagtcaacaaaaaggaacttgtgggcctacttactaagggcttggaggagactgcttttgagaaagaaaaagaagggcagatgggtgacacaaacttaggccttattgagaaggacatgatcaatatggttgcctatggggaagttgacacggagaggaaggacaatggcaaagcaaagctaatagaaaaggagtacaacaaccaagggatgtga

SEQ ID NO: 37457 - DNA, 252 bp, Glycine max
  Peptide Sequence Number=SeqID_154235
atggagtgggtagggtacaaactaaccataggtctattggaggagtacacatcacttttagtgaactataaggatgtcaggctgaagctcaatgatgtggaaaagaaaaaccgtgacagcatttttgagttgatacttcaggttgataacgaagattgtattacctattttggtttatgtgaagcacttaaacagtgcaccatcacacttgacaagaactattacctatacataaatgaagaacatatctaa

SEQ ID NO: 37458 - DNA, 369 bp, Glycine max
  Peptide Sequence Number=SeqID_154236
atggatgagaagacaaagaaaaaactggaggaagctgctcaatccggaagcattgaggtcgtgattgatcctcaatctcccatcaggcgacacgtgaagtggaagatggcccgcaccaagaaaactggtcagatgacgtttgaggcagcaaaggaaattgctgagaagattgtttcctttgtcccctatggacgccaggatgtcctgactgctgccattgggcgaccagaacaccctggtcatgtgcgtgttgctggagccggtgtgaccatcaaacaatactttggattggctccatggaccttccgcacttcttcctcaatggctcccgaagaactagagcagctaactcaacaaatcagggactag

SEQ ID NO: 37459 - DNA, 2658 bp, Glycine max
  Peptide Sequence Number=SeqID_154237
atggtgatctttggtggctcacttgcttacaccacttctctctttcaatccctttatctgttggatagagcttcttgccttgtgttctacgttctgcattcttctcagcccgtggttattgtttctgtggctgatttagcgtgtttggttcagaaacaaggacctgtcatcaagatggtgaagttcacaactcacaggcttcggcacataatggactgcaaacacaatattcgtaacatgtctgttattgcacacgtcaatcatggaaagtctaccctcactgattctcttgtggctgcttctggtaatatcatagcacaagagggtgaagctgagcgtggcaacactgtcaaatcctctggtatctctctctactatgcgatgccagagggtgatttgaagaatttcaaaggggaacgtgaagggaatgagttccttataaatctcattgactcacctgggcatgtggacttctcatctgaggtctcaaccgcacttcgcatcaccgatggagcacttgtggtggtggattgtgttgagggtgtctgtgcccagaccgaaactgtgctgagacaagcccttggagaaagggttaagcctgttttggctcttaacaagatggataggtgctttcttgagctcaatcttgatccagaggaggcatacctaacactccaaagggttgttgagagtgtgaatgtaatcgtgggtaactatgaagatgctctacttggagatgttaaggtgtaccctgagaagggaacggttgccttttccgctggcttgcatggatggggctttacactcaccaactttgccaagatgtatgcttccaagtttggagttgatgaggccaagatgatgagtaggctttggggtgagaatttctttgactctgctaccaaaaagtggaccaacaggcacactggggcttctacttgcaagcgtggctttgttcggttttgttatgaaccaatcaagcaggttattgaactctgcatgaatgaccagaaggataagttgtgccccttgttgcaaaagcttgggttgaacttgaagttcgagaaggagttgacagggaaggctttgatgaagtgtgttatgcaaagttggctcccagcaagtagtgccattctggagatgatgatatttcaccttccatctccggctagtgctcagaaatatagagttgagaatttgtatgagggtccccttgatgacccttatgcttctgctatcagaaattgtgaccctgaagggcccctaatgctttatgtgtcaaagatgattcctacatctgataagggaaggttttatgcttttggccgagtcttctctgggaaggtgtcaactaatatgaaggctagaattatggggccaaattttgttcctggggagaagaaagacctgtatgtgaagagtgttcaggggacttcaatttggatggggaagaaatatgaaacagttgaggatgttccttgtggaaacacagttgccttggctggtttggaccatttcatcaccaagaatgctactataacaaatgagacagaaattgaagcacaccccattagagctatgaagttttctgtgtcaccattggtaagtgtagctgttaactgcaatgctgcatcagatcttcctaagcttgttgagggcctaaaacgtttggcaaagtcagaccccatcatgatgtgcacaatttcagaaactggagaacacatcataggtgctactggtgagctgcatcttgaaacatgcgtaaaagacttgaaggacgattttatgaatgggattgagatttcaatatctgaccctattgtctccttcaaggagacagtgctggagaagtcttgccacactgtgatgagcaaatcacctaacaaacacaaccgtttgtacatggaagcgaggccaatggaggaagggcttgtggaggccattgagagaggcaagattggtccaaagaataacaacaaaatggtgtgtgaagagtttggttgggacaaggatctagccaagagaatatggtgttttggccctgataccattggacccaacatgatggtggatgcatgtaagggagttcagtacctcaatgaaatcaaggaggctgttcttgctggctttcagatagcatcaagagaaggtccactagcagaagagaacttgagaggggtatgctttgatctttgtgatgttgtacttcatgctgatacaatacataggggaggtggccaaatcattccaactgctagaagggctttctatgctgccatactttcagctaagccaagactacttgagcctgtgtatgtgatggaaatacaagcacatgaaaaggctcttggtggcatcaatagtgttgttaacaagaaaagagggcatgtgtttgaggaaattcagaggcctggcaccccattttacaatgtcaaggcatatataccagtgattgagtcattcaaattcagtgaaacactgaggactcaaattggagagcaggctttcccacagatggtgtttgatcactgggatatggtgcagtctgatccactggaacctggaacaccagcttctgcatgtgttgctgacattcggaagaagaaagggttgaatgaacaagttatgcctttgtgtgtgttcgaggacatgctttga

SEQ ID NO: 37460 - DNA, 354 bp, Glycine max
  Peptide Sequence Number=SeqID_154238
atggctacgccaagcattgagaatctgaatattaacgaagatgacccagttctcaatggaggcctatggagttttgacaaaaacatgtccatatttggagtcattgaagaaggaaaagacccaacaactatcccattattctacgtcccttttttgattcaaatgcataacctaccggtggagtttatgtctcaaaaggttgaagaaagcctcagaaattacactatccagttcttggagtatgatgagaagaacaacgtcaatttcttgtgccttttcatgcgcatcaaggtgcttctaaacattcaaaagcctcttacgtacaaaaatcaagaaaccacgaggagatcttaa

SEQ ID NO: 37461 - DNA, 894 bp, Glycine max
  Peptide Sequence Number=SeqID_154239
atggtttataaatacccttttagcattattgagggtgaaggttggatgtgggctttccaatatgcaaatcccgactttcaaaaagtgtctgctctgaggagaggaattgatgtatcagagaccatatttaagtgcttggaggtgtgggggattgaagaaaaggtgttttctgtgtcggttgacaatgtttcttacaatgactcatgttttaagaatttgaaagagaacttatcacttgatacaaaattagttttgaatggagatttatttcatgttaaatgttgtgcacacatattgaactggctggtacaagataggcttggtaagataaaagacataattcaaaatgttcgtgaaagtgtgaagtatattaaccataatgatgcgagattgaaggccttcagtgatgttgttgaacaaaagcgtctaaaagaaagaaagctcatccttgattgtccaactaggtgcaagtttcgtgtgattggcattttcttccctttgttggacaagcttgaaggaattgctaaggagaatgtggagaaggtacaaagtgtttttcaacaattatatgatgggtatgtggctttaagaaatgaagagtcatcctcaaatgaaaggaatgttggtggcataaactccttaactatccatctgccttatacattttctatgactaggtttgatcaattaatgagtcttgtgcatgaaaatgaagcagtcccaccaatgaaatcagaactagatgcttatcttgaggagaaaaatacttatatctctaataatgaaaactcctcttgtagtgccttggagtgcgctggaggtagagaaattgatgagtatcgttctagattgaacgaagaatctattgaagctctcatatgcagtggggattga

SEQ ID NO: 37462 - DNA, 141 bp, Glycine max
  Peptide Sequence Number=SeqID_154240
atgtctgagagtgtggtgggaaagtcaggagaggcaagggatggctgtagcttcgagtcatcatcgatgatgaacaaatcaaggaccattggaaaagaagtaggtgttggtggtgggggagtgcgaggaccccgtcagtga

SEQ ID NO: 37463 - DNA, 1572 bp, Glycine max
  Peptide Sequence Number=SeqID_154241
atgcaacaagttcttgccacaattcaaggtttgaagctcagtaaatatcttcatgaagaacacgttccaaagaaatttgagtccaaagaatatgaagaagttggatcaattactcgttgtctggctccttgcatcgatatcagcaccaatcctcacaaagatggttggtttggagcaatcatggcagatttggaaaagatttcaagtctattatgcgtctcagactcgtgcgaaggttttgttcctcaaaatactcatcccatgacaaccagagccaaacctggtgtctttaaactgaaaacttatgcttcttacaaggaaggaagctatgatcacactattgagccacatattgtaaaggaagcaatggccaagcctgaatggctcaaagctatgaaagaggaacatgacgcacttatccaaaatgatacatggtccttagtggatccacctcctggttgtaagcctataggctgcaaatgggtgtttaaaagcaagtttaatgcagatggaagttttcaaaggcacaaggccagggtggtagcaaaagggtatcatcaaagagaggggtttaattttaaagaaacctttagtccagtgattaagccagcaacgattagaactgttatgtcccttgtggtttctcagcagtggcctatccatcaagtggatatcaacaatgcctttttgcatggaggtcttcaagaaactgtatatatgactcaaccaccaagctttgtttcatccgacaaacacgaagtatgcaaactgctcaaagctctttatggcttgaaacaggcccccaggtcttggtttcacaaactcagtttgactttgaggtccttgagatttaattcagccaagagtgatacttctcttttcatgcgatttacacctacctctaaaacctatgtgttggtgtatgttgatgatataatcatcacccgctcttcttcttctgaaatcacctctcttatttctcatcttaacaacaagttttctttgatggacttaggtcctcttcattattttcttggcattgaggttaagcattattctgatggtggtattctattgtctcaatcaaaatacataatagatctacttcataaaaccaatttgttagactctaaatctcagccaactcccatggtttctggtttaaagcttactattgatggttctttttcagttcaggatcctactcactatcgaagcattgtcagagctcttcaatacatcattgtgataaggcctgaaatttcattctccgttaataaggtctgtcaatttatgcatagaccacaagagcatcattggagggcagtgaaacggattttaagatatctccaaggttcaattacatatggcttgcacatcaaaccttcgccgcagttgcatatcatgggtttttgtgactcagattggggttcagaccctgatgatagaaagtctaccacaagttactgtgtgtatcttggaccaaatcttgtatcatggtcttctaggaagcaagttgttgtttctcgaagtagcactgaggctgagtatagaacttgtttctcgaagtag

SEQ ID NO: 37464 - DNA, 411 bp, Glycine max
  Peptide Sequence Number=SeqID_154242
atgccaatctccccctacggaaatatcagttggtctgtgtcgttccgacatagggatcgcacccacaagacacccagtggacccgaagaagtccaacagggtcctagggtttccagctctgattacgggcctctggatcgcacccgcaagacattcagtggacccgaagaagtccaacagggtcctagggtttccagctctaattacgggcctctgtcagttctacggagtgcccgtcaaccccagcaagttcatcaggcccctattaattgggctttcatcaagaagtactgcgcccccaggcaggcgcagggcgagacaccacaacagcctagggatggccggcaacaggcaacaaacgcactgccaccccctctagagttcacctcaactcatccacgaaaaggttag

SEQ ID NO: 37465 - DNA, 312 bp, Glycine max
  Peptide Sequence Number=SeqID_154243
atggtggttgttggacccagagttgcagattttgtcactgaaatttctattattgttcaaaagcatgtccatttcaacattaacaagtggaagcatgttccagaagttgcaaaagaaaagatagttacaaaagtgctggatagttttgatgttgatggtgctcatccagaaaacactaaagatgttattcttttcatagtaggaagattatacccaaatcatagatatgaaatgagcacaataaatcaaagcaaattactaatcatagatgtggaaggaattcatttcaagctattagctttgaagcggtaa

SEQ ID NO: 37466 - DNA, 276 bp, Glycine max
  Peptide Sequence Number=SeqID_154244
atgttaatgataatactatcaacatcggtactttcaacatcggttcaaaaatcgaagttgaaagtcataaataaccgatgtagaaaatatgaaaatgagggattaaaaaaaagatgcaaaaataaaaaatatttgaaaaaaggtcaagcccaagacgtgctcagcgcaaaaacaagcattggtgctaagcgaggaagaggcgcgctaagcgcgaatactggcacccgagctaagcgagcatcacgcactaagtgcgaatacaagcacccacgctaa

SEQ ID NO: 37467 - DNA, 336 bp, Glycine max
  misc_feature (326)..(326): n is a, c, g, or t
  Peptide Sequence Number=SeqID_154245
atgaagacagaacaactcgctttgcgcacggctcgtgctaagcgagactgtagtgctaagcctagagactcaagattaggcgctaagtgcatggcctcaccgaaacgcctagcattgcccacacaaggaggggaatccacttgggattcctctcgcttcacttctgagacagcttggcacaaatatcaacacaatgttcacctccgaaacattctaccagataggaacatagagctctccgcaagcatgtttgatgaattttacggagatctccaacggagacagtggcactgggtactcaccaaactcccggagaagcagattancattgctctg

SEQ ID NO: 37468 - DNA, 492 bp, Glycine max
  Peptide Sequence Number=SeqID_154246
cattatgcacacccgaaggagggttcgtccttgaacgctgacgaagccctatggaagctgttgtggaaggatttcactacgctcgctcaaacatggagcgcactttcttactttaaccttgcccttatctctcacacttctgatcttaatgttgacagggcaagggctgatatatggcttggtgatgaagatggacatggacttgagcaacttcatttcagggccccatcgtgcctgagccagagccgcaacaccaaacgccccgcctccagcacaacctcctccaccacctatcgcacgccgccagccgccatccacctcagtctcgatggacctgcatactcagatactttagtccatctaccagggccagcaggtcattgtccagggtctttacagactctctgtgcacctggggatggacccaccactaacgaccccagaggccttcatccaacaggttgcttggctaggagtccagccctctactga

SEQ ID NO: 37469 - DNA, 573 bp, Glycine max
  Peptide Sequence Number=SeqID_154247
atggcattgcagcgagaccttgcggcttcgaaggaggagcttcattgcatgaatatggccattggtgacattcgctccgaccatgagatgcattcgagggagcttgttgacaaaggcatgaatatggaggctgacctcagggcaaatgagcccttgaagaatgaattaattcaactgcgagctgaggttcagaaacttaacagtctcaaacaagatctcacaacgaaggttcagacacttactcaagatgtttcaattttacaagcaaagaatcaacaaattcctatgatgagggctgagattgatggcctgtaccaagagctaatacgtgccagaaccatggtggattatgaaaagaaggcaaacatagagttcatggaacagaggcagtcaatggagaaaaatttggtttccatgacccgggaagttgagaaattacgtgccgagcttgctagtgttgatggaagacattgggctgttggtatgtcagataactccttgtgctatctaagattgataaatgataactatgacagactaatctttctctatgcctcatggcctgaaggctga

SEQ ID NO: 37470 - DNA, 195 bp, Glycine max
  Peptide Sequence Number=SeqID_154248
atgggctcaaaaatctaccctaaggttcatgagaaccctagggccttctttagtagctctagcccaaggctcttggagtcttctatcgaatacccttggggggtaggattgcatcatagaccatctgagattagggtgattcctccatccgagattgtatctattgctggagagcataagcttcagactgcttaa

SEQ ID NO: 37471 - DNA, 657 bp, Glycine max
  Peptide Sequence Number=SeqID_154249
gaacagatcaaggccaacatggaggccatgaaagagaaaatgaccacaatgatggaagccatgatgagtatgagaaaaatgatggaggtcaacacggctatagtcgttgtcgcaagtaccgccactgacgtggacccaactcaaccatcagacttcaatcaagtaaatcatccagtatcggatatggtccctcaacctatgggggagacacatgaagtacctcgagaccatgctctagccgacttcgagccttacctcggatatgccactgaggggcagacattttgtggcatacccttaccaaacactttggggggccctcagtatcgcccacaaccacaacccttacattttgcggtgggaagactgcctcctgccatggtggaaagggaaaaatttgatcatataaaagaaaggctgcgggagattgaaggagatggaaattatgcctttgctgacatggtagagttgtgcctagcgcccgatgtggtcattcctccgaagttcaaggtgccgaatttcgataagtacaaggggactacttgccctaataatcacctaaagatgtactgcaggaaattaggggcatacgtgaaggatgaaaaactcttgatgcatttttttcaagagagtctggctagggcggctatcgcttag

SEQ ID NO: 37472 - DNA, 261 bp, Glycine max
  Peptide Sequence Number=SeqID_154250
atggtgatcacaagaacagatgagttggaggcaggaactgtttccagttatgacaggataagtgaacttaaggcatttgatgattcaaaggctggtgtccaaggactggtagaaaatggtgtgacaaaagttccacgtatgttctattgtgaacatactaatgacagtaatggctcaaccagtgaaccaaattcaaagttcagtattcccaccattgtgaaccaaattcaaagttcagtattcccaccattgagctcatag

SEQ ID NO: 37473 - DNA, 483 bp, Glycine max
  Peptide Sequence Number=SeqID_154251
gtcataaaccatggaattccaagtgatgttttggatgagatgatcaaaggtactagcaggtttcaccaacaagacgcaaaggctaggaaagagtactacacccgtgatccgaacagaaaagttgtttatgtttccaattatagtctataccatgatcctgctgctacttggagggacactctttgttgtgtgatgacacctcatccaccagaagcaggagaattgtcagcacaacagcttcttactaatgacaagttcatcagtgttaagcacagagttttagcaaatcatataggtccaagaatttctgttgcatcgttgtttagaaaagatggtgatgactcactagtctatggtccaaacaaggagctgttatctgaagtaaatccaccactatacagagacgtttctttaaaagagtacttgacatattattatgcaaagggcattggaacttctggaccatcacacttcaagttgtga

SEQ ID NO: 37474 - DNA, 261 bp, Glycine max
  Peptide Sequence Number=SeqID_154252
atgagtgaggtaaaggatgtcacagtgacgaaattgatactagtgaccaaggtcacttgtgctggtcaattttttggtgaggtttatgccttagacatggagacattggcatgtaagaggttggaagataaggtggattccggtggccatctcgagcctcgagggtggtgtgcttttgctagtgctcatcgtggtggccacgagggatttggtgaattgattggtgctgagtatgatatggctgcatatgatggattctaa

SEQ ID NO: 37475 - DNA, 630 bp, Glycine max
  Peptide Sequence Number=SeqID_154253
atgctggtccatttcatcaatggatttcatcctccacaaccacaatttaagcaggaatggaggacggtgcatgtggatggcttttctagtcgacatggaagtggagccggagttatcttagaaagacccaatggcatagccctggcacaatctttatgcttcaggttcaaagcctcatgtaatcaggaaaaatacaaggctttgtcgataggactaaggcttgccagagaggacctttctgcacggtccccaaggcaaaggaaattcctgctagtggttgttgaccttttcacaaagtgggtcaaagctgaaccttttgcaagcatcgcaactcaaaccaaccgttataaaattcctttggaagaatgtgtagaagcaaagcttcatgatgatgacaaaggtgatgacaaaaagctcaaaggtcaatcaaagaatgagttcaagatgttcaagatagaatcaagaacacttcaagattcaagaggaaagttgaattcaagaatcaagaatcaagattcaagagatcaaggttcaagactcaagattcaagaatcaagaaaaggctattcaagaatcaagaaaaagcttaatcaagataagtatgaaaaggttttttcaaaaactgagtag

SEQ ID NO: 37476 - DNA, 315 bp, Glycine max
  Peptide Sequence Number=SeqID_154254
atgccaccggactcacaggtcacaatagcaaacgagactttttcgcggactcggtcggaagacgctgacatctccgggaaaggtgtagatgacgacgtgtggataaccataaggtgtgtccgcatgccaccggactcacaggtcacaattgcaaaaggtggggaggtcgacaaaagcggggcttttgctcctaggtatcctcaatttgtgatgaggaactcagacaaaagcggtgttctttcactaaaatgcgaacatgctttagtaaagaaacaaaacctccaactgattagagcaacatataatttttggtga

SEQ ID NO: 37477 - DNA, 399 bp, Glycine max
  Peptide Sequence Number=SeqID_154255
atggctagccttaggttatgcccccgcacaaagaaggaagccataaaagtcatgcactatgtggaggtcaggatgaaaataaaaaaagtggaggaactagacctcgatccaagaaccaacaatgacaaccaagtgaagccgctagaggaaacaccacattccgactcggtcctaagaaagggcaggtcacttggttgggaaaccaactttttgacgatgaccaaagctgtatccaacaggctatctgagaacacgttgccaagaattgattcagattttcattgccataaattagctatatgcaaaaatgcaaagcccaatgcacaaagaaagagaaagataagggaagaaagatctcgagcaataaagcaagaggttgccaagctgatggctgcttag

SEQ ID NO: 37478 - DNA, 183 bp, Glycine max
  Peptide Sequence Number=SeqID_154256
atggtgaagattgttggtaatctctggcatgctaggttagggcatcctaatgatcatatttgtggggaccttctcatattacctcatattttggttataaatattatgtctactgtttcaagtgctgcctctcctagttcaactcctactattaagaataatagttctaatgtaaatgtctga

SEQ ID NO: 37479 - DNA, 111 bp, Glycine max
  Peptide Sequence Number=SeqID_154257
atgtttgagtgtgagatcttcaatcttcttcgtgaactctttggttcaagcggttcacaaaatgacacagtagggttcacattttggacgatgaaggggaagagattgtaa

SEQ ID NO: 37480 - DNA, 1047 bp, Glycine max
  Peptide Sequence Number=SeqID_154258
atggtggccacaagcacaaatgagttggaggcaggaactgtttctaggtatgacaggaaaagtgaaatcaaggtattcgatgaatcaaaaactggggtccaaggactggtagaaaatggtgtgacaaaggttccacggatgttctattgtgaacactctaatctcagtgatggattaaccacagaatcaaattcaaacttcactatcccctccatagacctcactggcatcaatgatgaccctattttgagagatgctgttgtgggaaaagttagatatgcatgtgaaaagtggggcttctttcaggttacaaaccatggaattccaactcaagttttggatgagatgatcaaaggaactggcaggtttcatgaacaagatgccaaggtgaggaaagagtactacacccgtgatatgagcaggaaagttatttatctttccaactttagtctttatcaagatccatctgctgattggagggatacacttgcatttttttgggcgcctaattcacccaatgatgaagaattgcctgcagtttgtagagatattgtgcctgagtactcaacaaaagtaatggcacttgcttctactttgtttgagttactgtcagaggctcttggccttgatcgctttcaccttaaagaaatgggttgtgatgaagggcttcttcatctgtgtcactattacccagcatgccctgagccagaattaactatgggcactagcaggcacacagacggtaacttcatgacaatacttttgcaagaccaaatgggtggccttcaaattcttcatgaaaatcaatggattgatgtgcctgcagcacatggagctcttgtagtgaacattggagatcttctgcagagatttgaaagtttatggaacttgacacaatggcaaagttgtgccttggagaacggttggtcatgggttggaatttggaaacagtttctttgcatatgcaagagtaaagtcatgtacaatgaccctttctcatacgttcgcatagcaagaagtcttctggcaccaggatacattagttag

SEQ ID NO: 37481 - DNA, 408 bp, Glycine max
  Peptide Sequence Number=SeqID_154259
atgatcccatcaacccgatactttatggtgtatacctatgcagatgcggactatgctggatctgtagatgacagaagatccaccttcggatactacacttttcttggaggaaacttagtaactaggaggagcaaaaaagaaaacgttgttgcaaggtcaagtgcagatgcagaattttgggctatggccttaggaatttgtgaactcctatggatgaaaataattctagatgacctaaagattgagtggaatggacctatgaagctatactgtgataacaagtcagcaataaacattgcacataatctagtgcaacatgaaaggaccaagcatgttgaagtagacaatcacttcataaaggaaaagttggatagtgggacaatttgtacatcattgcagatgttctaa

SEQ ID NO: 37482 - DNA, 1779 bp, Glycine max
  Peptide Sequence Number=SeqID_154260
atgatgaggggagcaaacaggggcatgctgatatcgagcaccggaaacagagctcccaagactaggagctctgataccattttgagaaaaggacggtcatcaaatctcggctaccagccttttggtagtcgtggaggtttccatagaggctgtagtggccacattgcagggcattccatagcccgtggtggcagaatgtatgttcagtgttcagatgctggattaatattcacttgctttacttgtgctcagtttgatattggttctcaagttgttggccagaaggacacgtcaaagaatgttctagacgtctggaaagagatattccacaagagaagaacaaaaaagacggaaagaaaatctcatagaggcaagtcctttgaatttgactccttgtactcccttgtttcaaaccgtggtgatagtaacttgattctggatggaattcatgaaaatgttttgcagctcaattatcatgacccagtaatgcagaaaactgtcaagtgcttcgacaatcttggagtttatgatctaatgcatcaatatataatgcatacacaacagatgcccctgtatgtatatttgcccctagtagcaattactgtacatcatatagtatctcaagttcagaaaccaaacattgagtggccaaaatcacatcagagatatcgtaccatgatgatggaaaagatggacattttgaatacctggcaccacaaaatcccaccgtatattgcaaggaacttatcagctagttcctttgttgaagacttaatttctccattattacatattttgtccccaccaactgtaagaccggtagcatttcaattactatcagataaggagcagaatgatcttgctcaattagttagcacaatggtatcatacactataacatataaaactttgaaatcagatattctgcctcaaacccagaggtgtgaagtagctgatggcttggcactgtctcttgttcctcctattagcgactttataaatttcaaggattatacttcaaaccattatgtgctttctgtagctatgaagcaggttttggttcatgagtccattagtgctacccaccaacacttccatctgttaaaccttattcctgcatccaccccatggccatgctgcagaaaatgttgtcttgggttttgcgggaaggtgctcgagatatttacccaagacaaagactcccaccataaagctttccatacccagttatctcctctatgtggctggattacagtccgtgctatgtcccccaagaagccgtcagccatgtcgacttcattatcaaataagggtctcctccatatgaaattccattcccagcctgcatctgaaatgcgatacaacctaggatattttatcattaatgatacatcatcaccagtccagcaatcctcccagaatctgaccttatcttcacatcctaccctccaagctatcttgttactagttgaaaagcataagattttacaagttggtaatgacaaagctggggccttcacaaatggagggcatgaagttattgagactggaactaacaacatcccattagccaataccagtcatgcaactgcagttgatttgaaaattaatgaaaatcaggctaatgttttatcatggcaattaaatgctaatccaacaacagtttcaccaaacttggattccaataaaatttcacgtgcagcagactgtgggaaactactaaacatgggaaatatgaaaaaaccatccagaagttcctcaagtttctttgataggtaa

SEQ ID NO: 37483 - DNA, 267 bp, Glycine max
  Peptide Sequence Number=SeqID_154261
atgaacttaatcattgttatcaaaagaaaagaacacgctttacggcacccttaccgaacccgtgctagagctagagtaatgggtgaagtagaggaggtgcaagagcagatgaagactgacatggaggccgcgaaagagcaaatggccacaatgatggaggccatgatgagcatgaagaagataatggaggtcaatgcagctgcaatagccgctaccagcaccattgctgaggtggacttgaccccccatatggcctcaaccaaataa

SEQ ID NO: 37484 - DNA, 891 bp, Glycine max
  Peptide Sequence Number=SeqID_154262
atgggatcaagtcaaaagccttcgcttgaaaagaggttttatcaagtcaaaatcaagagcttagaggtcaccagtttacgaaagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccaatgggaggaaggaagccatatcttttctctaggttctatccttccacgacaagagttgccaaggtagtgaaaatctcagcacaagagttggaccggggagtcctctttccaaatgtggatgggttggtggacctggcagcgatcgacgtttttctcgcctatcataaccacaaggaaagtccggttgtcgctatgctagccggcctatatgacaccttcgaccgaagatgcccgtctatccgctacaaggaaggaagaatcaagattctatcttcatgcgaaggatgtccaaatgttcccttgatgggaacaaggggttgtatcaattataatcccgttctcgccataagacagcttggctaccccatgagaggagcgccattagatgaaagcatcacgcctttcatcgcacggggttttagggaccacaacgcgaggtggctgagagtccgaacacaaggattggattggctcccaaatctaaagactgtgagggacgatgaggttaaagcttcggaagaaagtgatgaggtacaagccctaaaggcaaagcttgaaagagcccgagtagtcgaagagaagttcaagtccatagccatcaaa

SEQ ID NO: 37485 - DNA, 1080 bp, Glycine max
  Peptide Sequence Number=SeqID_154263
atgcgtggtgggctgtcctcgtcgtcatccagcattgccaggccgtcgaagcggttgcgtacctgtggatcggcaaagcgacgggccaatgcttcctggtcggctgccagcacgctgatcgcaaagcgggtggcgcgctggaaggtggacaggctctgcgcgtgcaacgccaggttccacagcaccagcggcggctgcaatgacaccggcacgaacgaattgatggtcaggccgatgggtttgccctgcgcatcgcgcgcgcagacgatggccacgccggtaggaaagtggccgagcagccgccgcagggcccgcggcggcatctcgactgacggcaccggggccggggcggggaaaacccccgcccacggcccggcgtacggcagtgtctcgccgctcatgaggccctggcctggcgaacgcaccgatgtagtccgggcgacggttctggtagtgcaggtagtaggcgtgttcccagacatccagtgcgaggatcggagtgttgccggacaggccgacggcttcacccatcagcgggctgtcctggttggcgctgctttccacctgcaggcggccatcgcgatcgctggtcagccaggcccaaccgctgccgaaacgggtctgcgcggccttggtgaaggcatccttgaaggcatcgaaaccgccgagatcgcggtcgatggccgctgccagttcatcatcgggtgcgccaccgctggtgctgagtacggtccagaacaggctgtggttggcgtggccaccgccgttgttgcggaccgcgccacgctgcgcctcgggcacggcatcgaggttggcgatcagcgcctcgatcggctgctcggcgatgccggcctgctcgatggcggtgttgaggttgttgacgtaggtctggtggtgcttgctgtggtggatctccatcgtgcgcgcatcgaagtgcggctcgagggcgtcataggcatagggaagcgggggaagcgagtacgacatcgaagcaatctccgtggggaaggccagagaggctggccgtggggagatcgttatcgcacctcaacattggttgaggtcaaggggaaggattga

SEQ ID NO: 37486 - DNA, 306 bp, Glycine max
  Peptide Sequence Number=SeqID_154264
atgggtgaaatagaggaggtgcaagagtggatgaaggccgacatgaaggtcatgaaagagcaaatgaccacaatgatggaggccatgatgagcatgaagaagataatggaggtcaatgcggctgcagttgccgctaccagcaccgttggtgaggtggacccgactctcctatctgacctcaaccaaataaatcatccaacctcggatatgataggtcagagaggcaaagagttgggaagtacggtcggcccccattttgtgcaagttcataacaagcatgtcttcccaccatattgtgatttttag

SEQ ID NO: 37487 - DNA, 246 bp, Glycine max
  Peptide Sequence Number=SeqID_154265
atgtgtccagtgataacaaccaagaagttatacccacttcttgcaatgaacccaaaagatgttggtcttttatgtccagtgatcaaccaagaagtaaatcctgcttcttgcaatgaacccaaggaatgttggtcccttgtgttcagtgtttgcaacgaagaagaccttctcttgaaaacagtcaccaagagtaggtctcttgaaaagctttttgtaagaatggaggagaggaagaaaatagaatag

SEQ ID NO: 37488 - DNA, 968 bp, Glycine max
  Peptide Sequence Number=SeqID_154266
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatctgagcctctgggcagtgccacctctgtcaggggcggttgcacctctctgccaaagctcgaagaccgagctcaagcggttgcaccgcctgacaggagaggttgcaccgcctggcagagctcgaaacttgagctttggcggtgctacctcttgacagaagaggttgcaccgcccagtctcgctcggaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 37489 - DNA, 438 bp, Glycine max
  Peptide Sequence Number=SeqID_154267
atgagtgagatagaggaagtgcaagagcagatgaaagccaacatgaaggccatgcaggaccaaatgatctccatgatggaggccatgttaagtatgagatggatgatggaggacaatgcggccgcagttgccgccaccagcgttgccgccgaggcggattcgactctcccatccgacatattctttcccatcgaaagaaagccttggccaaacacttgcaaaatttataaggattcttactttgtaaaaggatttttacaagatagtggaaatctcaagcgggttgcttggggactggacgtaggcacagggcatggccgaaccagaaatacaaccatagaagagccttgggaacaatggagtgaggaggaaaagaaagttagttcaatacaatttaaaagccaaaaatatcattatatctgcatcaggaatggatga

SEQ ID NO: 37490 - DNA, 222 bp, Glycine max
  Peptide Sequence Number=SeqID_154268
atggagagaagtcataacttcaacaatgggaagagatcccaagaagtttctcctacacttaaatgctataagtgtaatcaaccgaatgagaagaaaagctataaagaaagaagatccaagaaggcgtatattgcttgggatgacaatgactcatccgatggttcggagaaggagatcaaccttctatccaaggactatgaaagtgatgaaaacatctcttaa

SEQ ID NO: 37491 - DNA, 387 bp, Glycine max
  Peptide Sequence Number=SeqID_154269
atgggtgaagtagaggaggtgcaagagcagatgaagaccgacatggaggccatgaaagagcaaacggccacaatgatggaggtcatgttgagcatgaagaagataatggaggtcaatgcagctgcaatacccgctactagcaccatcgctgaggtggacctgaccctctatatggcctcaaccaaattaatcatccaacctcaaatacgtagatctggaagggaaaaagttggcaggtacgggcggccctcatttagtgcaaaaaacaagcacgccttcctgccatatggcttgcctcccaactatacaccacccaatgtggcgtacactcccagtgagaatgtcaataactacactttcatactcattaagagccgacaaccctaa

SEQ ID NO: 37492 - DNA, 337 bp, Glycine max
  Peptide Sequence Number=SeqID_154270
atgggggatcccatcagcaaactctccttccctgcatgtttgcattttagtggagaaaacaccgagactttttcaagtctcacaagttatccagaactacgtaggtctgagttcctcattagaggatacgtaggagcaagagcctcgcttttgtcgaccacaccgccttttgttgccatgacccaagagctggtagcccgcggagacaccttacggttatccgcacctcgtcattcagtgaccccaagtgtgattgacgagcagaggccaatgtggtcatctgcgccctttccggagatgtcagcattttccgatggagacttttcaagtctcacaa

SEQ ID NO: 37493 - DNA, 711 bp, Glycine max
  Peptide Sequence Number=SeqID_154271
atgggacagcaatcgttgatctacagcttcgtcgctcgcggcaccgtgatcctagcggagtacaccgagttcaccggaaacttcaccagcgtggcggcgcagtgcctccagaaactcccttcctccaacaacaagttcacttacaactgcgatggccacaccttcaactacctcgttgataacggattcacttactgtgtggttgctgttgagtctgctggacggcagattccaattgctttcctcgaacgaatcaaggaggattttaccaagaagtatgctggaggaaaagctgcaacagcggctgctcatagcctcaacagagagtttggacctaagttgaaggaggagatgcagtactgtgttgatcacccagaggaaattagcaagcttgctaaagtgaaagctcaggtttcagaagtcaaaggagttatgatggaaaatattgagaaggttcttgaccgtggggagaaaattgagcttttggtggataaaacagagaaccttcgctctcagatgtcatcagttaggcaagccttctattacactattgaagtattggctcaagatttcaggcagcagggaaccaagattaggagaaagatgtggttccaaaacatgaagataaagctaattgttctgggtatcataattgccttgattctcattattgttctttccgtttgtggtggcttcaactgtggtaaatga

SEQ ID NO: 37494 - DNA, 732 bp, Glycine max
  Peptide Sequence Number=SeqID_154272
atggacaatcatgagtggatgatgtatgatcactacttgatcatgaaaacttggactcctgagttcatggtggaatcagacacgattgacatagaccccaatacttttcaagctgatcgtggagaatttgttcgtgtatgtgttgagttggacttgagcaagccagttgttggaaaggaggaagaggtagaaaatacaatccctggcaagattgattcagaggataaagctcctctatccaacaaagttgtggatacttttccttataagaacgtgacaccttctcacaaggaagttgaaggccacatggggggcatatgggttttagccaagaagcaaaggaatttaactctctctctagtggaatccaataatcgggctattacttttcagatctctttgggtggctttaattggctttgctcgactgtctatgctagacccaacctagctgctagctataaactttgggagtaccttatgaggttcaaagcttctatttctatcccttggcttatgataggagacttcaatgaagttgcttttattttagaaatcagagccatcaacatggctaaaaagcttgatagagtgatggcatatcaaccttggggaaacatgtttccaagaatgtacgctataaacctcactcgctggatctttgagcttcaatggggtcctttaatggtgattttccaccatggagatgcagcggaagacaaaagaaaagag

SEQ ID NO: 37495 - DNA, 960 bp, Glycine max
  Peptide Sequence Number=SeqID_154273
atgaaatactgggtgaatgcagctgtatccagggagcttcaggcaataggcaatccacccaatgttctaaaaaatctcaggctttacttcccattcatcttcttgccaaaatatctggatctctttggaggggtacatcatattggaactgtggtaattagcattgtaccaacactcagcctgactcatcaaccatggacattgctttggcttgaaccctgtgaaacattgcaggctgatcttaggcttcaaagtagctatggactatttggaaagcttagtccaaagttagctgataaaaactcaatcattatcaacaacccctttagcagtaaaggggtgactaggagtgggaaaggggcatttttggtaggggctgcaatagaccctatggagacaaggctcaatacttgttcctttaacatgcattacaactgccacatacttcttatctgcctgagcctccagtcatcttgcaatgtttgcttggtactagtgaacgagctagttgtagccagcctttggggctgcatagcgtggtgggatgttaggatccaattgcaaggtatagggttaaagtgtggggttcgagatcttgatttttccataaaagtgataggtgctgaaataacacgtgataatgatggcctggcaatgagttcacgtaatgtgcacctttcacctgaagagagggaaaaggcactatcaataaataaatcattgttaagagctaaatcagcagcaggagatggtcaggtgcattgtgagaagttgacaaatttggtcatccaaagtgttactgatgctggtggaaggatcgattatgctgagattgttgatcaaaataatttggagaaagtggaacagatcaagagtcctgtcgtcttctgtgttgctgcatggtttggcaaagtcaggcttatagacaacatggaaatcaacttgtcaatgaatgtttga

SEQ ID NO: 37496 - DNA, 378 bp, Glycine max
  Peptide Sequence Number=SeqID_154274
atgatgttagatcacatgagccaacttggcaacccagacatagtatgtaagttatcatcagctggtgagagcctattgttatatcatgttgatggtgtactcccaacaatcatccagcttaaaatcataagtgtagaagcaaagcttcatggtgaatcaaagaacaactcaagtgaatcaagaacaattcaagagttcaagataagaatcaagaagaattcaagactcaagacgaaagttaagagtcaagaatcaagattcaaggttcaagatctcaaaaatcaagatcaagattcaagactcaagattcaagaatcaagagaaagcttaatcaagataagtataaaaagtttttctcaaaaattgagtagcacatga

SEQ ID NO: 37497 - DNA, 477 bp, Glycine max
  Peptide Sequence Number=SeqID_154275
atgacattgtaccttggtcacgcctgcgctatgacaatctgcaaagatgttggttgtatggttaacttaaatattatcctctcggttctcttgaatccgtggttaacccctttcaaccaaccctggctactgaggccatgggtgctggcagcttcacgctcaacatttcacgcgttaacggctctgtcgcaatcaacactggcatcgttcagggctcaattacgcagaccgtgttatccagtcgcaatttttggggtttctaaggttctcttgccgagggagattctcgggagaaatccgatagtttctgctaagcctcttgataatgctcctccaccggatgatgacgctttgtcaccagagaattcatcgggatttgatggacaaccctcacagctatcgtccccgccaggctttcgcgaagatgtgaggtctcatgctggtggttccattttctgctgtggggttttgttttaa

SEQ ID NO: 37498 - DNA, 1050 bp, Glycine max
  Peptide Sequence Number=SeqID_154276
atgtcaagggcggtggtttatatcctaatagccaccgccatattgttcttcatattccggtcccctttgaatcatgaggagtcaaagggtcgccttaatcgcaggtttgggtacaaactacttgagcgagccccaaagtttgaccctcttgtgacaaatatagagagagtggttgaaaacaaaatgtatcacgaacctgctcctcgtatgttgtccaatttggatagtaccgcatcagtcagtgatgctgtagagacttaccaatatcttacctcgggtggtaaattgaacacgacgttacgtttgatcattttgttccctttgttagatagagaaccgaaagatggggtgatcgattttaatgagttagaggcttggattagtcaacgagcaacagagagattagattatctcacgcaagctgagttggattccaaagacaagaacagggatttggccgtctcttttaaagagtatttacctcaattttctgaaatggatatagggaaaaaggaaatggggcatggcgaagcaggatggtggatggaaagatttgaagttgcagacattaatcacaatgggcttctgaacttcaccgaacttaaagattttttacaccccgaagatagcaaaaatcaagaaatgttgaaatggatgttgaaagatagactaaagcgcatggacaatgaaaatgatgggaaactaaacttcaatgaatttgaagaccatctatatagtacatatgaaagttatatggactttgaaactaatggaggacatgtgcattctccaaaagataaatttgttgagcttgatgtgaacaaagaccaatttttgtccccagaagaattgataccgatactttcttatctctaccctggagagctagcttatgctaaatatttcacgtgttacttaatgaatgaggctgatgatgatggagatggaaagttgacacttcaagagatgcttgatcatgaatttactttctacaacacagttcatgctgatggctaccaagaaagcgatgatgaccatgatgagctttga

SEQ ID NO: 37499 - DNA, 687 bp, Glycine max
  Peptide Sequence Number=SeqID_154277
atgacgccgtttggggcagcaatgccctctgttgtgttgccttttggtggaatgccttttgtttgggatcggaggcgcataaccatggattcggagttcccctacaaggcgttaatgagcacgcgtttttctccaagccctatcacactctggcttcgagttctacacccccgtccaagtcgccaccattcctctgctctgcaacttcaaggatgtcaccgtcaacgccaccaccagttccgacaaacccctaggttttgttgttcctctcgtcgagattctacgctactcctcttcttatcccaagcctcactaggtgctaggaataattatatcccctacaagggagctataattgttgttactggtgcagttatggaacaggagctatcatgcaatgaagctgctctgaaagtcattgagtgggtagagaaaagtggaaatggaaagagaaagttaagggactatctttttgctcgacaacgttattggggtgaacttatccctatcatcttcttggatgataatggtgagactgtcccattgtgtgagactgaactgccccttattctacctgaattgcatgatttttctcccactggatcaggggagcctcctctgtctaaggcaatgtcttggaaattaaaaatggggatgagcaagttaaagccgatgcaatacgaatag

SEQ ID NO: 37500 - DNA, 201 bp, Glycine max
  Peptide Sequence Number=SeqID_154278
atgaacaacactacactacactatgctacccattattctatttggaaactttgccaaaactgcagtggtcacaagtattggaacatcgcactcaaagtgagaagtggccgccatggtgctatacacattacaatagacattaagcattcaaaggtctacaaagtgagcacgacttacctcaatcaaaatgagaccctatga

SEQ ID NO: 37501 - DNA, 174 bp, Glycine max
  Peptide Sequence Number=SeqID_154279
atgcctcttatccaaatatcagaaaatgaccagtttatggaatttcatctacaggaaattaatcatgctggagctgggggattgtgggctgagcttgtgagcaacagaggatttgaagctggtggccctaacactccttcaaatattgacccttggtcaaattattggaaatga

SEQ ID NO: 37502 - DNA, 113 bp, Glycine max
  Peptide Sequence Number=SeqID_154280
atgagtgctagatgcaagtttatcatctttacctcaaagaatatgccaaaaagtgtctctggtattggctttccagatgcatcagaagcattcacagttagagttgtggtcag

SEQ ID NO: 37503 - DNA, 900 bp, Glycine max
  Peptide Sequence Number=SeqID_154281
atggggacgaggggctgtatcaattataagcccgtccttgccataagacaacttggctaccccatgagaggagcgccatcggaagaaagtatcatgcctttcatcgcacgggatttcagtgaccccaatgcaaggatgtttcaaagagtccagaaagcatggagcgcggtgcaaagaaaggataaggatcttaggggaagcaacaatgtgatcattggtggctatcacaagtggctgaaggctagaacgcaagagttagattggctcccaaagctaaaattttcaagtgaggaagaggttgaaacccctgaggagagtgaggaggtgcaagccttgaaggtggaacttgaaaggatgcaagtgatcaaggaaaagctcaagacgacgaccatcaaggaagaatggggccgaaacaagttccgaggggcgttgtggggcggcaacaacatgcttaagcttcgaagggctaagagagaccagtcgagagtcgaaggcatgatattggaagacaagttaaagacttgtcaaaggtcaaagaggagtttgtttggagaattgagcaagacggaaggaaacatgtgggccatcattgaccaatacaaagagaagctaagtttagttgcaacccatgaacaaaggctagaggacgaagaagcaatgatgtggatggataggttcgctttcaccttgaatgggagtcaagagcttccaagactactagctaaagccaaggcaatggtggacgtgtactcagcccccgaggaagtgcaagaacaaatgaaggacgatatagaggccttgaaggatcaaatggcttccatgatggaagccatattaaacatgaagagaatgatggaaagaaacatggtcgcagttgttgccgccaacactgccacttag

SEQ ID NO: 37504 - DNA, 1233 bp, Glycine max
  Peptide Sequence Number=SeqID_154282
atggaatactgtaaagatgtcctcagctgtcttgattcggatacgtctcttaagatattcatgtgtctggatgatctggctgatcttgttcgggttacttgtgtctcgcgatcttggagacactttgtgatagcaaatggtctttgcaagcagctatgcttgagaatgtttcctcagttatctagagttgcttttgttgttgaactgaatcaaaatggagcgaaggaacatgcagaggttggatctagctattctatggaatggctatctctactgagagaacatagagtctttgcttatttaggtagagctctcatgtcatctgttgcaatgaattgcattgctaagacagttggtgcttctagcactgataactttcctcaggagagcattgataatactctagagccaagagatcacattaatggtagatattactactggtcaagtaatggacaaagtaatcccaatgtgcctgagacattaacatacgagttggtctctccaatttgtgttattacagaaatcaatatccagccttttcaagctgattttcagatagggtcaccaatatattcagcaaaatctgttcggtttaaaatgggtcatcctaaagcctctttagatgccaccgatgatgaaatgtttgtatggacctatacttcccctgagtttccaatgtctaaggtatttaacatatcaggtttgtctactggttttccattgcataatttctgccttattgatttcttgatgcctgatatgaaaaacgagatgtggcacttccatgagattgattcttggtctacatttttcaatgtaaatattgaaaatcggctacagaaattcaagcttccagaacctgtgctttgtattgggggcttcttgcagattgagcttttgggaaggatacaaagacaagaaatggatggtttattatacatttgtgtttctcatgttcaagttctgggaggttcattgtcacctccattcaatgtggatattctgcagccctctggaatgtttgtgttgaagagggaccagctggctgaccatcaacctgtagtgacatctggaaatgaatctcaagaaatttcggccgagcaaagagaagtgagagatttccagcatattgtgactatattgagtggacaagcattaggaatagtagaagatgagtgggatgaggaagaatttgatgttgatgattttgatccagaatatgccctctga

SEQ ID NO: 37505 - DNA, 594 bp, Glycine max
  Peptide Sequence Number=SeqID_154283
gtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 37506 - DNA, 511 bp, Glycine max
  Peptide Sequence Number=SeqID_154284
ggcgcagaagactacggtagtctttgcgtgctatcaagcttttcgtcttacagacagcaaaaagtttatacgaataaccactcgggtatttccgcccgtcagcgtgactcaaaagtcagtatgacagatcttgtgagcgcggaagataacggcgcagaagacgacgttagtctctgcgtgttatcaggcttttcgtcttacagacagcaaaaagtttatacgaataaccactcgggtatttccgcccgtcagcgtgactcaaaagtcagtatgacagatcttgtgagcgcggaagataacgtcgcagaagacgacgttagtctctgcgtgttatcaggattttcgtcttacagaatgcaaaaggtttatacggataaccactcgggtatttccgcccgtcagcgtgactcaaaagtcagtatgacagatcttgtgagcgcggaagatgacgtaaatctccacgtgtcaacgggcttgtcggccgcgattgacgaaggtcgcagaagaccac

SEQ ID NO: 37507 - DNA, 738 bp, Glycine max
  Peptide Sequence Number=SeqID_154285
atggtgggtgagaaggtgaatctgcctaaagtcattttctactactggatgcaaggcttcaaagacaaattcaaccccaaaatgaagaagaaccttgtcccttatgagtatgctcaaaagcatataaagagaaaggtcaagaaggaccccaggaagtttcaacctttgttaaggctaagaagaagtctatggtcgaagcccacaaaaaggccaaagttggatgagactctggaaaggaagcaggctttggagttggaagaaggtgtccttacttctgtgaaagctctattagctaaagagcataagaggaagttgactaaagatgcaaagattgctaacttggaacaatttgaacaagagatgaagaaaacaaagatgaatgaactagaaagagtccaacctttagtagaacatgcaactgaaatcatgtctcctgatgttgctcaaagacaggcagagaaaaaaaccatcattgttcctaaagacatggatcttgtagagaaggaagctcttgaagaggccattcttaagtatattattgaagcatctcttagagaatcaaaagatgacattgttgaaacaaaccctagaattgcaccagttcgaccaaggccaatgtctgatgttgatgaacaacttattgatgctaatcagtctaatataatagatgtcgacaaacttagacgcttagaggagatatgcaaagttccaaaatctgtctccatagaggttatgtga

SEQ ID NO: 37508 - DNA, 393 bp, Glycine max
  Peptide Sequence Number=SeqID_154286
atggggaggtcaggtagtggtggaaaggcttttccatggtgtggtgttttggagaacaaaacagagagagcaagacaccataaacttttcacaagttttggagggcaggcgcggaaagaatctgcagtgttgttttatgaagtactgggatgtcaacggggcagggcggggcggggagtactcccccactccccgtccctgatccccgccgtgggggctagatcttggagaggagctgctccgtcgtggcacaatggtggtggatggtggcaggtattgttgcaaatggaagcaccaccatgcgatggaggtgtgctgagatgggaaaggggaagagagtcgcgtagaggcattgtcgatgcgacagctcatcccggcatatggacagaatga

SEQ ID NO: 37509 - DNA, 624 bp, Glycine max
  Peptide Sequence Number=SeqID_154287
atggctttagcccatagaggactattcaaattttctagggaggggggagaatgtcctatgaaaagtgtccttgatcaagccatggaggaggaagaggtagagttagaatgtgtaggatgctatgatgcagtacatggccaaaactttgaatctaacaactctaatgtctcaaagagcttcttgtacctttcttttcaaactgaagttaatcccaagaagaaggatgtgaatgttgtgatgatcaggagaaagaaagctaaggaggaattaaagaagaagtctattgcttaccttaagggaataattaaggatgttgtggttaatgtagacaagttcatctttctggcagattttctggtgcttgatatgaaggagaatgaggacttcctgatcatactggggttaaggttaggcaaactcactcttaggttggggactagttctacggggaatgaaactaatgatggagtcctagaaatggatagtaatgatgtaaacaatatagatggtttggaagaagaaaactcaatttctgagggagaggaaaatgaagaggataaagatgaattagtggaagatgatgaagtattggaggagaagagtgactttgcatatgaattttga

SEQ ID NO: 37510 - DNA, 336 bp, Glycine max
  Peptide Sequence Number=SeqID_154288
atgggtcgaagcctattattagttattggatccagatgctgcaccagcaattcaatgaacttccaaaattgcccttcgtttaaaaatcaaaaggcttccagaagatccgataagggttcttctggaatttctgaaagaagttgtttcggaaacattccggaagaagtgttcttccggaagaaaccaaaggtcatctggaagaacccttcttccggaagtctcccggaacacctcttccggaaagtttccgaaagaagtagttcttccggaagaattccggaagaagggttcttccagaagaattctggaaaaagggttcttccggatgacctttga

SEQ ID NO: 37511 - DNA, 270 bp, Glycine max
  Peptide Sequence Number=SeqID_154289
atgtcatctgaggagatggaggagtaccgagaactattgaggcagttggaatcgacacttgaggaggagagtgactattctttcgaggacacgtcttacctgcctactgaagatcttattagggatttgaagaggtttatgagaattactaatattgttaagtatcctcgggtacctgcggagtacattagattaaaaactttttcattttcactgaacaagaaattcttggattggatttggtcgcttctggagcacatcaccacctag

SEQ ID NO: 37512 - DNA, 339 bp, Glycine max
  Peptide Sequence Number=SeqID_154290
atgaagagtgcggcaaaaggatacaagaattgcaggacgagttggcttctgcaaaagaggacaccagaaactggagagaaagtgatttatcttgagaatgataatgtgctgcttgagaacaagcagaaagagttgaagggaacgctgaataatttacttcaatctaggcaaaactttgtgaatgcttatgaggttgtgctggacttagatgaaacactggtatgtgcatttgagacatcaagtttgccagctgctctatggactcaagcaatcgaaggtggtttgaattgtttacagctggtcttaaaggctatgctagatcccttgctaacagaatag

SEQ ID NO: 37513 - DNA, 975 bp, Glycine max
  Peptide Sequence Number=SeqID_154291
atgggagttagaagttggcgccatgtgttgttctccttgtgtcttgtcttcaattcaggcctatgtaaagccacaacactaagagaagaagaacaccaagaaatctcatatgaatttggtaccaagttggatgcagttcctgtagtaaaccctacaactccaggcacaacaaatccataccctacactaaacccaacaactcctcaagcacctggctcaacaggacaaaccccatcaaccccacccacaaccccatacatgacccctataaacccttacacaaaccccacaaccccgaaaacaagccctacaaacccatacactaaccctacaactccaactatgactccacctagcccaactactactcccacaaccccaaccactcctactactgcatcatcaggtggtcaatggtgtgttgcaagccaatcagctgcagagaacactctgaaggtggctcttgactatgcttgtggctatggtgcagattgttctgcaattcaaccaggagcaagctgttacaacccaaatactctgaaagaccatgcttcttatgcattcaatgactactaccagaagaatcctgctcctacaagctgcgcatttggaggaactgccacacttacaaacaaggatcctagtaatgggaactgccgctatacatcctccaaaacaccaagcatgactccaccaacaccaacttatgtaagccccccaaatccaccaagcaccatgaccccaacaacaccaactactatgaccccatctgcaccaagtactatgacaccaactacaccaggtatcatgaccccaactgcaccaggcatgacaacaattcctggtggagcctcagtctatggtacaggaccagcaggaagccccaacacagcaacatttgcttcacattctgaagtgcttctacttaccttatttggcttgtgggcttcgcttcgtgtagaaaattacatctag

SEQ ID NO: 37514 - DNA, 210 bp, Glycine max
  Peptide Sequence Number=SeqID_154292
atgactgggctctcagaaaaagaaaaacacagaagtggatcttggaacaacaggcaaggggactcgaggttaagcatggagatcatcgatctatgtggttattgcgagatcagagaccccggaggcgggatcaatcgctccttgttgaagatccatgatctggttgttgatggaggtgagaaagtgaaaggggatggggctatgttatga

SEQ ID NO: 37515 - DNA, 567 bp, Glycine max
  Peptide Sequence Number=SeqID_154293
atgatgggtacagagctagtactccttgaagctggagaagagatagagatcagaaattgttttaacgaagatgttgggtgggtgaatgaatgtgcacgggtgggtgaggagttatttgaaatcaagatagttgaagaagctccggatacatgtgatcactgcatcatgtgcactagggtctcctctgacatttcggtgagatcaaaatcatcaacaaatgaagatggaggctcattattgcaagatctagaggtggtggaagactctttggcgggacaagcactagagaagcaagattttgaatttgaatttgaaaatgttcaaattcaaaatgatgaaggtgagcgagaacaaggggtacaagaagtgaatgtcgatttaggctttgtagcaaccaatcagataaaaaagatagtcccacctggcgtagtggagactcttaggcatgtggaggtgggtcaatttgaaatgagtccagggttaacgtctattggttcaagcccacccttggttttagactatgagtcccatagtgagggaccaaaacctctggttatatcgacttag

SEQ ID NO: 37516 - DNA, 342 bp, Glycine max
  Peptide Sequence Number=SeqID_154294
atggagccaccatcagaggcatcattcaaagaaaggaggacaacaaacctaacctatatgtgcaagcttactcataaccttctgttcaacatagtgatgcacagacttgggtcacgaggctatgtcagtggcaaggatagattatgcatgtataaggttatggtgggagagaaggtgaatctgcctgaagtcatcttctattactgggtgcaagaattcaaagacaaattcaaccctaaagtgaagaagaaccttattctttttgggatcttattcactcagataatgaggaacattggagtggatgtgtcaactatggaaccatctactggaacctcatag

SEQ ID NO: 37517 - DNA, 261 bp, Glycine max
  Peptide Sequence Number=SeqID_154295
atgaaggattgggggaattttctacatcgagtccttgagaaggattctgaggattccactccgattacagcgttcttcttggtgtggaggttcggcggcaagcaacagcggccaccagtggttgtgggtggtggagaagaaggtgttaagatctcgcttagcaagttcgtctcgctaagcgggagtccgtttttcgcacttagcacgaaaattcacgctgagcgtaactccctttgcactaattctcgctcagtatgctaa

SEQ ID NO: 37518 - DNA, 183 bp, Glycine max
  Peptide Sequence Number=SeqID_154296
atgacgaggttgcaaacgggacaaggaggtgccaacacaatttggaggttgctcgatttgggttccaggggattagggattttgggtaaagtgaagggagaagcttacaggtctgggaaagggaagaggttatttttttgccaattagtaatagtaacttggatagttactaacgagggttaa

SEQ ID NO: 37519 - DNA, 195 bp, Glycine max
  Peptide Sequence Number=SeqID_154297
atggagtccatcggtgtactatgtgaccacattttgactattgtcttgcatcttgatatgcttgaactgccaaatagtctacttcatgagtattgtaatatggttgaattgttcactgatctttcgcaaattgaagatgaaattttttttaaggatgttcttgatgaggatgaaattgatgtgcagaagttctag

SEQ ID NO: 37520 - DNA, 213 bp, Glycine max
  Peptide Sequence Number=SeqID_154298
atggtgaaatcattcaaagttcaagtgcaaatgcagttttcagagatatgcggagcaatgtcgtacctaaccctcacatgcactgacaaccccattaatgtgtggtgttgcacactgttcactcagatgcgtatgtttaccccattaacgtggttctcaaaaatccatgtgagcttggcacgcgatgcggaacaccacggtcaacactcatga

SEQ ID NO: 37521 - DNA, 751 bp, Glycine max
  Peptide Sequence Number=SeqID_154299
atgggaacatcaaaatcttacggtggaccgaccaacggtttagttcccgacttcgtggataacccgccggcaccaacgctaacgcctccaaatgatatacccacggatagccagactcagaacggaaacaccgctccaggcaatttaccttctgattccagtggcgcggggccgctgagcacacctaagggaaatttcactcgttatgcacgctctcgtagcccgagcgcgctaggcagagccgtcgctggatatgtcagaaacggtacgggtggtcccagcagggccagccgtcgcatgggatcgtcacgagttgttgctggtggtttactgaacattatcggcaatttcgaacaagggggcgcaactcaggctcttcagcgtttcgaccttggttcgcttgccggagagccagcctcatcggtattcctttcactggtggaattcttgtgtcctcccggtgggtctgttgatgaagggattgccaggcaggcaatgctcgataccattagggacctggcagaaacaggtgaggagagtttcgatgccttgacgcctgaacagctccaggaagtatttcttggttttgtcgtgcactccattgaaggcaagataatgtcagatatcggtaaaaatgcgatcaaactacccgatgatgttgaagcaatcgcggacatacaagaaacactgcatagtttcatcgatagcgcgacacgttcccagctcagaaacgatttatctgatgtttcag

SEQ ID NO: 37522 - DNA, 165 bp, Glycine max
  Peptide Sequence Number=SeqID_154300
atgacggtgtcctcaccaccgacgttgacatactaccaaacaacgtcggtgccactgacgttgtattcttgcattacaaatatgggtcctaggatgaccgatgttgttgttgtcgacatacaacgacatctggaacaaagacggtgtggggcccgtcgtagataa

SEQ ID NO: 37523 - DNA, 513 bp, Glycine max
  Peptide Sequence Number=SeqID_154301
atgggtcagctccagcaacaagcgtttcacaaagcttacggtaaaatctgggacctagccatggcagaagtctccacagaggccattgcctccctcgcccagtattatgatcagtcgttgagatgcttcacttttggggacttccagctatcacccatggtggaagaatttgaagagatcctaggatgtcctctaggatgtcttctcagggaattagaccacagaaagcaagtcgaaaatggggcggttggaataccgagaaaatgtttggaggcaaaagtaagaatcttggcaggtaaaggcgagtgggccccgttcatagatattctcgcactgttgattttcggaggagtcctctttccgaatgttgatgggttggtggacctagcagcgatcgacgcttttctcgcctatcataaccacaaggaaagcccggtttgtcgctatgctaagccgacctatatgacaccttcgaccgaagatgtgacaagagcaatacaaggattgtttgct

SEQ ID NO: 37524 - DNA, 1071 bp, Glycine max
  Peptide Sequence Number=SeqID_154302
atgcagttggaagacatggaaggtgctcatgttaatggaagaaatagtttgcatatacttaaagaagcacttagcagtcaaaggagcaaaaattatggtgaagtactcgagtcttctggtaccgggttttatgaaatggttgtggttttttcatgcttgtggttgcaaatttcaagtcttggttccatgtcttccattgtcgtctcttatggcgtcaaaggtggccatgttgaaatgggtgtgccacagcctatggttaagggagctcaatacctacatatcagtgttggtgactatgacatttgtggattgaggaaaccattgactggaagacacaggaacacttctttggttgtttgttggggctacaacatgacgaacaacaatgtgtttgatgggcaagttcaatcaatctcaccaggttctcaattcaattgtggcttgttttctcacaataggactgtgttctgttggggggatgagcctttgctacctttggcaaaagaactgaaagattttggtctatgcagctgccagtgggccaaaggtgaacaaactaaaagggagctcttcaaaccaaaaggatcagaaatgcaacatctggttggacttggaggacttcaaagagacctcaaacatggtactattgttgctgttaaaaggaccataatgtctcccaacgtgcagaagaattccaaggagtttcacaccgagcttgacttgctcaatctactaggctactgtgaagaaggtggagagaggctcgttgtttatgagtgcatggctcatggctctttgcatcaacacctacatggcaacaaggtgatgcaagagcaaatggattgggtgacaagggtaacaattgcaatgcaagcaactcaccaaatcgaatatttgcatggatatgtttctccacccgtgattcacaaagacattaagtcttcaaacatcctcatagatgaagaacacaatgttagagtggctgatttaagtttatcactacttggtcttacagatagtaggttatcaaaggatttgacatgggttattgtttcaaagaatatgacatag

SEQ ID NO: 37525 - DNA, 300 bp, Glycine max
  Peptide Sequence Number=SeqID_154303
atggatccaaaaagatcaatagaggatcaattctccaagctgcatccttccatgccagtaaacaccagaattggaatagtgggtgctggttcaagtggcttatcaattgcttatgcactggataggcttggttataataatatcactatcttggagaagcatcatacagttggtggcatgtgtgaattagtagaaattgaagtatatgatctaggtgggcaagtttcggctacaagtagtgctcctgtcatctttcacttggcaaaagagacaggctgtccactagaaaaatcactatga

SEQ ID NO: 37526 - DNA, 497 bp, Glycine max
  Peptide Sequence Number=SeqID_154304
cgtcagccgctgcaccggctgctgatgcagtgctggcagccgcggctggccttagcgcagggcgtggcgctggaaggcatttcgctctatccggtggtggagtatccggcgtgggccgacgatcggcgctcgcctggcgcgctgtttggtctgggcgatcccaatggcaatcgcaccctgcacgaagcgcttgcgctggagttgcgcatgacggatcggctggatggcgcacgtccgtcagccaggtcatggtgaaaaggaacactacgccgatcaggcaggcggaaagcagtccaatgatggcgatcagtttgtcatcccgggattccatcgacatctccttgcgggcgtccgtagtcggttgctggcctcagctcatccataatgtaagcatcaggacgaagattataagggtaaccgaggtcactgcaagtaccacaatggcgaagaaagaggcgtttttcagcgggattgccgcacagagtgtaatggaatag

SEQ ID NO: 37527 - DNA, 465 bp, Glycine max
  Peptide Sequence Number=SeqID_154305
atggatggcgagcagcgccatcgcggcgtggaagccaacgtgtttggtgagccggtgctgggcctgcgcctcaacgccagcgccacctggatcgatccggtgatgaagaaaaccgccggcggcacttacgatggcaaacaggcgatcggcgtgccgcgctacacctacgtgctgggcgcggagtatgacatcaagccggtggagggtctgacggccacggcgctgctcaaccacagcggtgctcagtacgccaactcggccaacaccctcaagctggacagctataccacgctggatcttggtatgcgttaccgcatgaaggtgaatcagaacgatctggtgtggcgcgtggcggtcgaaaacgtcaccaatgagaagtactggtcaaacgttgatgacaccggcacctatctcgcgcagggcgacccgcgcacgctgaaaatcagcatgagctacgatttctaa

SEQ ID NO: 37528 - DNA, 240 bp, Glycine max
  Peptide Sequence Number=SeqID_154306
atggtggaatctgaaagacttagctatatcagaaacaaccaaaagaagcttagagttgataagtattctagcttacaaacttcattggatactagaacagctaaaggcttaaccaagggaaaaagagtcatcttaccctcaacgtttgttgggagcccacgttatatggatcaactttactttgacgacttaacaaagggtcaattactgggaaaagtggttgcatatattcatggctaa

SEQ ID NO: 37529 - DNA, 179 bp, Glycine max
  Peptide Sequence Number=SeqID_154307
gttcgctgagcgcaccactccaagtcatcaagcgtgctgcttcagctcatccgctaagcgagagaagcgcgctgagccaaaaatcactaacgtgcgctaagcggtccatacgtccgctaagcgcccgagcacgaacaaggcaactgatcgaggccgtaaccgaatcaaataaacattaa

SEQ ID NO: 37530 - DNA, 756 bp, Glycine max
  Peptide Sequence Number=SeqID_154308
atggccagggcgtgcagccctctgaaatcgagagcttgtagccctctgaaggcgaggacgtgtagtcctctgaaggcgaggaagtgtagtcctctgaaggtgagggcgtgtagttctctgatggcaagggcgtggagccctctgaaggcgaggacgtgcagccctctgagggcgagaacgtgtagccttctgaaggtgagggcgtgctgccctctgaaggtaaggatgtctagtcctcttaaggcgatggcgtgtagccctctgaaggtgagggcgtgtagccccctgaaggggaggatgtgtagtcctctcaagatgagcatgtgtagccctcttaaggggaggacgtgtagtcctctgaatgtgaggagatgtagccctctgaaggctaggacttgtagtcatcagaaggtgagggcgtgttgccctctgaaggcgtggacgtgtagtcctctcatggcgaggatgtgcagccttctgaagacgaggacgtgtagtcctctgaaggcgaggacgtgtagtcctctaaaggcgaggacgtgtagtcctgtgaaggcgatgacatgtagtcctctgatggcgaggacgtgtagtcctctgaagacatggacgtgtagtcctctcatggcgaggatgtgcagccctcagaaggcgaggacgtgttgtcctctgaaggcaaggacgtgtagtcctctaatggtgaggacgtgtagtcctctgaaggcgaggacatgtagtcctctgaaggcaaggtga

SEQ ID NO: 37531 - DNA, 861 bp, Glycine max
  Peptide Sequence Number=SeqID_154309
atggataggtaccagaaagtggagaggcctaagcctgagtctcccatcaatgagaacgagatccgaatcacgacgcagggcgctattcgcaactacatcacctatgccacttcgcttcttcaggaaaagcatgcaagagagattgttttgaaggcaatgggacaagcaatcagcaagacagttgccattgcagagattttaaagaagagaattcccaagctgcaccaagatactggcatcagctcagttagcattgtagatacgtgggaacccattgaagagggtcttgtaccgtatcaggctccaagtaatgtggaacaaccaaagccacactccaattaccagcagcaatctataaaaccagcacaggttcataatgctgtaaatgaagaggtcgaggtcggggtcgggggagaggtagaggaaggaattggggaaggggtggttatggctatcaaggtggttatggaaattatcaaggatacgggtattaccaggggggataatggtgggtattcaaatcgtggacgaggtggtgggcgaggtagaggttgggggtatcgtggtactggttatgaaggcggcaggggtggtggttatgaaggtggcaggggtggtggttatgaaggcggcaggggtggtggttatgaaggtggcaggggtggtggatatgaaggcggcaggggtggtggttatgaaggtggcaggggtggtggatatgaaggtggaagaggtggtggatatgaaggcggaagaggtggtggttatgaaagaggcaggggtggaggaaggggttatgggcgtggtaggggccgaatgggtggacgtacaaggggtggcggcggcggcaaccaggcatga

SEQ ID NO: 37532 - DNA, 316 bp, Glycine max
  Peptide Sequence Number=SeqID_154310
atgagtcttcattcttcatctagtgttaatggtgagggtgctactcctaaggacccctttcataacttatgcaagagcctaagtgaagaacttcatgactattatgaaggaaggcatagagcacatcctagacctcactcacattggagagaaaaggaaagaaaacctcaagaggctaacattaacctcccacacttccatgggaaggacaatgtagaggctaacttagatagggaaataagggtagagcaacaacttaaaaggaagtctacttcaaaatcttatgactctcactattatccaaagaaagaccaag

SEQ ID NO: 37533 - DNA, 186 bp, Glycine max
  Peptide Sequence Number=SeqID_154311
atggttgcattctacaatgtttcactcagtctttctggtcaatcgcttcccttcgtaggacaatcagagacattgataatcagagctctgatacacctaattgtaagcactcaggcacttggggaacactcccctaaaggctctagatatataaatgtacaaactagtgcatgtttgaggaaatga

SEQ ID NO: 37534 - DNA, 330 bp, Glycine max
  Peptide Sequence Number=SeqID_154312
ggtacatcctttgtggtacaagtagagggtacatctacttgggttgttgtgactgagaacaagagagggtacatctcttgtggatcagttctagtggagggtacatccactaggttgttcaaagagaacaagggagggtacatcccttatggatctttgcttgtaaaggattttacaaggttgaaaagaaatctcaagaaccacagtattttgaaatctaaaattcttgcacaaagtagtactttggttaatgagatagcttcagatgatgaaggtgaaaatgcaagtgatatgatgggaagtggccttactacccacttggaggaatga

SEQ ID NO: 37535 - DNA, 630 bp, Glycine max
  Peptide Sequence Number=SeqID_154313
atgagggaaattgcacaccccagcaagcacaagcatctccttacaagccaccaagaaggagaacacaatcccatgatgaggcctaagggtgtggacctcactccaaacccttttatgcaagtcaaaggacgaaacaaagcaagagtcccaagaccccagaagagggtcatagatttcaacatccaaacggtcctctatgtcaacaaggttcccaatgaacttgaccccaccaacaacaatgaacttggggtggctaaaggggtgaagaattggggtgtagaggaagttgggggcagtgatgaagaagaaggagttggtgccaatgaaggaggtgttggattggtattggtgctggtgttggaggcagggtcaaaggcaaaggattggttgttctttgaggagatgttgtggatgccatggaggaagaaccatggttggttgaggtggttggagagggtggagaaggaagatgaggagattatggagtgccatagcttgcacactgtggaggctctgattaggatggggattgggaggagggacaggatcagctctatgagaaagagagaacgagagactcatggagtgagtggttggagagttgaagagttgatcggtgccgtgcgttga

SEQ ID NO: 37536 - DNA, 306 bp, Glycine max
  Peptide Sequence Number=SeqID_154314
atgcagcaggtagaggagcaagcaagggctgtcctagcaggaggtagtgcgccaaggatccctctacggctgtgcagtacaattccgttgggattgctttttcactttttgcattttgcttttgcttttcctccaaggcaatatgccgaggcaccattagcaagagcaaaggagacaatctatggtagtgtggtttggactgaatttccaaattttctttggaaaatgggtttgcaaatatggagaagaagggaaaaagaaagaaaaagggagaagagagaaagaaaggaggaggcagatggttaa

SEQ ID NO: 37537 - DNA, 609 bp, Glycine max
  Peptide Sequence Number=SeqID_154315
atgactaggcaacatgaattcaataatgacgatgtggccaaccttctctgcattccagattatacgtatgaagtgggaacattaggaaaagctttgaggattctcagacccaacataaggactcttactcaaatctggaccaatttctcgttggataatggactccaggtggacgctgttgcaattatatcagatgagatgcagaaggtcatcacttcagcattctcatttaccggtagtgcctctagactttcgggatttcctgcactcatcattggattgtgcaaatttcatggtgtacatatcccaactcatccagtgaagagcatccaacctccaatcaacaaggtctacattgtgacacactgcacaaaccccttggaggaggtacagggtcttgttcctaggcaccaaccaccctccaaggcacctatcactgagctcatgactatgcatttcacctatttagagcaacaacaagtgacgaaccaacaaccctacacttccttaaatgattatttttacatgttgaccatacaccaacatcaacatcccatagaactatttccatggttgtctccaacacaattttctcagcatgtagcttag

SEQ ID NO: 37538 - DNA, 1326 bp, Glycine max
  Peptide Sequence Number=SeqID_154316
atggaggaccgctcctccgccagaactcggcgttccatcttcgccggggccgccgagccggaaaccctcgaccccgacgacttcgccgacgtcttcggaggcccgccgaggagcctcctcgtgcacaaattctcgaggtcgaattcgttctacgaggagattttccgtccgccggagtttgcgtctccggcgccggcgaagggcagccggagcttgccggtgtttcggattccggcgaagaacgaggcgttctacagcgacatattcgggtcggacgacgaccggaggtcgcgggagcggtcggggccgcagtcgaaggcaaaatcaaagtcgaattcgtcgtcggctctgagctccgaggagctgagccctctccggacggcggtcggtgatgacgtggcattgtctgcctttgcttccaagctcaggccaatcaatgtcccgtgcagatggaactcaaccactatgatgcccggggaacacccaattaaacaaggggggccactttttccatgcaatagtcagtcatttgaaattcagtttcaggacaatgagtacaaggagagcttcaagagttcacatttgggattctcaagaagagtctcctcccccgaaactattagtctcgaatccaattcatatcaaagcatgaaggtatctgctgatgactgggaaatcagttccccgttttctgctgtctctggactctgtcaagaacctgaggcaaaatcttcagtccatgatcacttgtttccagaactggttatagagcaggacgacgacgacgacgaagttatgagctcctatgtcatagaggtcaactctaacctcagagaggaaagttgtggaacagcagaccttgacgaagcaatagcatgggccaaggagaagtttcaatcacgaaattctgatgaagaatcgagctcgagaaatgaaggcaatgagcaagctactacaggagtggaaggtgaatgccacggtgatggaataggagaagttaaatcttcgaaggtacaaacagaaacagagaagttggacagagatataagatcgtggtcatctggcaaggaaactgacatccggctactcctttcaacgctacatcatattttatggcctgagagtggctggtatgctgttcctcttccgaacttaatagaaagttcacaagtgaagaaggcctatcagaaagcaagattatgcctccaccctgacaaactacagcaaagaggagcaacattcctacaaaagtatatagcggagaaggctttctccattcttcaggatgcatggactgcattcatttctgaagatgtttccttctaa

SEQ ID NO: 37539 - DNA, 315 bp, Glycine max
  Peptide Sequence Number=SeqID_154317
atgtcgtggagcttgttccgaaacaggttcaacagagtgagattcttcaactccgcaaaacttgccggaacctcatcggagagcatgttgtggagagagctcgcagagggcgaagaggtttccaagctcggacgtgatgtagccagcaagctcgttgccgaagagggcgaggtattggaggtgttgccaggtgccgtactcaggaaggatctggccgaagaagaagttgccgccgaggtgaaggtggcaaaaaaggagcatggcggcgacggagagagaaatttccaaattcactcccatgaagatagaatttga

SEQ ID NO: 37540 - DNA, 285 bp, Glycine max
  Peptide Sequence Number=SeqID_154318
atggatgttaaaaatgcttttttaaatggctttatagaagaggaagtttatgtaaaacaacctcaagttcaaattgatgttgatggtatcatttttagagctactaatgaatctttatgcaaggatttctcttatatgatgaagagtgagttcaaaatgagcatgacgggagaacttaagttctttctaaggcttcagatcaaacaagatagtaaagactatgcaggagacaaattgaatgaaaaggcacaagtggtggatgccattatattgaaccctgtttga

SEQ ID NO: 37541 - DNA, 414 bp, Glycine max
  Peptide Sequence Number=SeqID_154319
atggtgaagaacgataacggaattgatcacgaaaacatttcggatgcgcctcggcctcgtgttttcttcttctttctccttcttctcactaatttcactgaaaatctctcaatctatgatgctgaacccttctcctcagccccctcacacctatttgtaggaaataaggggtggaggttgcacagtagcttgcctaggcgagctggttacttcagccctaagctttctggtggcccaggaaaattaaaagataattgtactgtcaagggtccacaaattgacatggcaagtgacatggcattgaaatatacacgtcaagcctggaacaggacacttgtaaatttgacgtgggagcttgaggagctcatcttgactacatcaaccccgacatcaatcagctctaaattttggtaa

SEQ ID NO: 37542 - DNA, 921 bp, Glycine max
  Peptide Sequence Number=SeqID_154320
atgcagattcttcaatggctctttagaagggcacatgaacaagaaagaaagagtagcaacaacttcaatctccctcccaaaagggaagatatcagtgaacaaaatgaagggaaagagataaatctgctaaagcgtgatagatcatacaaaggaacaagaagaaacaaatggagcagtcctggttgcaagaactttaagatattcgcttttctatatagaaaagacattccaaaagctttcttttacagcaccctcaacttgaagagattagggagctttaatagaaaacagtttttgtacttcatgaagatgaagagagaagaatcatcgtccagagatgttggaaatgttaacaaggcagattcaggtggccaacatgttggaaacaaggttttgcccataactgaggcaccattgtcatcctcagctgaaagaagtgaccaatgtgatgccacagaaactaaaggtcaaaccaaaggggacaagaaaaagccaatgtcgagaatgaaagagctacttagatgggctgcttctgccaagacagagaaaggagggaaattcaatgggagaaagctatactgtaaccataagtccataacagattgccataatgatcaaactgctaccatattggtcttaatgttcagaaggcgtggaaccctgaaagcagttccagatgatgaccatggttgcactgactcacccaagatcagtttcagatgggatgtggaaagttgctccaccacttcctctgtctactctgctatctcaatagcttcctcatcaaaaaatgaacaaaaccaaattgcaacttccactatatccatccctcctgaacacactggccataacaacaacactagtagaaaaaaaggaaactggatcacaacagactctgaatttgtggtgctggaactataa

SEQ ID NO: 37543 - DNA, 4443 bp, Glycine max
  Peptide Sequence Number=SeqID_154321
atggccgaccacgcaacaaggaagaccacgacggacagactcgaagacgccattacccgattgacccatagccaggcgtccctctccgataagtactcagaattatcaggcaaagtcgattccatattggatcatcttcgcctacgagacacgaattctaacaaccccaacgcccatgcgtcctccgcccaaagaaaccatgtcaagctagatattccgaggtttgacggccgcgaccccctcgggtggatctttaaaatcacccaactattcgattaccagaacacccctgaagaagaaaggatcactgtggcatctttctatcttgatggtgcagctttaagctggtaccaatggatgttccgcaacgggttcatcacgtcgtggacgggttttttacaagctcttgaatccaggtttgctccaacgttctatgacgaccccaaaggcgcccttttcaagctagcccaacgaggcacagtcaatgactacctcacggagtttgaaaggctagccaacagagtcatcggattaccaccgccgtttatgctcagttgtttcatctccggcttatcaccagagatacgcagagaggttctagccctgcaacccatttctcttccccaggccactgcgttagctaaactacaggaggacaaactaagagatcgtcgtcgggccttttctcgaccaactgagtcttccttcccctctacccaacctactaaccccagcatcaaagccaaagccccatttgttcaacgaaccccagaagagattgcgttcagacgcgaaaagggcctttgttataactgcgatgagcggtggaactcgacccaccgttgtaagggacgcgttcttctattcattgccgactccccgtcaccagaaactacggattccgaccctgaaccactctctttaccagatgacgaacaccaggatgcccaagaccaggtaacggacgacacgttccctcacatcagcttgcatgcactctcaggatttccctcatctgaaaccttcagactttatggaaccatcaatcacgcgcgtctcaccatccttattgatagtggaagcacgcataattttctccagccacgcatagctcacttccttcgtcttccggtaaggcctacttctccattacgagtactggtgggaaatggttcagtccttgactgtaaccagctatgctccaatacacccctttcacttcaaggtcacttcttcaacgtttctttccaccttttaccgataagcggggccgacgccgtgttgggtatcgaatggctcaagcagtttgggccggttattactgactacaccgccctcattatgaagtttcaccatttgggccaggccattgagcttcacgcagacgtttcaaataggcccgaactggtctcagtacctcaagtaaaacgcttggtccgcaccgggtccacatccgccctattccacttaaatctactacccgtaacccgacccgaaccgccacgtcatcatcttcctcatcatcatcttccccaccccgaccctgcaatcgaaaatcttctccgacgttaccaccaaatcttcgaaacacccaccacacttcctcctccccgaaccgttacccaccacataaacctcctcccttcatcatcacccatcaacgtaagaccatacagataccctcatttccagaagaccgaaattgaaaagcaagtctccgatctgctcgcggcaggcctaatacgaaccagcacaagtccatactcctccccagttcttctagtgaagaagaaggatgcaacatggcgtatgtgcgtggactaccgtgcccttaacgcagtcaccgttcgcgataggtttccgatacccactatcgacgaattgttggatgaactagggcaatcatcttggttctctaagttggatttacgacagggctttcaccagatcctgatgcatgaaccggatattgagaaaacagcattccgaacgcatcaggggcactatgaataccgcgtgatgcctttcggtttgagtaacgccccttctacatttcaagcggccatgaacagcttgctcacacccttcctgagacgttgtgccacagtattttttgacgatattctagtttatagtaagactctctcattacatactcagcatctggaaatgattttcaaagctttgttagacgctcagttctatctcaaatacacgaagtgcgtgtttgcgcaaacacaagtcgactatttgggccacgttgtttcaggcaaaggagttaaacctgacccctcgaagattcaagctatgctacaatggcccactcccacttctgttagagaactccgcgggttcctagggctaacagggttttatagaaaatttgtaaggaattacgcgtccatagcctcaccacttacaaccctcttatgtaaggatggcttcgagtggaatgaagattctcaagctgcctttgacgcccttaaatccgcaatgactcgagctcccatactagctcttcccaatttttctgagccatttaccgtagaaacagacgcgtcacaaaccgccatgggcgctgttttggtacaaagagatcacccagtggctttctttagcaaagtatttggtcctcggttaacccatgcctcaacttacatacgtgaacttcacactatagtcacagcagtacgaaagtggcgtcagtatctcttagggagatctttcactatcctaacggaccataagagcatccaggagcttatgacgcaggtaattcaaacccctgaacaacattactacctctctaagttgttagggttcgattacaccatccgctacaagtccggcgcttctaacattgtagccgatgccttgtctcgtgcaccaccaccttccggccagcttctgttactctccgtccctcacttggatttcatctcagaccttcagcaatccctacatagtgaccaggagtttcaaacattgctctcgaaaatccaagcccaaccctcagattaccccaaccaccaacttcacaatggcctcattctttcccagggacgaatctggttacccaacacaaacccgtatatacctactatcttactcgaataccacgcaacgccattagggggccacatgggtgtcgccaaaacaacacatcgtctcgaatctagcttcacttggcagaatctcaaaacagatgttaaacgttttgttcgcgaatgcaagatctgtcaacagaccaagacaagcactcgccggccgggaggattgctccaaccactttctcttccaacaggggtctgggaagatatttccatggattttataacccatttaccggcctcccacggttacacagtcatcttcgttatagtagatcgattctccaagggcgtgcacttaggagctctacccacacacttctcggcttacaaagttgcaaccctcttcattgatctggtatgtaagcatcacgggttccctcgcagcatcgtttcggatcgcgatccaatattcctgagttcgttctggcgagagctatttcggttgcatggaaccctcctccgcatgagtacggcgtaccacccgcagaccgacggccaaacggagccggcaaattggttccgttacctagccctcgcggaatggtcctataacacatcccttcatactagctccggtttcacaccatttgaggttatttacggcaaacctccgccgtccctccctcattaccttccaggccacaccactaacgaagcagtcgacaccttgctcaccagtcgtcaggagatccataccaaactccggcagcgtttattaaaggcacaagaggctatgaaacaccacactgattcaaaacgagaagacgtatcattcacagttggacagtgggtctacgttaaactccgtccacatcgacaacgttcagtcaccggagacactcattccaagctctcgaagagattcttcggacccttccagatccttgaacgcataggtcccgtagcatatcgccttcggttgccggacaatgcacgcatccaccccgtcttccattgctctcttctccgagcccatcacggtcccccgccatcttccttagacacatggcccttgcaggttgttgaccacaggccaattccacatccattatgcttcttagactcaaaaatggaccacactacatctccccctacgcgtttggtcctcactcaatggaaaggtcaaccccccgaagacaccacttgggagccttggtcagagttacgcgactcctaccaccttgaggacaaggtggttttcggggaagggggtattgatatgcccatgcataaaccagcacccgaagcaactaacccttcacccggagtaactaggacccgaagagaaacaaccacacctcatcacttacacgactacgtactcgagtag

SEQ ID NO: 37544 - DNA, 195 bp, Glycine max
  Peptide Sequence Number=SeqID_154322
atgagtggaaagggataccaattgggaaagaggatttttggtttatgtaaagaactcaaaaaattcgacatgcttacctttaggaacactcgaaaggtggcaagtaatctcaaaaagccacaacttcgcctatgtcgcggtaccgatggtgggagcagcaggtcacggcaagaagtagttcacggcgacaactaa

SEQ ID NO: 37545 - DNA, 1770 bp, Glycine max
  Peptide Sequence Number=SeqID_154323
atgtccaagctcggctggacccccagcttgcggtcctgcaactgcctcctcgcgaaattggtatgggccggtgaaagagacactacattgatggtttttgagcaggttttgaagatggggattgtgcctgatgtttatatgattagtattgttgtgaacacgcatttgtcgcggagggggagtgtggaacgtgctgagaggtttgtggagaagatggaggggatggggtttgaggttaatgttgtggtgtacaatgctttggttggagggcggggaagggcggatgaggccgagaggttgcttcggaggatgggggggtggttttggttgatcatgtgtatgcaaggtcaggttgggaaggctgagaaggtgtttagggggatggggggttggaatgtgagaccagatttttatagctataatacactgttggatgggtactgcagggaagggaggatgggcaaggcttttatgctttgcgaggagatgatacgggaggggattgatccgtcggttgtgacctataatatggttctcaaggggttggttgatgtggggtcttatggggatgctttgagcctttggcgtttgatggtggaacgaggtgtggcgccaaatgaggtcagctattgtactctgcttgattgctttttcaaaatgggagattttgacagagctatgaagctttggaaagagattttgggtcggggttttagtaagagcacagttgcattcaatacgatgattggtgggttaggcaagatggggaaagtcgtggaagcacaggctgtttttgataggatgaaggaacttggatgctcaccagatgaaataacatataggactttgagtgatggatattgtaaaattgtttgtgttgttgaagcttttagaattaaagatacgatggaaagacagacaatgtctccttccatagaaatgtacaattcccttattaatggactttttaagtctaggaagtcgagtgatgttgctaatcttcttgttgagatgcagagaagaggactatcaccaaaagctgttacctatggtactcatatttctggttggtgcaatgaagagaagttggacaaagctttcagtttatattttgagatgattgaaagagggttctctcctagttcagttatctgtagcaaaatagtcatcagtctttataagtatgatagaatcaatgaagcaactgggatcctagacaagatggtggattttgatcttcttacagttcataaatgttctgataagtctgttaaaaatgatttcataagtctagaagctcagggaattgcggactctcttgataagagtgctgtatgtaattctcttcccaacagtattgtgtacaacatagctatctatggtctttgtaagtctgggaagattgatgaagtaagaagtgttctgtctattttgttgtctagagggtttcttcacgataattttacatatggtaccctaattcatgcctgttcagctgctggtgatgtggatggcgctttcaacataagggatgagatggtggaaagaggtcttatcccaaatattactacttataatgcgttaataaatgggttgtgcaaagtaggaaatatggatagagcacagagacttttccataaacttcctcaaaaaggcttagttcccaatgttgttacctataatatactaatcagtggttactgtagaattggtgatcttaatgaagcctctaaattgagagagaagatgatagaaggagggatttcttga

SEQ ID NO: 37546 - DNA, 846 bp, Glycine max
  Peptide Sequence Number=SeqID_154324
atggcaagtgtcgttgtgcttaagtgccaggtgaagctggcgaaccctgaggactcctataagctgacctttcaggcttacgggagtgatgacttcctgttttttagtaccgcgcctggtcgtctgccctttttttttatgtacagatgtttgtttgaggtcttgagtgttattttacctttgaatgcttttcaatgtgctctgctggagcacttgaatgtggccccttctgagctctacccaaaaaattgggcaatggttttgatgatgccaagacaaaagcaacacaagttttatttcaagttcaaatcaagaccaagaaaacaaagatcaagaagaaagctaagtcttagtctatctttgttaaaagagtctcttagtgactgcaaagttattgaggccacttgtttaacccttccaaataaaactgtctggcagattggatggctctccttgaacagtgtgttcaagaagctgtttgagtttgattcaaacgtctttcaccgtttcaaggaccatttctttaaggtcttgactactgatgttgtggctaatggaatggcactaatgttcaatagggatgaggagccccgcttcctattctactggcagtctgatccctccaagatcaagtcgtatgacaaggatctgttgacccttgtaggtatgataggtgactttgctcggaggccactcgtgaagcaagtcggacttgtaggtggaactgtgccactatttgttgctgctccgttcattggagaagggggccaacctattggtgaggtttgtcctgttgttgttgctattgaggtcgcacccagcgcagggtgttgtggagcaaggtga

SEQ ID NO: 37547 - DNA, 348 bp, Glycine max
  Peptide Sequence Number=SeqID_154325
atggatgatgatactccgcagtggggtaggtctgcagatggaaactttactaccaaaactacgtatgagagtcttatttctaaccatgggcaggataccaataacatttttaaccatcggttctgcaatgaagaccaccgcctgctggagttatcaaaattaattgtgatggagcagtttgtgcagcggatagcaaggctgcttgtggtggggttttccgtgactgtcatggccaattcatcttggggtttgctagttcattttggtgatgtgtggggtggatatggcgaagtgttcaagtattttgaatggcttgcgtttggcatgagtagggttttagggaactaa

SEQ ID NO: 37548 - DNA, 561 bp, Glycine max
  Peptide Sequence Number=SeqID_154326
gccgacatggaggccatgaaagatcaaatggccgccatgatggaggccatgttgagcatgaagaagataatggaggtcaacgcggctgtagttgctaccattagcgtcgtcgctgagggaggagaaacattgggaagtacagatggtccccatgttgtgcaaagcaagaactccttcccaccatacgacttgcctcccaactatgcaccacccaatgttgtacatgtgcccgacgagaacgccgaccactccgctcttgttccccttgaaagccagcaagcccagttggggcatgcacattttgctcagcccatggggggcatactgtctcctgccatggaagaaagagaaaaatttgatcttatagaggaaagactgagggttattgaggggattgaagattacccttttgccaacatggcggaactgtgcctagtgcctgacgtcgtcatccctcctaaattcaaggtgcctgactttgacaggtacaaggggactacttgtcccaaaaaccacctaaagatgaattttgggaagatgggggtgtacgccaaaagatga

SEQ ID NO: 37549 - DNA, 528 bp, Glycine max
  Peptide Sequence Number=SeqID_154327
atggctctagatagaacacaattgcaaaacatgtgcaagaaggagcatgagtcttttaaagaatacacccagaggtggagggatttagcaactcaggtagcacctccaatgatggagagggagattataacaatgatagtggacacattaccagtgttctactatgagaagatggtgggttacatgccttcaagctttgtggatctggtatttgcgggtgagaggattgaagtaggcctaagaagaggcaagttcgattatgtcgcttcaacaagtgcgggaaataagaagaccagtacaggtggagctaagaaaaaagagggagatgcccatgctataaccgcaactcccacatggacaaagtcccaacaaactcctcacaaccccacttaccaatatcccccaccccagtacaattactcaaccaatatcggatctcctcccattccgatgcccatccaacagagaatgcccactcaaccacaaaggcctcccccacaaaacccatttcttgcacaacctcgatga

SEQ ID NO: 37550 - DNA, 963 bp, Glycine max
  Peptide Sequence Number=SeqID_154328
atggagctaaccgttttctctctcttcttcttcttcttcaccttccaccttccctcctgcttctcaggacaatcgagctccatggaatcagtgcctgatcttcagaacactatgtacgcttccatcgacggttatccttgcgtgcgcctgatgaatctctctggcaccatcggttgttcaaatcctggacgagataaggttgtggctccaattttaaggttcgaaaatgttgacaaaatagctgagccttctgctatattggtttcactggatgagtttccaactctctttactagaatatcagatgactctagctttgctagtaaagtccttggtgtactggttgaaccaacgggtgatgtgcagaataagttaaagggattttctccggaccaaaagtttccacaagctcaattcgctctttatcataataccagctaccaatggaattcaattggttctggtattatgtggaaatcctacaagtttcctgtatttttactcacagaaagtggctcaaagactcttcaagagtttgtaacaaagaatgaggacaaaaagaaatcttatacttctaatgtggctgagtttgatctggtgatgcaggtgaagtttcttgggctctattctataaatgctgttaaactagatacaatgttaatcatgcaagatattcaagaccaaaatttcagatttttggctgataattgcttggaacctcaaaagctatccttttgcagtgtctggtcatctcttcctccgatcaacatttcatccttacaacagtctaagcccattttattgacagtggcatctatggattctgcttcattttttcgggacagaagtcttggtgcagactcccctatttctggtttaattgcattactagcagctgttgatgcactttctcatttggatggtcttggtgaccttagtaaacagtttttggtccatctgtga

SEQ ID NO: 37551 - DNA, 609 bp, Glycine max
  Peptide Sequence Number=SeqID_154329
ggtgcaggggtttgtgcgtggaggatgaggtcgccatcgttgtgggatggtgaagtaggtggcgtgatgtactggacgaggtcacaatcgtcacgggtaaaggaggtgtcgttacggtgcaagtatgcttgtgaggaaggtgttatcgcaggtcttaagactatgattagtctaagggaggccataagacccacctcaaggctcctcctcggttcccaaaaccctaccacttttctcctccgaaccatcgtctccaagcctgagcttcggaatcccgaagccagcgccgcacagccggagcagccgccggcgcccgatctcccgccgcggactccgctcgccggcgcccgcgtccacttctcgaaccccgaggacgccatcgaggtgttcgtggatggctaccccgtgaaaatcccgaaaggaatgaccgttcttcaggcctgcgaggtcgccggcgtcgacatcccgaggttctgctaccacagcagactctccatcgccggaaactgccgcatgtgcctcgtcgaggtcgagaaatcgcccaaacctgtcgcctcttgcgccatgcccgctctccctggtcagcctcttcaatttcctgattttggt

SEQ ID NO: 37552 - DNA, 330 bp, Glycine max
  Peptide Sequence Number=SeqID_154330
atgacggatccatggctagtgttcaggtctgctttgtcttcggttggctcctcactgactgatcgattgatttgcctttcctctgagactccaccatctgcgtgtttggatgtgagagttctgatttatgactcagtcaacctcatcatggagtcttgcgccgccgctaacctctacaaccaaatcgtgacggtggtctatgattgccacaccatgagagtgatgcatagggatcttaagctagaaaacttcatgtcccttagtaaagacgataactcaccgcttaaggccacaaacttgggtctcttcgtgttcttcaagcctaattag

SEQ ID NO: 37553 - DNA, 315 bp, Glycine max
  Peptide Sequence Number=SeqID_154331
atgaactcccacaagcttgctgttattgatagcttctctagaaaataccaagaggttaaagttactgatgattatgtatttgttatgtcaccaacattgcaaatccaagtgaagaattctggtcattttggggttcatgctctcagtgaagttgcttcacacttagctccagattatgttgagcatcatggacttaaatctattcctaaatcagtggctcatggttatactgcttcaggatatggatttattcaacacatgccttatgcttacattcatgaatttaccagaacttccatggctggaaaaatttga

SEQ ID NO: 37554 - DNA, 377 bp, Glycine max
  Peptide Sequence Number=SeqID_154332
gggttccccaacgttggggaaaagaaggggattggaagcctccaattttaaactatccttcaaggggatttctgttttctcttctccaagggttctatttcgccaattccccaatagtgaaaggctatgatgcgaaagtgtatttctctcagcttcaacatgatgtggaaatttacaacggtttggtggtctgcgaaaaaagagagggttttgagaggaaaagggaaaaaacgaaaaagaggggaagaggaggcatcgtcgtcatattcagagtgaagtatgtaaagaagagaaacatggaagaaggtgatgaccataaggctggatttactgctctcatgtccatccttagagacactgttaagaattgggagtga

SEQ ID NO: 37555 - DNA, 273 bp, Glycine max
  Peptide Sequence Number=SeqID_154333
atgcctatgcttcagagtgctgtagaagtctatgctcatacatctggtgctgatgacgatatgacagaatacacaaattctttgacaaatggaattctaaaggcatactcagggatcttactaggatttaaagcaatccagggaaactggccttatgaacttgaagaggccttgcattgcacatccctaatgaaactggctacaagacaagtggtctgggatcaaatcaaaaagggtggaatgaagtggttcttcatcaattcaaagttataa

SEQ ID NO: 37556 - DNA, 549 bp, Glycine max
  Peptide Sequence Number=SeqID_154334
atggaaaccatatcgaaacgctttcagcagctcgatgtttatggtaaaatacatttgaagtcaaagctgcgagaaattgtttaccctgatatgaactccatgtatcctcctctagaaaaagtgaagaccaagggtgctccaaaaaaaccgcttgccaaacaacaaaagtcaacaaaacgcgatccgtcttattgggaaatcgtgatcattggtgaggaacatctgcataaagaactaactagctggtccgatcagtatatgaacctggttggtggcatagagaaatttgaggaattaaggcattttctacttgttgacaacttatctaaggttaccatggacaagtggatgaatattatggatatgggatacgtcattgcttcacaatacaatgtgatcgttgtttctctttcactacaacatagcatgacattttttcctcttagaagtgttgttatgagaccactgtcctttaccaccagtggcgttgctatggagtacacattgtcattctcaggcaaagcagtggctcactccgtacatagttag

SEQ ID NO: 37557 - DNA, 144 bp, Glycine max
  Peptide Sequence Number=SeqID_154335
atggagggtccaattcacaaggaatcacgtgtcgatgttcatgaaaaccctaatatattattcatttgcttactcatttgcaacattctaagggtggaatttcgccaccaccaggatctcatcaagtaccatgatgatatttga

SEQ ID NO: 37558 - DNA, 651 bp, Glycine max
  Peptide Sequence Number=SeqID_154336
gttcaacagatgtgcattaactgtggtgtttgcatgggcagatacttttgctccaaatgcaagtttttcgatgacgatttatcaaagaaacaattccattgtgatgaatgtggaatctgcagaaatggaggtgtagagaacatgttccactgtaacacatgtggattttgctattcatcatacttgaaggataaacacaaatgtatggaaaaagcaatgcataccaattgcccaatttgcttcgagtttctttttgatacaacgaaagccattgctttattggcatgtggtcacaacatgcacctaggatgcattagacaattgcaacaacgtttaatgtatgcatgcccagtttgttccaaatcattttgtgacatgtcagttatttgggagaaagtggatgagattattgaatcaaggccaatgcctgaagaatatcaaaatgtaaagatttggattctttgcaacgattgcgtggaaacatctgaagtaagttttcatactatggcgctcaagtgccctaaatgcaagtcctataataccagaaggactcaagctgcaccagctgaaccagctgcatcagctgaatcagctgaatcagctgcaccagctgaatcagatgcttcttctagttcatcgagggttgaatag

SEQ ID NO: 37559 - DNA, 607 bp, Glycine max
  Peptide Sequence Number=SeqID_154337
atggcagctgacaaactgaaattgaattgtgatgcttcggtaagcttggatcagagaaaagccacagcaggtggtgtgttcaggaatcatttgggttctgtgattttcacttatgctgctaatattggtttttgttcagtgttgcttgctgacaaggttgtgatccttccaatccgtgctatagtctggccctcagtcagaggaggtggttttgagttgcatcaagcaaaccaagtggcagataagatggccaaccatggaatgtctttagataatttggcagataagtttaatgtaataacggttttcaactatcactataatgatgattttatttcaaagaaaatggtttgtgaatggtggctgagtttcccaaggcgaagagagaaagcatttgtgatggcagacgatctgtttgatggattgccccctccttcctcaagcactctcattcttcctcaacaacaacaacaacaacaacataatcatgagccaattcttgttgctaccaacaacaacaaccctgaatcctctgcagttccggctccaaagccaatcctcaaaagtgccctcaagcgccccaaccctactcaacccgacacccaag

SEQ ID NO: 37560 - DNA, 834 bp, Glycine max
  Peptide Sequence Number=SeqID_154338
atgcagcgtcaaagccacatttcggtcgcaatttcactgatatgcatcctgttttgttccaaattaactagagctcttgatgaacctgagtatggttacaacgaaaaaagtgaaaatgggccccaacactggggcgatctgaaagaagaatgggcagactgtaaaatagggcaaatgcaatctcctattgatttgtccactaatggagtggaagtgatccccaagttagggggactaaagtactggaactataagcctcaacatgctattgtctccaacaggggtcatgatgttgcggtcatgtgggaagatgatgctggctcaatagacataaatggaacacttttcttcctccaacaagcccattggcactggcctgccgaacataccatcaacggccggagatatgacttggagttgcacatggttcatgttagcacacaacctgatggaacaaacaagaccgctgttgttggtattctgtacaagtacggttcccccgatccattgctctctaagttgggaaaatacataatggagattcctgaagaggacgaagagaaaagcgtaggggtgattgatccctcagaaatcataaagggcagcaagatgtactacaggtacatgggatcactcactgcacctccttgcactgaagacatcatttggaccgttgataagaaggtaagaactgtttcaagggggcaggtgaagttgctcaaggatacggtacttaattattatgccaaatggaatgcaagaccgctacagttcataaatcaacgagagatacaattatacgttccaaagatcaagaataaacctctgtattag

SEQ ID NO: 37561 - DNA, 1001 bp, Glycine max
  Peptide Sequence Number=SeqID_154339
ctgcagcacctaagaaaagcttgaagttcaaaaccacaacggatgcttctgaagcacaagttattgaggccatgcagaagataacttcacacatcaagaaccctgcaaagttcagcaaggctgcaaagcttgctatacagctgattcaggcaggaagtgtaaagtcagaaattagtgattatttttttgccatattagaagctgcaatgtcatcatccattaattctacagatccttcagttcgggcagattatcattctctgttctccgtagctcaaaacaccaaagagcacctcaataagaagcaaaagaatcaactggaaacttggacaattaatgctgtggtggcgaatgatttatatacagatgacagctttgtgttttctaaagcagctgggcaaatcaaggaagctatatctaatcttcctgttgcaacagaagaggaggacacagaggaagctaagtctctgaaagatagcacagttatagcagatgaaggtggtaaaacacctgccactgataatgataatgagggggaggaagctcaagctgacccatttggacttgatgctctgattcctaattccacaaagaaaggtgaaaaattaaaggcaaagaatgaggcatctgtgaaaataagggaggatgaggaagaaaccaatagattcctcaagtcacaaagagaagccctgataacttgtttagaaattgctgctcggcgttataaaacaccctggtgtcaaactgtaattgatattttagtgaagcatgcctttgataatgtggcaagatttacagctcgtcagagggatgctgttgggaaattgtgggcttcaatacgggagcaacaaactcgtcggaagcaagggaagtcagttaatggaaaacttgatgtaaatgcttttgaatggcttcaacaaaaatatgctggtgaaaagattagcattcgtcattctgttggagctagtggagaccgtcgtgcccaacaatggcttggttaa

SEQ ID NO: 37562 - DNA, 651 bp, Glycine max
  Peptide Sequence Number=SeqID_154340
atggctgataatgatggagttagactgtggggtctaaaaatcacggctcaatttcgcacttacggtggcggcaatggaggttcacggtggctgaaggaggagggtagccatggtcacagacttaaaggagcactcaaaccgagtgtatttacccccaagacctacactctgaagagtccgttagggcctttccctcctgattcagcaatagcgacatctctaacgttttatgagatttctcaagtttttcctctgactgctctgatagggttcccaaacgttagagaggatgagaagggattgaagcctccatttcactgtctatattcgatgggtatttctccctccacagacattagcttgcaaatcccaacgggtgactcaaattcccgctatttccatgccactgccaatagcaggagaaagaggaatattatatctcaattggaggacattgattcgagtttcaaagcccaatctcatgatgatatttgtgaagcgcacatggatcccaagctcaatgaagatgataatgctaccctccttgcacctttcaccattgaagaattcagaaaggcaattttccaaatgcacaatggtaaatcccctggcctggatggtttaaatccaactttctacaaaaagttctag

SEQ ID NO: 37563 - DNA, 1086 bp, Glycine max
  Peptide Sequence Number=SeqID_154341
atggcctccaggaagaggaaagcaatagcatcccggcaccaggaaccctatgataccactagactcacctctgagggggcctgggaacgttattcacagaacattcactcccggaacaccctttcggagaggaatgaatattactcgaacctatatgaacctgaagataaatcaccaaaacaggttcgagtcagagggcggctgattaaatttgatgcaacatcactgaatgctttccgggagatgccaccagtgattcagccaggggagcagtacccttcttactctattttttgcaagttgaacgcagatcctcaggagcttgcctccaagctttgtattccaagcgtgctatcatattctaacatcacccccacttctcatacctctgatctgaacctggaccgggcgaggttagtttatgaactagttatgaagatggacatggacttgggcttcctcatatcacatcagatctctcatatggccaagtctaactcctcgaggctcggctttccagccctcatttccgcactctgcgtggctcgaggagtagtttcagattctctgaccttcgagtccctcagccctgccattaatttggcatacataaaaaagaaccgttggaacctgtacgatcccatgatcgaatttccagggacccgcaaggcacgggctcgaggatctgagggtccatcttcagctgctcctgcttcctttgcacctgctcctccaccacttcctcctgctcattctccagcaccagttccttctactccatcctcatcattccagcaccgatgctctgaagtcaccattcctttgttgcagagcatccaccgtggcttatgcctggtgatgcaaagtatgcatgactcagctcagcatcagccttttatcagaatggatgagttcatggcacaggtggcctggccaggagtccagccttctcctttagggggagaggttgctcatgaggccactccagaggcgactccacaggtttcacatgctacttcacctgtcgtggaggtctctgagggtgaagaaggtgtcgaggacaccgactatgcagtagatctatag

SEQ ID NO: 37564 - DNA, 368 bp, Glycine max
  Peptide Sequence Number=SeqID_154342
gggataatgaaagttctacagcccatgcacctcaacagcatgagccagaactagaaaacaatcactcatctgaagccacaatctctggagctgttgattgtaaaacaagaagattagagacgagatccaatgaggttgttcatcatggaccagtgccagcgttagctgatgcaccatttctaggagtagatccatcttcacctcagcacgcagcagactcttccattccgatcttagagatacatgagggccagaccataccagttcttcctttggacacttctcctccagttactccagtatggcatctaacagatgagaagaatgttcagatacaggacaatcaggaccagtcacaggaattttaa

SEQ ID NO: 37565 - DNA, 249 bp, Glycine max
  Peptide Sequence Number=SeqID_154343
atgatgctattgtcattaaaggagtgcatgagcaacagatgcaatcccggatggaggaatcacctaaatctcagatggtctagccctcaacaacaacaacagcaacctgctccttccttccaaaatgcttctggtccaagcaggccatacgttcctcctccaatgcaacaacacaacagccacagcagcaacaacaacaacaacaacagagacaacaatcaactgaggccccttctcaaccttccttag

SEQ ID NO: 37566 - DNA, 153 bp, Glycine max
  Peptide Sequence Number=SeqID_154344
atgcccgtaaactttctgatagatgaagatgtgaaatttcagctcgagaatgagatagagcaaccatcgaccagagtggagcttaagcaaaagcaaaagcaagtgagagtgaaacctgctacactgctggcagaacaagggttgataatgtga

SEQ ID NO: 37567 - DNA, 294 bp, Glycine max
  Peptide Sequence Number=SeqID_154345
atggagaaagagctaaagtcaggcatgagatggctcccaagaaaggaaaacaaaataagattcttctacaacattgtggaggaagtgaggaacataatgacaacatcaattataaaagacataaaagaatgcaaggttggaaactcaaacattctagaacacagtagcaagtatgatttcaggccatacataaaaaaatacaatcttctgcagattatgtcaactaattacatgctgctcatgaatcaaaccttgcatgccaatcattgcaagacccacacctggctgacttag

SEQ ID NO: 37568 - DNA, 597 bp, Glycine max
  Peptide Sequence Number=SeqID_154346
atggatttcttctcaaatgagagttttgaatgctttcaagcatttgaaaactacaatcttattccattcatgtctctgaaattacctgtttattctgaactagccaaagccttttattctaatttagaaatccatgaaggtaccctaatttctgaagtttatgggattaagatggtcattgaccagcccctattctatgatttaacccaattgccaagcgaaggtgtaccatttgaagatgcactgattgacgattggaagtttgatttctctgtacatgatgcccgccggttggtttgtaccaaccaaacggatatggccagaaggcttcttgccggttcattggcttttgaaagtcgcatcctctattaccttattgttcgcatgttgcttccgagatcttcaaaccttgctcaggtttctgaagaagatctcattgtcatgtgggcctttcataaaggtttacaaattgattgggcacatcttgttagatatcgcatgcataaggcattgcgattgaatgctccattgccttaccctcatcttgttacccttttccttcaacacttcaacatccctcttgattctgaaccttat

SEQ ID NO: 37569 - DNA, 267 bp, Glycine max
  Peptide Sequence Number=SeqID_154347
atggtccagagggaatggatgaaggaattggcgtttcctatgacccggaatgtcgttgactctgactcgaagtgccctttcgctttttcaaaggtgcagggacgcgttgtaatcgattacacaaatatgataatcaattaccagagagcaacattgccagaaataactgtttgtaatcgattacactattatggtaatcgattaccaatggttattctagccagaaaacaaaaaccaaaaggctttctaggagaaaagaaattttga

SEQ ID NO: 37570 - DNA, 255 bp, Glycine max
  Peptide Sequence Number=SeqID_154348
atgactaacctcctaagatatcttttgtttctccttacaaagattcaagggactaaccgcctaagaattctttgtcttaacactggagcgtacatcctttgtggaagaagtagagcttcaagtgaagcgtacatccacttggtgtttcaaagagaacaagggagggtacatcttttgtggctctttgcttgtaaaggattttacaaggttaaaggaaatctcaagaaccggtggttgcttgggtactggatgtag

SEQ ID NO: 37571 - DNA, 612 bp, Glycine max
  Peptide Sequence Number=SeqID_154349
atggcgtttttccaaggttacacgaaatacaaagtgtggggcgagaaagtcgccagtgcacaggattttggtcggcaaccaaagggagaggaccacttcaagtcatggtttcctttcttttcttatttggttgtggctattctgcattgtttggatatttgtctgctgagccatgtgaatgctcattcccgtaaggatggcataccccagctgacacttcagcaggggaaggtcaaagttgtggtcgctagggaggatgttgctgagcagcagcgtcatccacatctgggtcagggtggtcatgctggtgcgcatgatccgcactcgcctccctgcgacagtccgggtaaaatcttgcgctggtgtacacagcaactgggcgatggcctcctcgtcgaaaccgtcattctggtccctcctttggctgtactcgcattgctaaccctcttccaggatcagcgggtggtccaagaactttttaagggcgtctgcgtcaaaagcaacccattggcccattacccacgagcgcatgtcacagatagcttctttggtgggccaggcgttggagtagaattccatgacaatttcgagatcgaacttagccataggtga

SEQ ID NO: 37572 - DNA, 159 bp, Glycine max
  Peptide Sequence Number=SeqID_154350
atgacatttattttagcacaagagtgtagacagataagagaaagagaaagagaaggtggcattggcgtggaggaaggcagaacatggcacgttagtttacaggctgccactgtgattggtcaatgcaatactgagaagcagcaattacagctgtactga

SEQ ID NO: 37573 - DNA, 1248 bp, Glycine max
  Peptide Sequence Number=SeqID_154351
atgagacgaaaccattctaactcgggcaattaccggaatccatgtttaactatgcaccagccttgggcttctctcctcgtttacgggatcaagcgcgtcgagggcaggtcatggcccgctccaatcacaggtcgtctttggattcatgctgccagcaaagtcccagaggagtctacaatcaaagcaatggaatacttctacaaggagatttatgcactcaatggcatcactgatatccaatttcctcagcactaccctgtttctaggcttttgggtataatacctcaacctcgttctctgttaaatgttaattcagttcaattcatcgctcaccaatttgaatgcttgataacaggatgtgttgaagttgttggctgcttaacacgtgatgagctagcatgctgggagatggttcctgaaggggtgcgggtggaagcacaaactgattattgctggctgtgcgaacgaccacagaaattgttgattccttttgagatgcgggggtaccaaggtgtttataacctggaaaagaagatttatgaagctgcagttagaggtctgtctccagttaatagtccgttgccggtgaaatttccacttccagatccacaaaacccattttcattgaagccaggttccatctctgcgcttactcctaacttaaaagcaactgaagtggataaatcatcaagtataagtctggccatagctggggcacaagcagcagccactcagttctcaaagaaggatcagaattcccatagtactgctcagaacaatgcacctactaacatgaatgctaataatgaggacacagaagttgcaacatcttataatctaagatcacaaggcaggtctatggaaaagggcaatatatcatccaccaagttaagtaagacatttgatgatctgacattgccatcatatcacgaagagaaaagcagtagaaataggagtgagggaagcagtaagcagaatcgatctcctggtgcagaagcagatttgagacagtttcctcaaccaccgtctaaggtatctctttctgaaaatggtgtctttatagagtgtgagaggatttctgtcgcccttgatggggaaaaggatgggtacccatttttcattcttggcaaggatgagggcagtggtcaaactgaagctgctcatttatgcatgtatccattaccttgttttgtgtacgaatgcaaagttgctccagcaactcaagggataagccacattctcaaatga

SEQ ID NO: 37574 - DNA, 1227 bp, Glycine max
  Peptide Sequence Number=SeqID_154352
atgctttccctctccgtccctcctctcaacctcaaacccataacacccaatgacctctttctctcatcagcctctccctcacctcaccgtcgctacttcgtgaaacccatctccgccgtcctcaactcatcttccttcaagaaacctgagcagcctctgctgccgcagcatcaagtctaccagcccttccgccctcccccgtctcccctcccctcgcaattcggcaccctcgacatcgccggccgaatcgacatcctcgccaaccgcctcggcctctggtacgagtacgcgcccttaatcaattccctaatccgcgaaggcttctcccctccgacaatcgaagaaaccaccggcatctccggcgtcgagcagaaccgcctcatcgtcggggcgcagtgtccgcgactccctcgtccactccaatgcctgaccccgacctcctcgctgccttcgagaccggcggcgccgagctcctctacgagatccgtctcctcagcgcctcgcagcgctgtcgccgccgcgcgcttcctcgtcgagaatcgctgcgacgggaagtgccgcgcaggagctcgcacgcagagcagggagcataggaacccgtcggagcagaggacttcggcgctggagcaggcgctgcgcgtggcggagacggaggcggccaggaatatgattttggaggagttggaggggaatggtgaagagggggataaggtggatgcaggggagggtgctgtgcgtgttccggtggtgaggctgaggattggggaggtggcggaggcgagttcggtggtggtgttgccggtctccgcggcggaggagagggagattttggaggcgccgtatgagagtaggagccagggggtgtttggtgtggtggtggcggagaagggatggggaaaatgggtggtgttgccttcgtgggacccagtggttggtttaggaaaagggggtgttgtggtatcgtttcccgatgctagggttttgccgtggaaggtgaataggtggtataaggaggagcctatattggtggtggctgacaggagtaaaaaagaggtgggtgccgatgatgggttttatcttgtgaatgctgatggtgagggtttgaaggtcgagaggggttcgggattgaaggaaaagggtttcactcagagtttaggaactgtgttattggttgttagacctcccaaagaagaaaatgatgaattgagtgacgaagactgggagtga

SEQ ID NO: 37575 - DNA, 201 bp, Glycine max
  Peptide Sequence Number=SeqID_154353
atggggattagggttccagattcaaggagagaatatgtgggaatggagaggatggatactaacgcggattcatttgtaacatcatgcagcacgagtctgaatgcttggatgcaatccatcaccccattgtctacagactacaatcttctactactaatgatacatgaacctaagctcaatcactcagacaccgagaaatga

SEQ ID NO: 37576 - DNA, 499 bp, Glycine max
  Peptide Sequence Number=SeqID_154354
atgcgtcaggtggcaggcggatatacccaagtgattatctgtacaaagacagcatctgctgatcttgacccatacgtcagggggatatacccaagtggtaggcggatataccaagtgattattcgtacaaagacaacatctgttgttcctgacccatgcgtcaggtgggaggcggatatacccaagtgcttattggtacaaagacaacatttgctgatcctgacccatgcgtcaggtggcagtatatccgtacaaagacaacatctgttaatcctgacccatgagtcagagataccttttggttatccgcatacttgctttcgttactccaaggctatcaatgtccttttatcttcccaggacaaccaaatacttttggttatccaaggacaatccagtaagatgacgtgccaaaaacctcttctgttgtccaaaaacgacaagtccgatagcatcagagacgtgatggttttcactaacagagctattggtcgattgg

SEQ ID NO: 37577 - DNA, 972 bp, Glycine max
  Peptide Sequence Number=SeqID_154355
atgtctaatcatacttgggatttagttgacttacctaagggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttagctgctattcatggacttatagtgcatcaaatggatgtaaagacagcttttcttaatggtgacttgagagaggaaatttatgtggaacaacctgagggctatgtgattcaaggtcaagagaacaaagtgtgcaagttgagaaaatcattatatggccttaaacaggctcccaaacaatggtatgaaaaatttgaccaaactttgaatgacgactcgcgctttgggagtgttatgtttctcatgaattgtactagacctgatatagcatatgctgtgagtagactaagcagatatactcacaatccaggtaatgaacattggattgcactttgtcgcttactcaggtatcttaaaggtggaggtgccatatcatggaagtcttccaagcaaacttgtatagcacgttcaactatggaatcagaatttattgctcttaatttagcaggtcaagaagctgaatggttgagaaacttgttggcagatgtgccattgtgggggaaacggtctataccagtttctcttcattgtgactctgaagcagctattggaattgctaagaacagtgtttataatggaaaaaggagacacatacgcattagacacagttcagtcagagaattgttaaaaaatggtgtgatctcattacagtttgttagatcagagaacaacttggcagatccgttcactaaaggtctaacaaagaaagttgtacttgaatcgtcgagggggatggggcttaagcctttgtgttga

SEQ ID NO: 37578 - DNA, 661 bp, Glycine max
  Peptide Sequence Number=SeqID_154356
atggctggaagtctatcaaaaatcattccggatatgtcgaaaatagaacctctagatggctcaaattataggagatggtctcaaaaactgttgattttgtttgaagccttagaggttgattatgtgctatttgaagatcctcccgctgatgtcaacgcttctgaatcatctactcctgaaactcctgctacccctgtcgtcacaccgcttcctgcggaaacacaagaagagggacttgcaaacatggtcgacaacaaggtggactggattctagataccggtgcttctaaacacttatgcgccaacaaagagctttttcaccagattgaggatgctgatgacggagaatgtgttttcatgggaaattcagctacaactggagtgcttggtaaaggaaagattctccttaaacttacttcgggaaaaacattatctttgagtgatgttttgtatgttccctctctgcgtaggaacctaatttctggtagttgtctaaatagagctggattaaaattggtttttgaagctgacaaagtagtaataactaaaaatgggtttatccatgaaactagtgccccttatactcctcaacaaaatggcatagcggaaagaacaaatagaacacttaaagaaatgatgaacgctatgttattaagttctg

SEQ ID NO: 37579 - DNA, 492 bp, Glycine max
  Peptide Sequence Number=SeqID_154357
atgttcaaacacgaaacgacgccgtttcgggagggggtgatgctagggttaaaactaacaagcaacaaaaatgacaatatgcagttcaaaaagaagaagacaacagaaattaccgcaaatcttaatgggtgcttcaagctccaacaaattaggttgctgcaagaaaatctctctggaagcggcacagagatggcggatctccgactccgacagctgcacctgcttccccggccggctgcgaacttcgagaaggcgattgattatgtcgtccagaagagcttggtccatttgttcccctcccagaaaaagcacaaagtcaacgtctctgtaggagcatgcctcggggaagacgacgaccaaaccgcagtcgttttgctagcggaagggtgtcgtttgaggatgacggcgtggggtgattatggacattggttcctgaggggaggcgaagagaggaaaagtgggaattggtttgagaggagaggatttgattag

SEQ ID NO: 37580 - DNA, 1482 bp, Glycine max
  Peptide Sequence Number=SeqID_154358
atgaagaatgatacttggaaacttgttgaaaagccagcaaagcagaaagttgtagggtgtaaatggattttcaaaaggaaaccagaagaaataggaatggatagctacagatacaaagcaaggcttgtggctaggggtttcacacaaagagaaggaattgactataatgagattttttttccagttgtgaagcatacaagcattagaatcatcttggcactagttgcagttcacaaccttgaattggagcaaatggatgtaaaaataacatttttacataggaatctagaagaaacaatctatatgagtcaacttgaaggatatgaggtaaaagggaaagaggagatggtatgtttgctgaagaaatctctgtatggactgaaacagtccccaaggcagtggtacaaaatatttgactcttttgtagtgtcaaagggttttagcagaagttcctatgacagttgtgtctacttcagaaggttgaagcctgattgttttatctacttattgctctatgtagatgacatgttgattgcaagtgcagatatggaagccattaaagaattgaagaatctgttgcaatccaagtttgaaataaaggatttaggggctgcaaggagaatactgggaatggatattatcaggaaaagaaatgaaggtctgttatatctatctcagttaagctatgtgcagaaactactgagaaggttcaatatgcttgattcaaaacctgtatcaacacctattgctggacattttaaattgtcaatcactcattctccacaaaccgaagatgaaatcaaagatatgagtagaatcccctactcgaatgctacaggttcacttatgtacgctatggtttgtacaagaccagatttagcatactccgctagcattgtaagtagattcatggcaaatcctggaaaacaacactggagtgccgtaaagtggatcttaagatatctaaagggttcaaagtctgttggtctggtctatggaagaaattcagaaagaatcaatggtctgtcaggctatgttgatgctgattatgcaggtgacattgacaaaagaaggtccttaacaggatacttattcactttgtatggaagtgtcataagttggaaggctaatttgcaatcagttatggctttatctaccactgaggcagagtatataactctcactgaagctataaaggaagccatatggcttaaaggtcttgttcatgagctcgaaggaaagactggtcctattgaagtatggtgtgatagtcaaagcgcaattgatctctctaaaaaccaagtttttcatgagaggacaaagcatattgacattaggatgcattgcatccaagacatcatagcacaaggtgaagttgaagtgaggaaagtggctggagcaaacaatcctgcagacatgttgacaaaaggaggagagcttgctggtcctaatattgaagatccaaggtggagattgttatga

SEQ ID NO: 37581 - DNA, 759 bp, Glycine max
  Peptide Sequence Number=SeqID_154359
atggtaagatatattcagtatccatgtaaaaccaaatatgtagtattggtggttgaggagtttatattcatgaactctaataatgattctgctagaagcagcaatttgaaacaacaaaactttaaccaaaatatccagaatccatgtgatgtacatggtcaatattctgatcttttaaggctttttgagtatggtggactacctcccgaggccaactacttatttttgggggattatgtagatcgagggaagcagagtttggaaacaatatgccttctcctagcatataaaataaaatatcccgagaattttttccttttgaggggtaaccatgaatgtgcttctattaaccgtatatatgggttttatgacgagtgtaaaagaaggttcaatgtaaggttatggaagacatttacagaatgcttcaattgccttcctgtggcagcactaattgatgaaaagattttgtgcatgcatgggggtctttctcctgacatacttaatctggatcagattagaaatctacagcggcccactgatgtgcctgatacaggtttgctttgtgatctcctctggtcagacccaagcaaagaggtccaaggttggggaatgaatgacaggggagtttcatatacatttggtgctgataaggtctcagagtttcttcagaaacatgatttggatcttatttgtcgtgctcatcaggttaaactccctgcctttggtgttcaatgtgttatgccaagtcttctgggttga

SEQ ID NO: 37582 - DNA, 2217 bp, Glycine max
  Peptide Sequence Number=SeqID_154360
agggatcttgcgatggggacaaggtttgatgtggagaagttcacaggggaaaatgatttcagcctaaggaggatcaagatgcaagctcttcttgttcatcaagggcttgatgatgcactacaaggagcctctaagcttccatctacactgtcagacaaagagaagaaagatttgctcagtaaagctcacagcacaatcattctttctcttggtgatgaggttcttcgagaggcagttcttgatttgaaaagtgtagatgtgaggatagatgaggaagatcaagcagtaatgctattatgttctcttccatcatcctttgaaaatttggtggacactatgctttttgggagagatacactcaccttggaggaggcattgatggctagaggaagattagaaaagagggattcaaagagtaagaacaagaagaggtccaaatccaggaacaagaaggcctgctactactgcaagaaagagggtcatttcagaaaagaatgccctgaaaggaagaagaagaacaatggtaaatacaatgatgaatctgatatagcagtggtggctgatggatatgaaagtgctgaagtgctctccatctcaactgaaaaacacagtgaggaatggattctagactcgggttgctcattccatatgacacccaatctggaatggttcagctcctataaggagatagatggagggaaggttctcgtgggaaacaatatggcatgtaatgtcattggcattggaactgttaaattgaagatgcaagatggatctgtaaagttgctccttgatgtaaggcatgttcctgagcttaaaaggaacctgctctctttgggaatgctagatcaatctggatgttcattcaaaggagaaggtggaactttaaaggtattcaaaggttcattacaaataatgaagggtacaaggcagaatgacctttacaaactgcaaggtaacattatcttgaactcagcttgcctagtttctatctctgaaccaaatgcttccaagctttggcattatagattaggtcatgtgagtgagaaagggctagaagaactacataaacaaggattgatcgataatgggaattatcaaaagctaagtttttgtgaacattgtgtatatggaaaccaaaagagagttagtttccataatgcaactcacacaactcagggtatcctagattatgtacactctgatgtttgggggccagccaaggtactttcattaggaggagcaaaatatttcataactttcattgatgattggtctaggaaagtctggacttatctgttgaaacataaaaatcaggcttttaagtgtttcaaacaatggaaattgcttgttgagaatcaaactggtaggcatgtgaaactgctcagaactgataatggcctcgaatacttaagcaaacttgaacctagagctaagaagggaatcttcttaggttatccggaaggagtgaagggatataaagtgtggttattggatcctgaaggtcccaaatctattatgagcagggatgtcttgtttagagaagaagacatgataacagattatcaacagaagtctgattcaattcgaaagggtgttcaagctgagcaaaacagacactctgatcaaggaattaggttggaggtggagaagctagcacaaacatcaagtccagtagaggacagaaatgaagcatctcatgatgaacctatgatttcatcaattcctgaacctgttgatacttcatataacctggtcagagacagacaaagaaggcagattaaagctcctgtaagattgggttatgccgatctcattgcttatgctttgagtatagaaattgataatcaaggctcagaaccaatttcttacaaagatgcaatttccagaaccgacagtgatcagtggagatcagcaatgcaagatgagtttgactctttaatgaagaatgatacttggaaacttgttgaaaagccagcaaagcaaacagttgtagggtgtaaatggaatttcaaaaggaaaccagaagaaacaggaatggatagctacagatacaaagcaaggcttgtggctagggttgtgaagcatacaagcatcaaaatcatcttggcactagttgcagttcacaaccttgaattggagcaaatggatgaaagaggagatggtatgtttgctgaagaaatctctgtatggactgaaacaatccccaaggcagtg

SEQ ID NO: 37583 - DNA, 144 bp, Glycine max
  Peptide Sequence Number=SeqID_154361
atggcatatgctcttgcctattacaaaatgcatgataagggggtaaggaccacatccactaatccagtggctccaagcacgaggttcttctataccctagattctctccgtacagtatcaccctcctcttcttcccatgcttaa

SEQ ID NO: 37584 - DNA, 252 bp, Glycine max
  Peptide Sequence Number=SeqID_154362
atggaggagggatttgtcgatgagtttgcaggcgtagggttcgttggagagtgggtggaagcagcggaagatggtgccgaaacgaccgcgaccgatctcctcgctaagctgagagaaaagtcacccaatcaatgcatattggaaccgaatattccttcggtggatacccttcactcttacaccacgtttcacgctttgcgcaccgcgatacacgccttcacttatactcctacttcaaattttttattatag

SEQ ID NO: 37585 - DNA, 399 bp, Glycine max
  Peptide Sequence Number=SeqID_154363
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtaaggagagtagaccagatggagagaaggcaaacaattcgaggcagaggaagacccaaaaagactataagagaggttataaaaaaggatctcaaacttaatgatttggatagaagtatgttgtgcaagattgattcggaaggaaaagctaggaaggttactcgttgctcctgcaattgtgcaacaatgacaacaagcttgcatcagttgaggctcatgttcttcttgctccatgagtaa

SEQ ID NO: 37586 - DNA, 573 bp, Glycine max
  Peptide Sequence Number=SeqID_154364
atggaggtcgtcactgatgcggcgtcgttggacctcgaattgttgcagcttccagagttttccggtttggctctcaagtctaacctcaatttcatcgagaagctcttcgaccagtggttgtcgcttccagaaagtaatcgattggtaacatcattactcaatgaagcaaagtctggtgctcctttgactgtcccagggaattgctctagtccaaatgcttcaagtaattctttgccttccatgtttcctgctggcactgctccgcctctttcaccaagaagtacatctggttcccctcgcattgtgaagcatagagttggcccttctaatttgggttctcctttgaaagttgttagcgagccagttaaagaagtgatacctcagttctactttcaacatggacctccacctccaaatgaactgaaagaagaatgcttgtttaaaattgatcggttattccatgatcatatggatggcatgcagagacaacaagagaaaaaaggtggaagtagcaaaaatgagaatgttaagatgaatgtgtggctgcacaagaacagccaagatacaaaatga

SEQ ID NO: 37587 - DNA, 201 bp, Glycine max
  Peptide Sequence Number=SeqID_154365
atggagttgccatatgtcgcaacttacctcacgacgggacggcgaaagaaaataaaagaggcaccttctaaaaagaaaacaagtgggagtttccaccaacgtttatttgaggaaaacattagaaaaaccaaaaaatggaaagagccatttggggtaggggaagctcgcccaagcgagttggagctcacccagtcgagctag

SEQ ID NO: 37588 - DNA, 323 bp, Glycine max
  Peptide Sequence Number=SeqID_154366
atgtcaaccttgataacacatgtcaaaatcactgaaggatacactaccatgtactgtaaagcatggttggcaaagcaaaaggccattgaaaacatctatggcaactgggaaaggtcgttttgtgatttatcaaaattgttgcaagctatgcagcaatttcttcctggtatggtcatggagaaggaaacactgccaatgtcaccacaaggaggtcaaacagtagagggtttcgcaaattccatcgtcttttttaaagtttcaaactatgggtttcaatattgcaagtttgtggttcaagtcgatggaacatggttgtacgacaa

SEQ ID NO: 37589 - DNA, 239 bp, Glycine max
  Peptide Sequence Number=SeqID_154367
tctcttattggtgtctctccttcttcatcaccttctgcttccttttgagcttagctcatcagtgggctaagcgcgcatccaccgctaagcgcagcttcagcgcgacaaaagaatctggcagggcatcagcatcaagaccacacgctaagcctgagatcagtgcgctaagcacaacaggtgtcttcagccaggctcagcgcatgactgacgctaagcctgaatccacttacccgcgctaa

SEQ ID NO: 37590 - DNA, 455 bp, Glycine max
  Peptide Sequence Number=SeqID_154368
atgacaggacccctccagatgcaagccttccgcaaggcgtacggaaagattttagatttgaccatagcggaggagattctaggatgtcctcttgggggaagaaaaccgtatcttttctccgggtttcttccctccttgagcaagattgcagttgtgaagtacttggatggcaaggcaagggatatggcgaatcaagaggagtgggtcccgtttgcggacgcactagctttgctaatctttggggttgtcctctttccaaacgtggatggtttggtggacctatccacgattgatgctttccttgcatatcaccataggaaggagagcccggtggtagctatcttggcggacttatttgatacatttgaccgaagggaggccgaacaatcaactggtttcctcgatggaagaaaggaaaggaggaaattctcttctcatgtggggactgtcgcaac

SEQ ID NO: 37591 - DNA, 552 bp, Glycine max
  Peptide Sequence Number=SeqID_154369
atggaagagtttgaagagatcctgggatgtccactaggaggaagaaagccgtatctcttttatgggttctatccctccgtggcaagaatagccaaggtagtcaaaatcatggcacaagatttggaccgagtaaagaaaaatagaaatggaatagtcggaataccaaggaagcatttggaggaaaaggcgaaggcattggcggatcaaggtgaatgggcttcgttcattgatgtcttggtgctattggtatttggagtcatcctctttccaaatgtggatgggctagtggacctagcggcgattgattccttccttgcttatcaacatagcaaggaaagtccggtcgctgctattttggccgatgtctatgacacattcgaccaaagatgcaaaaagagcggtgcgagaatcatctgttgtacacctactctctatgtgtggctagtctcacatctctttctccatgaaagtaggcccgcttgtcccctgcaaggtcacaacatatgcaccgagaaagggaaggcaatctgggagcaactcttggctagtgtg

SEQ ID NO: 37592 - DNA, 414 bp, Glycine max
  Peptide Sequence Number=SeqID_154370
atgataggaagagccgacatcgaaggatcaaaaagcaacgtcgctatgaacgcttggctgccacaagccagttatccctgtggtaactttctgacacctctagcttcaaattccgatggtcgaaggacgataagcacgcttcacgatgtgccgctccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 37593 - DNA, 192 bp, Glycine max
  Peptide Sequence Number=SeqID_154371
atggagatggaaatgggaaaaatgaatcaaggcaatatattgagggcaaatacaaatggtaatgatgctgatgttgcacctaaattttctcctttgaaaattgttcactttggaaatccttctcaagacactgttgacccaagagatggaggctttggaggaagactatggagatggaaatgggaaaaatga

SEQ ID NO: 37594 - DNA, 999 bp, Glycine max
  Peptide Sequence Number=SeqID_154372
atggaaggctgttatcctgatatcgttacgtataactctcttgtaaatttgacttctaaacaagggaaatatgaggatactgctttggttatattaaatcttctatcccatggaatgcagcccaatgctgtgacatacaatactctcattcactctctaattaaccatggatattgggatgaagttgaagatattatgaagattatgaatgagacttccagtcctcctacacatgttacttacaatattctgctaaatggtttatgtaaatctggacttttggatgttgccataagcttctacagcacaatggttactgagaactgttcaccagacattataacgtacaatactcttctaagtggtttgtgcaaggaggggtttatagatgagggcatccagttacttaacctattggtaggtactagctcttctcctgggttggtcacctataatattgtaattgatgggttggctagattgggatctatggagtcagcaaaagaattgcatgatgaaatggtgggcaaaggaatcattcctgatgaaattacaaacagtagtttgacttgggggttttgttgggcagacaaacttgaggaagctatggagctactaaaggagatgtctatgaaagaaaggattaaaaatactgcttatagatgtgtaatccttggattgtgcagacaaaagaaggttgatattgcaattcaagttctagatttgatggtgaaaagtcaatgcaatcctgatgagagaatatattctgctttaattaaagctgttgctgatggggattgtccaggcaaatttaatacttctggccatgtacaggaaagcttgttgggaagttttgacagatacttgcgtgggactgcaaggtccaacagtattggctactctcactcagcaagaactaaaatttcggtagttgaagttgacatgaacatgtgctcgtgtcaatctaatcttcaagtttgtagatttttgataacttga

SEQ ID NO: 37595 - DNA, 183 bp, Glycine max
  Peptide Sequence Number=SeqID_154373
atgaatgctgaaagactcaagaatccaacacaaggaggcacaaaggggccaacggcccagaggatacgagaaaacgaagcccacacccagcccaaagcttcgtacgaaagtagagaaggaaaaacgaaagcgagtacgggcaatccatccaaaaggaaagtgcttcaccagctcaaaagctaa

SEQ ID NO: 37596 - DNA, 219 bp, Glycine max
  Peptide Sequence Number=SeqID_154374
atggctctccaaactgcttctcttgttcttgcttgttttttgggaaagagtggtgggtctctcaaggactccaccttgtttggtcttttattgtcagaacctatcaaagctaacctcagctcttcgacattgaggtgcaagcgggagggcgacgcgaggctcatgggtgcatcttccaagggaggaaaatgtgcggagtcgccaccaatgtttatttga

SEQ ID NO: 37597 - DNA, 249 bp, Glycine max
  Peptide Sequence Number=SeqID_154375
atggcagaatcacattcaaaagaaaccgaaaatggcaaggaaaggtgtgctgcacaagtgacaggctggaatctgtgtaaatcagattgtgtgctcaaattggtacttggtggagtagcagaaatacaatctgtcgatgccatccagtaccaccccacccccatatcattggtaattaattcgataaatgcacttcccagctttgtgtgttggatttgcctgtggttctcatcagcgcttatacgttga

SEQ ID NO: 37598 - DNA, 639 bp, Glycine max
  Peptide Sequence Number=SeqID_154376
atgtttagcgcaggttggatgtgtgaaggacgggtcgccatgatacacgaagaaacccttcaagagaaaccaaattgggtgcggtcgtgtcctccagaatttaaattggggaactggcgaatcgtcaaacaacccagaattttcatggcgaactcaatatccgacaatgagtgctttgaaggtaataataccgaggacccaaacattgattttgagcaactgataagtcaagctgaggaaggggaagatgaagattgggggcttcccccaaagctaaaaagaatggtcgaacaggaagacagggaagtgaagccgcaccaagaagaaatggagattgtaaacttaggtgttggcgaagaaagaaaagaggtcaaggttggcacgagcatgtccacaaatatccgagatgaattggtggctctgctacgaaactaccaagacatcttcgcttggtcataccaagatatgtctgacttgagtgccgacatcgtacaacatagattacctttgaatcccaagtgttccccgataaagcaaaagttgaggaggatgaagcccgagatgtctttgaagataaaagaagaggtgaaaatgaaatttgacgttggcttcttggctgtggctcgatacctagaatag

SEQ ID NO: 37599 - DNA, 630 bp, Glycine max
  Peptide Sequence Number=SeqID_154377
atgcatgctttgttaaggtcattcaaaagtggaaactggtctgaatctaaagtccttgatagtgtagggctgagttgtcgtgctttcacgaggaatctgggtgcaataagtctgttaaatagtttatacgattgttcatattcacacttatttttacacaatagacgcctatttgctgaaatagcttaccaaataacacaagttccccgagtgttcgatactcgattcttatcgttttatactacttgtgcgatccagtgcacttgccggaagttggagctaggttttgaagatcagaaaattgattttgatttgtttgttgaagacaggcctgctccagaacacaatgtttgcctacagcgcatctctgttcatgtgctaagccgcgagtctcaagcgcttagcgcccaacccttgcatctaaggctaatttggtccgctaagctggccaaggttgagctaagcgaacttaaattcgatctgaattcagctaagcttcagcctgatcgctacgcaacaacttatccatggctaagcgggacctattgtcgccaagcgcaattccttatggccttaattgaggtccatgacactaagcgccagtcatggcagctaagcgagattcattga

SEQ ID NO: 37600 - DNA, 713 bp, Glycine max
  Peptide Sequence Number=SeqID_154378
atgggtcgttctccgaactacaaggggattaggcgaatagcctaccccgctaacacctctcgcctttgcctgaaaatcgcgaacatcgcgaaggtaaatcctgacggcgcgtgcgccgaaggggttggtctccgggcggccgccgttctcctcgtaggcggcgcggaggcggccgatgagggcgtcgaggctgccccaggcttggcggagcgggcagggacatggggcaggtgggttggggagaccgaagaacgggcaagggtggttatgaaccttagtcttcccgaactggtcgaggtagtggaggaattccagcacgtgcgcaccgctgcacaaggccaaggagagtggcggacggtggttcctcaggtactggcagaacgtgttccagtcccttcgcttttggttctcgtagcggctcggagtagtagtgctcccgctgttgttgcttcccgaagacagcaacgacactgccgccgccgtcgttggatgattcgtggtgctcgtgctgggtactgtctccatcttgtacctgctgctgggggtgtggctggaaagggaagaccgagaagacagcagcaacctgggcatgtgagagtggtaattggtgggaaatggaatgattcctgggtaaagggtaaaggagtggtgaagaaccgagggttaaatgaaggagaggagagtgttgtgccgaaacaggacaaagtttggca

SEQ ID NO: 37601 - DNA, 189 bp, Glycine max
  Peptide Sequence Number=SeqID_154379
atggcaaagaagtacaatcatcctgtgcatgttgatgatgaagaatttgatattagattttctcagcataggtatgaggctacatcatgtggtgacaactcaaaaacccatccccctcaaaccctaccgaggagagacttaggacttaaaagttttgacactactactggtggtttgaaaaatggatga

SEQ ID NO: 37602 - DNA, 294 bp, Glycine max
  Peptide Sequence Number=SeqID_154380
atggcacctccagactctattcctatagtagagaagtttaatgagatggtagcttggcctgagacccaaccttctcttcataaggaagacgaaggtcccacagctcaggtagctgcgaccactcctgaacaatcccttgaggctacttcagagccttctgcaccagtggtaaacctaccctcacctcagcttgcagcagatccctccactcctcttctacagatgccagaggacccaacgacaccagtcctagtatggacacttctcctcccactactccagtgcttcaactga

SEQ ID NO: 37603 - DNA, 2889 bp, Glycine max
  Peptide Sequence Number=SeqID_154381
atgaggattatgataaagggcggtgtttggaaaaacaccgaagatgaaatcctaaaagcagctgttatgaaatatggcaagaaccagtgggctcgaatctcttctctccttgttcgcaaatctgccaagcaatgcaaagctcgctggtatgagtggctcgatccctccataaaaaagactgagtggacgagagaagaggatgagaagctacttcatcttgctaagcttatgcccacacagtggagaacaattgctccaattgttggccgtaccccttcccagtgtcttgagcggtacgagaagctccttgatgtagcctgtgtgaaggatgagaactatgagcccggtgatgatcctcggaaactgcgtcctggggagattgatccaaaccctgagtcaaaacctgcacgccccgatcctgttgatatggatgaagatgaaaaggagatgctttctgaagcacgagcccggttagccaacacaaagggcaagaaagcaaaaaggaaagctagggagaaacagcttgaggaagccaggaggcttgcttctttacaaaagaagagagaattgaaggctgctggaattgatattaggcagcggaagagaaaaaggaaaggaatagattacaatgcagaaattccttttgaaaaaaggccccctccagggttttttgatgttacagatgaagatagaccagtggaacagccccagttccctactacaattgaagaacttgaagggaaaaggagggttgatgttgaggcacaattaagaaagcaggacattgcaaaaaataaaattgcacaaaggcaagatgctccatctgccatattgcatgccaacaagctgaatgacccagaaacagtaagaaagaggtcaaaattgatgcttccacccccgcagatttcagatcaggaattggatgatattgcaaagttgggttatgctagtgaccttgcaggaagtcaggaacttgctgaaggtagtcgtgcaacacaggctcttctgactaattatgcacagacacctggccaaggaatgactcctttgcgaacccctcagagaacaccggctggtaaaggtgatgctatcatgatggaagctgaaaatctggccaggctgagggagtctcaaacaccattgttaggaggagagaacccagagttgcatccttcagatttttccggtgtcactcctaagaaaaaggagattcagactccaaacccaatgctgactccttctgcaactcctggagctgcaggtctcactcctagaattggcatgacaccaacaagagatggtttttcttttagcatgacaccaaagggaactcctcttagggatgagctacatattaatgaggacatgaatatgcatgacagcactaaacttgagctacagagacaggctgatatgagaagaagtttgcgttctggtttaggaagccttccacagcccaaaaatgagtaccagatagtgatgccacctgttctagaagatgccgaagagcctgaggagaaaattgaagaggatatgtctgatagaatagctagagaaaaagcggaagaagaggcaaggcagcaggcattgcttagaaagcgatcgaaagttcttcaacgggaacttcctaggcctcctacagcatcattggagcttataagaaattccttgatgcgaactgacggggacaagagttcctttgttccaccaacctctattgagcaagctgacgagatgattagaagggagcttctaactttgctggagcatgacaatggtaagtatccacttgatgataaagtgattaaggagaaaaagaaaggagccaagcgtgctgtaaatgggtctgctgtccctgtgatagaagattttcaggaagatgaaatgaaagaggctgataagttgataaaggaagaggccctgtatctttgtgcagcaatgggtcatgaagatgaaccccttgatgaatttattgaagcacacagaacctgtctcaatgatcttatgtactttcctacccgtaatgcatatggtctctctagtgttgctggaaacatggaaaaactagcagctttgcagaatgagtttgagaatgtgagaaacaaattggatgatggtaaggagaagatggtacggcttgagaagaaggtgatggttctcacgcaaggttatgagatgagagtaaagaaaagcctgtggccacaaattgaggccactttcaagcagatggatgtagctgcaactgagttagaatgctttaaagctttgcaaaagcaggaacaattggcagcatcacataggataaacaatctgtggggtgaagtacagaagcaaaaagaacttgagaaaactttgcaaaataggtatgggagtctaattgaagagctggaaaagatgcaaaatgtcatggaccaatgcagattactagcacaacagcaagaagaaattgaagcaaacaaccatgctcgtgagtcaactgagatcattgagagcaaggctggtgaaactgatgtacagagtacagaaaattgtgaaactgtacctgactcagtagagcatggacatgctctagcagttgagtcatctgatgatggaactgctgaccagcaagtagatattgtgcatgaccaggctacttctagcgttagccatgacatggatgtagattctgataaattggctaatcctacaccagctgcagagaatgtcgatggaaaactggaagttactgctactgccagctatactgatgatgggaagaccatgctagaaatgggtgctgcagtggaagtaagtagcagccccaatcatgatgtagttgcggatgctgtaaactcacatgataacagcatggaagaaaccaatgctgttggggaggagacaaattag

SEQ ID NO: 37604 - DNA, 156 bp, Glycine max
  Peptide Sequence Number=SeqID_154382
atggcgaaacaccctatttcgccagcaccatcagcaggacagcagtatctcgttctgccaaggctgttggcgaaatgcgttgccatgggttccgccaaccccattggtgaaacgcgtgccatagcctttcagaagaagcgcagtggtcaagcatag

SEQ ID NO: 37605 - DNA, 492 bp, Glycine max
  Peptide Sequence Number=SeqID_154383
atgtactatggtgaaggaaatgtgggatctcatccaattgactcattaaggtacttcggaagtgagaagagcaaggaagaattcactcatccaagaggcctggacaaagagtttgaggaaaaagagttgaatgtgaagattctaaagtccctcaatagaacttggcaaccgaagaaacaacaacaaggaggagaaaagaaggcaaaaagtcataacaagaagaagacttacattgcatgggaagagaatgcttccagctcttcaagcgactcaagtgatgaagaagaagcctatctttgtctcatggtggacaatgaagtcgaaagtgttaaaggtggaagaagtggaaagcatttttcgagcaatgaggagttatttttgagtacatggagttttaaagtgtcttgtttcttctcccagacaagacttgattcgcccaggcaaatgaaacctgtgaaaacaggggttcatccaatgagttttcttgcctag

SEQ ID NO: 37606 - DNA, 2028 bp, Glycine max
  Peptide Sequence Number=SeqID_154384
atggaacaaatgcaagctgaaattgaagctcttaaggcacaagttccacaagttgatgtcttaaggaggcatttcttatgcagattggggagctttgctctcattcccttacctattcttcctctttctctgactaggggaacctctgatacagattgtaacattggtgctttcgttgagagtttccgattcgagtgtattcaaacctgcatgatgtcccaactccttgataatgttgagtccagaattacttccatcgaaacattcctccattcccatgatgcttccatgcagcgtcacgaaattttcgaaacccctccccatggatcttcaagaccagacgacttgaggttggtgacgaagcaagtcaatcttcctccattcaccagtgaggatccgcttgctcagatctccatggacgggatgacatggcgttggttcaaggtcttgagtgacttcgatgcttacctaactcgggccactttcaaatgtgcactgttagaatgttacggtgacaatcagttgggcaatccgttctctcaactcaagttgcttcgccaaacgaccatcattgatggatatgtggaagcttttgagatcctcactgtgcaagtaccccttctgactgaagagcaatacatggggctcttccttggtggtttgcgcaaggacatccgcttgaaggtgttggcatttgaaccactcaatcgccatcgtctaatctttgttgcacgtttgattaagtgcaaattgggccgagttaccactcatagtgctaatgggcttattagtgcggtccattctgcaagtggctctacaggatcacataatagaggtcccagatctgggccaatcactcaggcccaaccccttcacgacccacaggacaatgtcgcgtctgtctcagaatcacccaccagccttgaggatcaaccagacattaacgttcaagacatggcctgtcaagttttggattatcgtgccttggatccaagtgagttaatccaatccaaaaccatcaagttggaaggggagttggccgaatatcccatcctcctcctcgttgacagtggcgatagtcacagttttattgcacgagaattggtgagctctctgaatttggaggtcacactgacaaaggcattttctgttgggttgggcaatgaaagtacgtgctcgactcagggagtttgcaaagagctgcgtgtgaagttgggccgctacacaattgtgacagacgcatacatattgaacttgggcggagtggacattgttttaggggtggaatggcttaagaaatttgggcgaacaaccatggattggcagaagaagaccgttagctttgaggataatggccaattgaccatgttgaatggtcatcactttaaagacatccatcgttctctgccaacgaagaaatatgctgatgctcataggaggcatgtgacttatgctcctggagattgggtgtttgtgaagccttgcccacatagacaacagtctgtcgttcgtaggatcaatcccaagctgttccctcgctactatggaccctttcaggtgctgtcttgtgtaggagaggtggcctacaaacttcagcttctggactctgctcaaattcacccggtttttcatgtttcacagctcaaacgatcaatgaagagtggttctgctccgactactttgcctcctgggctggctgttgctgaatatgagcctcctagtcctgaagctattttggtaactcgggtaggcaagcaccaaggcaactcagtggaagaatggctgatcctgtggaagtcacagcctgtggaggaagcctcttgggaaagggcagtttctattaaagaaaagtttcccaatttttgccttgaggacgaggcaacattcatagggggtggtattgataggaatttatcttccaagagagagaaggagtgctgtgaggtgctgagagtttctgtttatttgggattggggagcacgtcagatttggaaattgaaattggaatcaagagagccttactctga

SEQ ID NO: 37607 - DNA, 870 bp, Glycine max
  Peptide Sequence Number=SeqID_154385
atggataactcaaaaaacaggcataatgacaatttgggtgtgaacaaaatgggaaaaaacattaggaagagcccattacaccagcccaattatggcaacaacaacaacattaatgtgggtagacagcaacaacagcctcagcctcaggtttacaacataagcaagaatgagttcagggatattgttcagaagcttacagggtcaccctctcaggaccctcaatccaaacctcctcagaacaacaattccccaaaacctcaaagcatgaggttgcagaaaattaggcctcctcctttgccacatgtgaggcctccattgcctgttccttacaataacaccaccttgccagcagctagacctgctcagtttagacaacaaccatcaccaaaccctttgccacaagttaatagtatagctgagtcaccaatctctgcctacatgagataccttgaacattccattacagatccagcttcaaggggtgcccaatttcaacaccatccggcttcttctgctttgcttcctaaccctcctatgttgcctttgaatggcacaagtcctcctcctcctgtgcctgatgttccttccccacaaccaaatggacctcctatttttcctttaccttctccaatctctcagtttctcttgccttcaccaaatggctacatgaatttcctctcccctcagcctggttatccacctctattgtcccctggcattcagtttccatatcctcttactcccaatttccctttctcacccttggcacagtcagggattttaggccccgggccacagcctccactttctccagggctgtttcctttgtctccttcaggctttttccccatcacaagtcctaggtggtga

SEQ ID NO: 37608 - DNA, 225 bp, Glycine max
  Peptide Sequence Number=SeqID_154386
atgccagaaacttcaatgttgcagaatgggttgaagcctagaacaacggtgctgaaaccctcaaagcagcaaactaaaaaaggccaaacctcgatgccgaaaccacggtgtgggtcgcgtagcactaacccttccaaactgcgggcagggtgggaaagtgaactcaaaaggctgcctgctaggggtcttagcgtagcgggtgctagagatctaaattcaaattga

SEQ ID NO: 37609 - DNA, 528 bp, Glycine max
  Peptide Sequence Number=SeqID_154387
atggagctacatcactttctaaagtttgtggatccttctaatgcttctaaaactacagaaaatttatataagattttgagggatgttgtgttacgtgttggccttgaaaatgttgtccatgtagtcacagacaatgctgcaaattatgttgttgttgcatgtgttgagaaattgaaacttactgaaccacttgtgcttgtgttacgcctcgttgatagtgaagataaactgactatgggatttctttaccatgctatgcataaggctagggaggagatggtgagaagcggtaataacggtaagcttctcaataaatgtcgtttgttgctgtcaaagttattagacgtgaagggggaaaacgccattgccactggcggcaaggctcaacccgccattgccagtggcggcaaagcaggagagaggggtgtatcgcccctgggtgctggcgagacagccatgcttcacgtgaaccttgcagggcttcaacttttcaggcttgcaggcttggttctgctctccattgattag

SEQ ID NO: 37610 - DNA, 168 bp, Glycine max
  Peptide Sequence Number=SeqID_154388
atgtggcgagggtttatgatgacgatgacgaaggattcccatatggaaggttttgagggaaaggggtttttgagaaagacgaaggtggtggtgcaaggagggctggtggtgcaagatggtggagcgaggaggccaatggtggcgttagggtttgaaagagagggatga

SEQ ID NO: 37611 - DNA, 549 bp, Glycine max
  Peptide Sequence Number=SeqID_154389
atggttatagttaccaccgccgtttactggggcttaaattctcagcttcgccttacggctaaccggacaaccatcgcctggcttggactaccttcctgcgtcacacctgttaatacgctaaccgcaccagcatggggtcacgtgctcccctccacggtgtcacccgaaggcaacgatgtgaaggctcggacgtttagcaccactggattagcttgggcggttcttcgccggtacgggaatatcaacccgttgtccatcgactacgcctgtcggcctcgccttagcctccacggctggtttccaccgccgcttcgctggccacacgacgctctcctacccatcaacacggctggaccacgaaggcctaccaataatgtcaatgccacaacttcggtggcgtgcttgagccccgttacattgtcggcgcggaatcacttgaccagtgagctattacgcactctttcaagggtggctgcttctaagccaacctcctggttgtcagagcaactccacatcctttcccacttagcacgcgctttgggaccttag

SEQ ID NO: 37612 - DNA, 276 bp, Glycine max
  Peptide Sequence Number=SeqID_154390
atgtcgtacaggatgtcacgacatcacgcttcagaacatgcagtttatatgtgtccgtatgaacagattaaacaaggtaccatcaaggtggctcacaaatcactcaagtcccaaaactcacaaaataactcttcaatcccggacttggtacagaactcgtgcagcctccatgattatatagccgtgtacgattctgggctgcaactccttgatgctggaggagatctatcttcttctgaaaaatctgcagttaaagaactaaaagataacttttga

SEQ ID NO: 37613 - DNA, 738 bp, Glycine max
  Peptide Sequence Number=SeqID_154391
atggcccgcacgaagaagacaggggagatgacgactgaggccgcaaaggaaatcgctgagaagattgattcgttcgtcccccatggacgtcaggatgttctggccgctgctattggatgtccagagcaccctggacgtgtccgtgctgctggagctggtgtcaccatcaagcaatactttggatcggctccacggacgtcccgcagcgtttcctccctgcctcctgacgaattacagcagctgacccaacagatcagggaccagctagaggagtccatcacagagaaagtgacgaggcaggtcatggcatccttcagccagcttcagtcacagatgcaatctcaggcacctcctgagcctctggttggtcctggtccctccggtcctcgggtgagcacaaaggggagttgtgttgatccctcaggaaatgatcctgagatgggtgactctgacaggtgcggcttgtacatagaagcagatcctgcccgcatggtttccgtggggagagtttatgagggatcgactcttgttcatagcactcctttgttgcttggccaagtaaaggtgagtgtggacgaggttaaagatgcagatgctccagttcctgtacccactgctgaggtttccttagtggggcaggcacttcacacctttcttgcttggccgacacatctgatcaagtctttatcacaccagttacttattgtccttactatatgtttcttctttttaaattaa

SEQ ID NO: 37614 - DNA, 198 bp, Glycine max
  Peptide Sequence Number=SeqID_154392
atggttgatttcgcgaagattttcaaccgttcttcgtcactcatccctcgttcttcggtcttcaaccgggataaaagtaacttaaccaaacactttgttctcaaagaactacgtaggtctgatttccttatcacaattgaggaatacataggagcaaagggaaacacccttgtcgactgcaaaaagataaaaatataa

SEQ ID NO: 37615 - DNA, 577 bp, Glycine max
  Peptide Sequence Number=SeqID_154393
atggccttctgtggtggaacttttgttaagctaaactattctgtgtccccatgccacaaatacaaagctccaagtccataccatagctacagaaacaagttctgtgtgagagtttcagcaagtggctcagctgatgaggagaggactattataaagaaagagaaagatgggtggaagatcaattatgcaggagagaaaccagcaactctattgttggacacaatcaactacccaattcacatgaagaatctgtcaacacaggatctggagcaacttgcagcagagctgagggcagatattgtacacactgtgtcaaacactggtgggcatcttagctcaagcttgggagtggtggagttagcagtggctttgcatcatgttttcaacacacctgaagacaaaattatatgggatgttggccatcaggcatacccacacaagattctcacaggtagaaggtcaaggatgcacaccattaggaagacttcagggctagcaggctttcctaaaagggatgagagtattcatgatgcttttggggtaggacacagttctacaagcatatctgctggtcttg

SEQ ID NO: 37616 - DNA, 1086 bp, Glycine max
  Peptide Sequence Number=SeqID_154394
ttctgtgtgagagtttcagcaagtggctcagctgatgaggaaaggactattataaagaaagagaaagatgggtggaagatcaattactcaggagagaaaccagcaacaccactgttggacactgtcaaccacccaattcacatgaagaatctgtcaacacaggatcttgagcaacttgcagcagagctgagggcagatattgtacacagtgtgtcagaaactggtgggcatcttagctcaagcttgggagtggtggagttatcagtggctttgcatcatgttttcaacacccctgaagataaaattatatgggatgttggtcatcaggcataccctcacaagattctcacaggtagaaggtctaggatgcacaccattaggaagacttcaggactagcaggctttcctaaaagggatgagagtgttcatgatgcttttggggtaggacacagttctactagcatatctgctggtcttggcatggctgttgcacgtgatctattgggaaagaataacagcatcatttcagtgattggagatggggcattgacagcaggccaagcatatgaggccatgaacaatgcagggttccttgattctaacatgatagttgtacttaatgacaataaacaagtctctttaccaactgccacacttgatgggcctgcatctccagtcggagccctcagtagtgccttaagcaaaattcaagcaagtgctgaattccgcaaactcagagaagctgcaaaaagcatcacaaagcaaataggaaaacaaacacaccaggttgcagcaaaagtagatgagtatgcaagaggtattataagtggttcagcctgtacattttttgaagagcttggcctatactacataggtcctgtggatggtcataaaattgaagatctggtcaccatctttgaaaaggtgaaagcaatgcctgccccaggtccagttctgattcactgtgtcacagaaaaaggcaagggatatcccccagcagaaaaagcatctgataaaatgcacggtgagaaagggatatttcttttacatctcaaaaacaaggaattcaaaattaattttgtctaa

SEQ ID NO: 37617 - DNA, 105 bp, Glycine max
  Peptide Sequence Number=SeqID_154395
atgacgacgagtaactcagcagtccagcacgacaacgatgacgacaaccactacgatgcgagtagcttagcgagagtcattttcggggatacatcttgcatataa

SEQ ID NO: 37618 - DNA, 597 bp, Glycine max
  Peptide Sequence Number=SeqID_154396
atggaaggaggggagaaccgggattcttatttcgtgtgggaaatttccaaatgttcccttgatggggacgcggggttgcatcaattacaatcccgtcctcactataagacaacttggttaccctatgagaggggcgccatcagaggaaggcctcatacctttcattacacgagggtccacaaggcatggggaatgtcggaaaaaaaggacaaggaacttagggggagtagcaatgggcccatcggcggctaccgtaggtggttgaaagcctacgcacaagatctggattggttcccgagtttgagcaccacttgggggatggagattgaaactctggaagaagacgaagaggtacaggccctcaagatagaacttgagaaagcccagacagtcaaggaaaagttcaagttagtagttgttaagatccgaaaggagaacgcccaactgagagacgtcaatatagccatcaccaaggccttggagcaagagactaagagggcccgtagggaagaacatggccaaaaaaaattccgaggggctctgtgggacagtaacagtgagcttaagctccagagagaggcacaggaccaatcatga

SEQ ID NO: 37619 - DNA, 315 bp, Glycine max
  Peptide Sequence Number=SeqID_154397
atgtggaagactaaccaacccaatacgacaaagtcgtttggaatgggcaagatcagccctgttcatgtagccctgattgtttaccagtaccttaacgacaacaatttttctcaaacgcgctctaccttccgcaacgaggcttcctccctcttttctgattcgttgatcaatgaggcatcgaagagttggatgagcttggggcagatactggatgattatatgtgtttgaaagtgcaaaaggtgatgctggatgaacaacaggtcgagataagacatcctaacagaccgatagtcttgaatctttttcctacatga

SEQ ID NO: 37620 - DNA, 669 bp, Glycine max
  Peptide Sequence Number=SeqID_154398
atggcggtgattcatgatggctatcttttagatctttttcgcgccaaaatccgtattttttatcttcccatccatttaaattcacttctctttgggaagaaattctctttaccgggcatcacacatctcttcttcgtgggaacgaaaatgtggaggcaagtgaaagccacaagtcaagatgagtcgatcggaagaaggaggaacatcaatcccgttcatgtcgccttcattgttgataagtacctctgcgacaatcatttctcaaacacgcgttgcatctttcgcaacgaggcatcttctctctttgccacttcgtcaatcaaccagttgccgaagactttggaggagatgctgaatgagtatatatttttgaagaaacaaaatgtggtcctgaatcaagaaagagtcatggtgatggaagagaaaaacaggattcaaatactgttgcaaggcatgcagaatgccctgaacacttacaatgcttttcagaggtcaccctcactgaatgtcgcggggatgaatgcaaattttgcagtagttcctcaaccgagagtttataacaaaactcctcaaggtacaacgttttttttttccttgactaatcatgagttgaaatattggttaccattgtatgttcttgttttaattcaaggaggtttgcaactgtaa

SEQ ID NO: 37621 - DNA, 342 bp, Glycine max
  Peptide Sequence Number=SeqID_154399
atggagcatgagacattccttgcaacttggttggcagagattgatttctctcccaatggcttggatggtggaagcagtcaatactgtatcatcatcgtgattttgcaaagaatattactcggtgaaagagcagtctatgcaatgatgcttgtgtttccacctgaattttctcctttgaaaactattttatttgggaatccttcccaagacaccgttgaaccactgatggaggctttggaggaagactataaagatggaaatgagataaatgaatcaaggcagtttattgaaggagtattggatcttgaaaagagaatcaatagactagatacattgacttag

SEQ ID NO: 37622 - DNA, 129 bp, Glycine max
  Peptide Sequence Number=SeqID_154400
atgagcactgcttgccatttagataaagatgaaaccggtcagtcaatagatgttaagaaatatcgaggtttggaagttgggttgcttaaggaggaagcaactgggcggcaagctcctccacgttgttga

SEQ ID NO: 37623 - DNA, 249 bp, Glycine max
  Peptide Sequence Number=SeqID_154401
atgggagttggtttctttgctaataagaaagaaaccaatgggttgcaagtgggtaggtacaaggcgagattggtcgcaaagggtttcacacaaacctatgagatagattactcagagacctttgcccctgttgccaagatgaatacaattcgagtaatattatctcttgctacgaattatgactgggaattacaacagtttgatgtaaagaatgctttcttgcatgggaagctagaggagaaaatctaa

SEQ ID NO: 37624 - DNA, 312 bp, Glycine max
  Peptide Sequence Number=SeqID_154402
atgatcttttggcatcatcaaaacatcaaattctttgcttctacagtcgtctgcaccttttcgtcgaagactcaatgtctatcgaccgagactactttagtctctcgtttttgtcatccagagacaagcgagtccgatgatacacccaaggctactttagcctctcctttcatcaaccagaggcaagcaagcccattgacacacggagaccaatgtggtcgtctgcaccttttcgtcgaagactcaatgtctatcgacccaaactactttagtctctccttttcgtcatccagagacaagcgagtccgatga

SEQ ID NO: 37625 - DNA, 183 bp, Glycine max
  Peptide Sequence Number=SeqID_154403
atggagaacgagcaatttctgattgaacagacttggagatcaactcagaagcggtcatgcaatgctcaatggaatgccctgaaacttctccatgataaacacatgttgcattccagttgtatcctcgagaaaatggaggttgaggaatctttgctgggattatggctaccattgcattattga

SEQ ID NO: 37626 - DNA, 411 bp, Glycine max
  Peptide Sequence Number=SeqID_154404
atgaaggttatgcagaaatcctctttagcgggaagacaatcacagaatctggagataggggacaacaacaaacactatcgccttaactggaggaacaatgccgacattacctccttttatttcacccatttccccgacgaagctaatgcagagttgctatggaggcacttcaaaaagtggggtgacgtacgtgaagtatacatcgctaaaaggctcaacaaggatggcaagagatacaggttcatgcggttcaagggagtctcggatgcaaaaggattggaggtgagactggacaacatcttcatcaacgattgtaaactatttgtcaaccttcctaggttcgacagaccagttcggaatacagagttgctgcaaacgaaccccattgggaggaagtacaccgacgaagca

SEQ ID NO: 37627 - DNA, 255 bp, Glycine max
  Peptide Sequence Number=SeqID_154405
atgagaactattcttaggagataccacggctctgagttccaacaatcatttaagttcacttgtcctctcataagattttcacagtacatcaaatgttgggttgcttatgcatttccgaacattctcaacattaccaagaatgtcaaaagggaaaagattaagcaagggaactcgttgttcagtagtgatgatgatgaaggatgtcactaccgagtggagacgatggtgaaggaagttgttgttgagtggcactaa

SEQ ID NO: 37628 - DNA, 330 bp, Glycine max
  Peptide Sequence Number=SeqID_154406
atgtggagctctctaaaagcgaggatgtgtagccctctgaaggcgaggacgtgtagtcctttgaaggcgaggacgtgtaatcctctgaaggtgatggcgtgtagccctatgcaggcaagggcgtgcagccctctgaaggtgagggcatgtagccctctgaaggcgaggacgtgtagtcctctgaaggtgagggcatgtagccctctgaaggtgaggatgtgtagtcctctgaaggcgaggaagtgtagtcctatgaaggcgaggatgtgtagtcctctaaaggtgagggcgtgtagccctatgaaggcgagggcgtgtagccctctaaag

SEQ ID NO: 37629 - DNA, 1332 bp, Glycine max
  Peptide Sequence Number=SeqID_154407
atggagacttccacagtgtgcttgaaagagaggacaaacaatgaatctgagcttaagcaaatgctgcaacagttggtgaagaatcaagaaatcaaacaagaactcaatgggtcattgaagaagcataaactgcacaagacactgaagagtcaagaaatcattcttgaaaagaaaagaatgaaagatgaggacaggatggagatgcatccttctcacataaaaaagactgagggaataaaagagatcaagttgtggtcggaaaggtggatgcaggaacaagacatcatgttggaggacaagattacaaataagcaaagcattcaagagaagatcaatgcccattcaaccaagcaggtcaagaagaccatggaagggagtgggtcagaatgctgcaataatacagaggttcattcttggacaagaaaggcgcagttagccacctttgggggttgctcagagggagaaacaaaagaggatcaccttgtttgtgtgttacatcaagcattagaaacagaacaatacaatgaagtgttgaaggagagcaagatagggagatcatcagaatccttgaagccaaagaaggatcttgttttctttgaggaagagtcagtcagcccatcatcatccttggaaccaccaaacagaaaatcatcagaggtagacatttctatcaaaggcactcgagatgcagagctagttgttgaagagtctcccatcaaagaccacccaatgtctcaaagcacatttggcccaacacataatgcaaacaaggggaaatcaatgaatggctacaatgtgattcagttgactgcaaaggccaatgaaagtcttttgtcaaaatatgaaaattgggatgaagatgggggtactggcaagggtggtattgttaggactatgaggaagggggacatcgaaatagagcacgctcattttgaaggccaagctgcgagtggccaaagacctagcggaagcggagattccgacgatgccgagaacgaggccgcgacagcggcgcatgccgcggcagagcggctggacggagccgagccagccggaggcggagagcgggtggcgggagaggaggtgcgtgcggcggaggaggccgaggaagagcgccatgacagagtccgcgatctcctcggcgcgcgaggtgtcaacgtggacgaggcggaggccgaggtcggcggcgagggcggagtcgacggcgcggtcggcggagccgaggcagaggatgaggtggtaggggcggaggcggcgctgggcggcgcgagggaggtaggcgagggagtggaggagcacggcggcggcggactcgatcttgccatcggatag

SEQ ID NO: 37630 - DNA, 618 bp, Glycine max
  Peptide Sequence Number=SeqID_154408
atggaggatcagaataagaaggtccgaaaaccttacaccattaccaagtccagagagaactggaccgaccaggagcatgacaagtttctcgaagctcttcacttattcgaccgtgactggaagaagattgaagcatttgtaggttcaaaaacagttatccagataaggagtcatgcacagaagtatttcatgaaagttcagaagaatggcacaagtgaacatgtacctccccctcgtccaaagagaaaagctgctcatccctacccacaaaaggcatctaaaaatgctcttactatatcccaagttgcgcggccattgcaatcttcatctgctttatctgaatcatcacacatctataggccagattcatcatctgtggttagaactccagttagcagtgtgccattgccatcttgggtttataatgttacaccaccagtcagtcttccccgagtgactaaagatgatatggtgatgatgagtcaacaaatcaatcctttcagcagtagtaatgagagcactcctaggggttggccaattagcaaacagacagatcagggtgaccaaggcaagccaactataggtaggaatgcttttcttactcaaattttaatttga

SEQ ID NO: 37631 - DNA, 309 bp, Glycine max
  Peptide Sequence Number=SeqID_154409
atggctagcatgcgtgtaaagaatgaaattgaatgggccgtggtgggccgtgcagcacataatagcgtgtggtggtcggagagaagaacgggatggagtgcgcggcgaaggggagcggaggaaggtgcggcggcagcggcagcggcggtgccacaagactctgcgctcgctgcgaagccgttgcatattgctctctctctcaccaggaaactaggtgttcattttttagcaagagaggccttcatcaagtgggaatgtggatgcatgaatgccattgtggagcatcatctacttcatttgattgtttag

SEQ ID NO: 37632 - DNA, 1023 bp, Glycine max
  Peptide Sequence Number=SeqID_154410
atgagctttgaaagtgaagataagggcttgttggatcaggcaactgatcaaggattggaaaagaagttaaaaatttcatacacaagggagtttttgttatcgctaagtggattggacatatgcagagagttgcctagtgggtttgatcgatcacttttaagtgaatttgaagatgcttctcaagatcggcagagaagtacaggtggtttgtcaatgcatagttttagtcgacgcaatgagtatagttcatcccctcccaccaaaggcgatagcttttcccggggaatacatggaaaatgggaaactcgatcttcaggactgtctgataaagacagtgattctcaatctgaattggattcagattttggaaaacgttttggcaatcaatcgcgtagatcttggcaaggtcctgagcatgatgggcttctaggtagtggttcttttcctcgaccctctgggtatactcctgggttgtctgcctcgaaatttcgagctaatgacaactaccagctaaatcggtctaatgagccttatcatcctcctcgcccttataaggcacctcactcacgtcgggagactaatgactcttttaatgatgaaacatttggttctttggagtgtacaagtgaagacagggctgaagaagaaagaaaaagaagagcttcttttgaattgatgagaaaggaacaacataaagctttccaagaaaagcataagttgaacccggacaagaataacagcgattttgacacaacttcacttgctgacgacgatgagaaaatgctagttaataggagcaacaagtctgtggagcctcatgtgactctaccagctttaagcaatgatgagaaatcttcttccctttcacagactccttcagcagcaagaccacttgtaccccctggttttgcaagtacaaagttggaacgcaatttggcaaccaaaacatcccttaacactcattcaacagagggaattttagttgttactgttaatagttatgatagaaagttgccaagttga

SEQ ID NO: 37633 - DNA, 645 bp, Glycine max
  Peptide Sequence Number=SeqID_154411
atggcgtttccctacatggaagccgttgtcgggtttatgatattaatgtacatatttgaaacttacttggatgtgcggcaacatagtgccctcaaacttcctactcttccaaagactttagaaggagttatcagccaagagaaatttgagaaatctagagcctatagtcttgataaaagccacttccattttgttcacgagtttgtgacaatagtgatagactctacaattttgtacttcggagtattgccctggttttggaagatatcaggagattttatgacaatagccagtctcaatgctgagaatgaaatactgcatacccttgcctttttagctggggtgatgatttggtcacagataactgatttgcccttttctctgtactcaacttttgtgattgaggcccgtcatggttttaacaagaaaggaggtccatacttggccatctatctttgggcttttacatttggtctttctattgtgatgatgaccctttatccagtactaatagctccactcttcaataagtttactccagcagtggaggtgtggggatgggaggatttagagcttggcttggatgaggaacagtccatcttggtttttgggagaagcatcccagaggaagggcacaatagtctt

SEQ ID NO: 37634 - DNA, 963 bp, Glycine max
  Peptide Sequence Number=SeqID_154412
atggctaccgctccttcgcttctacactcatctgggtcctcttttttctctcaatttcgtgcctttcaattctcttcttcttcgctgtttcctcatggaaacaggcatgggaatgccgtggtctctgtgaaggcctctgcttctggggttgtgttggtggagaagtctgaggcagagaaggccaataggctcaaaacagcttacactgagaaaattattcccttgctcatggaagagttctcttacaccaacaaacaccaggtgcctaaaattgagaagattgtggtgaactgtggtattggagatgctgcgcaaaatgcaaagggtttggacgcggcaataagtgatctagcactgatcacagggcagagacctattaagactcgggccagggcttctcttgccacttttaagatcagggaaggtcaaccgcttgggattgctgtgacactaagaggaaatgcatattcgtttaatctgaagcacgatttacaacccccaacaatttacatcccagatgtgaaaatctcagaagcaacagctagtagcattatcggatgtgaaaaatcacgtctccgattcatttccaaacatgctacggagtttctgtcatgtcaaaggatgatgtattcattcctagaccgagttatcaacctgggacttcctaggacaagagatttccaaggtgtgaaccccaacagctttgatgggcatgggaactacagcattggcattaaggaccagggtgtgttcccagagatcagagccgatgttgttggtaagcctcggggaatggatatctgcatcgtgacgacggctaataccgaccaagaagcacagaaattgttagctcttatgggtatgcccttcagagagggaagtggtcctgccacgacaattcggaaaaagaagcttaagtctcatcattttgatgcaaaatcaaagggaagaggaaggaggtga

SEQ ID NO: 37635 - DNA, 324 bp, Glycine max
  Peptide Sequence Number=SeqID_154413
atgggtgatcctgaggcacagtatgcattgggttgtcatctaagagttgaggtgaggaatgactatgtccagtctgatcaacaagctttttattatttggagaaagctgtggaccagttgcatccaggtgctctttaccttttgggtgctgtatatttgacaggcgactgtgtcaagaaagatattgcttctgcattgtggtgtttccacagagcatcggaaaaggatcatcctatgtgctatcctgcttttcgcatttttcgggtcggctgctacgtgccactatttggaattgataacaaggcaaaagagaatgcttcatga

SEQ ID NO: 37636 - DNA, 531 bp, Glycine max
  Peptide Sequence Number=SeqID_154414
atgggtgttgatagatcaaagctgaataacagtggaataggttacagaatagaaagcacgtatacagcaggaagtcatgcctatatgtatggattcttcaagaacaagaggattgtgctttatgacacattaattcaacagtgcaaagacgatgaggagattgttgctgttattgcccatgagttgggacactggaagctcaaccatactgtgtacacgtttgttgctatgcagattcttacacttctacaatttggaggatatacactggtgcgaaattcaactgatctgtatcgaagctttgggtttgatacccagccagtcctcattgggctcatcatatttcaggctgatggctttgctaagaagcttggatatgcatctggactacgcggtggtcttgtgaaactacaggaggagaatctttcagctatgaatacagatccttggtactctgcttatcactattctcatcctccccttgttgaaagattggccgcgctggacgaaccggataagaaagaagactaa

SEQ ID NO: 37637 - DNA, 363 bp, Glycine max
  Peptide Sequence Number=SeqID_154415
atgcacccagcgttattgctggtgcacccaacatcctttaaaaattccacaaatgctcctgttttttttccttgtgcggatcaagttgacccgtggaagacttgcgaaccaagtgcggatcaaatcaagtttggcttacggatcaagttgatccgtaaagccttctacggatcaacaacggatcaacttgataaggaaaatccaggagatagggtgttgggtcatgcttggaaggtggagggatcagtaaggaagaagacgaatgcaaggaaagagcagagaaagagaaaagaggagagaatggctataaaacaaaaggagagggaggaggagttgaaacgcttaaagaatttgaagaagtag

SEQ ID NO: 37638 - DNA, 135 bp, Glycine max
  Peptide Sequence Number=SeqID_154416
atgactgtgagaattaggggagaccagcctccacacctagggtacaacatattttacacaacttggcacaaaattccagagcggaccatagtgcctaattggggagaagtgctctggaggcaacaagaggagtag

SEQ ID NO: 37639 - DNA, 477 bp, Glycine max
  Peptide Sequence Number=SeqID_154417
atggacatcccactgagaagcactaggaagtaccttttcaaaaaaacagacttgttgagattaagggagctagcatctttagtaagtgatccagtggattttcaaactcaccatgggaagttactcagaattcttagagtagatgttgaggaaggatgcctagagaccctggttcagttctatgacccgctctaccattgcttcacatttcccgattaccagcttgtccccacacttgaagagtactcctacctagttggcttacctgtgcctgacaagatacctttccatggttttgagcctacccctaaaccctccgacatcgcagccgctctccatcttaaaacctccatcatccaagcaaaccttacctctaaaggaggcctccaaggtcttcccacccacttcctctaccaacaagcctccatatttgctgaagcagctattacctcaatcccgtgccttcaagaccaatga

SEQ ID NO: 37640 - DNA, 1401 bp, Glycine max
  Peptide Sequence Number=SeqID_154418
atggatcgctatctggagcagggcgatctcagtgaagacgaggtgattgccgggctgcggcagcgcacgctggcgggcgaaatccagccgatgctgtgcggcagtgcgtttaaaaacaaaggggtgcagcgcatgcttgatgcggtcatcgaactgatgccttcgccgctcgacgtgccgccggtcgccggcatcaacgagcgcggcgaacacgacgaacgccatgctgacgatgaggaacctttctcggcgctggcgttcaagctgatgagcgatccttacgtcggtcagctgacctttgtgcgcgtctattctggcgtgctgcgcaagggtgacagcgtgtggaacgcggtaaaagggcgtaaagagcgcattggccgcatcgtgcagatgcaggctaacgatcgcatcgaaattgatgagatccgcgccggcgatattgccgcctgcgtcgggctgaaagaggtcaccaccggcgaaacgctgtgcgatcccaatgcggtaatcacgctggagcgcatggaatttcccgatccggtgatttcgctgtcgattgagccaaagaccaaaggcgatcaggaaaaaatggggctggcgctgcagcggctggcggcagaggatccgtcgttccggctgcacaccgatgaggagtccggtcagaccatcatctccggcatgggcgaactgcatctggagatcatcgtcgaccgtctgaaacgcgagttcggcgtggaagccaatattggccggccgcaggtaacctaccgcgaaaccatccgcaaaacggtgcgcgaggtggaagggaaattcgtgcgtcagtcaggcggtaagggccagtatggtcacgtggtgctgacgctcgagccgcaggcggccggaagcggtttcgcctttgaagacgcgaccaaaggcggcgtggtgccacgcgaattcattccttcggtggagaagggcattcgcgaagcgctcaacagcggcgtgctggccggttatccggtggtcgacatcaaagccacgctgacgtttggctcttatcacgacgttgactcgtcggagatggcgttccgcatggcggcgatctttggcttcaaagcggcagcgaaacaggctaatccggtgatacttgagccggtgatgcaggtggaagtggagacgccggaagagtatgccggcggcgtgatgggcgatttgtcatcccggcgcggtacgctgcagggcatggacgagcgtttcagcgcgcgcattatccgtgctgaagtgccgctggccgagatgtttggctacgccaccacgctacgctcgatgtcgcagggccgcgccacgtacagcatggagtttgcccactacgccgaagcaccgcgtaacgtcgcggaggcgattatcgcggctcgcgcacagtaa

SEQ ID NO: 37641 - DNA, 1617 bp, Glycine max
  Peptide Sequence Number=SeqID_154419
atggtgctggccgatggcagcgtgcgcgagtttcagcgcggtgacgccgatttcccggcggcgatggtgtcacttggcgcgctcggcatcgtcaccgccattacgttgcgtactcagccatttcgcctgtttacctgccataaattcgcggcgtctgccgattcactggaacaggatttgctgacgtggaatgagcagcacgaactcagcaaagcctggtggtttgtcgatgacaaccttatgcatgtctggaacgccgatgtcgccagtgcggaagacagccaggcgtggcacgaccatcagcgcgaggtgattgagcatggcgatcaggccgacagcagcctcaacgacaccatcgatcagacgctggaacacatgcatcgcgacacgcagattcacggcaaaggcggcaaacagttccgtaccgtcacccgcttccgtgatttcaccgacatcagcggcgatatctaccagctgttttgtcgtggcatcgccgtaccgcagatcaacgttgagattggcgtgccgctggccaaaacgccggaaattatcagcaagatcaaagcctggtacgcacagaatcgtccgcacatgcactatcccatcatcctgcgctgcaccggcgcttcacaggcgtggatgagcccggcgcatcagcaaccaacctgcttttttggtttcgtggtgtattacgcggatgacggctcactgtcgcaggacggactgcatttcctcaccgaagtggaaaaactgctggcggcagaaggcggacgtccgcactgggaagctatgtacgcctgggtaacgctgttaacgcagccggaatattatgtcggggtgaaagcgctgcatcgctcactcaaacgcagcgaaacgcgctggccgctgattgtgatggtcaccgatgccatcgacctgagcatgcgcgaagcattacaggcgctgggctgcgtgatccatccggtccagccgctgatgccggacgccgcgctggagcagcattatgcctcggcacagtttggtgaagtgtggagcaagctgcgcgcctgggagctgaccggctgcgagcgcgtggtgtttcttgatgccgatatgctggtgctgcgcaacatggatgagctgtttacgcttgacctcggcaagcatgcgctggcggcctgtcacgcctgccgctgcaacccgaatcaaatcgccagctatcctgacagctggcagccggagcattgccattatacctggcaggcgcgcggtgaaacgccgcccgccgatcttgataactatctcaacggcggctttctggtgctgcagccggatcaggcggtattcgactggctgcagcagaaagtggctgagattgacgacctgcgccgctatccgttctctgaacaggatttgctcaatgaagtgtttgccggacgctggctgccgctgccgtacatttataacgcgctgaaaaccctgccgttccagcacgctggcttatggcatgacgatgaggtgaagaatctgcactacattctcgccaaaccgtggaaacgcgatctgaaccagccagaggcacagcgcgatcgttattacgcgctggataagctgtggtgggagctgggcgcggattaa

SEQ ID NO: 37642 - DNA, 1773 bp, Glycine max
  Peptide Sequence Number=SeqID_154420
atgcagcgcttcgtccgccagcgaactctgtgccaggccctgaccgtgggtgccggttgccagcgcgcctgccagcgtctgtaccgcaatcacgccgggcgaggaggccagcatgcgatccatctttgtcaggctgtcatacacctgctgcagcggcgtgcccgcggcaaacgttacgctctcttcatcctgagcgaggatgccgcgcagcgcactgagatccagcagtacgtcctgcggctgtacgcacagcatgcgaccgggcgacaaacggctgccgagcacgcgcactttgccgtgcgagtcgcgcaacagctgttgcagctcggcttcactgcgcggctgatgcaactgctggcgctggccaactaccgaattctgcgcccagttccagagcgcaggcgtgtcatcgcgcagcgtggccgttaccgccagctgacggttgcggcgaatactgtcctcttcactgtcgtggggggtaaacagcgtgtggaaggtgtagcggttggagacgtgatgcacacaaatactgctgagcaggcggtgtacgtccacggtatccaggccgtcgataaagatgccctgacgctggccgcgggacaggatgtcatccagcaaatcgagggtacttttgttcatcgctttgatgcgatccgactgcatgatgtaacgcccgcgcagcaggttttctgtacacaccaggcgcataaaatcgggatgcgtgacgtgatagtcaaaactggcttccaccagtttgatcatcgcctcttccggctccagcgtagtaagattcaggccggtttcatgctggcggatcgcctgatacacctgctccagcacctcaatatacagcttctctttgttgatgaagtgatacaccaccatgcgcttggtggtctgtgccagttcagcaatctgctccattcgcgcgccctgcataccgtattcggcgaaggtttgcagcgcaccggcgaggatgcgttttttcaacccttccgggtcatttttacgtttggcgtggtcgcgccgttttcagtggcgcaggcagcggataaaaccgcggtgaaggtcggtatcatgagcggcgaggacgaagacgtctggcgtgaagtgataaaacaggccgccgcgaaagggctgacggtgaagaccgtgattttcaatgattataatcagcccaacgaagcgttacagaatggtgaagtggatgccaatgccttccagcatcagccgttcctgaataatcaaatcaaggtcaatcattacgatatcgtgcgcgtcggcgataccgccgtctggccgatcggtctctattcgaagaaagtgaaaagtgccgccgctctgaaagacggagcggtaatcggcgtgcctaacgatccgtcgaacgaggcgcgcggtctggtgctgctgcagcaacaggggctgatcaaactcaaaccgggcgtcggcattgccgccaccacggccgacatcactgacaatccccatcacctgaaaatcaaagagctggattccggcatcattggtcgctcggtgccggatcttgatgcggcagtggtcaataccgactgggcgctgaaaagcggcctgaccgcggcggatcgtatcgcgcaggagccggtgaaagacaatccttacaacaactttatcgcggtgaaaaaagagaacgccagcgccccgtgggtgaaaaccctggtggcatcgtaccagaacgatgccgtcaaaacggtgttcgacaaggtctacaaaggcacgggcgaaaccgcctggtaa

SEQ ID NO: 37643 - DNA, 1470 bp, Glycine max
  Peptide Sequence Number=SeqID_154421
atgtcaatcttcgacggagctttcatgaacacgcaactctccaagcacacttcgatcttcggcctccgtctctgggtcgtgatcggaattctcatcggagtcttcatcgtcttcacgctcttcctcctctccctctgccttgtctctcgccggaaccgccgccgctccggcgcaggcaccggctacaaggtcgccggaggcgccgacgcggcgaaggacatccacacgatcgtgcaccttcccgggccccacatgctccggcctccggcgccggagatccacgtggagatggggaagaagacggagcaccgggtggtggtgcagtgcgatagggtttcaagtgaggagagtaaggtcacggtggggagtgggtgtgaaacgacgtcgtcttttggaagtgggagtgttggtgggcctgggcctgggcttgggcctgaggtttcacatcttgggtgggggaggtggtacactctgagggagcttgaggatgccactggagggttgagtcctgaaaatgtggttggtgaaggtggctatggcattgtctatcatggggtactcaatgatggtaccaaaattgctgtcaagaacctcttgaataacaagggacaagctgagaaagaatttaaagtagaggtagaagcaattggtcgagtgcgacacaaaaatcttgttaggttgcttggatactgtgtcgagggagcctacaggatgcttgtgtatgagtatgtagacaatggcaatctagaacaatggctgcatggggatgttggagctgtaagccctttgacatggaacatacggatgaacattatattgggaacagcaagaggattggcctatcttcatgagggtcttgaaccaaaagttgtccaccgagatgtgaaatcaagtaacatactcattgatcgccaatggaactccaaggtttctgattttgggcttgctaagcttttatgttctgagaatagttatgtcacaactcgagtgatgggaacatttggttatgttgcaccagaatatgcatgcaccggaatgctaactgagaagagtgatatttatagctttgggatacttatcatggagataattaccggaagaagccctgttgattatagtagaccacaaggagaggttaatttaatagaatggttgaagactatggttgggaatcgaaaatctgaggaagtagttgatcctaagctccctgagatgccatcttcaaaggctcttaaacgcgctttgttgattgctcttcggtgtgttgatcctgatgcaaccaagaggccaaaaatgggacatgtgatccacatgcttgaagcagatgacctgttattccatactgaacaaagaactgagggagagtcttcccgttcctatcaaagtgagcaaagggactcaaatttagataagagaagagatggaggtgccaatgataaaagtgaagatgctagtactagatggagatga

SEQ ID NO: 37644 - DNA, 471 bp, Glycine max
  Peptide Sequence Number=SeqID_154422
atggcagatgaccaatgtcagtttatcactgagggaacatctctcacaaggccaccaggctttgttggagaagactacccctacgggaaagataaaatgaagatgtacatcaagtccactcagtatagaatttggcttatcatcaccaatggggatattcgcattcacagacttgaagctggatggatagatgacaatcttgccattatggagcttaacacaaaagctagatataccctgacatgtgccatatcaaaaaatgagtacaataagatttgcagactgagaactactaaagagatttgggactcattgagcataaaccatgaaggcactgaagatgtcagactgaggaatgttgtgactttgactagacactttgaaagctttacaatgaaggatgaagagtctgtggatgacatgtttggaagacttcaagttcttctaaaaaatctaaacgctattggatag

SEQ ID NO: 37645 - DNA, 450 bp, Glycine max
  Peptide Sequence Number=SeqID_154423
atggtgaagattgaacacgcagacccgcgctcggcggaatcacagtggctgattgaaaaactctctgcagagcttgcggctatcactggcgatggcggaaacagccgcgccagcgttgacacctttcagggtgaaggcgcgttgtgggtgatcgcgagagacgcgcagggcacggccgtcggctgcggcgcgttacggccggtggctgccgggatcgctgaactgaaaaggatgttctccgaccgcagtttgccgggcatcggctgcgccttgctcagcgctctggaagccgcggcaaaaacgttgggatatcgtgaactgtggctggaaacccggcatgttaatcagcgcgccgtggatttttatatcaggcagggttaccggcagagagaaaattacggaccctaccgcggccgggaagaggccatttgcctgggcaaaacgttataa

SEQ ID NO: 37646 - DNA, 2307 bp, Glycine max
  Peptide Sequence Number=SeqID_154424
atggcaaaagatatccaggtgggcgtttctatggcgctgtttgatgacaacttcctcaccatcctgcgcacagccatgcaaaaagagatgcaaaaagataacgtgaaaggccaggtggaagatgccaaaggcgacgtctctcagcagctgcagcaggtacaaaacttcatcggccagggcgtcgacgccatcgtcgttaacccggtcgatactaacgcggtgaagccgatcatggatgccgcgaccaaagccggtattccactggtattcgtcaaccgcaaaccggcgggtcagctgaccgacaagatggcgtacgtcggctccgactctgaactggcgggccgtctgcagatggaagcactggccaaagcgatgaacggcaaaggcaacgtggcgatcctgatgggcgacctggcgaacgaatcaacccgtgaccgtactaaaggcgtcgaagcggtggtcgccaaatatccgggcattaaggtggtacagaagcaaaccgccaaatttacgcgtaacgatgcggtagacgtggtgagcaactggatgaccgccggtgacgatatccaggccattgcctcaaacaacgatgaaatggcgattggtgcgctgcaggcgctgggtaaaaacccgaaccacatcctgattgccggcgtggacggtacgcctgatgcgctgcaaatgctgaagaatggcaaaatggttgccaccgtattccaggatgcgaaaggtcagggcgaaggtgccgtacagactgcggtgaaactggcgaacggcgaaaaagtggaaaaaatcatcaacatcccttaccagctgatcaccaaagacaacatggcgcagttcgaaaaccgcatcagcaagttcttccccggagtgaaggcactcgacaatgtctcactgcgtattaagccggggtcggtacatgccctgatgggtgaaaatggcgcgggcaaatccactttaatgaaatgccttatcgggatgtatcgtcccgataagggcaccatccgcattaaaggggagccagtgcagtttcaggacaccatggacgcgctgcgttccggcatttccatgattcaccaggagctgaatctggtgccttacatgaccgtggcggagaatatctggctcggtcgtgaaccgatgaaatacggctttgtcgatcacggcaagctcaatcagcagacgcaggaactgctaaacaagcttaatatccgtctgaaagccgatcggctggtcggcgagctcagcattgcgtcccagcagatggtggagattgccaaagcggtgtcgtggaactccgacatcgtgattatggatgaaccgacctcggcgctgacggaaaccgaagtggcgcatctgttcaccatcatccgcgacctgcgtgcccagggcaaagccatcatctatatcagccataaaatggatgaaattttcgccatcaccgatgagatcagcatcttccgcgacggcacctgggtcggcagcaacagcaccaccgcctttacccgtcagtcgctgatcacccagatggtgggacgcgaactgacacagctgttccctaaattcaacagtgccatcggcgaagaagtgctgacggtgcgcaacctgacctgcaaagaccgctttaccgatgtcagcttcagcgtgcgcaaaggcgagatcctcggcgtggccgggctggtaggtgccggacgcagcgaggtgatggagagcctgttcggcatggaaagcttcgacagcggtgaagtgctgatcgatggtgtgccggtgaaaatcgattcgccgtcaacggcaattgagaagggcatggcgtttctcaccgaagaccgcaaaaagtccgggctgtttctggtgttgtcggtgctggagaacatgagcatcgtcaatatgcccgattatatcggcaaaagcggtttcgttagccacatgaagatggcgcaggactgcatggagcagatccgcaaactcaatattaaaacgccgaccatggatcagatcatcaataacctcagcggcggtaaccagcagaaggtgctgattgcgcgctggctgctggcgcaaccgaagattctgatcctcgatgaaccaacccgcggcattgatgtcggcgccaaagccgaaatctaccgcctgatcagtgaactggctaaccgtggcgtggccatcatcatggtgtcctctgagctgccggagattctcggcatgagcgaccgggtgatggtgatgcacggcggacgtataaccggcatcctcgataaagaagaggccgaccaggaaaccattttgtcgttggcatccgagtga

SEQ ID NO: 37647 - DNA, 2247 bp, Glycine max
  Peptide Sequence Number=SeqID_154425
atgggcatggtgtatgaactagacgccatcgccgccgcagttatcagcggcagcagcttgatgagcggcgtcgggcggattaccggcacgctgatcggcgcagtgatccttggtttaatcaaaagtggctttacctttgttggcgtcgatgcttacgtgcaggacatcatcaaagggatgatcatcgtcgcggcgggtgcgtcatcgccagcggataaacgttatgggtcatgtgcggcacttattaacccattcggggctgagaactcatcatttgggcattcggggatccgtgacggaggcaatatgaacttaagacgactgaaatactttgtaaaaatcgtcgatatcggcagcctgacgcaggcagcagaagtcctgcatatcgcacaacctgcactcagccaacaggtggcgacgctggagaacgaactcgaccagcagttgctgatccgcaccaagcgcggcgtaacgccaaccgaagccggtaaaattctttatgctcacgcacgcaccatcctgcgccagtgcgaacaggcgcagacagcggtgatcaacgctggccaggcgctcaatggtcaggtatcgattggcctcgcgccgggcacggcggcctcttcgctcaccatgccgctgctgcaaacggtgcgcgagcaatatcctgatgtgctggtctatctgcatgagaacagcggcacttcactcaatgagaaagtgatgaatggccagctggatatggccgtgctgtacgatcgcgcgccgactgccggtatcaacagcattccgctgatgaaagaggagctgtatctggtaggggcgacggcctgtccgggtgctacggtggatctggctgacgtggcgcagatgaacctgttcctgccgcgtgactacagcgccgtgcgcaaacgcgtggacgaagcgttctcgctgcgtcgcctgagtgcgaaaatcatcggtgaaattgagtcgatctcaaccttaaccgcggcggtgtcgagcggcatgggcgtcaccgtactgccggaatcggcggcacgcgcgctgtccatcgctgaatctgccgctgtcgctgaacgtctcagcgcgcctgccgctgtcgccatcggcgcaggcgggcggcaaatcgcttcacatttacccgcacctgcgcgcgagccactccctctccccatgggagagggccggggtgagggcagcaaagcgcatcacatttacccgcacctgcgcgcgatccactccctctccctatgggagagggccggggggcaggaaacaggagaaaagggtgtgaatttccagcaacttaaaattatacgcgaagcggcccgttgcgaattcaacctgacagaagtcgccaatacgttgtttacctcacaatcgggggtgagccggcatattcgcgatctggaagatgagctgggcgtggaaatcttcattcgtcgtggcaagcggctgttaggcatgaccgaaccgggcaaagcgctgctgaccattgctgaacgcatccttgatgaggccggcaaagtgcgccggctggcggatgtgtttaccaatgaaaccagcggcgtgctgaccatcgccaccacgcacacccaggcgcgctatagcctgccgcgcgtcatcaaagcgtttcgccagctctatcccaacgtgcggctggaactcaatcagggttcaccgcaggagatcgtcgccatgctgttggccggtgaggccgatgtcggcatcgcctcggagcaactggtgaataacaccagcctggcggcattcccgtggttcagctggcaccactcgctgctggtgccgcacgatcacgagctgctggcgaatcagccggtcacgctcgccagcctcagccgccatccgctgatcacctatcgtcaggggatcaccggtcgctcgcgcgtggaccgtgcattccaggctgcaggccttcgcccggatatcgtgctcagcgcgcaggattctgacgtggtgaaaacctatgtcgaactcgggctgggcgtcggtatcctcgccgatcaggcatgcgatatttacgatggcgaagacctggtgaagatcgatgctcaccatctgtttgatgccaacaccgtgtggctcggactgaagcgcggccagctccagcgcaactacgtctggcagttccttgaactgtgtaacgctaacctgtcactggaagagatcaaacggcaggcgctctcttacgaaaccgacgacgaacccgccatcgatttccaaatctga

SEQ ID NO: 37648 - DNA, 1497 bp, Glycine max
  Peptide Sequence Number=SeqID_154426
atgaccctcgcggacgccgaagcgggttatcgcctgactcagcaactgggctgggcgcaccgccgcgaagactggcagcagctcatcgccctgggtgaaggcgtggtggttgaggcgcagggcgactatctcggcggggcgattggctggcgctgggggccggatgccgccactattggtctggtgattgtgagcgaacaggcgcgcggacgcggtattggccgccaggtgatgcaggcaatgctggaaaaattctccggctgcaacgtgcggctgcacgccaccgatatggggcagggactgtatgagaagctcggcttccaggcctgcaagcgcgtggcgcagcaccagacgcgcgcgctggcgcagcagcctgcggtaatggtaccggatggcctgacgctgcggccggccgttgaagcggatgccgccgccatcgacgcactggattatcaggcgaacgggctgcggcgaacgcgtctgcaccagcagctgctggcgcaaagcgtggtgctgcaggatacacagggcacgctgcaggggtttgccagtcgccgccgctttggacacggctggaccatcggcccggtgattgctgacgatgttgcggcggcgcaggcgctggtgtcgcagctgatgcaggatctgacgcagcagtttgtccggctggacacacccgatgcccggctcggcgcgtggctgctcaaccttgggctggcgcaggtcgatgcgccttatgcgatggtacacggcacaccatggcgggcggcaccgaacgggccgcagacctttgcgctggcatggggcgtcacgcgcatttatggctatccgggcgatggcatcaacggcgtgctgggcgctatccagcgggccaataaagccggtgcaggcatcgaatttattcaggtgcgacatgaagagatggcggcctttatggctgccggtcacgccaaatttaccggtgagctcggcgtctgtctgtcgaccggcggccccggtgccacccatctgctcaccggcctgtatgatgccaaaatggatcacgcgccggtgctggcgattgccggccaggcagaaaccaccgcgcgcggcgccagctaccagcaggagatgaatttagaccgcatctttgccgatgtggcgaacttcgtgcaggaagcggcagcgccggcgcaggtccagcatctggtcgatcgcggcgtgcgcattgccaaagcgcagaacggcgtcgcggtgatcatcctgccgaaagatctgcaggatgagaactggcagccgccgcagcatgcgcacggatttacccattccgggccgggctatcagcggccgaagattgtgccctacgacgaggatttgcgccgcgccgcagaagtgcttaacgccggcaaaaaagtcgcggtactgattggtgctggtgcgcggggtgctgcggttgaagtggtgcaaattgccaatttgctcggcgcgggcgtagccaaagcgctgctgggcaaagac

SEQ ID NO: 37649 - DNA, 758 bp, Glycine max
  Peptide Sequence Number=SeqID_154427
atgcttcaggcggggatatttgcgatttttcattatgacctccttgtgtgtaaagaatgtgctccttttatttgcggaaagccattagaagaggggaacgttggaagttgcattccagatattcagagtgcgatgaatgggttatttttagatgagtgcgggtttttaccaggtcgccataaatggcgaccctacaggttagggattgtgtttggtcgtagtaaatggcaaaaccacaggacggtacaaggttttgtagggtgcgcatttatgcgcaccaggataattttagatgagtgcgggtttttaccaggacgccataaatggcgaccccatcgaacggcgcagggttttgtagggtgcgcatttatgcgcaccaggacaaaaacaaacgaattaaacgccgttctcccctcacaccatccgctcaatctcgctcaacggcaccgcccggctgaacaaatatccctgcagctcattacacccggcatcggccagcgcgtttttctggccctcggtttcgacgccttcggcggtgacggtcaggcccatggcgtggccgaggcgcaccacggattcgacaatcgcggtggagttctccgccacgcccagcgactgggtaaacgaccggtcgattttaatcttgtcgaccggaaacgtgctgagataattcaggctcgaataaccggtgccgaaatcatccagcgcgatacggaacccggcgtcgcgcagcgcgatgatactgttgcgcgcttcgt

SEQ ID NO: 37650 - DNA, 515 bp, Glycine max
  Peptide Sequence Number=SeqID_154428
ggaagctttctgcagggaagctaagtgtgaagtatgcaatcctgcataggattggcactgtcaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcaggtaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcattgatgatggagaagcagctgaggaagaagaagatgcagcagaggatacagaatcagatgatgatgattctgatgccaccccatga

SEQ ID NO: 37651 - DNA, 756 bp, Glycine max
  Peptide Sequence Number=SeqID_154429
atggaagcttctaaaaaaagatctgatgacactagcccagacatggagtgtcttctcttactccaacttagctaccacacctcaaatttgaatatgggcagagctaggttggtctatggcttggtaaccaacatggacacgaacattggagcccttatctcagatcagatttcttctattgctcagagtaactcctctaggcttggatttctagccttaatcactgccatatgtagagctagaggagttacctctaatagtctgatctatgagagcttgagctcgaccattaatttggcctacattaagaaaaattgttggaatgtggatgatctaatagttaactttagaggggcaaggaaggcaaggagcttgcaggttgtagctcctccaggatccattctaacagtggagcagtttttagagaaggtatcttggccaggaaccctgccttctcttgagagagaaggtgggggtcccagtgctcaggtacctcagcaggtacaggatgcatcatccaagaccaccatccctgagccattcatttttgaagttggtgagacacagccagcagaccctcctactctagtgcatgagattccagcagacccgcctacaccattacttgatcttccagaggacccttctacactagtcttgggattgactaccgctccttcggccactcatgtgctacatcttacagatgaggagggcactcaggatgaggacactcagtcacaggacctatcatag

SEQ ID NO: 37652 - DNA, 411 bp, Glycine max
  Peptide Sequence Number=SeqID_154430
atggctgagaagacaaagaaaagactggaagaagctgcccagtctggaagcactgagagcatcattgaccctccatctcccatcagacgccacgtgaagtggaagatggcccgcacgaagaaaactggacagatgacgtctaaggcagcaaaggaaatagctgacaggattgcgtcacagggatcgttcgttccccatggacgtcaagatatcctgattgctgccattgggcgaccagagcaccctggccgtgctcgtgctactggagccagtgtccccataaagcaatactttggatcggcttcacgaacgtcccgcagttcttcctccatgcctcctgaagacctacaacagttgacccaacaaatcagagaccaactaaaggagtcaatcacagaaaaagtgacttga

SEQ ID NO: 37653 - DNA, 387 bp, Glycine max
  Peptide Sequence Number=SeqID_154431
atgttcctcatattcaacactagtgctttaaaaggacttattgatactccatcacctaaatccaaggctgctgctaggtggattgttgttaagtattttaatgaagttagaccattggaagtagagagattcaaggcgctttgcatccagtgggcacagtattatctaaaaaaaaagaatcttgagactttgttctcaattatcaagttggtaatatcagagaggtggtctttatactttcttcaagaattgacaatcgattttaatgaatggatggctaaagatcaatcagtcattggaaaaagccaaatgtactatgacaaaaatcctaagaatgataaacatgacattactaagccaaatgaaccaaatttgcacaacaaatga

SEQ ID NO: 37654 - DNA, 417 bp, Glycine max
  Peptide Sequence Number=SeqID_154432
atgtcaaaatcttatggctcttactcttatccaaagaaagaccaaggtcaaggcatcttaggggtgacaccttctaagcccaaagatgataaggggaagacaatagaaaagcaagaccctaaggctagtatgcaagagaaaactagctccataaagtgctttaaatgtcttggaagaggacacattacttctcaatgccccaccacaaaaaccatgattatgaggggccaagacatttatagtagccaagataaggctactacttcaccttcctctagtgaaactgaagaagcaaaaggggaagaatctagtgaagaaatctacccccaagaagaaggacaaccattagtggttaaagagaagtgtaaggaggtgtcgagggaaggagcccagagtatgaagaacctcgggatttga

SEQ ID NO: 37655 - DNA, 196 bp, Glycine max
  Peptide Sequence Number=SeqID_154433
ggttttacttctttccgtgccctactccgaaccagttcagggcagtggtcgcatggcctggagattggctgaggcccgggcaggagaggcactagcagaggcaccagcagaggctcccgacgaggcagatgaggcccgcgaggacgaggagatgaccgatttactggatttcttaggagggagcggggccacatga

SEQ ID NO: 37656 - DNA, 297 bp, Glycine max
  Peptide Sequence Number=SeqID_154434
atggataaagttgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgttggtggggggacaacccttcccttgtgttcaagaatcccctacaacaagagacccacagtctcttaatcccttttcagaaataagaagaagagaagaagaggtctctcgtaaaaaaggtagattgtaa

SEQ ID NO: 37657 - DNA, 126 bp, Glycine max
  Peptide Sequence Number=SeqID_154435
atgggtcagataccaacatttatgaaagtgccattgtccattatcaccaccgtcgaaaacgatgatggtggtgatggcatcaacgatgatcatgacgatgaaggtgtagacggtcgtggctgttga

SEQ ID NO: 37658 - DNA, 189 bp, Glycine max
  Peptide Sequence Number=SeqID_154436
atgccgatctccccctgcggaaatatcagttggtctgtgtcgttccgacatagggatcgcgcctgcaagacacccagtggacccgaagaagtccaacagggtcctagggtttctagctctgattacgggcctctgttagttctacggtgtgcccatcgcccccagcaagttcatcaggccccctattaa

SEQ ID NO: 37659 - DNA, 826 bp, Glycine max
  Peptide Sequence Number=SeqID_154437
aggactacgcgtcctccccttcaggtggctacacgccctcaccttcagaggactacacgtcctcgcctttagagggctacacgtcctcaccattagagggctacacgccctcaccttcaaaagacaacacgtcctccccttcaggaggctacatgtcgtcgccttcatagggctacacgccttccccttcagaggactacacgtcctcaccttcagaaggctacacgctcacgcctttagaggactacacgtcctcgccttcagagggctacacgccctcgcctttagaggactacacgtcctccccttcagagggctacgcgccctcgccttcagcggactacacgtcctcgccatcagaggactacgcgtcctcaccatcagaggactacacgtccttgccttaagagcgttgcacgccctcaccttcagaggactacacgtcttcgccttcagaggactacacatcctcacctttggaggactacacgtcctcaccatcagaggacaacacgtcctcactttcagagggctacacgctcacccctctagaggactacacgtcctcgcctttatagggctacacgcccttgccttcagaggactacagctcctcaccatcagagggctacatgccctcgccttcagaggactacaggtcctcgtcttcagaggactacacgacctcgccttcagaggactaaacgtcctcgccataagaggactacacgtcctcgccttcagagggttgcacgccctcgccttcaaaggactacacgtcttcgccttcaaaggactgcacatccttaacttcagaggactacat

SEQ ID NO: 37660 - DNA, 237 bp, Glycine max
  Peptide Sequence Number=SeqID_154438
atggcttcaactgatactgcttatagccaacatcggctatggatcacgcccatcatcataagggcttctcgaagacttaatctcgctctacctccattctcggagaggggagtcttacccgcggatactcttattcgagagatggaattgggaatctgtttcgagacttcgtcattgagagctactaactgccattattccgaggcttatggagaccctcctaagcttaaaggctga

SEQ ID NO: 37661 - DNA, 567 bp, Glycine max
  Peptide Sequence Number=SeqID_154439
atgaatggcgcagttgaagctgcaaacaagaatatcaagaagatagtgcagaagatggttgtcacatacaaagactggcatgagatgctaccgtatgctttgcatgggtaccgcacttcagtgcgtacttcaacaggggcaacccccttctctttggtgtatggtatggaagcagtactccctgtggaggttgagattccatcaatgagagttctaatggaggcccagttatcagaagctgaatggtgccaaagcagatatgatcagttgaatctaattgaagaaaaacgcatgaaggccttgtgccacggacaactttatcaacagaggatgaagcaggctttcgacaagaaggttcgtcctcgtgtgtttcaagaaggagatcttgtgctcaagaaggttttatcgttccaacccgattctaggggcaagtggacgcctaattacgaaggcccatatgtcgtcaagagaactttctctggtggtgcgctgattcttacaactatggatgggggtgagcttccccgtcccgtgaatgcggatgcagtcaagaaatactttgtctaa

SEQ ID NO: 37662 - DNA, 162 bp, Glycine max
  Peptide Sequence Number=SeqID_154440
atggaacacgcatcccgcgagtcacgcgtcgccctcccgccgaagggtaggttgcgacagattgcgcggcaattggtgttaagcagctcaattcgactagcaagaatccaaatgtttgcaaatgatcgtccctggacgaaattagggtatgacagtcactaa

SEQ ID NO: 37663 - DNA, 345 bp, Glycine max
  Peptide Sequence Number=SeqID_154441
atgaccataatttgtcttcgcatgtcaacgggctcgccgcctctggatgacaaaagggcgcagaatgaccataatttgtctctgcgtgccattggacacgactgtgtctggatggcgaaaagcatttcgcatctaaatgaccatttagaggaaacactgggttcaacgaaaatagaagaaaatcactcaaagtgtatcgatctcacacagggcaaggtttatggtaagttgggattttggatcaaggcttgtagaacggatggacatggtatatgtcagggtttggccagcggttcggggataaaggggatgtcccacattatttccatggcacaaatgcaataa

SEQ ID NO: 37664 - DNA, 1420 bp, Glycine max
  Peptide Sequence Number=SeqID_154442
caaatcgccaccggcgttggcggtttacgccaaaaacacctgggcggcgatccaggggcgggagcggctgaaggtgacgtgggacgacgcgcaggccgaacggcgcaacaccgaggagatctacgccgaattccgtcaggtggcgcagaaaaccggcgtggtggcaaagagtctcggtaagccggacgaggtgttcgacaaggccgacaaggtgatcgaggccgaatacaccttcccgtacgtcgcgcacgcgccgatggagccgctggacggctatttgttctgggacggcgagagcgtcaaggcgcgctacggctgccaaatccaaacgctcgatcacaagcagctgtgcgagctgttcgagttgccgccggacaaggtgcagattgaaaccattctggcgggcggcagcttcggccggcgcatcgatttcggtaatgctttggtggggcccgatctggttgccgatatggcggcggcggccaagggcatcggtcccggccacggtgtgaaagtggtgtggacgcgcgaggacgacatccgcaacggctggtatcgtccgatgatcctgcaccgcctgcgcggcgccatccgcggcggcaaggtggtgggctggaccaataccgtggttgggcattcttggacactgaatagtccattgactgctttggtggtcaatgggcttgatccaatgatggtcgagggtgccagcgaggtaccttacactttcgacgctttccgctgtgatgcgcacatcgtgccgggcaaggtgccgaccacctcgctgcggtcggtcggcagcacccacaccggccatgcggtggagagctttatcgatcagctgttgcaggaaaccgggcaggatccggtcgaagggcggctggcactgatgggcgatgcgccacgcgaagcgggcgtgctgcgcgcggtagcgaaagccgctgactggcagggcgccaaggtggtggacgggcgcgcgcgcggtgtgggcgtcgccaaggcgttcggtacctatgtggcgcaggtggctgaggtgtcgatcggcgaaggcggcatcccgaaagtgcacaaggtgtggtgcgcggtggactgcggcgtggcggtgaaccccgacgtgatccgcgcgcaaatcgagggcggtatcggctatggcctgagtatcgcgctgtacggcaatatcacgctgaaagacggcgtggtcgaacagtccaatttcaataacttccgcccgctgcgcatcgatgagatgccggaagtcgaggtgatcatcgtgccctcgagcgagaaaccgaccggcgtgggcgagctggggataccgaccatcgccccggcggtcggcaacgcgctggcgctgctcgggcggccgcgtacctcgctgagcctgccgctgcataatcctcggcgtagcgctgtcatctga

SEQ ID NO: 37665 - DNA, 190 bp, Glycine max
  misc_feature (110)..(110): n is a, c, g, or t
  Peptide Sequence Number=SeqID_154443
atgagcatatcgcaacacccgctttcgcggcggcggtttatcgtcggcgctggggcgttggtgatcggcgcctatctgccgtccactggtgcgctggcgcgttcggctgncccggctgcctccggcgaggctgcgtttgacgccaatgctttcgtccagatcggcgtcgacgggatcgtcaccgtcatca

SEQ ID NO: 37666 - DNA, 575 bp, Glycine max
  Peptide Sequence Number=SeqID_154444
ccgaaacgaacccagcttcagaattggcgagcgcgctgactgcgcctaaatctacccattacccccatctgctagctgatgaactcgctgatttcttacaagcccttgctacgtattctggtagcccgatcacccgactggctactcgaattctgatgttgaccggcgttcgtaccgtcgaactccgccaggctgaatggaaagagtttgatttcgataagtgtgtttgggaggtcccagtcgagaggatgaagatgcgtcgcccgcatctggttccgctatccgatcaagttgtggcatcactccgtgaaattcagacggtgacgggccgttacaacctggtgttccctggccgtaacgacatcaccaagccaatgagcgaagcgagtatcaatcagggctataacacggcttggatcgagttacagcttgcgcatgtagataagaacaccattcgtggcacgtacaaccatgcgcagtatttggagcagcgtagggagatgttgcagtggtatggggattacttggataaattagggcaggataccaatgacgtcatggtaaaaactgggtga

SEQ ID NO: 37667 - DNA, 883 bp, Glycine max
  Peptide Sequence Number=SeqID_154445
ggggactcttggtgactatgctaatcaacaaggcccaatcaatttcagtagcatagtgattcctcattcccataataaggttgtggtgctgaagccaacattgctgagtttgattgatgcacattcttttgttggaatggatcatgaagatccttacatacatttgtctttcttcatggaactatgtagcacaataggaacctctgatgaagatgctgaggttatctatcgcagagcttttccattctccttgacagagttgaaagaaggaaagaagataaaagaaccaaatttggaactgaaagtgttgcctccatatttgaaatatgtttttcttgctggtataagtacttcgtattgcatgcatatgattctaatggaagaagtattcagaaaagaggtggtctggctattggaagttggaatgatatatcttgtaacaaaccaattatccatgaagtgtgatttgtctctacgtgaatggactctgtccaaggtttactctgagtacacatatccgaagggagggatcacgattggttccctgaaagtagtacgtaggcctgaaccccgtctctctttcttgtttgtttgtatgcatttgttgatgtacgtgggtgaggttgcgttaaagaagtggatgatggacagagatacactggggtgtagtgggtggagaggttcgaaggacttaagggaattagcaagtgcgatcgctcctgactgtcatccacatgattttgtaagaccatcaagacatgggaggattaagtgtgattgttacgcacttaggatgcgagagttggaggactcacctttgcaaccaccaatttcagggggtgttcacggagcatccatggaggatgttcacttggatcggtaa

SEQ ID NO: 37668 - DNA, 2241 bp, Glycine max
  Peptide Sequence Number=SeqID_154446
atgcacctcgatctcctcactcactcgccaaatttccacaattctaaaagcaaaaacatcactctctgctccaaatcttcctccgccatcactgatttgaatccagcttcgccaagaaaggtttttggagcaataaccgatcccaatcttaaaatcgatttgatttttgctttttcctttttccttcttgcgtctattacagtgatgacagtagcagcatatatagagagagagagagaacagatggaggatatatcgaaatacgcgcacagtcctgcacacgtggcagtggcgagacgcgaccacgccgcgctgcgccatctcgtgtccaccatccctcggctcgcgaaagccggggaggtcaacaccgaagccgaatccctcgccgcggagctcaaagccgacgaggtatcaacggtcatcgaccggcgcgacgttcctggaagagaaacccctctccaccttgcggtgcgcctcagggatgtcgtctccgccgagattctaatgaccgccggcgccgactggagcctccagaacgagcacggctggagcgcgctccaggaagccgtgtgcaccagagaggaagccatcgccgtcatcatcgcgcgccactaccagcctctggcgtgggcgaagtggtgccgcaggctcccccgcattgtcgcctccgccgctagaatccgtgacttctacatggagatttctttccatttcgagagctccgttattcccttcatcggccgcattgcgccttccgacacttaccgcatttggaagcgcggctctaacctccgcgccgatatgaccctcgccggattcgacggcttccgcatacagcgttccgatcaaacttttctgttcctcggagagggttatgcctctgaggatgggaagttgaacctcccaccgggttctttgcttgctcttgctcataaggagaaggaagttacgaatgctttggagggagcgggtacgcagcctactgaagctgaggttaatcatgaggtttctttgatgtctcagactaatatgtataggcctgggattgatgttactcaggcagagcttgttccgcatttgaattggcggcggcaggagaagaccgagattgtggggaattggaaggctagggtttatgacatgcttcatgtgatggtgagtgtgaagtccaggagggtgcccggggcaatgaccgatgaggagctttttgctgtggatgatggggagagtatggtgaatggagacaacaatgatgatcagtatgatgatgtgttgactgctgaggagaggatgcaactggattccgcgcttcgaatggggaattctgatgctatttgtcaagatgaggagcctggaggagggtttgatgggcatgagaatggttccaatggtggtggggttaaagagaagaaggtatggtttggttggaacaagaaaaacatgaagggtggtgacgagcctgaggatttgaaaaccacgaagaagttttcgggtgatcagcagaagccgcagccgcaatctgagtttgtgaaggaggatcccgcggaaacaaagaaggggaaggataaaaacattagaaggaaaaagaagaaaggaggaattaatgagtctaagaatgagagtgagttcaagaagggcttgagacctgtcctgtggttgacaccggactttcctttgaaaacagatgagcttctgcctctgcttgacatcttagcaaacaaggttaaggctattaggagactcagagaacttttgacaactaaacttcctcttggaacctttcctgttaagatttgtcttctggatatgaatacactagcactccaagagtggagtcatgttggtgttctaaatgtagctatccctatagtccctaccatacgggtccttgtcacttttacaaaatttgaagatcttcagccagcagaggagttttcaactccaccctccagcccagcatacttccaggatgccaaatccaaggaatcagaagggtctacgtcatggatttcatggatgaaaggaagtcgtggtacgcagtccagtgattctgatagtcataaatttaaggatgaaatggaccctttcagtataccttcggactacaaatgggtagatgccaatgagaggaaacgccgtatgaaggcaaagagagccaaaagtaagaaacataagaagcagacagttgctaaaggaggagatggaatgcaactagggagtgacgatgtggaagaatactaa

SEQ ID NO: 37669 - DNA, 303 bp, Glycine max
  Peptide Sequence Number=SeqID_154447
atgtatgctttagaaaagtttagatcttatctgataggttctaaagttgtgattgatactgatcatgttgctatcaaatatctcttggaattttatttggaaatcaaggataaaaagggaagcgataatcaaattttagaggagtttcctaacgaaaagatccttactatatctgaaaggccatggtttgctgatatggccaatttcaaagcagctagtgcacttcctggtgatttcacttggcaccaaaacaggaagtttctgagagattctaggagtgacttagtgttaaacaatacttag

SEQ ID NO: 37670 - DNA, 1791 bp, Glycine max
  Peptide Sequence Number=SeqID_154448
atggagccactgaatcataagtcttttgagagagtggtttcccagaaagccttgcaaatgggaaactcgtttccttgtcaaatttgtgtggtgggatttctctgcggtgtatgcctcacctctctgttcatggctgctctcacttcctttggctcctttcagtttagtcccattttgttttcaaccatgtcgatggctagtaattcatcagggaattctacttttcctaatgatatcaacaaggttacacgttcggactgccagtttaagcttaaggaaactgagagattagaggattctaagagcagcagagagcaaaataacgatgagagagtctcattgctttattcagcatggagtgctgtgttgaatgaacctacaagtggcggtaaagagcacttgcagaaacatggaattagtgggtccagtttgcctcatgccccacatttggaaaactgcaaggtgaaaacacagctatatgactattttgataagcgtaaaggaaatgaggttttcccaccatggacaacttggaagggatctttgcagacattccctgtcgctgcaatcaatgagcaaatgcaaaatcttaggcatgatgcagtctctgagggggcttatccaccatggaagcatttgcagattgcagggtccgatgaagaaaactatcccttgactagaaaagtgcagcgtgacatatggatccatcagcatcctttaaactgtagtagcccggatgtcaagttccttgtcactgactgggagagattacctggatttggtattggggctcagattgctggcatgtgtggacttcttggtattgcaatcaacgaaggaagagtccttgtcactaactattacaacagagctgaacatgggggttgcaaagggtcttcccgttctagttggagttgttacttctttcctgaaacctccctggaatgtcggcggcgtgcatttgaactcatgaaaagtgaagatgcgtggagtaagggaattgtgaccacaaaagaaaattatacaacaaagcatatatgggcaggacctactccaaggaaatggggtcttcagtggaattatttgcaacctactactgatataaatgggactctgttagcttctcatagaaaaatggatatacggtggtggagagcacaggcagtacgctacttaatgaggttcccaactgaatacacatgcaatttaatgaatgaggcccgccatgctagctttggaaaattagctgcagaaatggtccttcaaagtcttgctggggattggccaaaggaaagtagtggcagggcaaggtctaatgatattgatgaatacgtttggtccaatcacaagccatgggtccctaggcctcttctatgtatgcatgtaaggatgggagacaaagcatgcgaaatgaaggtagttggatttgaagaatacatgcagcttgcggataggactcggagacacttccctcaccttaataacatttggctgtcaactgagatgcaggatgtaattgacaagaccagagaatattctcattggaacttttactatacaaaggtaagacgccaagctaagattaacatgtcaatggctgcctacgaagccagtctgggaagggagaccagcacaaattatccacttgttaatttcttgatggctgctgactcagatttttacgttggggcattgggttcttcctggtcctttcttatagatggaatgagaaatactgggggaaaggtaatggctgggtttttgagtgtcaataaagacagattttggtag

SEQ ID NO: 37671 - DNA, 303 bp, Glycine max
  Peptide Sequence Number=SeqID_154449
atgaaagaaaatcctacctccgtccaagctgaagcgtttgctaaagctgaggatgacactattgtacatgagcctgctactgttaccagagatcaagtgcaagacattgtggaagcaatgccttccaaggttattttgatgatgccaaagaatcaagagttaagcaaattccaaagattcaagaatctagtttcaagaatcaagattcaagattcaagaatcaagtttcaagaatcaagattcaagaataatcaagatcaagactcaagattcaagaatcaagagaagactcaatcaagataa

SEQ ID NO: 37672 - DNA, 1788 bp, Glycine max
  Peptide Sequence Number=SeqID_154450
atggctcctcatccaagagtcatcaaggcttataatgctatgaggtccttgggaatttctgatgaagaggtgaaaccggtgttgaaaaatttgttacaattgtatgatagaaactgggaacttattgaagaagacaactatcgtactcttatagatgcatactttgagttaaaggaagataagcaaacagaaggtaagagaaaggctccaatcagttatcttgatgggagaaagccaaaacataaactgcacttggtagatggagatatccaagcttcagcaactgacaactcaagtgaagggttgtctatagaagacacggaaatacctcccaacgtttttaaacagaaaatcattaaaccttctcaaacctccattggacatatggagcccacaaccagttcacaagcattgcaaacagtgtcgagtaaggtagacgggatctcaactttaccttgcatggctgctagagatagaaaattgcatcgtgggaaggcatcagctgcagggcattgtgaagatccaattgttgaaacaagcaatcctcgtatccagagggaaaatatatcaagtgatcatcatcagaaggagctgatgacaccaagaactgagaaacttaagttgcatcttggacctgtttcaacgagttacaatgtctcatctaatgcttcaaatggaaattgtcgtgccaaatctctatcagctctgtatcagaatgtgcacaaggaagatgctacctcagcatgcaataatagcaaaagaactcagaagggtaatattgacattgcctcttcacctttgggagaaattaaaatttctttaaactgtgaagttgctttgggacaaccaaacttccgtattcctgatttagatgctgtcatgaaatccattgaggagaaatacctgaaggctcacatgatagtcgagcctcaatcatctatggtgaagctattagatgatttatgtggaagttacttgaagctgggcttgagtttaagtccaaacgggtcaacttccaagtttgctaattcacgcaatgtgacatgtctgccactgcaaactgttactgaagatgacaagaattcctttcactttcttgatgacataacaaaaggttcagagaatgttaaaatatcattgttagatgaaactggaagtgaggacgtgccacagtttaattacataccctataatgtaatatatcaagatgctaacgtaaatatttcacttgctcgtattgcggatgagggttgctgtgctgattgtgctggcgactgtctttccttatcacttccttgtgcatgttctcaagaaacaggtggagagtttgcttacactccacgaggcttgttgaaagatgattttttaaaagcttgcatgtctatgaaattggaacctctagatcatcattttgtgtattgccaagaatgtccattggagaggtctaggaatgacatcgttcccgaaccatgcaagggacatctggttaggaagtttatcaaggaatgctggaggaaatgtggttgtgacatgcagtgtggaaatcgggtagtgcaacggggtttaagatgtaaattgcaggtgtttttgactcaagaaggaaagggatggggcgtcagaacactagaagatttgcctaagggatgttttgtatgtgaatatgcaggggaaatattaaccaatacagaattatatgaaaggattatgcagaaaagcggcaatgacagacatacatatcctgtaacccttgatgccagattggggctcggaaggggtgttaacggatga

SEQ ID NO: 37673 - DNA, 864 bp, Glycine max
  Peptide Sequence Number=SeqID_154451
atggatgtttcccattccacaatcctcatcagtttcactttcttgctattcctaccttcttccaaaccagtttccgattatagcacattagtctacaaaacctgtgcaagccaaaccttcaacgaccaattattatctcaaacactcaactctctgttccaacaactcatcgcacaatcctcccaacacaagttcttcaaaaccacggaagccgttagcgacgacacagccatctccggccttttccaatgtagagatgatatcagcaaagaagattgtttcagctgcgtaaacttgctgcctcagatgtcaaacaccttgtgcagtgaatccatatcagcacgggttcagcttgacggttgctacattcactacgagacagaggaacttcccgaaccagaaacaaaaagtgaatctaaaagtagaaatttgattattcacaatgagtgtggggaaccggttgtggattatatcaagtttaaagagttgatggacgaggcgtttgtgaatctggaaagtgggatcctaaacagtaatgggtactatgcaatgaactataaatcagtgaaattgatggcgcagtgtgaaggggattcagatatttgtgactgtagcaattgcgtgagcgatgcagtgcaggttgcaaaggaagaatgcggaactccactttcggcacgaatatatcttgacaagtgtttcataagctactataacattcctcgcaactttgtcccaggagcaagaagaaataacaacaccgaaaagttggcagcaataattgttggaggggccgcaactctgtttttgggttttgcttttttatcactgcttaactctcggtttagaaaagacgattatgaatag

SEQ ID NO: 37674 - DNA, 282 bp, Glycine max
  Peptide Sequence Number=SeqID_154452
atggagctatatggtgaaggagaatcttcagtaatgttacatgattttctctggaagcttcgaagaagcaatacgcagagtccaaactcagaaaccctcagaacagagactgagagtgtgcgtttggtttgccaagagaatgttaggaaaatacaatgcgtgactgcgctgttatatgaagcggaagccgaagagtcgccgagtctgttgggtcggattgactgcgactttcaacgtttttccgttgttattggacgggattctcaagaaaaaggaggctaa

SEQ ID NO: 37675 - DNA, 258 bp, Glycine max
  Peptide Sequence Number=SeqID_154453
atggtggaaattattcttggtttgcaaggagacatctgcggaaattctagaaatggggttccctttgttgctggaaaggataaaattgagcttatagataatgaaaacttatccaaagtttccattgttattgtctcttcaccacctattgttgtcattttacaggataatgatattgatattagcattgagaatcttgaaagtgaagttgctaagctttatgcaaccaaaatggcccaacaattgttggaatggtaa

SEQ ID NO: 37676 - DNA, 420 bp, Glycine max
  Peptide Sequence Number=SeqID_154454
atggtcattcccaagttcaaggtgctggactttgacaagtacaaggggactacttgtctcaagaaccatctaaagatgtattgtcagaagatgggggaatacgcaaaagatgaggaattgctgatacattcctcccaagaaagtcttactggggtagctgttacctggtacactaacttggaaccttcccgagtccattcttggaaggacctaatggttgcctttgttagagagtatcagtacaattctgatgtggctctgaataggatgcaactacagaacatatgcaaaaagggggcacaaatctttcaaagaatacacccaaagatggagagacttggcaactcaagtagcacccccaataacagagaaagagattatcacaatgatagtagacacatgatcggtgttctactatga

SEQ ID NO: 37677 - DNA, 1122 bp, Glycine max
  Peptide Sequence Number=SeqID_154455
atgtctatgctagcttcccccttccagctcctggaactgaacatcatatccgcccaagaccttgcacccgtctccaaatccatcaaagcctacgcagtggcatggcttaacccggagcgcaagctaaccacccaaatagaccccaacggccaaaacaaccctacctggaacgagaaattcgtcttccgcgtcgacgacgacttcctcacctccgacgaatccctcatcatcattgaaatctacgcctccgcctggcttcgtgacatcctcatcggcaccgtcaccgtcctcgcctccaacctcctcccccgctccatcaatacccgcaaatcaaagatccgcttcgtcgccttgcaggttcgtcgcccctccggtcgcccccaagggatcctcaacatcggagtcaacctcgttgactccaccatgagaagcatgcccatgtattccgaactcagcgcctccgctgttggctattgggacgtaatggaccccaagaaaccgaaactgcagcaaaatgaaactaataataatgattccagttgcaagctcttgacgctgcaacgctctcagagcgagaagaatgactcaaccatcaatgattatgcgtataactgttcgaaagaaaacggttacgacgaaggcggggatgattgccagggttcggaggttgggatgccgatggcaaaaaaaggagtgattatgaacatgaacgggtcgctctgctcggacgtggggccctcgccgtcggtggtggcggcggctatagcgaaggggttgtatccgctgccgatgatgacggcgccgcggaagccggggaacttggtatttcaggattggccggaggagcgtggtgggttgacggcggtgtacgatcacctagggaagaataatgagaataagaaggtgaggcatgtgcatagtattccgaaggggaaaggtcagaagcatagaaagggtagtagtgatggtgggttgttttcgtgttttgggactgcgatggggtgtgagttttctattacttgcggagggggtcatgggaacaggaagaagaggtacgagggtggtagcaaggctcctcccactgcagagtctgaactcacctatgatgaatcctatatttga

SEQ ID NO: 37678 - DNA, 429 bp, Glycine max
  Peptide Sequence Number=SeqID_154456
atgttggggatgttcctattttatttcccagtccgattattctgcaacattctgtggtggattgccaattatcatgaacatgaatccctgttacaagaaaatgaagaggaaaagctatcgaaagaggagcaagatatggcttgggaggtttaccagaaatcgttggaatgggaagaagtgcagagagtaccacttggtgagtctattatgcccgaacagaagccagaaatgccaattgcgatgccccaaaatgtatcagaaagctgcagcatcttgccaactaaactaagcaggcgtttcacgatacggaaatgcaccaaccttgcgcatatgttgacacttagaagtcaaggaacaaaatttggatgcagtactgtctgtggggaatgcgcccaggagattaggtgggaagacttgaagaagagatag

SEQ ID NO: 37679 - DNA, 1773 bp, Glycine max
  Peptide Sequence Number=SeqID_154457
atgtgtcttaatcaacaacaacaaaggcaagaagaagaaaagaaaagcgctctcttcttcatcttgttgctttgtgagaagagaagagagatgtttgggtgcaatagtttatgctgggattcttctgtccctgaattcactgaccctgatcctcttcccttctctctgccttcgccccttcctcaatggccacaaggtggtagttttgcaagtggaagaatatgccttggagaaatagaagttataaaagtaaacaattttgagaaggtttggagatgcacaagtttgaatgggaaatcgcttggtttcacattttatagacctttggaaattcctgaaggctttttctgccttggttactactgccagtccaatcaccagccattgagaggatatgttcttgtggcccgtgaaactagtttcgatgcctccgtgttagaatctcctgctctggaaaagccacttaactactcgttaatatggagcctggattcacatgatgagtgtgtttacttttggttgccaaaccctccaacaggttataaagccatgggcatagtagttactagcagtcctaaggaacctgaagttgaagaagttagatgcgtgcgagatgatctcacagaaacttgtgagacttctgatctgttactgactgtaaagtcaaaatatgcaaaagattcatttcaggtttggaacacacaaccctgtgatagaggtatgttagctagaggtgtagatgttgggacattcttctgtggcagtacctattttgattctgagcaagtggtggatatcatgtgcttgaagaatcttgattcttccttgcatgcgatgccaaatcagaaccagattcatgcacttattcagcattatggtcccactgtatacttccatcctgatgagaagtacttgccatcatcagtgcaatggttttttaagaatggagcagttttgcatgcagcaggcaataagaaaggtatagctatagattatcagggctcaaatttacctagtggaggaacaaatgatggtgcattttggattgatttgcctactgatggagatgcaagaaacaatctaaagaagggaaacatagagagtgctgaactctatgttcatgtgaaacctgcattgggaggagcctttactgatattgtgatgtgggttttttgccccttcaatggacctgccacccttaaagtggcattgatgaacattgagatgagcaagataggagaacacgtaggtgattgggagcactttacccttcgtataagcaacttcaccggagagctatggtctgtttacttctctcagcatagtggaggaggatggatacatgcatttgatctggagtttaataaggggaataagccaattgtttattcatcaaaagatggccatgctagcttccctcatcccgggacgtaccttcagggatcatccaaactaggaattggagtacgcaatgatgcagctcaaagcaaatttattgtggattcgagtgtcaaatatcagattgttgcggccgagtatcttggtgaaggagtcattacagaaccatgttggttgcagtatatgagagagtggggtcctaccgttgtatatgattcacggtctgagatagagaagataataaatctgcttccactatttgttagattttctgtggagaacttatttgaactatttccaactgagctttatggtgaggaggggccaactggtccaaaggagaaggataactggctaggagatgaatattgctag

SEQ ID NO: 37680 - DNA, 819 bp, Glycine max
  Peptide Sequence Number=SeqID_154458
atggacatgaatgtggtgaagaaggatctaccacccaaaactgtcttcgtgataactgtcaagctatctcccttgcagagaaaattgtacaagaggttccttgatgtgcatgggttcactactcaggtgcatcctgaaatgttaaggaagagatgtttttttgctgggtaccaggcattagctcggatatggaatcaccctgggatcttgcagttgactaaagaagtcaaggattatgtaaaacacgaagatgctgttgagaattttcttgtggatgatagttccagtgacgagaattctgattataatgtacttgctggagagaagatgagatatgcaaatgacttgctgcaaaggaaagatgataatggctttttcctgaagggttggtggaatgatcttcttcatggaaaaatttataaagagattgatcacagtggcaaaatggttttgctgatggaaatactaactatgagttctgatgtgggtgataaggtgttagttttcagtcagagcataccaaccctagacctcattgaactttatctctcaaggatacctcgacgtagcaaacgagagaagttttggaagaaaggaaaagattggtataggttggatggaaggactgagagttctgagaggcagaagcttgttgagagatttaatgagcctttgaataagagggtaaagtgcactctgatttcaactagagcaggctctttgggtattaatcttcatgcagctaatcgtgtagttatagttgatggttcttggaatccaacatatgatctccaggccatctatcgatcatggaggtaa

SEQ ID NO: 37681 - DNA, 210 bp, Glycine max
  Peptide Sequence Number=SeqID_154459
atggtggtgaggaccgtcgtggtggctagctgggtgaatggtcatgtgcttgtagatttgaagatggaaacggcatgcaacagtggtgatggtgttgcactcaaatctggctggaggtggtggcacagtgaggccaatgtcaggcgattaggtggtggctcacgaccttggtgtagtggtgatgagttgggtggggtgagaagaaggtga

SEQ ID NO: 37682 - DNA, 207 bp, Glycine max
  Peptide Sequence Number=SeqID_154460
atgaggaggagaagaaacctcggtcaaaacaaaagatttgtgataacccaagttagccaagaagtccagactacgattggtctctttataaacatgatgaagagacgacttttaatccacgagcatcaatggactgcagatcgtagcaaccagaggttaaatcattccaaagatagtagcctacctatgccaaagaaggtggcctga

SEQ ID NO: 37683 - DNA, 2360 bp, Glycine max
  Peptide Sequence Number=SeqID_154461
gtgagatccctgcagagtttggcaacctcaccagtcttcaataccttgacttggctgtaggcagtctaagtggacaaataccagctgaattgggtaagctgacaaaactcaccacaatttatatgtaccataacaacttcacaggaaaaattccacctcaacttggcaacattacttctctagcatttttggacctctctgacaatcagatctctggagagattccagaagaacttgctaaattggaaaacctgaagctcttaaatctgatgaccaacaaattaactggtccagtaccagagaagcttggtgaatggaaaaatttacaggtgcttgagctatggaaaaattcttttcatggtcctttgccacacaaccttggacagaactctcctttgcagtggttggatgtatcctccaactcactatccggggagatccctccaggtttgtgtactacaggcaatctcactaaactaatcctttttaacaattccttcactggtttcattccaagtggacttgcaaactgttcatctttggtacgtgttcggattcagaacaatcttatttctggaactattccagttggctttggaagcctccttggccttcaacggctggagttggcaaagaacaacctcactgggaaaattcctactgatattacctcatccacatcactctctttcattgatgtatcttggaaccaccttcagtcctctctaccctcagatattctttctattccatcccttcaaaccttcattgcctctcataacaattttggaggaaatatcccagatgagttccaggactgtccatctctctctgtgctggatctttcaaacacccatatatccggcacaatccctgaaagcattgcttctagtaaaaaattagtcaaccttaaccttcgaaataaccgcttgacaggagaaatcccaaaatcgatcacaaacatgcccaccttatctgttcttgacctgtccaataattcactgactggtaggatacccgaaaattttggcaactccccagctttggaaatgcttaacctgtcctataacaaacttgagggtccagtaccctcaaatgggatgttggtgactataaatcctaatgatcttatcggcaatgagggtctttgtggaggcattctccatccatgttctccaagttttgctgtgacaagccatcgaaggagctcacatatcagacacatcattattggttttgtgactggcatttcagtgattttagctcttggtgcagtatattttggtggcagatgtttatacaagagatggcacttgtataacaatttcttccatgataggttccagcaaagcaatgaggattggccctggaggttagtagcattccagaggatcaccatcactagtagtgacatccttgcatgtataaaggaatcaaatgtcataggcatggggggcactggtattgtctacaaagctgaaatccatagatctcacattactgtagcagtaaagaaactatggaggtcacggacagacatagaagatggcaatgatgtgttgagagaagtggaactcctagggagacttaggcacaggaatattgttaggctgttggggtatgtacacaatgaaaggaatgtgatgatggtttacgagtacatgcctaacgggaatctcggaacagcactgcatggtgaacaatctgcaaggttgcttgttgactgggtctcaagatacaacatagctcttggtgttgcacaagggcttaactatctccaccatgattgccacccaccagttattcacagggatatcaagtctaacaacatactccttgatgcaaatttagaggcaagaatagcagatttcgggttggcaaggatgatgattcaaaagaatgagacagtttccatggtggctggatcatatggatacattgcaccagaatatggatacactctgaaggttgacgagaagattgacatatacagctacggagtggtgcttttggagctcctaactggcaaaacgcctttagacccttcgtttgaagaatcaattgacatagtcgaatggataaggaagaagaaaagcagcaaagccttggtagaagcactggatcctgctatagctagtcagtgcaaacatgtccaagaagagatgctgcttgtactccggattgctcttctgtgtactgcaaagcttcccaaggaaagaccacccatgagagacatcatcacaatgcttggagaggcaaagccaagaaggaaaagtgtttgccataatgggggacaagacaccagtagcgtggaaaagccaacgatctttaccacctccccagtaatcagtcttttgtga

SEQ ID NO: 37684 - DNA, 288 bp, Glycine max
  Peptide Sequence Number=SeqID_154462
atggaacgtgccataaaggaagactcatctaacccttcttcctttatcaatgacaatgacatatattttactgttgttggaggtaaaaatgccaaagggaatgtgtatggcctacctgcattgagcaaaatgatcacctcaaaatcggcccaacctttggtcattcagcctaaggtggtaaaccaaatacaagagatgcatgagacgattcaaaatctgaatgtcgagcttatgacaaaggtagataaagagatgacattggaggaacaaatgatgcaattgatgtag

SEQ ID NO: 37685 - DNA, 3786 bp, Glycine max
  Peptide Sequence Number=SeqID_154463
atgacttcttctccacttcactcaccacttcatttcccccagcgtccacttttcacttccattcgtcccattccaaaccgaacattcatctccaaaaacccccgccgaacaccacgaaccccactcttactcgctcccatcaccctcactccaccaatcacgttcgccgcaaagtccacacccacacccacaccctccccgaacgacgacgttttctcgaaacacctcgttcgcgcattgttctgcttcgccgttggtttctccgcgctcggtgcattccacgctcctcctcctgcattcgcaattgcagctccatggacttattgggcaaagagaggcaccgaggagaaagagagagccaagagtcaccagtactcagactgcaccgataggctacttgagacggtatcgtttctgttgaaaaccgtggacgaggttcggaacgggaatggcgacgtgagcgaggcggaggcggcgctggaggccgtgaaatcgaagaaggaagagatgcggaaagagattaacgggaggctctacccggcgctgaagaggctcaggagggagaggaaggcgctgtggaaacggtccggggagatcgtcggcgagatattgaatgcaatggcggaatacgataagttgaaggcgaaggtggccgcgaacgagaaggagaatgagaatgcgaggatgaaggagttggaggagagtgtgggagtgatggaggatgagtacaatggtgtgtgggagagagttggggagatcgaggacaggatttcgagggaggagactgtggcattgagttatggagtgagggaaatcaatttcatagagagggagtgcgagcagctggtggagaggtttaaacgggaagtaaaaaataaggacttcaaaagtttgcctactggctcagttaccaggctctcgaaatctgccattcagaaagatttggaaactgttcatagaaaacaagcagaacaaataattcttcctagtattttggatgtcgaagatcttgggccattctttcatgaagactctattaattttgcccaatgcttaacaagaagtcttaaagactctagggagaagcaaaggaatttagaggctcagataagaaaaaaaatgaagaagtttggcaaggaaaaacgcagtattatttattcacctgaagaagaggtggttaagggttttcccgaagttgagttaaagtggatgtttggaaataaggaggttgtgcttcccaaagctgttggtctccatctgtaccatggttggaagaaatggcgtgaagaagccaaggcaaatttaaaacagaatttaattaaggatgcagagtttggcagacaatatgtggctgaaagacaggaaagaattcttttggaccgtgacagagtagtgtcaaggacttggtacaatgaagagaagagtagatgggagattgatcctgtggctgttccttatgctgtctcgaaaaagctaatagagcatgtccgcattaggcatgactggggtgccatgtatattgcattaaagggggaggatgaagaattttatgtagacataaaggttgtagctgaatatgaaatgctttttgaagatttggggggatttgatgggctgtatatgaaaatgcttgcctgtggtattccaacagcggttcatctgatgtggattcctttctcagaattgaatatccgccaacagtttctattgattttaagagtgtctcatgggattttgagtggcttgtggaattctggagttgtcacgaatgcgagaaattggatctttaagaatattaaggatacaactgatgacataatggtggtgatagtgtttcctactgtggaacttttagtcccttacccggtgaggatacaattggggatggcttggccagaggaaatatatcagacagttgactccacatggtacttgaaatggcagtcagaagcagaattgaattttagatccagacaaacaacaacagatgatgatgaagaaagatccgaatatgcagaagttgcggcgagtggtataagtttgttcttgcatcttgtgcataagtattacatttctcaaaaattgaaaaaaatcaagcagaggagaaaggatggcgttgatcccataaagaccgcttttgaacagatgaagagggtgaagaaaccaccaattccattgaaaaactttgctagcattgagtctatgaaagaggaaatcaatgaagttgtcacatttttacaaaatccaaaggcatttcaagaaatgggtgcgcgggcacctcggggtgttcttattgtaggcgagaggggtacaggtaagacatctctagcattggctatagctgctgaggctaaggtgcccgttgttgaaattaaggcccaacaattggaggctgggctgtgggttggacaaagtgcctccaatgttcgtgaattgtttcagacagcaagagatctggctcctgtgataatatttgtggaggattttgacctgtttgctggtgtacgtggtacatatattcataccaaaaatcaagaccatgaaactttcatcaatcaactgcttgtggaacttgatggatttgagaaacaagatggggttgttttgatggctactactagaaatctcaagcaaattgatgaggccttgcagaggccaggtcgcatggatagaatatttcatcttcaaagaccgacacaagctgagagagaaaaaatattgtacttgtctgcaaaagaaaccatggatgatcagtttattgattacgttgactggaaaaaggttgctgagaagacagctcttttacgacctatcgaattaaaaattgttccaatggctttggaaggaagtgccttccggagcaaagtactggacacagatgaattgatggactactgtggtttgtttgcgactttcagttctatgattccacaatggctgcggaagaccaaaattttcaataagtttagcaaaggattggtgaatcatcttggactgacattgacaaaagaagatctgcagaatgttgttgatttgatggagccatatgggcaaataagcaatgggatagagtatttgagccctccacttgattggacgagggaaaccaagttcccacatgctgtctgggcagctggtcgtggtcttactgctcttttattaccaaattttgatgatgttgataatctttggcttgaacctctatcctggcagggaataggatgtacaaaaatcacaaaagcaagaaatgaaggttccatcaatgggaattcagaatcaagatcatatcttgaaaagaagcttgtgttttgttttggttcttatgttgcatcccaaatgttacttccttttggggaagaaaacttactttctacatctgagatacagcaggcacaagagatagctacacgaatggtcattcagtatgggtggggacctgatgacagtcctgcaatatattaccgtagtaatgcggttacggcattaagcatgggggatgaccatgaatatgtgatggcagctaaagttgaaaagatgtttgatttggcatatctcaaagcaagagaaatcctgcagaaaaaccgccttgtacttgaaaagattgtggaggaattactcgagtttgaaattttgactggaaaggatttagaaagaattactaaagataacggtgtaatcagggagcaagagccgtttactcttggtgaagttcaagctagtgagccaacatctggcagcttccttgaaagaggaaatgcatcaggaagtgctctattagcatcctag

SEQ ID NO: 37686 - DNA, 495 bp, Glycine max
  Peptide Sequence Number=SeqID_154464
atggctcaacctccacctcgtgagaggactctaagggaaatggttgcacctgatttcacttatgaaagcttgtgcatacaataccctgatgaggatgtcccatatgttcttaaaattggactgatccacttgttgcccaagtttcatagtcttgcaggtgaagaccctcataaacatctgaaagaattccatattgtctactccaccatgaaaccttcagatgtccacgaagatcacatctttctaaaggcctttcctcattctttagagggagtggcaaaggactggctatattaccttgctccaaggtccatcacaagctgggatgacctcaagagagtattcttagaaaaaattttccctgcttccaagaccacggccatcagaaaggatatttcaggcattaggcaactcagtggagagagcctatatgaatactgggagagatttaaaaaactatgcgccagttgccctcacccccaaatttttgagtaa

SEQ ID NO: 37687 - DNA, 444 bp, Glycine max
  Peptide Sequence Number=SeqID_154465
atggcttgcattccagacaagataaaagatataaatggatctaaagaaaccctgaaacttgttgtcagaataactgatctttggtttgttggaacacaggacaagttcgaacttaccaaattaaaaattgtggttcgcccaattctcacgtctcgctcacaactttccggttctagccaattttcagcaaaggatagatttttttacaaagctgaggcaaagagtctttttgagataaacaaaatctcaaagtataggcttgaggtcatggtttaccgcaaggaagaatgcacaaaatttctgctatggggccgtgaatgcacagacctaattgatttgatgaacaccataatagacttactaccagatgctaaggcaccttgcaaggttcattttccactctctgatgctaataatcctcctcagtatgagactgatatatga

SEQ ID NO: 37688 - DNA, 384 bp, Glycine max
  Peptide Sequence Number=SeqID_154466
atgaaccccaaggaagttggtcccttgtgtccagtgataacaaccaagaagttgtacccacttcttgcaatgaacccaaaagacgttggtcttttgtgtccagtgatcaaccaagaagcaaatcctgcttcttgcaatgaacccaaggaacgttggtcccttgggttcagtgttcaaccaagaagaccttctcttgaaaacagtcaccaagaatttgaaaaccaacatttagaaacactggggttggacctgaatcaggaaggtgaggccctaacggattctaggccttggggtaaagacactcggtttgagtgctcctttaagcctatgttgatcccatatggttggagcattctctcaaaacagagtgaccctgactggtaa

SEQ ID NO: 37689 - DNA, 789 bp, Glycine max
  Peptide Sequence Number=SeqID_154467
atgtgcttactattgaacactgtcttgaagtaccttaaagaaaagaagagaaaaaagaactgcatatgcaaagttgtggaatgcctaaataaagaatatttggacaagattaactataaactaatttgtccctcagaacttcctagttcctataaccttcccttccctccccttcattccttgttccctgctatgaaaaatgcaacaagattaagaggaaccaaagcaaagagaacaaccaccaaaatgcaaagccacctgctgttcttcttctattgttacattggcctctcacttatttttactaaagctgcagcagatgatgaattgtcaactcttctctcaatcaaatccactctcattgacccaatgaagcatctgaaggattggcaactaccaagcaatgtgacacagccaggttcacctcattgtaactggactggagttggttgcaactctaaaggctttgtagagagtcttgaactctccaacatgaacctcagcggtcatgtttcagaccgcatccaatctctttcaagtctgtcttcattcaacataagctgtaacagattttcttcatcactgcccaaatcactgtccaacctcacctctctcaagagctttgatgtgagccagaactacttcactggcagcttccccactggtcttggaagagctgcaggcttgagatcaatcaatgcatcgagcaatgaatttcggggttttcttcctgaggatattggaaatgcaacattgctcgagagccttgattttcgagggagctacttt

SEQ ID NO: 37690 - DNA, 647 bp, Glycine max
  Peptide Sequence Number=SeqID_154468
atgagtcagcaacctgtagtggcggtactgggattaggcgcgatggggcacgcatttgccgccaatctgttgaagaagggctttaccgtgcgcggctggaaccgcacgcgtgccaaaggcgaagatctggtggacgcaggcctgacgctgagcgacagcgccgcgcaggctgtggaaggcgcagacgtggtgattgccatgctggcggacggcgctaccacgcgcgccacgctaaaccaggtgcagaacacgctgcagcagggggctaccgtggcgcagatgggcaccatcggcgtggaagcgaccgacgcgctgatcgccgggctggcggccgcacggccggatgtggtgtttattgatgcgccggtctccggtactaaagcgccggctgagaacgcgcagattctggtgatggccagcggcgaccggcagcgcgcccaggcggcggagcaggtgttcgccgcgattggtaaagggacgcagtggctgggtgccgccggcgccagctcgcgcatgaagctggtggtgaacagctggctgattggcctgatgcagagtcttgccgaaagcacccggctggcagagcagtttggtttcactaccgacgatctctggcaggtgctggaaggcggtccgctggccgcgcc

SEQ ID NO: 37691 - DNA, 210 bp, Glycine max
  Peptide Sequence Number=SeqID_154469
atggggttgaatcaatttagatttttcaacatggttcatgacatcttggtcaaggtgaaactggaagtaacaaggacatcaacagtcctaaatgtgtttggcagtaaacaaagcagtgataggaaaatgaaaggatcacgcatgagcaaacatgaaaacaaaaggtatgcagtttgtagaacaaaaagtatgttgaacgcatatgcatga

SEQ ID NO: 37692 - DNA, 372 bp, Glycine max
  Peptide Sequence Number=SeqID_154470
atgacaccggcacaatctgctgatccggccagacatccacctgtgatgcaagatgacacatatgtgaagcctcatatccctgaggtcccagtggcaccagcagcagcactgacacatgccgcttttgatgtggagcaacctagacatgcagtggaggcttgccaagcaatcggagaaaggttgaagcatttgcttaacctaaggatagtcactgtaggcacaaaaatacacgaggtcatggaatactgtttaagaatggctaggggtgtcacagcagagggcaatgtttatgtcaggtcggacgaaggcgacgcacggatcaaccatagatgccatccattttatatttcaatatctggactatgtttataa

SEQ ID NO: 37693 - DNA, 345 bp, Glycine max
  Peptide Sequence Number=SeqID_154471
atggagcattttcttgagcaagtagcctggcatgaagctcaacttccattggtgagacccaatgaggcttctccgcctgagcccacacctgtacaggttgatccgaagcaaggtggcccacaatctccagtggtgaatccaccgtcttctcctaagcgtgaagtagttcccccatctccacctctaattgtcatctctgatgcatcatcggatgaagcggctgcccctcctgattcaccagttggagaaacagccgaccctcttacttccccaattgaaggaattgccgatctttctgattcgtcatctggagaagttgttgctcccactgattccccagtttag

SEQ ID NO: 37694 - DNA, 1350 bp, Glycine max
  Peptide Sequence Number=SeqID_154472
atggtcgttttggtctctgatgttgtctctgattatgccaatacccttctccaggctgatgggtggatagttgagaagattagtttattggcgaatcctaatcaacattctgagaggttgaattcgggagtcatggtggtgcagccatctgctaccattttcaatgacatgatgagcaaagtaaaaactctgccatcttacactggaggggaccagggatttctcaattcatattactctggatttcccaacgcacatctttttgaaccaaatttgtccccagacatgttggatactagaccagttcctgaaatggagcgactttccacactttataatgcagacgttggtctttacatgctggctaacaagagattgaatgaattggaagagaaactggaggggatggaagccataattgaggcttggatcaatgtggacgagaaattgtggatggtggatgagaatgaactccgtgtaattcattatacactaggtcctcttaagccttgggactggtggacatcttggcttgtgaaacctgttgatgtctgcagcaatatctcaaaaacttgtcttccaaatgtaagggaacagctggaggaatcccttcctggaactggagggggccaaaatcctaaagataattatcttgtgaagtttctttttctgctaccattttgtgctgtgctgttctgctgttgtcgttcgtttctaaaggaattccgtgtgcctcataatgttgtattttctgcagaatcagagggatttggatcatgtgaggctcttgcatactcatcagatgactggctcataaatggtgttcagtacaaggtgcctgcatatttgggcagtatttctgtctgtttattggttgcagtggtgtctcttggattatctatctttatagtaccacgacaagtggctccatggactggtttgcttttgatgtatgaatggacattcacaatcttctttatactatttggaggttatctaaatttgatttatcatcggggaaggattattgcatcacaaatgccttcctcgttgtctcatcctgaatcttctgatgatgattctgaaaaagttcatcagcgtcagatgtcatcatgtgatgctgctacgtggttctatggattagggatggccttcttggccattgctactccatctttgccttttctttttgggatcactgcattgtttttacggttagctttgatggttgttgggggcgcaatattagcatgtttcttgacatactcctccgaacgtcttgcaatcagatcatttctgaaagggcttgaagagagggatgttgcacgcaatgcaaacttctgttgttga

SEQ ID NO: 37695 - DNA, 773 bp, Glycine max
  Peptide Sequence Number=SeqID_154473
ggcttcacgtcctcgccttcagagggctgcactccctcgcctttagaggactgcacgtcctcgtcttcagaggactacacgtcctcatctttagaggactacacgtcctcgccttcagagggctacatgtcctcaccttcagagggctgcacgtcctcgccttcagagggctacgcgctctcgccttcattcctgagccaccccctgatattggagggcgctcgactgtgcaagcagaactagagaggaaggctatcatgcagctactatgcataccggggcaagatttcacccgtgccgctgcaaagagacaacgatcgcaatgccgatctccccctgcagatgtatcagttggtctgtgtcatcccgacataggtaagtatgcatatggttcaactgatttcttataccatccactatttgcagggatcgtgcccgcaagacacccagtggacccggagaagtccaacagggtcttggggtttccagctctgattatgggcttctatcagttctacggagtgcctgtcacccccggcaaggtcatcaggtcccctactaatcaagctttcatcaagaagtattgcacccccaggcaggcgcagggcgaaacaccacagcagcctggggatggttggcaacgggcaacaaatgcaccgccgccacctccagagcccctcagctcatccacaaaaaggcgtccagctcaagacgttaaagaagcgttactaggaggcaacctagtaccttttgaatctatgcttgttatttga

SEQ ID NO: 37696 - DNA, 1509 bp, Glycine max
  Peptide Sequence Number=SeqID_154474
atgcattcattgaggtatgagttggctgaagagtgtgctgatgacgacgatgcgaaacttggaatctgtgagttgaggaaggcagttctagaggagctgaagatgcacaacttgctggtacaggaacgggagttggaccttgccaaagagcatggtattaattctgcaactgttaagtacacagagttcctgctggctacagcctctgggaagattgaaggactaaaaggtcctggtaaacttgctacaccatttgagaaaacaaaaattgctgcttatactttaggtgccatgactccttgcatgaggctttatgccgttatgggaaagaagttccaggaacttttggattccaatgaaagtactcacccatataacaagtggatcaacaactattcctctgatggtttccaggctactactctgcaaactgaagatttgctcgacaaactaagtgtctctttgactggtgaagaacttgatgtcattgaaaagctttattaccaagcaatgaagcttgaaatagagttcttctctgctcagccactcttccagccaactatagtacccttgactaaaggacataagcctgtggaagatcatctcattattttttctgattttgatttaacatgcaccgtagttgattcgtccgccatcttggctgaaattgccatagtgacggcaccaaaatctgatcagaatcagcctgaagatcaaattgttcggatgttatcttctgacctcaggaatacatggggttttctatctaaacagtatacggaggagtatgagcaatgtatagaaagcattatgcctcccgatagattgaacaatttcgattacaaagaattgtcgatggcccttgagcaactttcaaaatttgagaacactgcaaataatagggttatcgagtcaggggtactcaagggtataagtctagaagatataaagcgtgctggagagcgtctgatactacaagatggttgccctaacttctttcagagcattgttaagaatgaaaatttgaatgccaacgtgcatgttctttcatactgctggtgtggtgacctcattaggtctactttctcttccgctgatttaaatgagttgaatgttcatgctaatgagttcacttatgagggatctgtttccacgggtgaaattgttaagaaagtggagtctcccattgacaaggttgaagcttttcgtaacatattgaaaaattgcaatgatgacaaaaagaaattaactgtttacattggcgattcagtgggtgatttactttgcctacttgaagctgatgtaggaattgtgattggttcaagttcaagccttagaagtgtagggacgcagtttggtatttcatttgtcccattgtattctggcttggttaagaaacagaaagaatatgttgaaggaagcacttctgattggaagggtttatctggcattctttacacagtctctagttgggctgaagtgcatgcttttattttgggttgctag

SEQ ID NO: 37697 - DNA, 312 bp, Glycine max
  Peptide Sequence Number=SeqID_154475
atgtcaattggagatgcacaaccgattcaaattcacaacaaagaaaattgtggtgaatcaatccctgaagagtttgacattgtcaaacatcatgatgggctgaaagagatgaagaaaaccatagaggatgttcgtgaattggtgcttaagttaacaaaaaatattactattggcacaccaacaaagactccaaaacaaggtcatcgacttctctatgctggtggtgatgctaaaagattggagaagaaaacaggtggcaaaaaattattctcaccgctaaagaaaattatgaaacctacaaaggttttgtga

SEQ ID NO: 37698 - DNA, 582 bp, Glycine max
  Peptide Sequence Number=SeqID_154476
atggggtgtagcaagcaaatgctcacctcccccttagcccatgagcccaaaatctaccctaaggctcatgagaaccctagggccttctcctgcatctcaagcccaatcttcttagagtcttctatccaatgcccttggggggtaggattgcatcacaatttcctgaggaggtgtgtaactcaggggcagccaagaagcataatatggaattgccatagttcaccttacagaggccattacaatggagagatgactgctgtcaaggttctccaatctggtttttattgtccaaccttgtgcaaggatgctcatgaatacgtccaaaggtgtgacaaatgtcaaagaacacgtggactctccaaaaggaatgaaatgccattgcagaacattttggaggtcgaagcttttgattgctgggggacagatttcataggtccatttccatcatcttactcacacgaatacattttattggttgtggactatgtaacaaaatgggtggaagcagtagcggtacaacatgcatatgcaaaaaccattatttgcttcctaaagaaaatatcttctcaaggtttggcatga

SEQ ID NO: 37699 - DNA, 741 bp, Glycine max
  Peptide Sequence Number=SeqID_154477
atgtgggacacaccagctctaatgtatgaaggatcatcgcaagtaaaacacaacaaactcaacatgttgacatacaaagattatcaattagcctttatttcaaggaagataaggaacatgtggaagaaagggaacgaatcaaagtggaagggatccaagaaaccatataaagaaaggaaagatagggataaaagttccatcatatgctataagtgtaagaaaccaggacacttcaagtcagaatatccagatcttgaaaagacataccacaagaaaaggtacttcaagccaaaggacaacaaagtactaatgagcacttgggaagaccaagatgacacatcattcgatgaggaaatcgaagaagaagaagaaaaagccaacctttttctaatggcaaacactacatcaaaaggatcagactttgaatcagatgaatatgtaaatataaacaacattgaaactcttcaatcaacatatcatgaacttctctccaactcatccattttgtctaaagcttgtcaaaatctgagaaaggacttcaaaagtctttcaaaagattatgaacaacttcaaggaaaacatgaagaaaatacaaataattcttcaaaattttccacccaaccatgtgatggctttgaaactctaaagaagacaacaaagcttcacattgaaaatgagaaaatttataaagaaaaatctagtctattgaaagatcttcagaaattgaaaaatcaattgtaa

SEQ ID NO: 37700 - DNA, 804 bp, Glycine max
  Peptide Sequence Number=SeqID_154478
atgatttctggtatccgttttggtaaatttgttgagatccaattcgataaaagtggaagaatatcaggagcagccatccgaacatatcttctagagagatctcgggaaattgagaaatacaaattaggaaatcctagatcatttcactaccttaaccagtcaaaatgctatgaactggctgatgtaagtgatgctcgtgaatatcttgccacccggagagctatggatattgttgggataagccaaaaagatcaggaagccattttcagagttgttgcttcaattcttcatattggtaatattgaatttaccaagggaaaagacattgattcatcagttccaaaagatgacaaatccaaattccacctgaaaacaactgctgagcttctcatgtgtgatgctgatgccttggaagacgcattatgtaagcgtgtcatgatcacccctgaagaagttataaaacggagccttgacccccaaagtgcagcaatcagtagagatggattagcaaaaacactctattctcggctatttgactggttggtggacaagattaatagttccattggacaagaccccaattctaaatctttgattggggtccttgatatctatggtttcgaaagctttaaatctaacagttttgagcaattttgcattaatttcacaaatgagaagttgcagcaacatttcaatcaggcaaagtctaagaacaaattatgcacttcaagtttgtttgctatttccattattaatatgatgaaacctggaggaatcattgctctcctcgatgaagcttggtaa

SEQ ID NO: 37701 - DNA, 3105 bp, Glycine max
  Peptide Sequence Number=SeqID_154479
atgtttccgaagtcaactcatgaaacatttgcaaataagctttatcaaacatttaagaatcacaagcgctttattaagccaaaactgtctcgaacagatttcacaattgctcattatgctggggaggtattataccagtctgaccaattcttagacaaaaacaaggattatgtggttcctgaacatcaagatttattgagtgcttccaaatgttattttgtatctggcctttttcctccacttccagaagagacatcaaaatcttccaaattttcttcaattggttctcgttttaagctacaactacaaagcctgatggagacattaaattctacagaaccccattacattagatgtgtgaaaccaaacaaccaacttaagcctgcaatttttgagaatgtcaatattatgcaacaacttcgctgtggtggtgttttggaggcaatcagaatcagttgtgctggctaccctactcgccgtgctttctttgaatttataaacagatttggcatccttgctacagaggccatggaagcaaactgtgatgaaaaggctggttgccaaaagattctggaaaagatggggcttcatggatatcagattggaaaaacaaaggtattcttgagagcaggtcagatggctgaactagatgcacggagagctcaagtacttggtaatgcagcaaaagttatccaacggtgcgtacgaactcatcaagctcgtaaacattatcttgcattgcgaaagaagagcatatatgtgcagtctcggtggagaggaagacttgcatgtaaactctatgagcacttgagaagggaggctgctgctaggaaaattcaaaagaatgtacgcagatatgaatctaggaaagcctataaagaacttcatgtgtcagcacttacactgcaaacagctataagggccgttgctgcccgcaagaaattcagatttaagaagcaaactaaagcttccattattattcaggctcggtggcagtgccacaaagctgccttatatcataagaggcttaagaaaggtgcaatagttacacaatgcagatggagggggcgcatagccaggaaagaacttaggaaactgaaaatggctgcaagagaaactggtgcccttcaagaagcaaaggataaactagaaaaacgagtggaggaactcacttggcgtctccaactagaaaaaggtttaaggaccaatctggaagaatccaaagcacaggagatagcaaaagtgcagaatttattgcaggagatgcagaacaaatttgaagaaactaatgctctgctcatcaaagagcgagagaatgcgaagaaagttgttgaagaagcacctcctgtcattaaagaaacacaggttattgttgaagatacacagaagatcgagaaactgaacgctgaagttgagagcctaaagctcatcttaagtgattttgccttggctgtatcaacacagacttcactcaagtcagagaaacagaaagctgatgactttgaaagaaaatacaacgaaacccaagtttgtagcgaagaaagacgtaaaaaactagaggacacggagaagaagacacgtcagcttcaagaatcattgactaggctagaggagaagatcactaatttagaatcggagaatcaggttctacgtcaacaagctgtgtccatggcacctaataagttcctttcaggacgttcaagatcaattatccagagaactgaaagtggtcatattgtacaggaagcaaagacaactctgcctaatcaggaaatgcacagcaaatcaatgcaccggagggaaccctctgacggcttggacgataaaccacaaaagtcactaaatgaaaaacaacaggagaatcaagagttactcattagatgtattgcgcaacatctaggctttgctgggaacagaccaattgctgcctttatcatatacaaatgcctcttgcactggagatcatttgaagttgagcgtactagtgtttttgaccgtatcatccaaactattggccatgcaattgagacccaggataacaatgatgtcttggcttattggttatccaatgcctctacacttctcttgttactccagcgcacactcaaggctagtggtgctgctggaatggctccacaacgccatcgttcttcagcaaccctgtttgggaggatgactcaaagtttccgtggagcaccagctggagtcaatgtttccctaatcaatggtaacacaagcagaggagtagatacattaagacaagttgaggccaagtacccagctctgctgttcaaacaacagcttacagcatatgtggaaaagatatatggaatgattcgtgataatttgaagaaagaaatttctcccttgcttggattatgcatccaggcaccgagaacatccagagcaagccttgttaagggatcatcacgttcagttgcaaaccccgaagcccaacgcgctttgattgctcactggcagggaatagtgaagagcttaggaaactttctaaatgcgttgaaagaaaatcatgttcctccatttttagttcgtaaggtgttcacacaaattttttctttcatcaatgtacaattattcaatagtcttcttttaagacgggagtgctgctcatttagtaatggagaatatgtcaaagctggtttggctgaattggagcattggtgttataaggcaactgatgagtatgcaggttcagcctgggatgagctcaaacatattagacaagctattggatttctggtcatacatcagaaaccaaagaaaacattggatgaaataagccatgacctgtgcccagtccttagtatacagcagctatatcggataagcaccatgtattgggatgacaaatacggaacgcatagtgtgtcctccgatgtaatatccaatatgagagtgttgatgactgaagattcaaataatgcagttagtaattctttcctgttggatgatgattcaagcattccgttttctgttgatgacatatcgaaatcaatggagcagatagatatcgcagatatagagcccccgcctctaattcgtgaaaactctggctttagctttttgttgccacgcccagattga

SEQ ID NO: 37702 - DNA, 855 bp, Glycine max
  Peptide Sequence Number=SeqID_154480
atggatcgtccaatagggacaaaagcaggggcatctgtttcccgttctgctccgagcgatcaatgcgttcgagaaatgcagcagcacctgatgcagatgcagcccatgatggctgcctactaccccaacaacgtcaccactgatcacattcaacagagaaaaacaactaaaaaggttcttctttcatcatatccactgttctggtggcaccccacttttagacttggtgttttgaaggattttaagttgaataaatggtttgattacttcgtgacactgacacacattaacattaattacctggatgagaacaagtccttgattctgaagattgttgaaagccagaattctggcaagctgagcgagtgtgccgagaaccaatcaaggctgcagagaaatctcatgtacctagctgcaatagctgattctcaaccacaaccatctccattggctggtcagtatccttctagtggacttgtgcagcagggagcacactacatgcaggctcaacaggctcagcagatgtcacaacaacagctaatggcttcgcgctcctcgctcctgtactcccaacagcctttctcagtgcttcaacagcagcaaggcatgcacagccaacttggcatgagctccagtggaagtcaaggcctccacatgctgcaaagtgaagccactaatgttggaggcaatgcaaccataggaaccggaggagggtttccggactttgtacgcattggtagtggcaagcaagatattggaatctctggtgaaggcagaggaggaaactctagtggccactctggtgatggtggtgagacacttaattacctgaaagctgctggtgatggaaactga

SEQ ID NO: 37703 - DNA, 744 bp, Glycine max
  Peptide Sequence Number=SeqID_154481
atggcgagagaaacgtaccattattgcggtgtaaagtgggagaaagtgggaaaatggtgtgaaagtgagatgacaggaacgacgacattgattagtttttgggggaagatgaacagagagggaaatggaagaagtgagcaagggtttggatccatgaagagacattcttcgccacgcccttcaacttcggcaccttcttcttcttccctttgctttcgcgccaactcgtggctcctaattaactatgtgtctaacggaatttcttctcactcccctccctggtcgaaggcgacagtcagggaaagaaattccgacgatgggagaagcggaggaaggaagaaattcgtacaaggaggaggaaataaaaaagagcaagggggaaaagaaacagaacgacaccgatctcctttttttttctatttcgctttcctctctctcgatctcctttgtttatttgatgttcatttgtgttttctgttatgtgcgctgtctgtggtgacggtcgactcattggctcactcggatgagggagggacaagggagagaagcaaggtgcagagctcagtgagcttgatgcggaagaggaagacgcggcggaggaagaaggtttcaggcggcggcggcagcggtagcggtagcggctcctcgtctccgctggagaacgatgaggttgtagtttgctcaccaaattactaccattgcctaaaacgtgccaaaaaacttgttgtttcaggaattgagtag

SEQ ID NO: 37704 - DNA, 666 bp, Glycine max
  Peptide Sequence Number=SeqID_154482
atgcagcagcaaactgtgattaaactgatttttctacaatgtggtatccagttggttgttaggccaatattcctgagaattatgggtactccagtgaatattgttgtgggttctcatgtctggattgaagacccagaggtatcttggattgatggacaggtattaaaaataaatggaaaggatgctgaaattgatgctaccaatggaaaaaaggttgttgcaaatttatcaaaaatatatcctaaggatatggaagctcctcctggtggagtggatgatatgacaaaactttcctatttgcacgagcctggagtcctgcagaacttaaaagctagatatgaattgaatgaaatatatacttatactggaaatattctgattgcaataaatccattccaaagactacctcatatttatggtgcgcacatgatgcaacaatacaagggagcaccatttggagaattaagtcctcatgtgtttgcagttgctgatgttgcatatagggcgatgattaacgaaaagaaaagcaattcaattctagtcagtggggaaagtggagctgggaaaacagaaactacaaaaatgcttatgcaataccttgccttcttaggtggtagggctggtactgaagggcgaacagttgagcaacaagttcttgaagtatga

SEQ ID NO: 37705 - DNA, 381 bp, Glycine max
  Peptide Sequence Number=SeqID_154483
atgaaagataagagggatgaggaagaaaaactagaaaagcaaaagaaaaagaaggatagtaaggccttgtcttcaaaggccaaggggaaggaaaaggaggaaaaggattcctctaagaagattgttaagaaggaaaaacattttgcaacaaagggtgatattaaaagagcattccttcttaaacaatctttctaccttctcctatcaagggaagcatcccttagcaccgccatacctcttgagcttgaggttattcctcaagtaaaggagttgttcgatgagggtgtggtttgcaagagcttaaatccttgtgctttgttggtgcctaaagtaggaattattaggcaccaaatccctatgataggtggtgtcataccctaa

SEQ ID NO: 37706 - DNA, 1029 bp, Glycine max
  Peptide Sequence Number=SeqID_154484
atgcccgcgttcttcgcgtgcccgtgcgcgacggtcgaacagcaatgcactggtcacgatgccaaggccgagcaccacgccgatgaacaacagaatcagcgcaatcagcgggtagccgaacagatgccagccggtgtcgatcttcatcatcatcgcggcggccatgatcaacgcggcgctgatgatgccggccgcgacgcggttggcgatcttctgcaggttctccatcaaccgcgattcttccaggccggtcaccttcatctgcaggcggttttcggccagcagggccatgatgtccgacagcttgcgcggcccatcgcgcagcagctgctgcagctccatcgcctcgctggcgaggttggcggcagacagcgatttcttcaggcgtgcgcgcatcacgtgctgcagctggcgctcgacgatgcgacgtgtttccagctctggtgccagcagccggcacacggtttccaggttgagcagtgccttgcccagcaggctcagttccggcggcgtgcgcagcccgcaggcggtggcgatgcgcaccatgtccagcaccacgcggccttcggagaacgtgccgctggcggcgtaacgcgcgatcaactggccggtctcgcgcagataacgttcctcgtcgaacgcctccagccgcgtgctgatgctgatcaggtcgtcggccacttcctcgccacggccgtcgaccgcggcgaacaggatcttcagcaagcgctcgcgcaggcgcggcggcatgtgcgcgaccatgcccaggtcgaagatcgccagccggccatcgggcatcacccgcaggttgccggggtgcgggtcggcgtggatctcgccgtgcacgaagatctggtcgaggtagccgcggatcagcgccgacgccaacgggtccatcgattgttcggtgcggcgcacatcggggatcgcatccacgcgcacgccggtggccagttccatggtcagcacgcgctggctgctgtagtcccacagcggctgcggtatccacaggcggcggaacggcttcag

SEQ ID NO: 37707 - DNA, 411 bp, Glycine max
  Peptide Sequence Number=SeqID_154485
atgggctcagaaatctaccctgaggttcatgagaaccctagggctttcttcagcaactctagctcaatcctcttggagcctcttgctcatggctctagtgactgctcccttcctagggaggattgcatcaacgacctcctttccgagaaccttggacacaatggtcttctagtccttcatttgagcattcctccagaacattttgataagctttgggtatatcatctaagggtcactgaaataaccatggattccacagagaagcggagttcactatatgttgaggtcgaggccttccagcatactgataccgaagtagtgttcaacttgaacaataggttctccattgatgtgaatgatggttgtgtcagtggtgataatagtggatgcaagagcagtattttcactgga

SEQ ID NO: 37708 - DNA, 267 bp, Glycine max
  Peptide Sequence Number=SeqID_154486
atgttgattggagagatagacttcctggtttatagtggtggtagactggatggctatggagtgggtgttcatgttaccttgttatcaaatgaactagagtcgtcagatgatgggatcttgatggattctgtgggtgtcaaggacttgcatccagctcttgtcttcctcttctttggaaaagaagaggggatcatagttgcatttgactcctttttggagtggtttgcggatgagttcattgagactagactagacgagagggtctag

SEQ ID NO: 37709 - DNA, 267 bp, Glycine max
  Peptide Sequence Number=SeqID_154487
atggtgcctgatagagtctaccttagactgcccatctgtgatgtggggaagaagaagggatttaagctctatttcaatgaggacatgcccaacaggaaaatagaagatagagctagacctcatggaaccaaacaatgtggtatgacaccaagggagccagcccttccaactctacacatgtacatgctttccaacaaagggactccattaaggtattacatcaaaccaaagtttaccactttgatgatgaaaacacctgcttcgtga

SEQ ID NO: 37710 - DNA, 252 bp, Glycine max
  Peptide Sequence Number=SeqID_154488
atggccaaaatatggttcaacatcactcggaagagttttatgcacaaaagactagatgaggactccaaacattccatcatcagcaagggaaccttcatcgccaggcagttgcacttcagttatgtcaacctaaaggcaatgaaggattctaagagagcagcaaggcaagcttcaggccaaaaagcatgcccaacaccaagaagaggaagaagaaaccgtgtcgaagaagcaacagaccaagaaaagacatga

SEQ ID NO: 37711 - DNA, 273 bp, Glycine max
  Peptide Sequence Number=SeqID_154489
atgggctcaaaatctaccctaaggctcatgagaaccctagggccttcccttagatctgtagctcaatctactaggagtcttctagccaatgcccttgcgggagtcaatagtgacttcgtaggacaaacaatactagaacaatgttggtgtagagctcatgttatagagctagaagtggtagtggttaatacttgcaacttgttgaagttaatggaacttagtggtttgccaagaactggacgtagtctcagtggtagagacgaaccagtgtaa

SEQ ID NO: 37712 - DNA, 159 bp, Glycine max
  Peptide Sequence Number=SeqID_154490
atgagcgagagtattgagaccgagaatgatagtgccgacactagctatagcgtcgcaagaatgagatcgataagtaagagtgagagtgacaaagggttcgaggttgccagaagcgtgaggaagacgagtgaactaccagaagcacgaaagatattataa

SEQ ID NO: 37713 - DNA, 570 bp, Glycine max
  Peptide Sequence Number=SeqID_154491
atgagaactgctcatagtgggcaaaagagttatcaagacaagaagaggaaagacttggaatttgaggttgttgatcatgtattcttgagagtcaccccttggactggggttggtcgagctttgaaatcccgaaaactcacaccttattttattagtcccttccaaattctcaaaagagtcgatcccgcagcatatcaaattgcattacccccatctctttctatcctccacaatgtctttcatatttctcaactccgtaaatatatccatgatccttctcacgtggtcgaattagacattgttcaagcaaacaaagcatttgagaaggaaaaagactctgttggtcaaggaaacatggaaattagagaattagatgcgataagcctatccagccttgcttcagtcaggttgaaattacgagatttcaacatttacctaaacctgttccactataaccgcgatcctagagtcattaaccattggattgccttcacattccaactgtatgcttgcaacccaattcttcacgttttgaccattggaattttcacaataacatttggagtatga

SEQ ID NO: 37714 - DNA, 389 bp, Glycine max
  Peptide Sequence Number=SeqID_154492
atgccagaccataacacccgtcaatccacactagaacgcctcgaggaggccatcgccaaactcacccaagctcaggccaccctcacccaagatcacacgaccctcgcccaaacccaaacctccatgaatacaaaaatggacgccatgctcgaacacctcgccgccctcaccatccaaccatcttccccgcaactctccccacaccacaaccccatcccttctccacacacttacaaaccacacacgaagctcgatgtacctagattcgacggccaagatccagttggctggatttttaaaatctgccaattcttcgactaccaaggcttacctgaccaggagcgtatcaccgtggcttcattctacatggacggtccagcgctatcctg

SEQ ID NO: 37715 - DNA, 243 bp, Glycine max
  Peptide Sequence Number=SeqID_154493
atgagaaggtttccaaaacatgtgactggtattgttttcggcaatgtcattgacttcacggagaatggtgctgccagtgtggtagttgtgcttgaagaacatgacgcagttgactatcgacttgagtcagaggagcttggagaggggtgggtagttgggtggtggcatgatggtgggtttggtgtattgtggagttggagttggcattgggtggttgcggtggacgatggtgatgttgggtga

SEQ ID NO: 37716 - DNA, 609 bp, Glycine max
  Peptide Sequence Number=SeqID_154494
atgcctacgataaatgagctacttgatgagatcgaaacaacatcgtggttctcgaagttggacctccgtcaagggttccatcaaattcgaatgaatgaagaggacattcccaaaactgcattttgcacccaccatggtcactttgaatttaaggccatcttggatacgctctcacaaggctccttctatctctgccgttccaagtgtattttcgtcgaacaacaactgacctatctcggccacatagtatcctcgcaaggtgttgctccagaccctgagaagattcacgcaatgatcgcttggcccacacccacaactccttcggaactcaggagctttctgggtctcacggggttttatcgtaagttcattcgaaattacactaccactgctgccccgttaacggctttactctgtaaagatagcttcatatggacgcctgaagctcacactacattccaacatctgaaaactttaatgactcaggctcctattcttgcttcacctaacttcacggtgcccttcattttggaaactgatgctttcggcaccgctatcggggcagtcctgctccagaagtcaaggcccattgcgtttttcagcaagtaa

SEQ ID NO: 37717 - DNA, 153 bp, Glycine max
  Peptide Sequence Number=SeqID_154495
atgtgggatcggcacaggcttaaaagagcactcaaaccaggtgtatttaccctcaaggcctacactccgaagagtctgtcagggcctctccctcctaattcagacattgctcatgaattatacaatatccacgacctcacactcatgttttaa

SEQ ID NO: 37718 - DNA, 312 bp, Glycine max
  Peptide Sequence Number=SeqID_154496
atgcctgaagatgcaatccgattgagcttgttttcattttctttatcgggagaagccaaaaggtggcttcattcattcaaaggtaatagtcttaagacatgggatgaagtagttgagaaatttcaaaagaaatatttccctgagtctaagactacagaaggcaaagctgctatctcttcttttcatcaatttcccgatgaatctttgagtgatgccttggaaagattccgtggtgggaaaattaaattgaagacctctgaagaagccatgaatctcattgaaaatatggttgcaagcgacattgctatttga

SEQ ID NO: 37719 - DNA, 1380 bp, Glycine max
  Peptide Sequence Number=SeqID_154497
atgccgggcgggctgagtgccgcgcaatactcgcaaaacccgttccaatccacgcggccgtgggaccagttcgaaggccgccgcaaggatatgtcgttcaagtacaaacatcaggaagacgacaaacagttcgaagtgttgacctacttcaccgacagctaccgcggcagcaacatcgaatcggaaggcaccggcaaaaacgcgggccagcggcgcatggtctcctatccgcgtcactattcaacctgggctatcgaaccaagctattcgcaggtcttccgcttctgggatatggcgcacgaaatcaccctcggttaccgttacctgaatgaaaccatggacgaaaaggcgtcgcgttcggcctggtataatccggcggatatcggctcgacgccggagaccccggactattaccagcacacctccggcggcaccgcggccaacgcgttctatatcgacgacaccatcaacgtcggcaactggacggtcacgccgggccttcgttatgaaagcatccgcacccacgtggacgatgccttcaacaacatcagccgcgagaaaagctacagcgaaccgctgccgtccttgaacgtgatgtaccacctgtccgacgcctggaagctgttcgccaacgccaacacctcgttcggcagcatgcagtatttccagctgaccaaaggcggcaacggcaaccaacctgcgccggggctgacggcggagaaagcgcatacctatgaattcggcacccgctacgacgacaccgtggtcaaagccgaagccacgctgttctacatcgacttcgataaccagctgcaatacatcagcaacgacgtgggctggaccaatatgggcgccaccaagcacaaaggtatcgagctggcgctcagctacgatctcagcgagctgaaccgggcgctcgacggcgccagcgtctataccagctatacctacaccaaggccagcaccgataagggcgacttcgccggtaaagacctgccgttctactcgcgccaggtctataccgtcggcacgcgctacgccaccggcagctgggtatggaatctggacggctacgcgcagtccaaacagcattcgccgggcaccgggccggagtacgtcacgcaggaaagcgccgatggtcagttcggcgatatcgccggttacatggtgtggaatatgcgcggtgaatataacttcgggccgcagctgtcgaacctgacgctgggcgccggggtgaaaaacctgttcgatcagcgttacttcacccgctccaacgacaataacttcggcaagtacgtcggcgaaccgcgcaccttcttcgtgcaggggtcgatcgctttgaataaccgaggccccgccggggcctcggtatcaccgaca

SEQ ID NO: 37720 - DNA, 965 bp, Glycine max
  Peptide Sequence Number=SeqID_154498
agatagcgcgtgttgacgctgcgaatatcgctttgataacccatcttgctgaactgctgcttcaggtagtcggcggtgagcaattcggccgggctgcccgccatgcggccggggaagtaagtggcgatgtggcgggtctgttcggcggcgaaacggcccattggcgcgtcttttgcgggctgtgcggcacaaacgctgaagacgccgccgagtgcgagggccagcaggctggtcttcaggctgttgtggactatctaccaatatttgccgacctgaaacaacgtccggtgctggtcgttggcggcggtgacgtggctgcgcgaaaagtcgatctgcttcagcgcgccggggctgaaatacggatagttgcgcagtcgctctcaccggaactggaacaacaacgtcagcaagggcaactgctctggctggggaaaacctttgacccgcaacagctggacgaggtgtttctggcgatcgccgccacggacgacaacgcgctgaatgccgcggtgttcgccgaggcggataaacgccgggtgttggccaacgtggtggacgatcagccgcgctgttcgttcatcttcccgtcgatcatcgatcgctcgccgctggtggtggcggtgtcgtccagcggccaggctccggtgctggcgcggttgctgcgcgaaaagctggaggcgttgctgcccgccagtttggggcagatggcgcaggtggcgggccgctggcgcggccaggccaaacagcggctggcctcgatcggcgaacgtcgtcgtttctgggagaaagccttcggcggccgtttcgccacgctggtggccaacggccagacggcgcaggcggagcggcagctggagcaggatttgcaaagcttcgctgcaggcgatgaaggcgcgcagggcgagatagccctggtgggcgccgggccaggcgacgtggggctgttgaccctgcgcgggctgcag

SEQ ID NO: 37721 - DNA, 288 bp, Glycine max
  Peptide Sequence Number=SeqID_154499
atgatgagagaatctagaagagcacaagagtcgaggccacacgctaagcgcaaaatcagcttgctaagcgagatgttcgtctcttgcaggcttagcgcacgactggcgccaagcctaaatccacttactcgtgctaagcgcgatgatggcactaaggaaaacaacacttttatcagagctgcatacttttgcacagaattcgagaagagtgctctagaggcaacagagaggcagcagctaagaagggaagctagggttcatcactttgagagattagagagtgtttga

SEQ ID NO: 37722 - DNA, 393 bp, Glycine max
  Peptide Sequence Number=SeqID_154500
atgaacaagatgacaataggcacaatgcaaaatagcagggtcatcctaagggctgaatctcaacactttgcaagatttatgttggtagaccaaaagaaacttggttaccacaatgaccctttcatcatggcagaacaagctagacaagtattttacattcaagacccttgtgatgaaaggtggtgcgtggttctacagggcaaaacaattagtgttaatgtagaagatgatgattcatacatggacacctatgttattcctttgtcaacacaaatcactcctaatgttgttggagaagaagaagttgacgacgttcatgctaatggaagtagttgtagaggtggttcaaaattcagtatccacgtgaagcatcagctttgtttattgaggtga

SEQ ID NO: 37723 - DNA, 345 bp, Glycine max
  Peptide Sequence Number=SeqID_154501
atgatgagatcaaagatgctgcaactagtgaattataaatcaaaggcaataaagagagcactcaaacatagaaggaaaaattatcaaatgaagaagttagtgccacagataagggcaacaaagggagatctgaaacacacaaggaaaaattatcaaatgaagaagttagtgccacagataagggcaacaaagggagatctgaaacacacaaggaaaaattatcaaatgaagaagttagtgccacaaatgagggtagtgcaaagaatagcatcaaaagcaactataatgaagttagtaaatttgaagataaggacaaagaacaaagcatacagaattcaaaaatga

SEQ ID NO: 37724 - DNA, 264 bp, Glycine max
  Peptide Sequence Number=SeqID_154502
atgataggtggtttggacagtttaagaaatggcacccatctcattcttgtgtccatatccattttacccaacagatcatcaccaactccatgctactccttgcttgcactatttcccttcttcatgcaagctctactaagcacatcaggcaaaggttccctcgaagacgtatgtgatggcaaactcgaaacggaagcgatagagactaggacgaaacaaacagatcccaaaaaacagaaacttgaaaaacttggcgccgaatga

SEQ ID NO: 37725 - DNA, 420 bp, Glycine max
  Peptide Sequence Number=SeqID_154503
atgttagacgaaggcataggagctccaatgatggaccctttggaccaatctggccaagtagaggctttagggcgtgttgagcctgtgaaggttgttgagcctcaagagcctgtccaaattattgagcaagtgaagcctactgaccaccaagagctagaagtacctgttgtattccctggtgaccccgaggacacgtcacaactgacctcatatgctgatcatgaacatggtgagctaaagttgagatgggacacagagacaaacaccttccatttgcctgtgggagagatgacgatgacgataacccttgatgacatggagtcattgcttcacattcccattacaagggaattttacaattttgaacatacggataaggaagcggcaatttctgtgcttgttgacttacttggagtttaa

SEQ ID NO: 37726 - DNA, 414 bp, Glycine max
  Peptide Sequence Number=SeqID_154504
atggttattgatatgacaaagagtgtggtgaagcctaaaaatattcttcggacattgaaagaacacaatgacaaaaatgtcaccaccattaaacaagtgtattctgccagaactacatatcggagatctctcagaggccccagaatagaaatgcaacatttaatgtataagctacctttgcttgagattgttggtgttacttgtattgggctaacattttctactgcttttgcttatatgaaagctaaacatgaaaaaactgtgtgggcacttgaaaggttcaaaggcctttttcacagacatgatgaattgccaaaagtgattatcacaagcaaaggtctagctttgatgaatgcagtaaaaattatgtttcacataattggttgtgccaatttcatattgataagaatgtga

SEQ ID NO: 37727 - DNA, 306 bp, Glycine max
  Peptide Sequence Number=SeqID_154505
atgtccttctcacctacaactcacctccttcttgtgaaggacgctttcttcctccttcgtctcaaagtcgagcatcccttcctctttcattcctccttcgccattgaaggttttggtggggggttgggttctagtttggatgggatagagtatgggattgggttcaggcttccgaaatggttactccaaaaaagtcattctgtaatagccattggaatagtcaatgactattatggaatggtcgtttcagattggctatttcagaatagtcatttcaaaagtctttgcctgttctggaatgcatag

SEQ ID NO: 37728 - DNA, 420 bp, Glycine max
  Peptide Sequence Number=SeqID_154506
atgggaggtgcagaattcagcgagaccgagcgatccgaccctaatctcgcgatgctccgccgcgcaacctcctccctcctcaccggcgcctcccgccgccgcctctcctccgacgtgccggcgacccccgccgcggattccgccttcgcggaggcgtggaagaaagtgagccccaacatcgacccgccgaagacgccgctggcgtacatgaagccccgaccacccactccctcggctctcccttccaagctcacagtcaacttcgtcttgccctactcttctcaattggccgcaaaagagcttttgttttggatgtggtttattgtgggttttcggtttctgcatttcaagcgtgctgatctggttgatgtggggtttgactcgtttgaggtgaacgaggttggtcttagggttgtttga

SEQ ID NO: 37729 - DNA, 282 bp, Glycine max
  Peptide Sequence Number=SeqID_154507
atggggaatttcttggatccacagtttaaggctacatctggtttttttaaggcaaaaataaattttattcattctactacatatgctattgtgaccgttatgagtatcatggttgcagcattcggcatggccaaacacttgcctaggcgcatacctacgtattcaataaaaccatgcttaaagaatcagggtaatcggcatggccgaatacccgaacatcccctaaaaactactttttcccttgaccaagtgctcgacttggtgatcaaatacttggcctag

SEQ ID NO: 37730 - DNA, 309 bp, Glycine max
  Peptide Sequence Number=SeqID_154508
atgaatccaatgcttctacatccttcttcttcttcttcttcttcttcttcttcttcttcttcttcttcttcttctttatatgataccatgggaggaagcttcaatcaagatattcatgctcctgctcttgattcctatattcttgctcctcctagtagtcttgcggttgattactatatttctactcttgctattgttcatgtgcttgacaactatattcctgctcttgttattgatccttggcttggtcaagatatctgtcctcttcctactcctaccattgatcaaaatatttctttcagcttctga

SEQ ID NO: 37731 - DNA, 339 bp, Glycine max
  Peptide Sequence Number=SeqID_154509
atggttggaattcctgctattgaacaacatattcatattcataacaacctcattcctacacatgatctacatattcttattcatactcttagcttcaatcaagatattcctgctcctgctctttattgctatattctttctccttctagtgatcttgtgcttgattactatattcctactcctactaatgttcatgcacttgataactactactatattcttgctcttgcttgtgattcttgtgttggtctcaagatattcctcctcttcttactcttgccattaatcaaaatatttaagcttctaattcttttctccatcaagataatgcttatttga

SEQ ID NO: 37732 - DNA, 241 bp, Glycine max
  Peptide Sequence Number=SeqID_154510
atgtccttctcctttattcccaaatcccaacatatagctaaccctactcccaattcttatttgctagggagctgttgttgcagtggtgatgagataaagctactggtggaggcgacggtgaagggtgaattgtcgcttattccctgggctccctcttcccctccgaaccaagaccctttcgctctaaacctaatgtcaacaactcatgggaactcaaaagttagcaagatctatgagattg

SEQ ID NO: 37733 - DNA, 270 bp, Glycine max
  Peptide Sequence Number=SeqID_154511
atggcttattccctagtggatgacgcctcctctcacctcttctcctttgtcttccgctgcatctccatggaccaggaactccaaccgtttggtttagcaaacttcctcctaagaagccaagataataaatatgttacaattgctgaagaagcagatgaatggaagaaagaagagctacaaatatacaaagaaagtgaatcaacaaataagttagaaacaagaagcaaaagcaaccaacaacttagggaatcacaaaagtttaaagattaa

SEQ ID NO: 37734 - DNA, 180 bp, Glycine max
  Peptide Sequence Number=SeqID_154512
atgacgactaacagcaatcaatcccatgaagataatgaggaagaagttgagcctgattctctaataacaaccataccaccatactacataccaccatacacgcataatgctgaagaatttaattttgaagattttgaatgcgttgtgcttggaggtgcagggcattatacatccttgcaa

SEQ ID NO: 37735 - DNA, 507 bp, Glycine max
  Peptide Sequence Number=SeqID_154513
gaattctatgcaaatctatatgtccctgacgagaagtttcccaagcaagttagggttcgagggcacctgataaaatttgatgttgattccctcaacacttttttggagactctagtggtcgtggaacaaggggagaacttgccttcttactccaggtttgctagactaaggcctgatcctcaagagcttgcaacccagctgtgtatccctaggaggggatttgttcttaatgttgagggtctgccatggaagctcttgaggaaagatcttaccgttctgaagaattgttggaacctggacgaaccttcggtcacttttccagggacccaaaaatccagggctagaagatctgaggccccatctacatcagctacccccgctccccctacatcagcttcatctacttatgctcttccttcatcacaagcagttccagttcctccatatccctctgctcagagctcaaagccttccttgtggaagcaaagctttccaagtttattttga

SEQ ID NO: 37736 - DNA, 597 bp, Glycine max
  Peptide Sequence Number=SeqID_154514
atggataatgctagagacatttggaaggacttaaagtcaagatactcacaaggagatctgctgagaatttcagaattgcagcaagaaatggcttctatcaaacaaggtgatcaaagcattgtcaattacttcacaaaattgagaattatttgggatgaattggaaagttacaggcctgatccaacatgttcatgtgatccaaagtgtatatgtgatgcttttactagtatgatagaaagaaagcaacaagatcgtataatgcaattttcaaatatatccaaggttttctcatatgttgttcaacaggaaagacaaatcaatagcaatgaattaataggaagcattagtctgatcaatgcagcaggcaacaattcatcaaattctaggccttcatatacctattgtgggaaagataatcacactattgataaatgctataggaagaatggtccacctcagaatgatccttcaaaaaggggaaaaggaaactttggagcaaaaggaaacaaggtctccacaaaccgtggtctttctaaccatactatagatgactgctacaagaaacatgggtacccaccaggacacaaattttacaag

SEQ ID NO: 37737 - DNA, 227 bp, Glycine max
  Peptide Sequence Number=SeqID_154515
tccacacacctccactgttgggatttgcaaagaattgtctgtggagggagaaatatgcatcgcacgaagcattacaaaatggaggcttcaatcccttctctttctctctaacgtttgggaactctatcagagcaatcagaggaaaaattgaggaatctcagaaaattgctagagatgccgctatcgctgtcggaagacacgtgatcccgcttagaggtaagggatga

SEQ ID NO: 37738 - DNA, 192 bp, Glycine max
  Peptide Sequence Number=SeqID_154516
atgacaaaaggtgcagaagacgatgttggtctcttcgcgtcaacaggctcgttttccccctggttgacgaaatgtgtgggtaaccataagggtcagtatgacaaagattatggggtggctaacaaaagcgaggctcttgctcctacgtatcctcaatttgtgatgaggaactcagacgtacatagttcttga

SEQ ID NO: 37739 - DNA, 1233 bp, Glycine max
  Peptide Sequence Number=SeqID_154517
atgccttcgtggcgggactgctgtgggaactggcgcagcggggtctgccggcggatgaagcgcagctggcggcctgcctgcgcacggcgcagcaaaatccattgcgctttaaaaaatggcaccgctatgatgcggtgcctaaaccggtttagcaaaaaaatacatctgatgatagccttgcctcagggatgcaaaacagtgaaaaaaagcataatcgcgataacccttagtaccgtattaggctcaggctcagcctgggcggcagacgacatgagcagtattgaagcgcgtctggcggcgatggaaaaacggctggccgcggctgaacagcgtgccagcgtggcggagcagcgcgcgcaggcggcggaacagcaggtgcaaaagctggctgcggtgcagcagcagaacccgacgccggttgccgtggcacagaccgaaccgcaggccgctcagcctgttgcgcctgccgccagcagcgagtcagagggctttgagtttcatggctacgcgcgttccggcctgttgatgaacagttccgccgccaaaactcagggcgggcccaccgtcacgccagccggtgagaccggcggtcacgtcgggcggctcggcaatgagccggatacctacgttgaacttaacctcgaacataaacaaacgctgaccaacggtgccaccacgcgcttcaaggcgatgctggccgacggacagcgtacctacaacgactggactgccgccagcagcgatctcaacctgcgtcaggcgtttgtcgagctggggcagctcccgaccttcaccggcgcgttcaaagacaccacggtgtgggccggtaagcgtttcgaccgcgataacttcgacatccactggatcgattccgatgtggtgttcctcgccggaaccggggccggtatttacgacatgaagtggggcgatgacgcccgcagcaacctgtcgatttatggccgcaccttcggggacatcgaaaataacgacaacaccgcgcaaaactacatcctgtcgctgaataacttcgtcgggccgctgcagctgatggtgagcggcatgcgcgcgaaagataacgatcagcgcaccgatattgacggcaatcgcgtgaaaagtgatgccgccagtgacggtgtgcacgccctggtcggattgcacaacgacagcttctacggcctgggtgaaggttcagcgaaaaccgcgctgctgtacggtcatggcctcggcgcagaa

SEQ ID NO: 37740 - DNA, 804 bp, Glycine max
  Peptide Sequence Number=SeqID_154518
atggcagaaccatcgaagaagcgaaagggttcttcgagtagaagccaacgccgctttgggtctcaggatactccaattccaccatccatttcgtcctctacgctgttctcatctgaagagcaatgtatccggtacacaactcttttctcttctcgctctataatagatcctaagttcatggacatggagttcttttctgatgaaatgtttgagtgtgttcaagcatttcagaactccggtctcattctgtttgtgtctttaaaaattcctgtttatcctgagttagtgaaagtttgttattcaaacttaggaattcaagaaggttccttgatttctgaggtatatgggattaagatggtcatagaccagtcccttttctttgaactcacccagttatccagtgatggtgtaccgtttgaaggtacacttgatgatgattggaagttcgatttttctgtttttgatgcccgccgattggtttgcatcaaccaagcggatatgaccagaaggcttcttgcaggctcattgacatttgattaccgcatcctccactatcttattgttcgcattttgcttccgagatcttcaaaatttgcacaattttttgaagaagatctcattatcatgtgggcatttcttactgtttgtcaaatcgattgggctcacttagtccgttattgcatgaataaggcattgcgatcaaacactcccttacccaatcctcatcttatttctctctttcttcaccatttcgagtggtcgcctccttcggttatcgcaaagagcgtgatggctcttggataa

SEQ ID NO: 37741 - DNA, 120 bp, Glycine max
  Peptide Sequence Number=SeqID_154519
atggccctctacgggtcggcgttcgcttactcgaacccactcaaggatactaggctgcctcgcaacagcgctttccatttgtccagagctaggcaagggacgacgacccatcgatcatga

SEQ ID NO: 37742 - DNA, 927 bp, Glycine max
  Peptide Sequence Number=SeqID_154520
atggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaagggcgaagagcaaaagaaactggatgtcctttccaatgatgtctttatcaaggctttggtcagcagtggacgaacatgcatcttggtgtctgaagaagatgaggaagcaacatttgtggaagcttctaagcgtggaaagttgttacctatctatagcttagtaatctttgggatttatttgataaaagaagaccatgaaccaaccattgaagatgttttgcaacccgggaagaacatgttggcagctggttattgtatgtatggaagctcttgcacgcttgtgttaagcactggaagtggtgttaatggtttcacccttgatccatctcttggggaattcattctaactcaccctgacatcaagattccaaagaaaggcaagatctattcagtgaatgaaggaaatgctaaaaactgggatgaccctactaccaagtatgtggagaactgcaagtatccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggcaaccaaagggcacttgatttggttccaaagaagttgcacgagcgatctcccatattccttggtagctatgaggatgtcgaggaaatcaaggctctttacgctgctgaggaatga

SEQ ID NO: 37743 - DNA, 141 bp, Glycine max
  Peptide Sequence Number=SeqID_154521
atgactaatcaggaaaaagctaatcaccttactttttcaccttcaatgacaaagaaacttgcacgcatgggtaccaacactgattacccacaacaaaatgggagatggatatccattggatacctattcagtatttactaa

SEQ ID NO: 37744 - DNA, 211 bp, Glycine max
  Peptide Sequence Number=SeqID_154522
atgcatcttgttgagcctcttggaaatggtgacgagagaagcgttgatgtagcttctagaaagcgacgccaatgtcaggatttctctgacatatttttcatcggctgggacttattcatggttggtggctttgacgatgaagactttgaggttgggggccaaattgtcggtgaatatactaccttggattggggcttagggtttcctccca

SEQ ID NO: 37745 - DNA, 294 bp, Glycine max
  Peptide Sequence Number=SeqID_154523
tatccttcgcagatgtatcggtatcctttcgaaggtcatggcactgatatgtctgcaagtgaatattcgtttggtggtgttgcggaaacacatcctcatttttcatggccgaccatgaccctttcacagcaacatgatgccccaatggcaacacctaatgccccattaggtccgcaatgggatgtacccggagcaatacctgatatgggtgacttattaggtgggatcaaccatgtggcacatccttgcgccatcacggacaccataatgactgattttgatgtctctatttga

SEQ ID NO: 37746 - DNA, 150 bp, Glycine max
  Peptide Sequence Number=SeqID_154524
gatgcagaaattgaaagaagaatcaagttagaaacaaaggctgaaaagcatattcagaaacttttattactaggtgctggagaatctgggaagtctacaatctttaagcaggcaagaaattgcatcttctcaactgcttgtgaattatga

SEQ ID NO: 37747 - DNA, 354 bp, Glycine max
  Peptide Sequence Number=SeqID_154525
atggatttaccaggcttcatggaatcccttgtgaagcaaatgtctgtaaatcttaagcgcattcacagcttagggataaaaaaggtagcagttgggttattacagccaattgggtgtttgcccgtgttaaatgtgatacctttccgtacgaactgcattggccttttgaacgtgatctccaaagatcacaacaaaatgttgctcaaagctgtgcaagaactcaacaaggaagcagcagacaaatcagttttcataacactggacctctacaactccttcctctctgcaattgaaactatgcagaaaaagcaatttcaacacgctacagataaaattgtagaggatagcatttaa

SEQ ID NO: 37748 - DNA, 99 bp, Glycine max
  Peptide Sequence Number=SeqID_154526
atggcttcttctcttgttagaggaagcccaggtagagcgggaactgggttcatcgatgacctcaaaaccagtagcaaccctagcttagcctctttctga

SEQ ID NO: 37749 - DNA, 186 bp, Glycine max
  Peptide Sequence Number=SeqID_154527
atgactctttcttcggtggacatggcggaggctcatgcacttacacttaggaaaggttctgacctggctttttctctacagctatcttctgtttcaactccggatgtcccaccacagctggtcggtataaagggtgaacagattagccaatgcttcggccgattgggtggcaaagcatcttcctga

SEQ ID NO: 37750 - DNA, 876 bp, Glycine max
  Peptide Sequence Number=SeqID_154528
atgttaggcatttacatgcaacgttcatgggtggttctttcaatcactggggttatgtttttggctttgttcctctttgtgacacctatcttgaagttctttggacagacttcagaaatagctgagctagctggagtgatttcgttgtggttgatacctacccacttggcttatatattttatttacctatgcattttttcttgcaaagccaactaaaaaataatgtcactacttgggtgtctctattgggtttattggtgcatgcatatctttgttggttggttgtcaacaagtttcatcttggagtgattgcccttgttgcctttggaaacattgcttggtggcttttggtgctaggttattttggttatgttatttgtggtggttgcaccttaacatggactggtttttccatcgaagcattctctggtgtttgggagttctccaaactctctactgcttccgggatcatgatttgcttagaggtttggtatgataaagcacttatgttgatgactgggaacctacaaagcgcaaagactactatcgaggctttaaccatatgtttgaccataaatatatgggagttgatgtttcctctatcgttctatgctgcaactgcagtaagggtagcaaacgaacttggagctggcaatggaaaaggggccaagtttgcttccatggtgtcagtggtgacatcaattataataagcattttcttttggttgttgattatggtatttcggagaaagcttgcgtatttattttcttcgagtgaagttgtgattaaagaggtagacaagctttcacctttcttaggcgtcacaattctactcaacagtgttcagccagttctatcaggtgatattatctaa

SEQ ID NO: 37751 - DNA, 291 bp, Glycine max
  Peptide Sequence Number=SeqID_154529
atggagaacaacgatggtttgtggtggctaatggtggctgtgggtgatggagaaagtgcttgggataaatgctctcgggagcggaagcttctagcacactccagacaacttctcaaagatcccaacggtcagattatggacaattgtcttgtaatgctgcagaccgaatttcgagaaaatccaacggttaacgaaggctggacaacgtttttaccgaggcagcttcatgtagcttcctcaagaagcttcattaagaggcttcctcaagaagcttcctcgtggcttctttga

SEQ ID NO: 37752 - DNA, 1302 bp, Glycine max
  Peptide Sequence Number=SeqID_154530
atgtttgcttgcagtcctttcgctaagcgtctgcttctcgctaagcgcataatcattcatgcgctaagccacgagtttcaagtgcttagcgcacaaccctatcatctaaggctgattaattccgctaagctagccaagctaagcggattagagcttggcttagcggaaattgcagcgaacctcactgctaagcgaaaagaacgaaacgttcttagtgggtgcaacgtcagttacaaccactttccaaaaatttgcgccctttctactccctctctccctcaaactgctctctgtgcgttttgtttctttttctttgcatccttttgttctcatcaatcatcgcagcacaagcattttcctgaagaactcgctcagcgcgcttaccgtgctaagcgagtttatttcttgaggatgaacgctcatctgcttggtacatttaaaatagaattggagaggcgaaacctgcacaagcgtctcgccaaccttcaggaaggaagcatagatgtggcagtggttaaggaattttatgccaatttctatagtccaacagatcaagctcctaaatgtgctaaaataagaggccatttaatcaagatagatgcagagagcttaaatgagttcctccagactccagtgttattagaggagggggaatctttacccacttattctagattttgcagactaaggtctgatcccagagagatggaggctagactatgcattacgggcatggagtgttttctcagaaaagatcttaccaccctggctcagacatggagtgttttctcatactcaaacctagctcctacttcccgcacttcatatttgaacacagacagagctaggttggtctatggtttaatcacaaggatggacatgaacatcggcggcttgatctctggacaaatgaccatgatcgctcagtctaactcttctcgattaggcttcccagctttaatcacagccttgtgtagatcgaggggagtgggatctgatgcccttacctcctatgaaaatgtaagaccgaccattgacttagcttacatcataaggaacttttggaatgcaaatgaccaaatagttaattttccagagacaaagaagactaagctcagagcagctgatattccctcttcctttacaccaatagttggcatctctgcatcttctactttagccccacctccatctttagcagagttatctgcccaaagctctcagacttcagatgccaaatttcaaagcttgtttgaaggacaggttctcattatacaaagcttgcaggaactagttcagtag

SEQ ID NO: 37753 - DNA, 357 bp, Glycine max
  Peptide Sequence Number=SeqID_154531
atgcacatagataagtgggcttatacttatctcatgggcccaaaatctaccctaaggctcatgagagccctagggtcttctcctgcatctctggcccaatcttcttggagtctcctagccatggttctggtgatgagtcccttccttgggaggattgcatcaagaatgaaagataagaggcgtgaaagagcaggtattgagatgcagatcagtgagaacaacaacttattcgagcaatctcgaggcaaagagaagataagcaatttaaaatgctcatggcccttgttatcagaaagttctgatggaggaagtgatagcacattttcacattcagatgattgttcaggcccctcatga

SEQ ID NO: 37754 - DNA, 300 bp, Glycine max
  Peptide Sequence Number=SeqID_154532
atggagtggcggttctataggatatcttatccatttatgagtgtgtcacaacttagtgatccttctagacatccactcgtggtgcatgatgatacatttattttaccagatccacctatgttgcccattcagttagaaattatgccacaaccatatgcacatgcgactgtcgatgcagacatgcctcatcatgcagtggccacttgccaaaggatagcaaaaagtttcgaaaacatgatcaacatgatgatggtcactgttggaattgatgcatacactcagactgaccattgtctatga

SEQ ID NO: 37755 - DNA, 891 bp, Glycine max
  Peptide Sequence Number=SeqID_154533
atgtacgattaccatgaggaagaaagagcccctgatctagaaagtattttggcagacttcatgacataccaagctagctctaaaggttactgttattttatgcaacagcagggaactcaatttgaaaggaaccagtcttctgcaggttatcaatgggagtcataccggcaatctgattatcacaataaagcagaaggaattcttaatttggatgatctgttaatgaaattcaaagatattgtagagtcaatacaagatgcctttagaagaactgaaactcagattagtaagttggtggatgacatgactaacgctgcggctaggaaagaggaagagcgtgtagagattgaaatacatcaagaaaacattcatcaagttacctccatctatcatcaattgaccaatgaagaggaaaagcctgaagtctccagtactccagaatatccctactgggccactgttggctatgttggagggaaagataaaggtagattggaactcagtgtggaggatcaaaagatctcttttgacatctttgaggccacgaaacactcagatatgggtgatgcctgttttgacgaagaagaagaggtggagcaggaaataacattgttagcctcaaccatggtactacagtctcttttggttaaagaacatggctatgggagagattgcttaccttgtgatgaagagctcgatgattcaaaagacagttgtgttgaccaggtggtttttgaagaattggaaaaactgagaccagcaaaaaagcccaaagcaaaattaaagacccttccggcacatttaaagtatgtattcttggaagaagatgagaccaaacctattataattagcaactctttgaagaaagaagaagaagatcaactggtgtag

SEQ ID NO: 37756 - DNA, 393 bp, Glycine max
  Peptide Sequence Number=SeqID_154534
caaaatcctcaggaatttaaaatccttgagataggtcctgggcatcctgagtctgggcctcctccttatctatcagatggaaaaataggggaatcagagagagcaacaacatctctagataaggaatcagaaagatcaacagcttctctagttggggattcagggggagcagtagcttctccagatggggaatcagagatgataatcaaaggtggagatgggggaactacttcaagctcaggagaagaaggtggattcaccactagagattgtggatcagctggcactggttcaacccgtgcaggtgtgggctcaggagaagcagcctcgttgggcccaccaatggaggttgagctccaggccaagctactcgctcaaggaaatgctccatag

SEQ ID NO: 37757 - DNA, 360 bp, Glycine max
  Peptide Sequence Number=SeqID_154535
atgaggattcccttttttacaggccaaggttcaaaaaggtctaaggttgtgtttcgatggggtctttcatcgtgggaacccaatcttgatatctggggcaaaacaaatttgggtgacgaggtgtcggtctcgggccgaacttccacattattccataaggcacgcgtgacaatgatgatttggaaactacgtgcaaaattagtcatggctacagccaggtgggcactcaagcttcctgtttatggcattgtgattctacggttgggaatttatacaaacagacccaacgtttccaaattacgttctttcatcagttcaatgcattcatccatccttatctcggttcattccggaaaataa

SEQ ID NO: 37758 - DNA, 303 bp, Glycine max
  Peptide Sequence Number=SeqID_154536
atggtacatctcttgtggattagttcaagtggagggtacatccacttggtttatcaaagagaaccagggagggtacatcccttatggatctttggcttgccacttgatacaacattcaagacaagatctgtggaagcaaagcgttccaagtttattttgatgatggcaaagactcaagtcaagaatcaggagtcaaacaagtttcaagaatcaaagagtcgttcaatcaagaatcaagattcaagtgaagattcaagagaagactcaagatatgcaagaacttcaagaaaagcatcaagataa

SEQ ID NO: 37759 - DNA, 210 bp, Glycine max
  Peptide Sequence Number=SeqID_154537
atggcttcaccttggctaagcgagacccaatgtcaccaagcgcaattcattgcggtcagaattgagggccatagggctgagcgtgtaatctgctggctaagcggatattcttgcgcttgtgcgctaagcggatctcttaaccgctcaacactagcttcactgcacataaaatacatgatttctgctaagcgggctcagatctcggcttag

SEQ ID NO: 37760 - DNA, 651 bp, Glycine max
  Peptide Sequence Number=SeqID_154538
atgaactcgctggtggcggtgggcaccgccgcggcgttcggttattcggtggtagcgacctttgcaccgcggctgttgccaccgggcacggtgaacgtctactacgaagcggcggcggtgatcgtcgcgctgatcctgctcggccgcttccttgaagctcgggccaagggccgtacctccgaggcgatcaagcgcctggtgaacctgcaggccaaggtcgcccatgtgatccgtgacggccgcaccgtcgacatcccggtcaatgaagtgcagagcggcgacgtggtggaagtgcgcccgggcgagcgcgtgccggtcgacggcgaggtggtcgagggtcgcagctacatcgacgagtcgatgatcagcggcgagccgattccggtcgagaagcagccgggaagcagcgttgtcggtggcacggtcaaccagaagggcgcacttacggtgcgagccacggcggtgggcgcgcagacgatgctggcgcagatcatccgcatggtcgaacaggcgcagggctcgaagctgccgatccaggcggtggtcgacaaggtcacgttgtggttcgtgccggcggtgatgctggccgcgctggcgaccttcgcggtctggctgatcttcggtccatcgccggcgctgagcttcgcgctg

SEQ ID NO: 37761 - DNA, 354 bp, Glycine max
  Peptide Sequence Number=SeqID_154539
atgatgatatacacgacaggtggatgcactactcggatcatatcgttccagcaggtgaggtgtgcgctgtgccagccccgagtcgtccctcagcccccacagacaaatatccctcatgtgccggagccaggagcaccgtcgacatctgcgaggcccgctgtggaggagcctagacatgcagtggaagtttgccattggattgctgagaggttggagcgccatctgagcctaggggtggtcacgccaggctcatcgacacatgaggtgatcgaagaatgcctcaggatggccaggagtgtgacacaggaccaactagcatatattaggtttcgacgcaggcggcacacggattag

SEQ ID NO: 37762 - DNA, 468 bp, Glycine max
  Peptide Sequence Number=SeqID_154540
atgacgttgctacttagcaacattctgcctggcgaccgcaatgctgatcccccctgcggaaggtgcccgttccccccagcaaggtcacgccatcatgacataggtaaggatcgcgccggtaagatacccagtggacccgaagaagtccaacagggtcttggagttgccagctctggttacgggcctctgtcaatcctacagggtgcctgttccccccagcaagggatcgcgcccgcaagatacccagtggacccgaagaagtccaatagggtcttggagttaccagctctgattacgggcctctgtcaattctacggagtgtctgtcgcccctacaaggtcatcaagccccctactaatcgagctttcatcaagaagtactgcgcccccaggcaggcgcagggtgaaacaccccaacagcctagggacggctgacagcgggcaacagacgcaccgccaccacctctag

SEQ ID NO: 37763 - DNA, 195 bp, Glycine max
  Peptide Sequence Number=SeqID_154541
atgcctatgacaaaaaacccaccatataaagcaaagaaagaatcagaggtatcaagttggtgtgctcggtgcaggaagccttttctcttactcacaacaaggcttccattgaatgcacgaattgataaggtagcagggaatgtgcggttgagattcacatcacaggtttccaggaacgtgcaattgaattattga

SEQ ID NO: 37764 - DNA, 279 bp, Glycine max
  Peptide Sequence Number=SeqID_154542
atgaagcttgtggctgtcgtcctaagtatgaatgtgaagctgatgattgctgctgacacgaccgaaactagttggctcaggaagattcctttcaaggatatcttatcctctcgtacacattggacacgtccaagatatcagatcatgttatatccagttacgttttgtgttctagtccagttagcaggaaactatacaacttgtagtgtggaatcatcttggacagaaaataggttaaagtggggtgtacaaggaaagccatgggagacactggtgtaa

SEQ ID NO: 37765 - DNA, 297 bp, Glycine max
  Peptide Sequence Number=SeqID_154543
atgttcatgaattatactccatcctacaaaaagacacggttagcaaagcaaaaagcgttggagatgattcatggaaatgggaagaatcatatgccaagttgtcaaaagtttttgaagcttcgcaaccttgtgtttatgggattatgccatcgtgcaagtaaatggtacatggctttgctttacgggaagtatattagcacattattgatagctacagcacaagacgatctaatcatatcttcccaattgcctatgccattctacaccatcgtagaaggggagaccacttcatcgtga

SEQ ID NO: 37766 - DNA, 441 bp, Glycine max
  Peptide Sequence Number=SeqID_154544
atggttgtagctttgcaacctactcaagacgctacaataatgagaaaacctacaaaacacaggcgagtagttgtgacaggcatgagtgtggttacaccacttggtcatgatcctgatgtcttctatagtaatttacttgagggtgttagcgggataagcaagattgatacttttgactgtgaagaatttccaacgagaataggtggtgagatcaagtccttttcaactgatggttgggtagcaccaaaactttcaaagaggatggataaatatatgttgtatttgctaacggcagggaaaaaggccttggtggatggtggaattactcaagacataatggatgagttaaataaacaaaaatgtgggattttgattggttcagcaatgggtggcatgcagaaaaccgatgttgttagtgtaggtcaacatcggtttttttaa

SEQ ID NO: 37767 - DNA, 1320 bp, Glycine max
  Peptide Sequence Number=SeqID_154545
atgaaatcgattccagttccagccggtgtttatttaacccccttaagcaaggacattgtgatgagtgacgcatttaaagttctgaacaacattcgcacattacgtgcacaggctcgtgaactgccactgagcgatctggaagaaattctggaaaaattaaccgtcgtggtgactgagcgccgcgacgaagttgaagcggaagaagcgcagaaccgcgaaaaagaagagaagctgtctaaataccgtgaaatgctgctggcagacggtatcgacccgaacgaattactgggtgcactggaaaccggtaaaaaacgcgccaagcgtgcgccgcgtccggcgaaatattcttacaccgacgaaaacggtgaagagaaatcatggaccggtcagggccgtaccccagctgcgattaaaaaagcgctggatgcagcgggagccggaggcgtcagcgtctccggcttttttattggcctcgctccgggcacgggcggcggttcatttctcgcgccgtggataacctgtccggcacggtcgcaattattttacctctggcaacaaggtgttctccgccttgcctctgcgtatccgggtgcagaggtggctcatccaggccgcttctggcataatgcccgctgttttttcctccactgcgtaacaaaggtcaatgccgtgttagtttccagcaatatcactatgcagttcggcagtaagccactgtttgagaatatctccgttaaatttggcggcggtaatcgttacggtttaatcggtgcgaacggcagcggtaaatcgaccttcatgaaaatactgggcggcgacctggttccgactaacggaaatgtttccctcgaccccaatgagcgcatcggtaagcttcgccaggatcagtttgctttcgagcaatatagcgtgctggataccgtgattatggggcaccaggaattgtgggcggtgaagcaggagcgcgatcgcatatatgcattgccggaaatgagcgaagaggaaggctataaagtcgccgaccttgaggtcgcctacggtgaaatggacggttacagtgccgaatcacgtgccggagaattattactcggcgtgggcattccggtggagcagcattacggtccgatgagtgaaattgccccaggctggaaattgcgtgtgctgctggcgcaggcattatttgctaacccggatattttgttactcgacgaaccgaccaacaacctggatattgacaccattcgctggctggagcaggtgcttaacgaacgtgacagtaccatgatcatcatttcgcatgaccgtcacttcctgaatatg

SEQ ID NO: 37768 - DNA, 168 bp, Glycine max
  Peptide Sequence Number=SeqID_154546
atgtcttgtgcagaattagggtacaacaactttaacagagccagggcacaaaattctacagcacaccacagtgcctatttcgggaaaagagctctggagtcagcaagaggagcagcttttgcagagatacctacgtttttgcttaaattttgtatgctcttggtctga

SEQ ID NO: 37769 - DNA, 234 bp, Glycine max
  Peptide Sequence Number=SeqID_154547
tcctctgcctttttctttcttgtggttaacaatcagatggcaaaatcaatcaaggaactcaagaaggagaatcaattcttgaagagtaaatctgagaagtctgatgtcacactcagaaaattgggtaccggtttcatcccaccttatttggcaccctccacaattggaacaatagttttgaagggtgtaaactatgcctctggcggaggtggaattctcaatttcactggaaaa

SEQ ID NO: 37770 - DNA, 258 bp, Glycine max
  Peptide Sequence Number=SeqID_154548
atgaaaaagtgcgggaccaaatggtttcccgcatgtcatcgggcccgccgcctctggatgaaaaaaggtgaaaaagtgtgggaccaactggtttcccgcatgtcatcgggcccaccgcctctggatgacaaaggacgcagaatgaccataatttgtctctgtgtgccatcggacacgactgtggttggatggcgaaaaggtgtgcgaaatgaccataattcgtctccgcatgtcatcgggcccaccgcctctggatga

SEQ ID NO: 37771 - DNA, 351 bp, Glycine max
  Peptide Sequence Number=SeqID_154549
atggcagcaaataaccaacaatttggtactagagttgttgcaccattaaggactactacaagtgaagtttttgtttccatggttgctgataatcagaggctggagaataaacttaaagagtttacatcccttgtaaggcagctagccattggtcaacaaaagaatatgatgatagccaatcaaccaaggttgtgtggtatatgttgtgcttctgatcattcaacagatgcatgctccacaatccaggaaacaaaacaagctgctgatgtttctgccatgcaacctggacaaccattcaaacctcaacaacaacaatataatccttattccaacacctataattctggttag

SEQ ID NO: 37772 - DNA, 930 bp, Glycine max
  Peptide Sequence Number=SeqID_154550
atggggggtggttggtgcggtgcggtgaaccatggggacgagggaggaggtagtggaaatagagaggctggaggagagtttgttggagaagaacgagcgagaagacgaggaagcggtgctttatgcggcgtcgtttcgggaaatggaagagggtttcgtcaagtaccaaacggtgcagtgggtgctttactcggtgttgctgattttggcgtggggcattggaattctgatgctgctttatcttcctgtgagaaggtggattggatggttaaggaagaaggaatgaggggaaagaggtggcgggttacgaggccggtatcgtttccgtgctttggagtgctgaagaaggagaaacacgttttgctgcactctgtggcagatgttgtgattgaacaaggatacttgcaatcacttttcggtgtatattctcttagaattgaaaatgttggagttagaaggccacccagtgatgatgttaaaatccagggcgttgcaaatccaaatgcttttaggaaggctgttatgatgcgtctatcgaacatgagaaatgagattttgtcaagacaggtctctacattagaagatgttccacatcatctgatgatgtctccatcaatgtcattgaaacatgatcctaatccttctggggagctgctactaatgcagaaactagaggaagttggaagctctgtcaaggttgatgctatagaggtttctcgtaagcacagtggcgagctgagtcaaggttcggtgctattgagttctaataaagccactatcggtggagtgtctctaggaatcatttgggggaatgtggcttggcaaaaagggtataaggttttcactgtggaatcagattccaagattgcgatagatcttccttctaaaggatgtgctaactgtcatccttgctataatcttgtgggctga

SEQ ID NO: 37773 - DNA, 450 bp, Glycine max
  Peptide Sequence Number=SeqID_154551
atggaggtggggtcacatggtgtggtgatgcttgaacaacaagacgacacgattaggggagtgagaagtccaaggagaaggggaggagaagctaaacaagtttttcaagagcacgaggatttgttaaattgggttcagtgtgtgagaaaggagcacaagtttgtggttgtgattcaaaagtcaggagcaaatgatgtgttacctcaagttattgtcggagatagggatcttgcttacatgagtgcattggagaaagtgtttccttcttcaaccaccttgttatgtctttttcacataacaaagaatgtcagcgcaaaatgcaaaatccacatggataagactgaagagtggaaaaatgtcatggatgcatgggaactattgctacagttttcgaatgaagaatcgtataatgaacacttgaaaagatttacaaactggtgcacacattga

SEQ ID NO: 37774 - DNA, 234 bp, Glycine max
  Peptide Sequence Number=SeqID_154552
atgcgcgaagtcgccaccaacgtttatttgaggaaaacgtcgaaaaacccggaaaggtgtggtctacgaactttaatcgtgaaaggttcgggagttgtttttacgcacggagaagggtgtttccctcgctcctacgtttcctcaattgcgatgaggaaatcagacctacgtagttctttcagaactaaacgttggttaagttgttttgatctttttccgcaagatcgattttaa

SEQ ID NO: 37775 - DNA, 1751 bp, Glycine max
  Peptide Sequence Number=SeqID_154553
ttcatcaagaatgttgcgctgctgaagcagcagtaccgcacgttggacgatctctccaccggcttgctggtggggcagaaaaacaaggcggacattctctcttatatggatgatatcgagggcacgctggtcgatatccaggaaattatttatcggatacagattaaaaactttaccgaagtgaaaggcatcatccaggagaattcgagtaaagccgagatgttcgccctcttttcgttgattttggtgtttctgatgatgttcctggtgctgagaaatgccttctcgttaaaagagatcatcaagaacaagaacatctttatctcttccatttaccacgagatcgccggctcgactcaggccatcgtcattgccgcggatatcatggagcacgagctggcgcaggaagagttgaaaaaagaagcccgcctgatctcctatcacggcaataagatcgccgaacaaacgcgcgaggtgatggattattcgcggcttgagatgggggaagtcaaaatcaatatttccaccttccggctgaatgaggtggtggacgatgccgtaaccggcatcggcgccgggcgcggcaatcgcctcgtgattcaccgttcgtcttatgccggcctgattggttctgataaatacaagctctaccgaatattggccaacctgctcagcaacgcggataaatttacccaccgcggcgcgataacccttaacgtgaagggggtggaaagggaaacgcggcaggggttggggctggggctgaccattatcaaaaattacgtcacgacgatgaaaggtaccattaaagccaaatccgtcgaaggagtgggctcatcgtttttgatccgcatcccggatcatatcgccgatgtttttctcgtagtgattcagctggccggtcagaatgatgatgcgggcgtgcggatcgagggcgtctttaattttcttcacgacgcgttcggaggtctcgccgaaatccaacagccagtccagaataaacgcctcaaaggactgctgttccagcgcggccagcatggcgtccgccgtctgaaaggtctcagtctcgatgccgtagcggctggcgatcttcttcaacagttcgagaatatccccatcattgtccaggatcgcgatacgcggggccggcagaaagtctatcttgttgactttgtacagcggagcctcggcggcatgttcccgattggtgttgatgatgaaaagatcgtcttttttgcaggcgtaggtttcgtcgttgtccgcttgcgtgaccgggcgctcgtcaacctcaatattgcagcgcttgtgaatgctgttcatgataaagacggcgttatgcgtcctttggccggcaaacggctcgttgaagtactgaaatacctttttgacttcatcgagggtgatgcctcttttgccatccagcttctgtttggcgctgttgtactgaaggttcagtatgttggccatcgtggaggcatgctttctgtcgccaactcctttcagagtgagcaacgcgctgattgcatcgatgcggcaaaaagatccgcggccaacaccagggccaatggcagcaccggggatgaccactcgaatctctcttcgtcgctgtaccttcttatcctcgcaatctgcccgtacgcccttaccggccgcgatacgccatatgcgcgttgccgcggacgagggcccggcgtcgcgcaagagaagctccggcgcgatccgggatgggataaggcggggccatcgagagg

SEQ ID NO: 37776 - DNA, 210 bp, Glycine max
  Peptide Sequence Number=SeqID_154554
atggtgcaacctaaccatcctaaaatttctagttatttcataactaataaggcacaagattgcaatgcttcacaaggttggagttgggaaggtgcttcctccaagtggcaaccaggtggttcctccaagtggcaaccaggcacgtacaaaatggagaggctatggaagtcatatggaggaaatgagaagtgcagaatgacagcgagttag

SEQ ID NO: 37777 - DNA, 720 bp, Glycine max
  Peptide Sequence Number=SeqID_154555
atggacactctaaaagcctccacctctggttatgatggaagtgacaatgttgtgcaccacaacgtcattcaagtattacgtctagttaggaagtatcatttcaatgatgcttgcatctacttcacaaaggatgtcgacagctactcgtttattcaatgtctactccaacttcctactattcaatataaagggacctacaacctcaagaagatgagtaaagagttgatgatagctcatgtgattcagctccataatgctcagaaaaagaagaaagctaaagaaaaagaaacattaactgttgttgctatgaaagacaaagatgcctttgtccaagctaaagcgtttactaatggtgtggatgataccattgtacgtggggtcattattgatcttaccaacactggtatcatggataaaacacctgaggcatccaatacgaccatagttgatgaggttatacatcacgtcctagaacctacatccaaggatcaagtgcaagacatgattgggcaagctatggagtcatttgttgaatgccaatgccaagaaaatgaacaatttaggctctccatgcagaatgctatcacaactcaattctctaaccttggtgttttccttctacaaaaccttcaacaagctcaggcatccatgcttggagctattgctacacctgcattcgtacccataccagcacctcaaccacttgaacctttaccataa

SEQ ID NO: 37778 - DNA, 492 bp, Glycine max
  Peptide Sequence Number=SeqID_154556
atgtctcttgccactttgtttggcaaattgcaggaacatgaaatggaacttcaacgacttaatcaaaatgaagaaactgacaaaaagaaaagaagcatagcatttaaggactccttatcaatgcaagaggaaaatgaagatgaagagtcagaagatgaagaagacttctcactctttgtgaagaattttaaaaaatttgtcaagaagagaagaatcgtgaggcgtcaaaactttaacaatggaaaaagatctcaagaagattctcaaattcttagatgctacaaatgcaaccaacttggtcacatcaaagcaaattgtccctcaaatgaggaatggcctgaaaagagtgataagaaaaggtatgaagaaagaagaaataagaaagcctacattgcatgggatgacaatgactcatccaatgggtcagagaaggagatcaaccttctaaccaagaactatgagagcgatgagaacatatctcaagaagattaa

SEQ ID NO: 37779 - DNA, 231 bp, Glycine max
  Peptide Sequence Number=SeqID_154557
atggaaggattgtccttactcattttctccttaaagtggcgtctcctctctctctcttccttctccattcctctgccattaatcttccaagaagcaaaggaatccattgatgaagaagatcctaggcctacaagctccaatggagcttacatcatgtggtatcaagagcatcttcatctaggtgatgttcttttgcttcctctatcattttgtttggtgaattctctttaa

SEQ ID NO: 37780 - DNA, 648 bp, Glycine max
  Peptide Sequence Number=SeqID_154558
atgaacagagtttcatcatgtttcttatgctgggatttcaggaaattgcttgaacctccgtatattgattccatagagtggtcaaaatggcatgttttctgggtggatgagagagttgtgccaaaggataacttagacagtaattacaagctcgcctatgacggatttctctctaaggtgacaattcctccggtaaatgtttatgccattgatgatgccctagcagcagatggagcagctgatgtttatgagacaactctcaaacggttggtcaagagtaatgtgatagatacatcaactaggggatttcccaagtttgatctcatgttattgggtatgggcccagatgggcatgtagcttctttattccctgggcacccccttctgaaggaggataaaaaatgggttacattcataagggactcaccaaagccaccaccagagagaatcacttttaccattccggtaatcaattcatcttcaaacatagcaatggtggtgacaggggagggtaaagcaaacgctgttaactctgcactagaggaccatgagaagactgataaattgcctgttgaactggtttcacctgaaggggagtggaaatggtacctagacgttggtgctgcttcaaagctgtttaaggaatag

SEQ ID NO: 37781 - DNA, 600 bp, Glycine max
  Peptide Sequence Number=SeqID_154559
atggcggcacagctaatccatgatcgagtggagatggagtgcctagagggagcttgggagaccctcgaaggcaacacgagctcaaagatccagcccccatggaagtttctcaagcaagctttcatcaaggatgatatagcagcacccaaagaactccagatgtctactcccccctccctcgcatattgttctttcaagaataaggggaagttcatttcacttgcaatcaatggaaaagtgaatgttcaaagaagggaagtacacaaccaaagtgagggacgtcacaaaggacagtgggtgagggacagtgcaagagttaataatggacgcaatcgagagtgggtgagctacaaagggagacttcgagggagggataatgcgagagttcgagggtgtaatcgagagtggaaatccgagcacaaggatgaaactcgcaacagttacttgaccaagagaggaattgggcttgtcgctgtgtcaccctctgcgcgtgtcgtcgtcggcgccggcgccgatgccttacccaaacgacaagatctactgattcacggcctctgtggccagatctgtggtcttcacggccagatctgcgacccttag

SEQ ID NO: 37782 - DNA, 198 bp, Glycine max
  Peptide Sequence Number=SeqID_154560
gcatcttctacatcaaagccttggatcattttttttcctcaaagggatatattttctggccctgtctgtccaatgggtaaatgggacttgctagaaggcaacattgaggttcctgatttatttaagtgtcatgagaaagaagaaaaaagtaagagagtacccctagctcagaaggcacactggactttaaatggctaa

SEQ ID NO: 37783 - DNA, 272 bp, Glycine max
  Peptide Sequence Number=SeqID_154561
atgtgggtgtcgagggagcggttttcgacagatttcaggcgggaggaaaaagagaagagcgatttcaggaaggaggagggcaagggggatgttggcaaaatcaaggcatcaattaagtgggaaaagggctacaagaaagttgagatctccagtaaggagcatcttgctgtatcattggcttatgatgttgctcagctctctaacaaattcacaagagagagaggtgctttcactgtcgttttgtccggtgggtcactcatcaagtacctcag

SEQ ID NO: 37784 - DNA, 717 bp, Glycine max
  Peptide Sequence Number=SeqID_154562
atgcggggataccttatggttatccgcaccttttgtctgccagaggcgagcgagcccattcacacgcagagactaacctcgtcatccgcacctttgtcatccagagacggcgagtccgatgacatacagagataccttatggttatccgcaccttttgtcatcttgaggcaagcgaacccgttggcacgcaaagactaacgtcgtcatctgcacctttgtcatccaaagacggtgagtccgatgacatgcggagataccttatggttatccgcaccttttgtcaaccagagccaagtgagcccgttgacacgcagagactaacgtcgtcatctacacctttgtcatctagagacagtgagttcgatgacatgcggagataccttatggttatctgcaccttttttcaaccagaggcaagcgagcccactgacattctgaggctaacgtcagcatccgcacctttttcatccagagacgaggcaagcgagcctgtcgacacgcagagactaacgtcgtcatatgcacctttgtcatccagagacggtgagttcgttgacatgcagagataccttatggttatctgcaccttatttcaaccagaggcaagcaagcccactgacacgctgagactaacgtcatcatccgcacctttgtcatccagagacggtgagtttgatgacatacggagataccttatggttatccacaccttttga

SEQ ID NO: 37785 - DNA, 252 bp, Glycine max
  Peptide Sequence Number=SeqID_154563
atgttaggattcacaagcgattctcctcaaatttcagccagcccgcatcaattagaccttgcaccttacgcttcagggccctacaatgctcaatggaacaccccgaggcttctccatgacaagcacatgttgtgtttgagtcgtattctcagagaaatggaggttgatgaaccttggctggggttatggctaccattgaattatcaggtagatatgggagcaagtcagcataggacatcggaattggggtga

SEQ ID NO: 37786 - DNA, 348 bp, Glycine max
  Peptide Sequence Number=SeqID_154564
atggcccgcaccaagaagacaggggagatgacgactgaggccgcaaagaaaatcgctgagaagattggatcgttcgtcccccatggacgtcaggatgttctggccgctgctattggacgtccagagcaccctggacgtgtccgtgctactggagccggtgtcaccatcaagcaatactttggatcggctccacgaacgtctcgcagtgcttcctccctgcctcctgacgaattacagcagctgactcagcagatcagggaccagctagaggagtccatcacagagaaagtgacgaggcaggtcatggcatccttcagccagcttcagtcacaaatgcaatctcactga

SEQ ID NO: 37787 - DNA, 216 bp, Glycine max
  Peptide Sequence Number=SeqID_154565
atgaaacagaggcaaatgatgcacaagctgttcattaaagaaattgccacttggcgaagagagggtgacatctttggatcagacacactggggatgacacctgggggaaatagaggccatgtaagattgaaagtgacccgacgtcgcatcacaaacactcggcaatcttcaatggggatgatgccactagggtatatcaaaatagtgacggggtaa

SEQ ID NO: 37788 - DNA, 1308 bp, Glycine max
  Peptide Sequence Number=SeqID_154566
atgatgaatgccctcacaagctcttgttctaaggccatggtcgagaccctaggtcccttctctcccagagttcccctttgtgtttctgatagacccgaattctgcttcacccttcgttccaaaaatgagaaaaagggatggaatttattgctcctgaaactggttcgaaacaatgatctttaccctgttcatgcagtgccaccagaggaccaggtggacttggaaactgtggagcctcaggctcaacaaagtgaacaaacaaatgaatcaaagtttgttcgtgtatcgttccagttacaaaagacttgtgattttggtgaacagtttcttatagttggaggtgatcctgtgcttggttcatgggaccctttagaggcattacccatgacatggtctgaaggacatgtatgggctgtggagctggatatgcctgctggacaatcattccagtataagttcatactgaaaggagaagggggggatattatttggcagccagggtcggatcgattgatccacacttgggaaactatgaatagaatagttgttctcgaagattgggagaatgtagaacttcagaaaattacagaggaagatcaacttgccgagccaattgaggaaccccaggttgactttgaagtgccaactttagctgaatttcttaataatcctcaagaactggattccaaagcatcggaaatatcgtctgtagaagatacccaaattcatgctgtggatgaaccacttgctgaaacagtcgggcaacaaatcactgaaaacataagttcttcggaggatctcatcagcagtataagccacaaaagtaataaaaagagtatacttcgacctagtgaagaatctgcagatagtccaggaaatgatgatataatacatgatcttggtcacaatggaaatgctgcatcactggagaatcaggaaaagacaattgtggaaagcagcttatttgatcttgaagaaggtcctgttcttgtacctggcttaacaataccaccaactgagccaactgatgaagcagaccaaggtgaagttcaagaatcgactaaaaaggacatttcagttgaagcttttgaaactcaggatcagaacatagctgagttcagtaaggaggaagaaactgatgatgccataccccaagagataaatgcaaccatcaataatgaaccagagttgctttacaataaacatgaagagtctcatttgtccccagaaatggaagacggccaaactacgagccagatgatgacaatcccttgcaaaatgacatcaaatggagccaagacacggtaa

SEQ ID NO: 37789 - DNA, 294 bp, Glycine max
  Peptide Sequence Number=SeqID_154567
atggtgattctaacactaacaatctggatgccacaacttcatcccccaagttgcacttctcctcagcagtgcattcccccaacaagtgggattggaccatgcactattctctttgccatcaatcagtttgacacaacttcccctgtaggaagaaaaggagtgaacaacttctttaattggtactacacttcacaaacaatggtccagttgatcagtttgacagctatagtttacctccaaaacaagaattggatctcgggttttggcacactaagtgtgcttatgatctgttaa

SEQ ID NO: 37790 - DNA, 279 bp, Glycine max
  Peptide Sequence Number=SeqID_154568
atgcccaagtggcctcttatcctatatttaacagtgttggatgagtcgatggggtgtatgttggggcaacatgacaattccgagaagagggaatgggctgtctactacttgagcaaaaagttcaccgcctgtgagatgaattactctcttcttgaaaggacgtgttgcgccttggtgtgggcagtccatcgtctaagagtggtatctagagatatgtcgcgggggtcaggagaccttggggacgtcaggtggggtgctattgcccaaaaccaagcttga

SEQ ID NO: 37791 - DNA, 323 bp, Glycine max
  Peptide Sequence Number=SeqID_154569
gtaaaaaacacgctttacggtgcccttaccgaatgcgtgccaaagctagagtgaagagtgaaatagcggaggtgcaaaagcagatgaaggctgacatggaggccatgaaagagcaaatgaccacaatgatggatgccatgatgagtatgagaaaaatgatggaggtcaacacggctatagtcgttgccacaagtaccgccactgaggtggatctgactcacccatctggccacaaccaaggccagagcaagcatcccttcccatcatatggcttgctttccaactatacaccaccaaatgttgcacacgctcccgatgagaat

SEQ ID NO: 37792 - DNA, 705 bp, Glycine max
  Peptide Sequence Number=SeqID_154570
atggctaaccagaattggcagcaagcgatgttggtagatatgattgcacctgatgacacaattgattacgacaaagctcgcttgtgcactcttcttgagtttggaatgactcattgtgaagctgatctcttagtattttccatccactcaccgtctggcctatgcatctatctagttgtgtatgttgatggcattgtcatcactggtgtcaccttcatatatgttttagacattatgatcgagattggtatgcttgattgtcgtcccaacgacactcctatggatcctaacgtgaatatttttccgggaaacttgatctcttggaggagtaagaagtggaaaatggttgttagatctagtgctgaagctgagtatcgtactatggtagtagctgcatgtgagattacatggcctaggcaacttctccaacaaccaaaatgtggagacactcagaatactaaattgatatgtgacaatcaagctgttattcacattgcatcaaatccggtcttccatgaacggactaaacacaatgagattgattgccactttgttacagagaaggttcttttaggagaaatcatcaccgactttgtcagctctagttatcaacttgcagacatattcactaaatccctcaagggctctcatgttcacaacatttgtaacaagcttgaatcatatgatatatatgctctagcttga

SEQ ID NO: 37793 - DNA, 228 bp, Glycine max
  Peptide Sequence Number=SeqID_154571
atgacttatgtgagtgtaatggcaattactctcacatttgttggaaactgctgtactacctgcatcttctctctcgcactcattttccttcgttttcgccttcttctgaatcaaagcatcaacaatacaaacaaactcgctaagcgcgcataccgtgctaagcgagttcatcttgtgaggatgaacactcatcctcctgttgagatacttgtggctaagcgaggctga

SEQ ID NO: 37794 - DNA, 252 bp, Glycine max
  Peptide Sequence Number=SeqID_154572
atggagagatgcattaagttgatactagctcccaagtctatgagagcttttcctacagcaacctcactagcttctcatctcaaggaggtgagcttagctattagagagcatcctctccaagcttcttatccaaggcacattcttggtggtgaagctccttcttccatggcttattccctagtggatggtgcctcctctcacctcttctcttttgtctttcgctgtatctccattgtgaaaaattaccattga

SEQ ID NO: 37795 - DNA, 309 bp, Glycine max
  Peptide Sequence Number=SeqID_154573
atggcttgtcaagtgttagactacaatgcccttgaccctagtgacttggttcattccaaatccatcatgctcgaaggcatgtttgctagttacccaatgctgctcctggttgatagcggtgacagtcataactccattgtgcctttacctcaaggtttggaagtggctgactctgactcacctacgcttgaggccattttggctactcgagagaataagtgccaaggatcagtagctttggagtggcttacttttttagaaatcccaacccatggaggaggccacatgggagtcggctcattcaaataa

SEQ ID NO: 37796 - DNA, 1275 bp, Glycine max
  Peptide Sequence Number=SeqID_154574
atgaggtggggcttgtggaaacttgggcaatcaatccctcgccgtcttgctcacggtaataataaagctgttgcttgtcgatattttgcctcagatgctgagctgaaaaagacagtcctttatgacttccatgttgctaatggagggaagatggtgccatttgctggatggagcatgccaatccaatacaaggactcaattatggactcaacccttaactgtagggagaatggtagcctttttgatgtttcccatatgtgcgggctaagcctcaagggaaaggactctgtcccattccttgaaaagcttgtcattgcagatgttgctgggcttgcccctggaactggttcgttgactgtcttcacaaatgaaaaaggaggggcaattgatgattcagtgattaccaaggtgaaggatgatcacatatacttggttgtgaatgctggatgtagggacaaagatctggctcatattgaggaacatatgaaggcattcaaggcaaaaggtggtgatgtgtcatggcacatccatgatgagagatctcttcttgctttgcagcagggtcctcttgctgctccagttcttcaacacctgacaaaagaggatttaagcaagatgtactttggggagttccgtgtgttggacatcaatggtgtgcagtgctttctcacacgaacaggcttagggagtactgtgcataataacacactcttcactgagactttcaggtatactggggaagatggatttgagatatcaattccctcagagagtgcagtggatcttgccaaggcaattctggaaaaatctgaagggaagataagactgacaggattaggtgctcgagatagtctacgacttgaagctggattgtgtttatatggcaatgacttggaacagcacattacacctattgaggcaggactcacatgggccatagggaagagaaggagagctgaagggggttttctaggggctgatgttatactaaaacagcttgaagaaggtcctaagatcaggcgtgttggtttcttttcttctggccctcctcccagaagccacagtgagattcaagatgaaggaggaaacaacattggggaagtttcaagtggcggattcagtccttgcctcaagaagaacatagccattggatatgtgaaatcaggattgcacaaggcaggcaccaaagtaaagattattattcgaggaaagtctaatgaaggagttgttacaaagatgccatttgtaccaacaaaatactataagccatcctaa

SEQ ID NO: 37797 - DNA, 195 bp, Glycine max
  Peptide Sequence Number=SeqID_154575
atgaagggttttagtggatttgcagctcgcccaggcaagctgatgcttcactcaaaagtcactacattagagtttgatgaagatggcggtttcttaatgtttgtaatggttgttggaagtagtgcaggaaagatgttcaatatattcatgctaaccatgaagcctagacaaataatagttgttgcaatcccatag

SEQ ID NO: 37798 - DNA, 1302 bp, Glycine max
  Peptide Sequence Number=SeqID_154576
atggatcaagttcgacgtcaagcctttagtaaggcatataggaaaatatgggatttggccatgatagaagtgtctgttgaagccatcacatccctcgcacaatactatgagcagtcgctcagatgcttcatgtttagggactttcaattggtaccaaccatagaagagttcgaagggatcttgggatgctcgcaggaggaaggaagccatatcttttttctggattctacccttccatggcaaaaggataccaaggaagcgcctggaggagaaggcagaagctttggcagaatgaaagagaatatgttgataatcattgatcaatataaagagaaagtgaacctagctattagtcacaggcagaggctggaggatgagcatgcaaaggtatcagctctgcaaattgaaagggaagcaagagagaggatgatagaatcattgcacgtggaagctatgaaatggatggataggttcgctctcactctgaatggaagtcatgagcttccaaggttgctagccagagccaagacgatggctaacacgtactcagctctcgataaagtgcatggtctctttgattactgcgtggattcaatacttcgacaacttatcattatcatgcattcatgtttatttagttgtcgcattactcattggattttgttttttagcagtcgttgtcaaaaagtaaacataataaccaaaaagaatgaacacactttacgacacccctaccaaacacgtgccaaagccaaaatcatgagtgaaatagaggaggtgcaagagcagatgaaggccgacatggaggccatgaaggaccaaatgacctccatgatggaggacaacgcggccgcagttgccaccactagcgctaccgctgaggtggatacaactcacatatccggcataaaccaaataagttgtccaatcccagacgtggtaggtcagggaagaaaagtgttgggaagtacatgcggtccccatgttttgcaaagtaagaattctttcccaccatacggcttgccacctaactatacaccacccaaggcggtacatgtgcccgacgagaatgccaaccactttgctgtcgtgctccttgaaagccaatgtcataccctaatttcgtctggggaccttcattttctaatgtttaaactcttgctagccgaattgagctacttaacatcagttgtcgtgcgatccgtaagggttgaagtaaacagctcatctgggcgagcaaggttacttctggaggaagcgaccaacttgcttgggcgagctgagctcgcatgggcaagctga

SEQ ID NO: 37799 - DNA, 258 bp, Glycine max
  Peptide Sequence Number=SeqID_154577
atggccggcagcgggcaacagacgcaccgccgacacctccaaaagcccctcaactcatctacaaaagctggagcattgcctacgaaccgtggtcgaccagcaggcggccaagtccaaagccaaagaaataaatgtgggacatcccctttatccctgtaccgctggccaaaccaacaccctgacatacatcatggccgtccgttctgcaagccttttgacccaagacctcaaaccaccataaaccttgagccaagatga

SEQ ID NO: 37800 - DNA, 153 bp, Glycine max
  Peptide Sequence Number=SeqID_154578
atggaagaaacatatataaatgatgacaaagaaaagagcgtgagctcaagagagacatcattggcatctggaccagtgtggctccgattcaagaacgaatgtgaagagggccttgagctcattgaaagggacagtgtgtcttggaatctttga

SEQ ID NO: 37801 - DNA, 594 bp, Glycine max
  Peptide Sequence Number=SeqID_154579
atgaagaagggtgaaaaagctcagagtgagagttctctcaaacgctccccaccttcaaccatgtcttcctcctcctcttctcttatcaccactgttgttgttcataataataataataataatccttctcaaccttctgagttaagagccacgacacgttgttgttttggctctcatcaccttcctgacataagcctcaaaactcctatggctaggccttatgttcgatcaaaaatgcctaggcttcgttggacaccagatctccatcgttgcttcgtgcatgcagttcaaagacttggaggagaaaacagggccacaccaaagttggttttacagctcatgaatgtaaaggggcttactatatctcatgtcaaaagccatcttcagatgtacaggagcatgagacacgagcagatgagtcaaggtgcaaagaagaatgatatggctccggatttccttgcttccacactctcaactcttggccaaaggcaacagaatcctcacaaaagaagctgcacggaagagcttgttcccacccaagctcaatggacattattacaacaggcattaggctcctctgtatccgttaagtaa

SEQ ID NO: 37802 - DNA, 660 bp, Glycine max
  Peptide Sequence Number=SeqID_154580
atgaacaaaccctctcactttatcgatctctcactgctgaaaacccacgcggcgtttcgcgcggtgtttattgcgcgttttatctcgattgtggcgctcggcatgctggccgttgccgtgccggtgcagattcagcagatgacccattcaccgttgctggtgggcctcgccgtcacactgtccgctgccggcatgtttactggcctgttgaccggcggcgtgctggccgatcgctatgagcgtaagaagttgatcctgtttgcccgcaccacctgcgggctgggctttgtcgcgctggcgataaatgccgcgctgcccgcgccttcgctgctggcggtctatctgctgggcttgtgggacggctttttcggtgcgattggcgtcacggcgctgctggccgctacgccggcgctggtgggacgcgaaaacattatgcaggccggcgcgatcaccatgctgacggtgcgcttcggctcgattttatcgccggcaattgctggtgtggtgatcgcgcacggcggcgtgctgtggaattacggactgaccgccttcggcacgctgctgacggtgctgacgctgctgcagctacatgcgctgcccccgcctccgcagccgcgcgagcatccgctgcgggcgctggcaaccaggcgtgcagttcct

SEQ ID NO: 37803 - DNA, 1416 bp, Glycine max
  Peptide Sequence Number=SeqID_154581
atgagactatgcgaagctctttcttctctcattcttgttcttgcacttgcattcctttacaacgacgtcaactgtgaagacccatatagattcttcacttggaagctcacctatggtgacatttaccctcttggtgtcaagcaacagggtatcttgattaatgggaagttccctgggcctctcatagacccggttacaaatgacaacttgatcatcaatgtgcataactaccttagggaaccattgcttatatcatggaatggattacaacaaaggagaaactcatggcaggatggaattcatggaacaaattgtccaattccacctgggaaaaactacacttatgttctccaaagctgtcctctgattcctgtccctttccctcctgcaggggacttcaccttacttgctggagattggttcaagacacactactgtaggctgaataaaatcctgaatgatggtcataatcttcccttccctcatggacttcttatcaatggacgtggttggaatggaaccactttcactgttgataaaggtaagacttacagattcgggatatcaaatgtggggctcacaacatccatcaacttcagaatccaggggcacaagatgaaacttgtgaagcctgccaaaaattactacatagatgtctccacaagatttaccaaacagatactcacaacaacttccattcttcactacaacaattcaagcaatagggtatctggtcccattccccaagatgtcattgcttcctctctttttcaggccaggactattcgatggaacctgacagcaagtagacctaggccaaaccctcagggatcttaccagtatggattgataaaacccattagaaccatcattttggaaaactctgcccctattatcaatggcaagcagaggtatgcgatcaacggcgtctcatatgttgcaccagatattccgttgaaactagctgattacttcaacatctctggagttttctctgttggaagaattcctaccaacactaacaaaggcaaatccctcctccaaacttctgtcatgggggctaacttccatgaatttgtggagattgtgttccaaaactgggagaactttttgcagtcatggcatattgatggctattctttctttggtgtgggcgggcagtggacacctacaagtagagcatactacaatctaagagacgctattcctagatgcaccactcaggtgtacccaaagtcatgggctgcaatttatatagcgctagacaatgtgggaatgtggaatgtaaggtctgagaattgggcaaggcaatacttgggacaacaattctatcatagagtgtatacatcttccaagtcatatggagagatgaatatccgatcccaaagaatgcacttctttgtggcagggccagag

SEQ ID NO: 37804 - DNA, 267 bp, Glycine max
  Peptide Sequence Number=SeqID_154582
atgctctcgcaagatggtggtggtggagacaacaccaatcttgtccatcataaatttgtggcgcgaggacacaagagctttggtgaagaggtcaacatgctaatgacaagatggaacaaatttgtcaatgatggattgcttcttgcagctccaggagatgacactcaggccaaagtaaactacgtaagcacccgtggaccttatgtcagaagtgttgtcaacccagttagcatcataaaaggcacgaagatgttgatctggagatga

SEQ ID NO: 37805 - DNA, 528 bp, Glycine max
  Peptide Sequence Number=SeqID_154583
atggagggccttgtgaagcttacaaacatggtttgggagttacgaattagtgaagccaagaggttgagacatatagatgtcctcagagatggtgtcgaccagtgtgattgtttgtggctttaccattggactaaaggtttcatggtaatcaatgccacaccgttggtggtagcctttggcaacaaggcaagctggacaagtgtccaagttccattagcaatgagcgcattgagttcttctaacatggtttttttccactcaaggtgtttcatggcttgtgtaacacatgttggttcaaccagagaaggaaagggaaatttggtggctagcatgggggaagagcatttgcatttgcaggaagtgatgagcatgtgtacagatatggtgaagctgagactggagaaggttggtttgatacgtgaggtgggtttagacttgaatgttgttgaggtgataaggtttgctgggaggaattggagtttggttggttcggtgataaagcagcttcctataaaagataggaattga

SEQ ID NO: 37806 - DNA, 162 bp, Glycine max
  Peptide Sequence Number=SeqID_154584
atggcagcgttcatggttgttttgcaaaacatcaacggcaaagcattcaacattttcaatgacgtaggagaagatagaggcttaggaacacttgccggtttgcagttgaacaatcccacctgtggtggttcaacatcatccacacgctcttccaatctatga

SEQ ID NO: 37807 - DNA, 603 bp, Glycine max
  Peptide Sequence Number=SeqID_154585
atgggcgcgaaaccgcagacgccggagtcctcctcctccaccgacacgcttcccccgttcgcctccgacggcaccttgcgaaacgcaccgtttctccactcggaaactcctcgcccagggaaggcacgcagcaagcgctcacgcgcggcgccgggggactggtccacgcgcctgctccacctggtcgcgccggagaaggagaagccgccgcaggcgaagaagagagagggaacgaatgtggagtgttccggacgcaaatgccttcactgcggcgcggagaagacgccgcagtggcgaacgggaccgatgggaccgaaaactctatgcaacgcgtgcggcgtgaggttcaagtccgggaggctggtgccggaataccggccggcggcgagtccaacgttcatgtcaacgaagcattcgaattcgcatcggaaggttttggagctcaggcggcagaaggagatgcaacgacagcagcatcatcagcagttgatgagtcaaagttcaattttcggcgtatccaacggtggagatgaattctcgatccatcatcatcatcataatcatcacctccattgtgggccagactttagacacgttatttag

SEQ ID NO: 37808 - DNA, 594 bp, Glycine max
  Peptide Sequence Number=SeqID_154586
atggcacaacatgacatatccagacttggattccctgccttgatcaaagctttattaactttgagaggacttaggaaggctagaggaaagagatctgaggccccttccacttcagcactagagacaggaagtcctttttcttctacacttcctccctcttcctccacagagattccaatgattcctccagcaccttcaaagatgccatttccaactctagtatttgcaggtctagcatattttatttttactccacagatgctgcactccatgctccagagcatccatatggggcagtccatcatcatgcaaaaccttcagggcttgggcttgccctccattatgagcatggaagagtttgatgctcaggtggcctggccaggagaccagccctcttcctctggagggggtggggcctctatagcccaggagcttgtgactgaggagccaccagcagcagcagcagcagaggaagagaccactctagatcagaccccacagccatctccatcctctgcacctgctcctgaggagactcagccagcagcactggatcttaatgaagaccagccacagaaggagcaggacgtttaa

SEQ ID NO: 37809 - DNA, 1656 bp, Glycine max
  Peptide Sequence Number=SeqID_154587
atggcgctgctgatcggtgcggcgctgggtgtcagcggggcaatttttcagtcgctgctgcgtaacccgctcggcagcccggatattctcggcttcaataccggggcttacagcggttattaccgcgatgaccggggccgcgctgatcggcggtatcgcgacggctgcgctggtgtatctgtttgcctggcgcaacggggtggaaacgtttcggttaatcatcgtgggcatcagcgtgcgtgcgctgctgatggcgctcaatgcctggctgattatcagcgcttcgctggagtcggcgctcagcgccgggctgtggagcgccggctcgctcaacggcatcacctgggcgaaaacgccgccggtggtgacggtgctgctgctgtcgctgctgctggtggcgctgttaacgcgccgcatgcgtctgctggagatgggcgacgacaccgcctgcgcgctcggcgtgccggtggagcgcagccgcctgtggctgatgctgctgggcgtgctgctgaccgcggcctccaccgcgctggcggggccgatctcgttcgtggcgctgctggcgccgcagattgcgcgccggctgagcggcggggaaaaaggcgcattatggctggcggcgctgtgcggcgcgctgctgttgtgcgccgccgattatgccgcgcagcatctgttcctgccttatcaactgccggttggcgtgattaccgtcagcctgggcggactctatctgattgcgttactggtgcgggaggcgcgacgccaatgatcgatattacttcacgactgtatggcgaaggcctgacgctgggttatgacaaaaaagtggtggcggaaaatctctcggtggcgattccgcaaggggagctgactgtgattatcggccctaacgcctgcggtaaatccaccctgctgcgcaccctcagtcgcctgcaggcaccgctgaaaggcgacgtgctgctggacggcgaggcgattgcacgttatcccaccaaagaggtggcgcgccgtcttggtctgctgccgcagagttcaaacgcaccggcgggcatcagcgtgagcgagctggtggcgcgcggacgttatccgcatcagtcactgtttggccgctggcgcgcggaggatgaagcggcggtgcagcaggcgatgctggccaccggcgtggcggacctggcgcaacaggcggtcgatactctgtccggcgggcagcgtcagcgcgtatggatcgccatggtgctggcacagcagacgccgctgctgctgctggatgagcccaccacctggctggatattacccaccagattgagctgcttgagctgatgcagacgctcaaccagcagcatggccgcacgctggtggtggtgctgcacgacctcaatcacgcctgccgctacgccacccatctgatcgccatgcgatccggtggcgcatacgccaatgattgtgccgctggggcgcgggcgctaaggcgggaaaggggctgtggtgtaaacgttttctgccatacggttccctctcccgccgggagagggttagggcaaaaccgctacgccagcaactgctgcaacagtggcccgatctgctcaaacatgcgaggcgagataatctcgacgtgggcgcaatccatcggccacaccgtcagctcaccgacatag

SEQ ID NO: 37810 - DNA, 1374 bp, Glycine max
  Peptide Sequence Number=SeqID_154588
atggtgatagcgctgataccagaaccagtgctgctcgccgaggcgggaacagacgatggtgccacaacgatcaacgatgtctggcaggctgaaggtctgcggctgcggccactgcagcggctcgccgtcgatttcgccgaacgccatattcagggtatcggcttcctgcatgccgtcgacaatggcctgcgccagcagcgcgctgttgatgtcgccgcgcagttcgacaaagtgcgcgaccgcgtaggcgttgtgatggcggctgagctggtcggcgatccagatgccaggctgcgctgccaccagcggcagagtttgttgaccgtcgagcaggccaccgcgccagcacagcgcgtcatggccgccctctaccgactgaatcaggccttcacgctggcctgcctccagccagaaacgcagcggctggcgaggttccaggccatggtccagcgcctgcaacagccagccatgcgggttaccgcgctcgggccaccagaaggagccggacaggctgagcgcattaccaaaggtgtggggaaagtgcagcgcggcaaacaccgcggccagaccgccgaagctttgtccggcaaccagcgtagaccgccggcggcagcttgcccgcggcggtcagctgctgcagcgggccggcgatcggcatctgctgcgcccagaactgaccatcgagcagtatcgccagcggacgcgggccgtgctgcgcctcgcctgtggcgtacagccacacccggcgacgattgccgagcagcgcgctgtcccactgctgctcctgcagcgtcagcgccggggcgcggccctcatccaccgcacgccacacctgctggtcgggcgcgtcaggcagtggcgcagcgcatgcatgtcaggctcgccgctgaaatcgctggcctgccgatccggcatcaggcacacggtttgccagtaccagacatcgctactggcgacgcgcatcagcgattgcggcgggcgccgctggtggtgatcggtcacgccggtgatgttgatccacacgcgctgggtgtgggaggtggtttcactgccttgcggatcgcgccagaagaaggtcaccagacaggtgccatcctgctgcggctcaatgcgcggaatgccctgagtctgttgctcctgccaccaggcttcgctaccaattccatcatttcgccaggtcataggggctgccagtcgccgtctggtgactgcgctcaaaatgagcacgcacgttccgtctggcacccggtaagtcatgggattcagcaaaggatggccctgccaggtgtgaacggctgcgcgataaagacagggatcttctcaccggctcgccagtcactccgctgtggcgcagaactggccttccaggaatga

SEQ ID NO: 37811 - DNA, 804 bp, Glycine max
  Peptide Sequence Number=SeqID_154589
atggcactttctctgcccgtcggacgagccgtaacggtacgcttaacgtggcagagtaattttgcgctctttggcagggcgatacagcaccagcacgttgccgataacctgaacgttgtttgccttagtttcacgcacgatagcgtcaacgatcagctgcttggtttcacgatcttccgaggcaatttttaccttgatcaattcgtgatgttcgagcgcctgttcgatctcggcgagcacgccttcagtcaggccattgccgcccagcatgaccactggcttcagtggatgggcaaggcctttcagggtgacaagctgttcaaacccggtatgaccgtggttgacctgggcgctgcgcccggcggctggtcgcaatatgtggtacaacagattggttcgggtggccgtattattgcctgcgatctgctgccgatggatcccatcgttggcgttgacttcctgcagggcgattttcgcgacgaagcggtgttgaaagcgttactggagcgcgtgggcgaccagaaagtgcaggtggtgatgtcggacatggcgccgaatatgagcggtacgcctgcggtcgatatcccgcgttccatgtatttagttgaactggcgttagaaatgtgtcgggatgtactggcacctggtggcagttttgtagtgaaagtgtttcagggagatggcttcgatgaatacctgcgggaaattcgctccctgtttacgaaagtgaaaattcgtaagccggacgcttcgcgatcacgttcgcgcgaagtgtacattgtggcgacagggcgcaaactgtag

SEQ ID NO: 37812 - DNA, 477 bp, Glycine max
  Peptide Sequence Number=SeqID_154590
atgaatcagattccgatgacgttgaaaggcgctgagaagctgcgtgaagagctgaacgaactgaaaaccgttaagcgtccgcgcatcatcgcctctatcgccgaagcccgtgagcacggcgatctgaaagagaatgccgaataccacgctgcgcgcgaagaacaggggttctgcgaagggcgtattcaggagatcgaagccaagctctccaatgcacaggtgattgacgtgaccgccatgccgaaaaccggccgcgtgatttttggcgccaccgtcaccgtgctgaatgtcgataccgatgaagagtttacttaccggattgtcggtgacgacgaagcggactttaaacagaacctgatttccgtgaattcgccgatggcgcgcggtctggtgggcaaagaggccgatgacgtggctattgtcaaaaccccaggcggcgatgtggaatatgaagtgctgaaagtggaatacatctaa

SEQ ID NO: 37813 - DNA, 274 bp, Glycine max
  Peptide Sequence Number=SeqID_154591
atgtcgcttaagtcaacgaggtccagaaatgcttccaacgtcggtgaccttctccgtcaaagcaatgagaaaattgcccctgaagccattcaagcacatggtcaaggtaacaggaacatagtgcgcgcgaggtgtgcgacacatgggtcctgtggttgtggtcatgttcattgtggagatctcatttctgggaaggggtggtgcacgatagtgatggaggttaggggtgagaagtttgaaggaaagaaaaatgtggtccatggaaaggtggagg

SEQ ID NO: 37814 - DNA, 195 bp, Glycine max
  Peptide Sequence Number=SeqID_154592
atggcaaatggaataaataatgcaaatcaaggaatcaggggtgaacaatgcaagaacaaattgtccttgttgatgccgccatcgccttcgatggatttgtccccgacgaagccgatgccgccgacgttgctgcccaataagggaatggagtgtgacgacgcaaagagaatgggggtggtgctagtttatgagtaa

SEQ ID NO: 37815 - DNA, 114 bp, Glycine max
  Peptide Sequence Number=SeqID_154593
atggaagttggtaacctattggaggctcccaacacacttccaatgaaagaggcgtttttgttacaaaatttgaaagcaatgaaggtgattcactcaatttggagtgcttcttag

SEQ ID NO: 37816 - DNA, 180 bp, Glycine max
  Peptide Sequence Number=SeqID_154594
atggagaaaagcaagaggaaatggaaaagaaaaacaagttctttggaacaaacaatgtttgaaccatatgaaacacgtgcctgtgtgaagctttatacaccttgtgcggttttcctctattcggtttcacttccttggttttcgccagttgccggtcagatagcaagatcgctcgaatga

SEQ ID NO: 37817 - DNA, 360 bp, Glycine max
  Peptide Sequence Number=SeqID_154595
atggaatgtctaccttggagccttcctgaatgggtaagtacatttgcattagcattactcaacaacatcaatattttaatgttctttgtattcaacactgctttgaaaggacttgatgatactccacaacctaaatctaaggctggtgctaggtggattgtttttaagtgtaatagacaaaaaggtagcactgagtgtggctactacgtcatgcactggatgtccactataatcttaggaagtttcaggaataattgtgaaacgtattttaatgatgttagtccattggaagcaaagagattgaaggcgcttcgcatccagtgggcacaatattatctcaaagttagaaatcaaacttag

SEQ ID NO: 37818 - DNA, 201 bp, Glycine max
  Peptide Sequence Number=SeqID_154596
atggccaaaaaactgaagtccctggagctggagaagaaaggtagccagaaatggcgtctgtgtttgttaaatgggaacatgcggatcaatagggtcccaatctcccccgacccaacagtgtgcgtggcttccttggcggtgttgaaggtgccagatgcaggttttcttaccggggtcgtggatcttgacctgaagtgttag

SEQ ID NO: 37819 - DNA, 189 bp, Glycine max
  Peptide Sequence Number=SeqID_154597
atggcgagcgaagcaccaagttgggctgataatggggtgcgggtggtattggtgcaatggaggaggatggcactagatcccaaaaagacatccgcaagaacaagaattcgggtgctgagggcggttttgccagattcaaaagcaactgcaatgatagaatgtgcactggcagatgaggattcccactaa

SEQ ID NO: 37820 - DNA, 1770 bp, Glycine max
  Peptide Sequence Number=SeqID_154598
atggcgaaatcgagcaaagatccgacaacgtcgtatccggcgataaagtcagagcagtacttacacagccccgttcactacgcggtggcgattcgcgaccacacaaagctttccagaatcatttcttcgcttccccgagttcccgacccggcccgagtcatcaccgagtccgactcgctcactcaggagcgagtcgccgagaaaatctctgccgtgctcgaccgccgcgacgtcccattccgggagacgcctctccacctcgctgtccgcctcaacgacgtctccgccgcgcgggccatcgcctccgccggcgccgacatctccctccacaacgccgccggctggaacccgctccaggaggcgctctgccggcgcgcctccgaaatcgcgcaggtgctcgtccggctccaccaccgcgccgcctgggcgaagtggcgccgccgcctgcctcgcctcgtggcggctctccgccgcatgcgtgatttctacatggagatctcgtttcactttgagagctccgtgattcccttcgtcggaaaaatcgctccctccgacacctacaaaatctggaagagcgacgggaacctccgcgccgacaccaccctcgccggcttcgacggcctcaaaatccaccgcgccgaccagagtttcctcttcctcggagacggcgactccgtcgccggcgtccccgccggctccctcctcgtgctcaaccgcgacgacaagaaaatcttcgacgcattcgagaacgccggaactccgatgagcgactccgacgcggcggggttctgctcgcagagcagcgtgtaccgtccggggatggatgtaacgaaagcagagctcgtcggaagaaccaattggagaagacaagaaaagatggaaaatgttggagaatggaaagctagggttttcgaagtgcataacgtggttttcagtttccggtcacggaaagttgctgcaggcgaatccgacgtggcagggagtgagcaggttttgccgttggagcttgatgaagacgaagacggttttctcgttgcggaaaatccgagttttggaatgcctctgagtagtaacaacaatgctgataagagaagacatagtagttttgtgagagaagaacgagagtgggtcccaatggggagaaaaagcgtggatttgccttccgtttccgtcgcaccgccgaggaggtcatcggcggcggctgtggcgccgcctccggcggccccaccaacgaaagagaaggaatatttgagaagcttgcgaccagcggtgtggttgacggagcagtttccgttgaagacggaggagctgttgccgttgttggacattctggccaacaaggtgaaggcggtgcggcggctccgggagcttctgacgacgaagttcccgccggggagttttccggtgaaggtggcaatcccggtggtccctacggtgagggtggtggtcacgtttaccaagttcgtggagctgcaacctgtggagaagttctacacgccgttatcgagtccaacgcatttgctcaatgcagaagatgatgatgatcctcagaaactaagaaggcagggttcatcatcttctgggagatccacgtggctgagaagaagtactagtagtagtagtagtagccaacaccaacaacgatgttcttcttctggggctttggattctgatccttttgctattcctgttggatatacgtggaccaatagtgggaatgattcgtcacggaaaatgaagaagtccaggtccgtgagaaaatccaagtga

SEQ ID NO: 37821 - DNA, 171 bp, Glycine max
  Peptide Sequence Number=SeqID_154599
atgccttgcacgaaaaaatctggtcaaatgacgtttgaggcaacaaaggaaattacagaaaggattgattccctggaagagcaagccttacaaggaagctttgtcgcccatggacatcaggatatactgattgttagagatagagggagcaacatgaagactaagtcttag

SEQ ID NO: 37822 - DNA, 357 bp, Glycine max
  Peptide Sequence Number=SeqID_154600
atgtttgaacataaattgcaagaggatggggacaatgtggcatgccccattgcttcagaacacaacctaggcctaaggccttttcattcaaatcctcaattcaagaaaacaagaaccaaagcaaaccaaaactgccttacaaatataagcatgttctcacaatttaaggcaccaaaggatgaagaaagcacatcaatggaaagcaaaaacaccaaggatggaatacttacttgttggaatgaattgaaataccaaaaacgaaagcaaaacgcgatcaaaaatggcttaggggagcaagaaccgggaacattaaccatgtccccacctttcttatgggctagcgtttgcctaacttga

SEQ ID NO: 37823 - DNA, 3690 bp, Glycine max
  Peptide Sequence Number=SeqID_154601
cttcaagagactgatgatgatgatgatcttcaaaatgctgacgatgaagaagagtataaaaaatttttagcagctgttttacagggtggtgaaggcgatggtctttcaactcatgaaaatgaaaatcttgatgatgatgaggataacgatgcagactttgagatagaactcgaagagttattggaaagtgatgccgatgacaatgcaacagtaaaaacccgaaaggagtatgatggagcaggacgacgacctgagactaggcaaaataagcgccaaaaggtctctgcccaatgtgagaagaaaacattaggagaagtcaagaggccactgcgtcccattttgccatggcttaacgggcccctaccttcagggaaaggtttgattcctgatgctacactgagctttcaatcttctacttcaggaaatggtcttgtcaatgggtttactccccagcagattggtcaattgcactgtttgatacatgagcatgtgcaacttcttattcaggtattttctttatcggttcttgaaccttcccaaaaacaagttgcttctcaggttcaaggtttgctatttgagatgcttcacaaacgtgatgaaatattagctttgaaaagagtgccatatcccagtgtttgctttactccatcttttgcttgctcatctgtgtccgacggaggctcaaaattcgtccaggaccagtgcaacatagaatattctcctccacaagatgcacagaatgtatggttttctcaatccaatcagagatcctctgaaggtttgaacaggcaaagaggtttccaagctacagaaagttctttctgggttccttttgtgagaggccccgtacaatctattttggaggcattgtgtgaaattccttttacagctgcccaagagtttcgaaagagatatattgagtctggtagtgattcacctgttgaaaaggaacctctctttactttttcttctccagttgctgaagctaatggtgaaatttcaaggggaaccatctctagagcagttaatgcagtctcaacttcaactaggcaacaacgacctaagaaaacattggctgctatgcttgttgaaagtacaaagaagcagtcaattgctttggtgcagaaggaagttgcaaagttggctcaaagatttttggccttgttcaatccagcattattccctcataagccacccccagcagcagttgtaaataggatacttttcactgattcagaggacgaattactagccttagggataatggaatataatacagactggaaagcaattcaacaacgttttcttccctgcaagtctaagcatcagcttcggaagctagtgtttgaattgaaatggagtgttcagttgaataatttagttcagcaattccaatatggtggtgaaggttgctacctatctaatatgaaagggaatggtctggctgttcgaagaatgaaaacctccccattgactgcagaggagatagcgtgcattcaagagggacttaaaatttataaatgtgattggacgttagtatggcaatatattgttccacatagagatccatccttgcttccacgccagtggcgcattgctcttggcactcaaaagtcatacaagatagatgcatcaaaaagggagaagcggagattgtatgagtcaaacagaagaaagttgaaggcattagaaagttggcgagctatatctgataaagaggattgtgatgctgaaattgctggttcagagtgcatggattattcagaagttgtaccatatgtccaccaggcgtttctggcagattggaggccacacacatctactcttacttatcctgaatgcatttccactacatctagagaaggaaatgttgctcacaatgcattttctcaaaaagatattcaattttataggggtactcatgattatggtttaagtggaaaagttccacttgagaatggtaatcagtctgcattaccatctgtatctaagcttcctcagctttttcatactacatctgatttgagaaatggaatgaaaggtgctcctagcaccattaatcctaagaaaccagtttttgacgtgacctctagctccaaatactattgtcggccctatcggtctcggagggcacataatgctcacttggtgaaattggcaccaggtttgcctcccgtaaatcttcctccatctgttcgtatagtttctcaaactgcttttaaagggttccagtgtggaacatctaaggttcatcttcctggagctggtgtagctgcttgtagaaaagataattcttcatctcaaactcctcacggggagaaatctgaaaatgttcatcctgttaaaggtgcaagacctacattagaagatagtgtcacaggttctcaactaggaagatctgatactgttgaagacggatctcttgtggcagaaaaaggcaccagttccgatctccagatgcatcctctcttgttccaggtcactgaagatggcaatgtgccttattatccattgaaatttagttctggtacttctagttcattcagcttcttctcaggaagccaaccacaattaaatctgagtctcttccatagctcacagcaacaaagccacattgattgtgctaacaagtccttaaagttgaaggattccactttaagatctggaggcattgattttcatccacttctgcagaaatctgatgatacacagtcaccaacaagttttgatgccattcagcctgagtcactggttaatagtggtgtgcaggctattgccagtagatcttctggcctcaatgacaaatccaatgaacttgacttagagattcacctaagttctgtatctggaagggagaaatctgtgaaaagtagacagctaaaggcacatgatcctgtagggtccaagaaaactgtagcaattagtggaacagcgatgaaacctcaagaggatactgctccttattgtcagcagggtgttgaaaatctttcagctggcagttgcgagcttgcttcaagtgctcctttggttgttcccaatgataacattaccagatatgatgtagatgatattggtgatcagtctcatcctgagatagtgatggagcaggaagagttaagtgattctgaggaagatattgaagaacatgtagagtttgagtgtgaggaaatgacagattccgaaggagaggatggttctggctgtgaacaagctcttgaggttcaaaataaggaggtcccaatttcttctgaagaaaatgttgtgaagtatatggattgtatgaaaaaaccgtgtgaaccaaggggaaattatggtactgaagttgatggtggcctccttacaaatagtactgcactaaatattgctttgactaatgatggacaggatgacagaagtagttcttcatggctaagtttagactcatgtacggcagataatcctgtgctttcaaaggccatacttcaacagagtacgattggtgaagcttctgcttccaaaatcttttcaattggtaaagctgtcagagaggagagacatactgtagacatgatacaacagccaagtctaggtcctcatgtgtctatcacttcacgaaaactcaggaagcgttctggcaaatcaaatgcaaatttaaatgtaggattgactgtcgaaagatcaagccgtgatggtaatcatgaaaatggttga

SEQ ID NO: 37824 - DNA, 3159 bp, Glycine max
  Peptide Sequence Number=SeqID_154602
atgtctctgcagctaaactgcaaaacggtgtttccctacagaggcggtgattgtgtttctggcgtattacctcgtcgtcattcagtaactgttcaccgtgcaaagcaggttggggtgtttcgttcttccgtgccagtgcagaggcaacagaagaaggtgccagttgcaaggaccaagggcactgctggaaagggttttgtcccaagcaaaaagagtacaagagtgaagaagggagacacgttaacttcagtagtgagtgaggtttcagggggtgataaaaagcaaacagttgatgtcaatgttgatgctgataaagaaggggaacttgaattctcccaagaggagaagtttgaggctgtagatagaattgacgaaattgtcagggatgtgggggagttatcgttgttagatgagacggcgggggagttattattgttggatgagagcaatgaagctaatatttctgtaattgatgaggatgatgaggttcttgagttgcggaaggaggagattccttacaatggaggtgttgggattgttgaaggttcttcggaagaaggtttgtttgaccgtgcacgaattgatgaaaatgttaaagaaacagatactgatggtgaaataactgaggaagctgttgaggaatcaagcagtgctgctgatgatagaataaatgaggaagctgctaggctgttgaagttagagttggaagcaaatcagcgcaggcaggagatagagaggattgcagaggaaaaactttcacaagggatgaagctgtttgtatatcctcctgtggttaaacctgatcaagatatagaacttttccttaacaagaacctttcaacactaagtgaggagccagacattctgatcatgggggcattcaatgattggaagtggaaatctttttccattaggttgaataagtcacatctcaagggagattggtggtcttgccaattatatgtgccaaaagaagcctacaaggtagactttgtgttcttcaatgaacaaaatgtctatgacaataatgaccaaaaagacttctgcatacccgttgatggaggaatggatgcattagcatttgaagatttcttgcttgaggagaaacgtaaagaattagaagaacttgcttgggcacaagctgaaagggaaagacaagctgaagagcaaaggcgaatggaggcagacagagctgcaaaggaagaggacagggcacgggcgaaggcggaggttggaagaatgcgagaaacattgccacaattgttgaaaaatgctgtaaagtccattgataatgtttggtatattgaacctagtgaattcaaaggcaatgaattgatcagattatattataacagaagctcaggtcctcttgcaaatgctaatgaaatatggattcatggtgggcacaataattggaagtatggattatcaatcgttgaaaggcttgtcaagtctgttctaaaaggaggtgaatggtggtatgctgatgttgttgtacctgaccaagctcttgtcctggattgggtctttgctgatggtccacctaagaaggcagttgtatatgataacaatcgtaaacaagatttccatgccattgtccctatggctatacctgatgaacagtattgggttgaggaagagcagcagatatacagaaaatttcaggaggaaaggaggttaagagaggaagcgatacgtgcaaaggctggaaaaacagcacagatgaaagctgaaacaaaggaaagaactctgaaaagatttttgctttctcaaaagcatattgtattcactgaccctcttgatgttcaagcagggagcacagtgacagtattctataacccctccaacacaaatctgaatggcaaacctgaggtttggtttagatgttcatttaatcgttggtctcaccgtaatggtccattgccacctcagagaatgttacctgctgagaatggcactcacgtcaaagcctctgttaaggttccactggatgcatacatgatggactttgtattctctgagagtgaacatggtggagtttttgataacaaattcggaatggattatcacataccagtttttggaggtattgtaaaggaaccacctttgcatatcatccatattgctgtggagatggccccaattgcaaaagttggaggccttggtgatgttgttactagtctatcccgggctgttcaggatttaaatcacaatgtggacatcattcttccaaagtatgactgcttgaaccttagcaattggcttctgtgtggaaatggatggtttgttgagagcgtttcttcacatttgactgctgagcatcagcatcattggcatgcatggctcccaatgcaggatatcatccactgccatgattggtcaagtgctccggctgcttggctatttaaagacaactatgcacattatggtcttagtaaagcacgagttgtcttcacaattcataaccttgaatttggagcccattccattggaaaagctatggcacatgctgacaaagctacaactgtctcccccacatattcaagagagattgctggtaatcctttaattgctcctcatcttcacaagttccatggtataataaatggaatcgacccagatatatgggacccgtataatgataaattcattcctgttgtattacttggttcagctccagatcctcgtatccaaaatgattttgtgaatttggccaatgaattgcattctgctcatcatgatcgtgctagactttgccttgcatatgatgagcctctttcacacttgatatatgctggtgctgatttcattctagttccttcaatctttgagccatgtggactcactcaactcacagcaatgagatatggttcagtacctgttgttcgaaaaactggaggactttacgatacagtatttgacgttgatcatgataaggatagagcacaagcacaaggtcttgagccaaatggatttagttttgatggagctgatactggaggtgttgattatgctctcaatagggcaatatcagcatggtatgaaggccgtgattggtttaacagtttatgcaaaagggtgatggagcaagactggtcttggaaccggcctgctcttgactatttggagctttaccatgcagcacgcaaagcagaatga

SEQ ID NO: 37825 - DNA, 201 bp, Glycine max
  Peptide Sequence Number=SeqID_154603
atggaaaaatctaacaggaaaatcttcaaagataagaaagcaaagaaagcttacatcacttgtgaagataacaatatgaattcatctggagactcagaaaatgaggtcatgaatctaagtctcattgccaaaaactatgaaagcgaagaagagatgcattcagtgacttacataaagaatcagtcaaacttgccaaactag

SEQ ID NO: 37826 - DNA, 807 bp, Glycine max
  Peptide Sequence Number=SeqID_154604
atggcaaaaaccttttcatgtgctccagagatggctgagcttccaaaaatagaaagtttcgttgaagacgcacacatacggttacggtgggggcactctttctcccctccaacaaaatcggcgagtcacgccacgccccaccgcagtcgcgtgccatcaacgacaacacacttcggcacttccgatcatttctccgcggcggcgcaaccgattcccccgccgcctatggccaaaggtcgaaaattaacgaccagccggagcgaacgttttttgggaacctacgcctatagccaaggctccgccgccttgaacccatcggagctccgggaagaagatgtctggggcgccggagatgacgccggcgatcgcgagtgggagccacacgccgccgccttaaacaacagtggcgtcagccggcgccggattccacgtgacacggaggagcaccggcgcgtgggtggactgtcactggcgtttgaagctccggctagtggctcgtcgccgaggatggtgcaccagtttcgggcgcgtgaggagatgacgtcgacgccgcgagggcgccacatggcgacgtcggcgccggtgaacgtgccggactggagcaagatactccgagtcgactcggtcgagtcgataaacgacgaggacggggacgaatcggaaatgatgccaccgcatgaatacttggcgcgtagccagaagatggtggctaactcggtgtttgaaggagtgggccgcacgttgaagggccgcgacttgagccgggttcgtgacgccgtgtggaaccagaccgggttcgacggttaa

SEQ ID NO: 37827 - DNA, 321 bp, Glycine max
  Peptide Sequence Number=SeqID_154605
atgcctttaggttcaaattcagagtcagtcaaagttggccttgctatgaatcagaatgcactttcttctcctgatagccatggaaggactttgaaacctgaggaggataaggaagtgggggaggaggaggaagatgaggatgctgattttaacccttttctaaaggaaactctttctcaagaagcatcttcaagtttgagctctgaagttgatggtttggatggtaatgttgtcactagtgggccatctgggggttcagagctatcaaaggttactactaaggaagcaatctgtactgtggtacttaatgaaccttggtga

SEQ ID NO: 37828 - DNA, 279 bp, Glycine max
  Peptide Sequence Number=SeqID_154606
atgatgggaagccttatgtacaccgtgatttgtactagaccagacattgcacaagtagtgggagcgattaagtatctttcacattgcaaggaatccaaccttccattccaggacaaagcacataggtgttcaatatcactttgtcagagaaattgtataggaagtgtggatatgcagaagattcacactaaagataaactcacagatgccatgatcaagccgatcaatgcaaacaagtttgcatggtgtaaatcctcatttggcctatcagacatgtaa

SEQ ID NO: 37829 - DNA, 254 bp, Glycine max
  Peptide Sequence Number=SeqID_154607
atggctaccgtagatattactggctcgaacaacaatgacctcaacaaaccttttaggtttgaagggtatcatttcaaacgttggaaacaaaagatgatgttttatttaactatgagaaaagttgcctatgttttgaacactgatattccgatggtacttgaggatgctgagaaggaagtgaaggataaaatgactatggaattagctctctggaatgaaaatgattacctatgcaagaatttcattctgaatgg

SEQ ID NO: 37830 - DNA, 288 bp, Glycine max
  Peptide Sequence Number=SeqID_154608
atgtcgcgcttagcgcgagtaagtggatttgggcttggcgctagtcgtgcactgagcctacaagagacaaacatctcgcttagcaagctgatctcgcgcttaacacgcgaccttgattcttgtgtgtcataccctaatttcgtccgggaactattgcttgatggcatgcaacctgtgattgactactttaagattcttcctccagaaggcggttgcttctggaggaagcaacctggctcgcctggccaagctgggttgcaagctcctcccctatttttctataaatag

SEQ ID NO: 37831 - DNA, 1349 bp, Glycine max
  Peptide Sequence Number=SeqID_154609
gttgttgcgtctgatttagatggcacgctgctttcccccgaccatttcctcaccccctatgccaaagagacgctgaagctactcaccgcgcgcgggataaatttcgttttcgccactggccgccactacatcgatgtggggcagatccgcgataatctcggcattaagtcgtacatgatcacctctaacggcgcgcgggtacacgatagcgaaggtaaacaaatcttcgctcataacctcgaccgcgatatcgccagcgatctgtttgagatggtgcgtaacgatgtgaagattgtgaccaacgtctatcgtgaagatgaatggtttatgaatcgccatcgcccggaagagatgcgcttcttcaaagaggcggtgttcaactacaagctttatgaaccgggcgagctggatgcggatggcatcagcaaagttttcttcacttgtgaagatcatgaacatctgctgccgcttgagcaggctatcaacgcgcgctggggcgaccgcgtgaatgtgagtttctccacactaacttgtcttgaagtgatggctggcggtgtttcgaaggggcatgcgctggaggccgtcgcgaaaatgctcggctacagcctcaaagagtgtatcgcctttgtcgacggcatgaacgatgccgagatgctgtcgatggccggtaaaggctgcatcatggcgaacgcccatcagcggttgaaggatttgcatcctgagctggaagtgatcggcagcaacgccgatgatgccgtaccgcattacctacgcaagctcctgattggcgaataccttgccggtagcgtcgatagctatttttccgtgctgatgcgcgtggggctggcagcgctggtttttttgcctttcctgcatacgcgcggccagtctccgcgcaccatcgtactctatatgctagtgggggcgatgcagcttggcatcatcggtcgtaaactgcgctggggctatctgcttagcgcggcgctggcggtgttaggggcggcgatcatccgctatgacaaagtcagcgatcatttctggaccgggctattgctggtgcagttgtcgaatatctgcttcgccatcggcatggtgggctacaagcgtttgatggaagtccgcccgatgccgcaacacaatgcttttgcctggttctatgcaggcgcctttattgtggcggtagcggcgtggtttatgctgagcaatccgcagaggttgccgaccaccgacctgcagtggggaatcctggactggcttggcgtggttgcttccggattgggatatttcatgtggaactacggcgcgacgcacgtggatgccgtgacgttggggatcatgataacgttcac

SEQ ID NO: 37832 - DNA, 1245 bp, Glycine max
  Peptide Sequence Number=SeqID_154610
atgccggcccgtttcagattgcgatccgagatgtcgaaacctgcgggttcgatgatgtcgacgccaaggccaaggcaggcggccagccgcaggatggtgccgggcgattctgatttcggtcgtggtgccggacatggagatctcactgcggttgctgtgctcgtccgattatcacgcgcaggcaagggacgacaggcagtttgcgaaaagtccctctcgggtgccattccagaccggatattcatgcgcgtgacacactgggcggctacccattcaccagtacatcatcaggcttgcccgaaccatcgggaacggttgacgtcggcctacttgagccggatcttctgcacgcagcaacagggggatagcatgtccgaacgggtgaatttcgtccatctgaccgatctgcatgtgggcaatccgcaggtgcaggatgacgatctttattcagagacctcggccacgctttccacgacgcttgcgcagatcaaggcgctggtgccgccgcccgaattcatcgtcgtcagcggcgatctgaccaatcggggcgatgccggcagctatgaggagctcaagcgtctgataaaggaagcggaactcggtatgcctgtgcttttcgcgctcggcaatcacgaccgccgcgatggattttatcccgtgatgctcgatcgccacgaggatctggacgagccctatgaccatgccgaggtgattgccggcattcacatcatcgtcatggacaccagcgttcccggcaaggttgggggtgctttcgaacccggacaggtcgaatggcttgaggatgagctggaaaaccatcccgaattgccgaagctgctggtgatgcaccatgcgccggcgcttgatttcgaccgtcccgatgcggagtgggaatccctgtcctttgacgataccgagattctggacgagctgctgttcgaacatgacatcattggtattctggcaggccacatccattacgaccgcatgtcacactggcagggcattcccatcgtggtcggtatcggccagcatttcgcgaccgatcctctgtggctgcatgagggcgtacgcatgctctccggcgcatctttcgccatcggcacgataagggatacgggtctgaccgttacctttgccccgcagcccagcgaccggcgggaactcaagcgccatactcaggccggaatgatcgagttgatcacggaatatgagagtggtcaggcgcaggacgcagccgaataa

SEQ ID NO: 37833 - DNA, 378 bp, Glycine max
  Peptide Sequence Number=SeqID_154611
atgtcaactccacctctagatcctcacaatcactcacaaactcatttcaagctctcaggacgacttcctcttatagctttattctctgcaggtttaataggtggtcttgatggtgttttcgcgcttagggcaactaggcaccgctcaacgctcattagtggatttcggcttagtgcgtgcttttggcgctcagcggatggactgaagcgatgcgcttcgctggatgacccttcgctcagcaaacatgcacatgtcatccttcttccaaattcttcctcatgctcagccgaaggagtgttgcactcagcggatggctcgctaagccagcagattggcttagtgagaggatggaaatcagaacttcacaaacttgcctaa

SEQ ID NO: 37834 - DNA, 123 bp, Glycine max
  Peptide Sequence Number=SeqID_154612
atggacccaatcaagtacattttcgagaaaccagctctcaccggacggatcgcttggtggcaggcaataaagggaagtgccttggcagactatctagctcagcagtccctcaatgactactaa

SEQ ID NO: 37835 - DNA, 507 bp, Glycine max
  Peptide Sequence Number=SeqID_154613
atggcagaatcattgaagaagagaaagggatcatcctccaccaccactgttgctggtcatcgccgccacggaccatctgaagcacccacaacacctatccatccttccttgtcatctccaagatcatccactttgttttcttccgatgatcaacgtctacggtacctttctcaattttcttctaggatcattttagaccctaagtacctagacatagatttcttcaatgatgagacatttgattgttatcaagtgtttcaaaattctggcttagttgatttcatgtctttaaaattgccttattatcttgaacttgtcaaagtcttttactgcaatttaaaaattcaagatggcattatttcttctgaggtgcatggtatttccatgatcattgatcaatctttgtttttttctttgactaaattacccagtcaaggtgcaccttttgagggcaccattgttgatgactggaaatttgattattctagtcatgatgctcaccgtatg

SEQ ID NO: 37836 - DNA, 177 bp, Glycine max
  Peptide Sequence Number=SeqID_154614
atggctcgtggctgtcaccgatggtcgtggacggtagaggaggaggtttggggtattgcgtcaatcttagaatcacacagttccaatgcagatcaatcaaactccgcacaacctaacatccacatcaagcagttgtacaaggataattcatataacacttcaactattccaaattaa

SEQ ID NO: 37837 - DNA, 399 bp, Glycine max
  Peptide Sequence Number=SeqID_154615
atggctcaggaggaggtaccttcaccagatcccatgccagagccatcccttgcacctatatctgagtacactatgccatcactaccagcaatggagctagagcagcccattcttcagaatgtacctgctgctccagtgctggatttaaatgaagatcagccacaggatgaccaggatgagagcatcatccacaggaagcttggttcaaagaaaatttgtcccaaatttggggaagatattgggctaagtgttgaagtgctaaaagtggtagttgcgctcagcgtgcatccatcactaagcgcagctttagcgcggcagaagaatctggaagagcttaaatatcaaggccatgtgctaagcgcgacggttgtctttagccaggctcagcacatgacttga

SEQ ID NO: 37838 - DNA, 345 bp, Glycine max
  Peptide Sequence Number=SeqID_154616
atgggtttaagttcgaagcactcagctcctagcccctctttccctgaacacaatttaaacgacttcagtagtgctttacttaagtatacatatagatatgcagcaaatttgttggaaggattttctcagacccagattagcacattagccgtcaaggataatcttcttgttgctggtggcttccaaggagagcttacttgtaagcatcagctcagcggttttgattattcggccttatcgttttctgatatattttatttttggtcatgtcatggtcatcaagcttcgtggttagcaacgggtacacgaaaagagaaagagaggaacaaggccaagtttggatga

SEQ ID NO: 37839 - DNA, 261 bp, Glycine max
  Peptide Sequence Number=SeqID_154617
atggatgatttacacagtacactagggtatggtgtgctgagaagttcgaagaacctgggggaattagcgagtgatgactacccagcatttggtacactcatttggcgtgagaaactcacaagtctcactttgttactcctgacgggctccgagactgtactttttggagttggaagcttggggtcgatatatatcatacttgtatatggtgatcactcccaactgtcatccatgtggttgtgtaagaacaccaatacctag

SEQ ID NO: 37840 - DNA, 267 bp, Glycine max
  Peptide Sequence Number=SeqID_154618
atgaagatggaagccctcagcagctctaaaactcaaccgaaaacaaaagaaaaaagtggaactgaagaagacaccaaaatgaagaagaaagaatggaaacagaggaaacaaattggtgggcaaatgacacaaatgaaggaagcagctggcgattttgaatttgtgccgcctcttgaaattgtggagtatccgaacccgagattgagggccaggaataagcgcatagttgccttcgatgattgtttgtccacgaaatgtttgatgtaa

SEQ ID NO: 37841 - DNA, 201 bp, Glycine max
  Peptide Sequence Number=SeqID_154619
atggtgtggaaaatgtctatcaatggtcgtgtgggtatgttgcatttctcaatggctgcaatagctcatagttatatgttggaggttttggagcttgacaattgcagcctgttgacttcagtgtctttggatcttcctcgtctgcagactattagattggtacactgtcgcaagcaggtttatcacagttatgtaggttaa

SEQ ID NO: 37842 - DNA, 906 bp, Glycine max
  Peptide Sequence Number=SeqID_154620
atgggaacggggatgaatcaacagactctcgacgcgcgccgctcgcgtcaggcgttgctggccggctcggtcggcaactttatcgaatggtatgagttcggggtgtacgggttcctggccaccgttatcgccgccaattttttcacgctgcagggtgaaaacgaaatcaccagcctgatcctcacctacgccgccttcgcgctggcgtttttctgtcggccgatcggcgcggtgatattcggccgcatcggcgatcgcatcggccgtcgcccaacgctgattgcggttctgctgttgatgacgctggccaccgcgctgatcggcgtcatgccgacctatgcctcgatcggcgtcgccgccccgctgctactgacgctgctgcgcatgttacaggggctgttcgccggcggtgaattcggcggcgccgtgtcgctgatgaccgagttcgccccgaagggcaagcgcgggctgttcggagcctggcaatcgctgaccgtcgcgctcggcctgctggccggggccgggctggtggcgctgttggccgcgctgctcagcgtgcagcagctgcatgactggggctggcgtattccgttcctgctggcgctgccgctgggcgccgtggcgctgtggctgcggctaaagctcgaggaaacgcccacattcacccaggcgcagcaacatgcggaacacgccgccgcgccgccggaagcgaagctgggcggcgtggtgaaaaccattttgatcggtatcggccgcatgatgggctggtcggccgccggctataccttcctggtggtgatgccttcctatttgcaaacctcattgcacgccaccttccagcaggcgctggtggcgacagtgctcgccaacgtcggcttcgccctgaccattctgccggcgggcatt

SEQ ID NO: 37843 - DNA, 371 bp, Glycine max
  Peptide Sequence Number=SeqID_154621
gctcagggccattgaaggaggtgaagattatgcctttgctaacctagaagagttgttcctagtacccaatatcatcacccctccccagttcaaggtgttggactttgacaagtacaaggggactacttgccccaaagaccatctaaagaagtattgtcggaagatgggggcatacgcaaaagatgagaaattgctgatacattccttccaagaaagtcttactggggtagctgttacctgtgtcagtataatggcttcggataggatgcaactacagaacatgtgcaatgctagtagacatattgctagtgttctattatggaaaatggtgggttacacgccttcaagcattgcggatttggtcttcaccg

SEQ ID NO: 37844 - DNA, 219 bp, Glycine max
  Peptide Sequence Number=SeqID_154622
atgacggacatcactgacgacatagcggaggaaatctccttccagggcttcgaagatgactgtaaattgctagggaaccttctcaacgacattctccagagggaggctggctccaccttcgttgacaagctcgaaaaaattcgagtcctttcacaggtgtatactttaatgggttttgcttctttaccttttcctagaatgattggagtatgctgttaa

SEQ ID NO: 37845 - DNA, 399 bp, Glycine max
  Peptide Sequence Number=SeqID_154623
atgaatgtcggagctcttatctctggacagatcacatcaatggcccagtctaactcctctagaattgggttccttgctcttatcacaactttatgtaggtccagaggagttgctttcgacagcttagtctttgaacgtttgagcccgctggtagcgcctccagactccatctcgacggtagagcaatttaatgaatggctagcctggccagggactcagcctcctcttcacagggaagatgaagatcccgccactcaggtaccccatcagccgaaggatgagtcatcagagtcttccactcctgagcccttgatcaagaagaggagggtagttgtaacccaggaagctgcaaccacctctgaaaagtctcttgaagccactctagagcttccggcacca

SEQ ID NO: 37846 - DNA, 465 bp, Glycine max
  Peptide Sequence Number=SeqID_154624
acttatcaaggtaatccttgtggcgtctaccctgacttatcttccttcaccggaagtggcgtcatccaaacctccatagcctgtatcaaacgatccgctcctactcagaacaaggttgaagatgaaaggaaggaaagaatcactctttccggcgagggcaacacacaaagattgagggcaaatgttttccaagaaggagggaatgatgagaatcctaaaactgtccaaatacagggacctatgaccaggagtaggaccaaacagtcagtggataccctccaacaaatggtagcaggcatacttagcaaggcccaagtggagaaggacaaaagcccaaatggagaaggacgaagaccgaagtggaaaaggacgaagccccaagtgaagagaaggatgaaggcccaagtggagaaggacgaaggcctaagtggagaaggacgaaagacccaagtggagaaggattaa

SEQ ID NO: 37847 - DNA, 440 bp, Glycine max
  misc_feature (413)..(413): n is a, c, g, or t
  Peptide Sequence Number=SeqID_154625
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtgactgctcgagctgcttccgcggcgagagcgggtcgtcgcgtgccggtcggggacggattgggaacgggccnttcgggcctcttccccgggcgtcgaca

SEQ ID NO: 37848 - DNA, 801 bp, Glycine max
  Peptide Sequence Number=SeqID_154626
gccggcgatgatcttcagcaggctggttttgccggcgccgctggctccgagcagggcgacgaagctgccgccggcgatgtcgaagctcagccgccccatttgccaaaatgccgattccagctgggtggcggtggtgaaaatctgcgccagctcggtgaagcggccttgtgcgccgcgctggtggccgacggtttccagcagctcgatggcggcgcgcacgccggccagatagccctcgtcgccgtagttgcggatccaggaggcgtaaggattgccctccatttgggtggcgggatcgtgcagcagccgcaggccgatttcggcatagccggccacgcagggcagcaggccagccagcagatcgagggcgtcgccggcatggccgatatccagcacgtagcgggtatagttcatggtttccgccgcttccggctgggcggcgatctgcgcttcgctcagcccccattcggcgcagtaggccacgtgcagcggcagttcggcgacgatgccgttgagcgaggcggtagcggcgcgcatctccggcagggtgcgcagcttgctgaccagcagcgcgtaggcgcgggcgaagtgcagcaggaacagatagtcctgggtcaggtagcggcgaaacgcgcgttcgggcaaggtgccggcggccagctgctgcagaaacgggtgatcaacgtaatcttgccagtggctgccggcatgttggcgcagccggccgtaaagaccgctttcgaacagggtggtgatggacatgggacctccttgagtcagtggagatccgggcacgctggg

SEQ ID NO: 37849 - DNA, 516 bp, Glycine max
  Peptide Sequence Number=SeqID_154627
atgacaaacgctaataaatcacacattatcttgctttcacatactctcccaattgatacacaaagtatgacatttttaggagaaactagcagtcagacgattgtcaactcaaggttgggtttcatttttccaaatggatcgattattcacaatgatagtggggtttacttccaaactttcactctggtgcccattcgagtaccaaacagctgtgattttgcaagcctaaaaaccataatacacaatacccttcaactaaccgacaaacaatttttggatgaaattcactaccgccagccattcacccatacaagtaaccaaattcgctttcaatgtatgcaattgataaatgaggacgatttcaacacaatgttaatgtgtaatgatcaatttttgtgtgttggtccgattgagttattatgcaccgttggaagaacaccggatgaagtaataaacttacttgaacgcattacgatccctactcatgacgcgctcttgtattacaacgggagatag

SEQ ID NO: 37850 - DNA, 597 bp, Glycine max
  Peptide Sequence Number=SeqID_154628
atgaggtcctgggtgaggggtcagtggatcccgtttgatgcagatgctatcggccaactcctgggatatcctttagtgctggaagagggccaggaatgcgagtatggccagaggaggaaccggtccgatgggttcgatgaggaggccatcgcccagttgctatgtataccggggcaagattttgcccggactgctgccgggagacgggtgcggatcatgtgcaccaacatgaccactctgactcagatatggatgactttgctgctcagcaacatcctgcccaccgatcataattccgacctccgcctgccgaagtgtcagctggtgtacgccatcctgacgcggatgagcatccatgtggctcagttaatcgctgatgccatctatatttttgcagcctccagagtcagggctttacttcttttccgtgccctactccggaccagttccagggcagaggtcgcgtggcctggggattggcctgaggcccaggcaggagaggcaccagcagaggctcccgatgaggcagatgaggcccgcaaggacgaagagatgaccgatttacttgatttcttaggagggagcggagccgcatga

SEQ ID NO: 37851 - DNA, 874 bp, Glycine max
  Peptide Sequence Number=SeqID_154629
ggcacacgccctcacgtttagagagctacacgccttcaccttcaaaggactacacgtcctcgccttaagagggctgcacgcccttgccttcaaagtgctacacgccctcgccatcagaggactggacgtcctttccttcgtagggctacacgctctcacctttagaggactacacgtcctcgccttcagaggactacacatcctcgccttcagaggactacacgtcctcacttttagaggactacacttcctgacctttagagggctacacgtcctcaccttcagagggctgaatgccctcgcctttagagggctacacgtcctcgccttcagaggcctggttgcacgccccctcgcctttagagggctacacgtcctcactttcagtgggctccacatctgcaccttaagaaaatttaaggtcctctgccctgaaatgcttaatcgagacttgcactcctgggaggctatcacgcagctactatgcataccgagacaagatttcacccgtgccactgcaaagagacgagtgcggatcatgcacaccaacatgaccactcttacacagatatggatgacgttgctacttagcaacgttccgtccagcgaccatgatgccgatctccccctgcggaagcatcagggtcgcgcccacaagacacctagtggacctagaggagcccaacagggccctggggtttccagctctggttacggtcctttgtcagtcctacagagtgcccgtcccccccagcaagggatcgcacccgcaagacacccagtggacccggagaagtccaataaggtcttggggtttccagctctgattacgggcctctatcagttctacggagtgcctgtcacccccaacaag

SEQ ID NO: 37852 - DNA, 357 bp, Glycine max
  Peptide Sequence Number=SeqID_154630
atgaaaacggagaagagcaaagtcaatacattgatagcaatttctccaaaaatatggaatgcatcaaagtttattgatattttccccaagataagtggatatgtgatttatgaagacaacaaactgtcgcaacctacccttcggcgggagagcgacacggggctcacgagtgcgtcttccaagggagaaaggcgcgcggagtcgccaccaacgtttattcaaggaaaacgtcaaaaaaatcgaaaaaggtgtggtctacgaactttaagtgtgaaaggttcgggagttgtttttacgcatggggaagggtatttcccttgctcctacgtattcctcaattgcgatgaggaaatctaa

SEQ ID NO: 37853 - DNA, 297 bp, Glycine max
  Peptide Sequence Number=SeqID_154631
atgtttgctttcttggaacactggcataaggaaactagtagtttccatttacccgtaggagaggtgactgtcaccttggaagatgtggcgtcgttgctgcatttaccgatcatagggacgttccttagctttgagccacttcatgttgacgatgttgtctatatgttggtggaattacttgaggtcagcgctgcaaaggcaagagctgagacgattgaatgtcagggctcttatgttcaactatcttggaacgagacatgtatcagacaaaaattgatgcatgtcactggatcatag

SEQ ID NO: 37854 - DNA, 408 bp, Glycine max
  Peptide Sequence Number=SeqID_154632
atgaagatgagaggtcaattgaaagcttatgatctctcggaagtagtggagacagttgaaccaccagctttagaagagaatcccattgttgctcagatcagatttcgtagtgagctagttgctaaaagagcaaatggtcataccatcttacactcagttatgaatgatgatgagaagcttcaagatgagttctttggaaatgagaagaccaagaaaatgcaatttatcaaccttaagaggtttgtcttacctaaaaggtttgaatccaagatttcttcacttgaagagtcaaaagatctttccacgttaagcttgatagagcttgaaaatgtcaacgaaattgaagatggtgaagatctttcgttcatggccaatactacaaggagtttggaggatgagagcacctag

SEQ ID NO: 37855 - DNA, 495 bp, Glycine max
  Peptide Sequence Number=SeqID_154633
atggacaaaattgagcctgaagttgtagatgttggtctgcttggacaacttgatttgtgtgttcacgccagagaatgccaccgcatacggagaagaactcgagtgtggatgtctcgagtgaaacctctcaataagcctgtggccactctttattggcaaaggaagtttgtttgtgggcgacatgattgtcctttcacctcaggtgtcaagatgttgtctctaccttgctttgtcgccatgttaccaaacctatacgtctttaatgtgccagggtgtacagcctcaatgaggtcctttaatggtgattttccaccatggagatgcagcggaagacaaaggagaagaggtgaaatgaggcggcatccactagggaataagccatggaagaaggagcttcaccaccaagatgagccttggataacaagcttggagaggatgcttcaatggaggaaaagaaatagggagagaaagagagaggggggagcacaaaattga

SEQ ID NO: 37856 - DNA, 657 bp, Glycine max
  Peptide Sequence Number=SeqID_154634
atggacaagttggcttacatttgtcctatcctaggaaatgtggacattttggtcaactatatggagcttccttatgaacctgttagtgtgaacgaacctaagaaagaacctaaattaatttgcttgttaatgaacatcgtgatcttaggtccaaatctgtcaatgtacctattgagtgagtcatctgaagctgaacatgatgacattgaagatgatgttgatttggttaatggtaatgagagtgataaattaagtggctttgaaaagaatgttaatgtaataggtgaagtgaatttggatgatgatataaatgaaatatatgttgagagaggtattttgggaaaaccttttgagaggcaaccagatagcaagatcaagtttataaaagggcaattattctcaaatgtatctcattttagggaaatccagagtgatttttctattcaagaaggatttgagttgtatggggggccatttggaggggtattactatctgttgttgagcttgatggaaataaaggcatgtttcatatttcattcacaatggttgagattgaaaatacaaatttgtggaagttttttctcactttgttaagggaatcattgcaatcagttcctgaatggaaggatgactttgttactatcatgtcagattag

SEQ ID NO: 37857 - DNA, 1575 bp, Glycine max
  Peptide Sequence Number=SeqID_154635
atgaagcaaaatcttgatgaacgtaacaccaagagaagtaaagtccgagaagaatatgtgtatagtggtcaatttggtaaagatcgaatgagaataattgtggatgaagtgcaagagccaataagagtatgtaatgtcaatcaacctcaaaaggggaagaacatcaatcgcttaggtcagtatttcatgcctacaacaacccctagagctcaacctaccttaaaggcatattatcaacctatgattgatactattagtagcatgggtccaagttatgaagctccaaattttcatagagtttgtggttatttgttaaataaatgggttgatgatgtgaggaagcttgttgatggttatcgaattgtttggaagcaaattggatgcactcttatggctgatgggtggactgattgttgtaggagaactttcattaattttctagtttattgtcctaaaggaactgttttcttaaggtatgtagatgcttctcatgtttccaaatctgctgaaatgttgcataagctttttagggagaaggtgttattagttgggcctgagaatgttgttcacatagtgacaaatagtgctgaaaattatgttgttgctggtagattattggaagttgacttttctaagttatattggtctccatgtgctacacagtgcattaatttgatgttggatgacatagggaaattagaggaagtaagtggaagagatatacttcgtccagctccaactctgtctgccactaatttcattgtcttgcaaaatatattggctcataaagatgcactaagagccatggtaacatctagagattggacaagctcagcttatgccaaagaatctagggcaaaaaaatttgcggaacagatcttagactccaggttttggaaaaaatgtgttgatattgtgaagctcatggagtcattggtttgtgttttatatattgttgacggcaaagataaacctgccatggattgtttttgccaagctatgtataaagccaaagaggagatgatcatgaggatattggaggagtcaccaccattcttaactaataaagaggtggaggctttacataatgaccttgcaaatatgtccatccaaccaatttctgatgacattggtatgtttctttgttacactgtacttataatttcattgtctgatatttggtatcaccatagtagtcaatcgtgcacgatagtgctgcgatcgtccggttgcagagcggccccttactgctccaaagacactcgttgtggagcgcctggttctagtggctgtcgcgacgctattagcggggcaaatagcgaagaatcgcagcaatttgtgggttttgcatgcgaccctcatcgtcgttggacaaggcgttgcgacattcaccgttgccagcgacagcttctgctgcttccgtcatgccgtcgttggcctttcacacacccatctgcgttgtcttcctcctccataggagcactgcatgatgatgatgaagatggtgcacaagacaacactatggacaatgatgatgatgcccaagaaaacactatgcaaaatgtgaatatgtga

SEQ ID NO: 37858 - DNA, 1182 bp, Glycine max
  Peptide Sequence Number=SeqID_154636
atgttgaggtttttcttaaagctagtgaatgttgtggactcacatgttgttcctaggaagaagaggttgtgggtgttggtgagttcagttgttggaggaattgttgttttgctttttgttatagctgctttgctgctttctctcaaatgcaggaagaagaagaaaacgcaaagaacaatggaaagtgtagaatggacgcttttatgtgtgttcggagggagttcacttagtagaatgtctgaagggacaacttttgcctctcttggttcttatggttattttggcttgacaatcccttttgccgatatacaatcagcaacaaacaattttgatagaagtctaattatagggtctggtgggtttggtatggtttacaaagggctcaaagacaacgtgaaggttgcagtcaagagaggcatgcctggatccagacaagggcttctagaattccaaaccgaaataacaatcttttccaaaattttccatcgccatcttgtttcactagttggatattgtgaagaaaactcagaaatgatacttgtctatgagtatatggaaaaagctagaggtctccactatctacacactggtttcgtgcaaggaatcatccactgtgacatcaaatcaaccaatatttttctcgatgaaaactatgtggccaaggttgtagattttggtctttcaagatctggaccttgtctcaatgaaatccatgtgagcactggtgtgaaaggtagttttggttatcttgatctggagtattttcgaaggcagcagcttacagataagtcagatgtttactcatttggggtggtgctttttgagaaaaagggcatgctggagcatattattgatccctatcttgttgggaagataaagcaaagctctttgaagaagtttggtgaaacaacagaaaaacgtctggctaaatatggtgttgataggccaacaatgggtgctgtattgtggaatttggaatatgcacttcagctccaagaaagtgaacaagaaggagagccatatgatgatagcaatgctcaggaaacagtgaatgtgacaactacaataattcctgggagtccttctagtaacgtaataagagagggagataatggtaatgtttattcagacataagtgctaccgaagttttttctcaactaatgaacagtgaaggcagatag

SEQ ID NO: 37859 - DNA, 348 bp, Glycine max
  Peptide Sequence Number=SeqID_154637
atgacatgcggagatacccaagtggttatccgtacaaaccaacttctgttaatctcgacccgtgaagtcaggtggcaggcggaaataccccaagtggttattcgtacaaacgcacttctgttaatcctgacccgtgaagttaggtgtcaggcggaaataccccaagtggttatccgtacacacacagttcttctaccccgacctgtgagaagccaggaatttcaatatcttcatgtcgtcaatggttttactgcttggatttgcgctagtggccgatcgggtaaagattcagctcgaacgaaatttgtgtcttatctttacttccctttcatctccaataaaagataa

SEQ ID NO: 37860 - DNA, 775 bp, Glycine max
  Peptide Sequence Number=SeqID_154638
gcggcaggcccgatgacacgcggagataccttacggttatccgcacccttttgtcattcagacacagtcgtgtccgatggtacgcagagacaaaatttggtcattctgcacccttgtgtcatccagaggcggcaggcccgatgacacacggagataccttacggttatccgcacccttttgtcatccagaggcggcgggccggatgacacacagagacaaaatttggtcattctgcacccttgtgtcatccagaggcggcaggcccgatgacacgcggagataccttacggttatccgcacccttgtgtcatccagaggcggcgggcccgatgacacgcggagataccttacggttatccgcacccttttgtcatccagaggcggcgggcccgatgacacgcagagacaaaatttggtcattctgcacccttgcccgatgacacgcggagataccttacggttatccgcacccttttgtcatccagaggcgacgggcccgatgacacgcagagacaaaatttggtcattctgcacccttgtgtcatccagaggcagcaggcccgatgacacgcggagataccttacggttatccgcacccttttgtcatccagaggcggcgggcccgatgacgcgcggagacaccttacgtttatccgcacccttttgtcatccagaggcggcgggcccgatgacgcgcggagacaccttacggttatctgcacccttttgtcatctagaggcggcgggcccgatgacaagcagcgaccaatgtg

SEQ ID NO: 37861 - DNA, 530 bp, Glycine max
  Peptide Sequence Number=SeqID_154639
tgtttgatgagttcaagggggaactcgagagatgccactgggatgaagagttgactgattttgttgacgacaacattgatgttgccattgtgaaggaattctatgcaaacctctctgaccccgaggacatctcacctaagcaggatactctcaacacattcttgaagacccctgttgttgtggaagagggggaaacactttgtgcatattccagatttgcactcctgaggccagaccctcaggagttagctgttaagctctgtatcccatggaggggattcaagcttaatgctgatggttatccgttgaagatattgagaaagaacatgaccaccctagcgcagacatggagtgttctatccttctctaacctaattcctacctcctatacttctgatgtcaccctagatagagccaaactcatttatggcatcatcatgaagatggatatgaatttggggtacctcatttcccaccagatctccctcatagcacaacatgacaatccagacttggatatcgtgccttga

SEQ ID NO: 37862 - DNA, 192 bp, Glycine max
  Peptide Sequence Number=SeqID_154640
tataatagacaaaaaggaagcactgagtgtgggtattacgtgatgcattggatgtcaactataatcttaggaagtttcaagaataattggaaaacgtatttctatgatgctagaccattggaaccagagagattgaaggcgcttcacatccagtgggcaatgtattatttgaaagttagaaatgaaacttag

SEQ ID NO: 37863 - DNA, 1563 bp, Glycine max
  Peptide Sequence Number=SeqID_154641
atggaccagtttgccgggtatgccatcaccaccgaaaacctgccacgactgctgaccatgcatcctgcgctggatacctacagcgaatcgctgcggcagttttatcaagcggtgcagcacacaattattgctggcgacgggatatggggaacactgggggctgacacagctctggcccttgctgctgctgccactggcgatgttgccatggctgttgcgggggcagcagagttttgcccatccggcgttgcaagggttgccggaagaccctttgtctgcctggttggaccggctatggaagatggcgctgagcctgctgatactctcactcagcctgggattggccggaccttacctgaaggagatgcccaggcgagggtccccaagatggaggtggcgcgcaatgtactcaaaacgctggtcgcccaggggcatgacgacttaatgggtatggtgaccttcagtacctcacctattcttgctgcgccgctgggtaatgaccgtgcctttgtgcaggctgcactggatgccactgaggccggcggcatgggattcacagctgtggcgcgtggtttgggcatggcgcttgattactttgccgaccagccggtcacgggcgcacgcgccatggtgttggtctcggatggcggggcacacctggatggtaaaacccaggacatgttgcgcgccatgttcatgcgccagcaggcctcgctgtactggatttacctacgttctgaaagtggcgtcagcctgaagcagagcctggcagaaggtgaaaatattgatgcttatcccgagtatgccctgcacgagtatttccagaccttgaatgtgccttaccgtatttatgaggctgaaaatccggaggcagtgatggctgccgtgcgcgatatctcaacccttaaaaataaacctacccgttacctcgaaccagtcgcacggcaggacttgagccactatgcctactttctggcatgtggcagtcatgaatgcaaaactggcaggtgtcatgcggcgcgggctgctttgggcaagcgtgatcatcgtgatttcactggtcatgctggccaggcaaccccgcaggcgctgtttgccactgccgtgctttatgacaaccagctcaagcctgaacaggcgctggcccaatatgctgcggtggcgagtcggcggggcctgccagcctgggacgaagccgggccgctggtggcgctggccaaggaaagttaccagaaggctttgcgcatagcgcctgactgcaatacgaagatgagcaaatcaaggccgagcaagagcccagcggctggccagccatgcctggcaatccacgaggaatgccctgatggcgaagcgttttttggggccactggctgcgcgtctcagacgctggatgcctcgctggttgatggcagggaggcgacaggcggattggcgccagcgttgcctgttcctgatgctggtattgctcacattgattttgttcaaaccacattgggtgctgcccaaccgcgtctacgactggtattttgtggtggatattacccagagcatgaatgtgcctga

SEQ ID NO: 37864 - DNA, 471 bp, Glycine max
  Peptide Sequence Number=SeqID_154642
atggaactactttttttaagagctggacttagggaggaggaaagaacaagcatagctaggttccttagtgggcttaatatggaagtgaaggacaaggttgaactccatccatatagggacctagacgagctagtccaactttgtataagagtggatcaacaacttaaaagaaagtcttctttaaaatcttatggctttcactgttatccaaggaaggaccaagcccaaggaattttggaggttgcaccttcaaaacccaaggaagataaggggttttttctgctaacaccagctaggtattttagaccgacatcgggcatgactatttttagtcgacatcgactagtttgtaggccaaagaagagaaggtgcaaaaagctgtttatgaactcgcttagcgaggaagattggctaagcgagccttatccgctgagcgaggcaggttgctcgcttagaggatgggaaccctag

SEQ ID NO: 37865 - DNA, 306 bp, Glycine max
  Peptide Sequence Number=SeqID_154643
atggtgtttattttttgtgggaaatttggctttgagtgtttgggccttttccttctctgtttttgtttagtgcgtggcgagaaagtcgctagcgcacaagattttggttggagaccccaccattcctttttccgagggaaagaatggaaattctcatcttgggtcaaggttcatggtgagttgggattttggctcaaggcttgtagaatagctggacatgatgtatgtcagggtgttggtttggccagcggttcagggataaaggggatgtctcacattatttccatgacacacatgcaacaatga

SEQ ID NO: 37866 - DNA, 276 bp, Glycine max
  Peptide Sequence Number=SeqID_154644
atgattcaacctcgagaccttcacttccagaagctgcacttgaccggtgtgatgcacgcgctgatgctggtgccatacaatgcatgcacgttccagacgctgcacttgttccagacgcacgcacttgaccgaaagggccaccgtcagaggcagcagatgaggaggaacagtcgtcgtcggagatcacgtggtcgacgcgacgcttgctctttcgagagtgagggagtggaagcagcgcttgctctttggagactgaaggagcgtgaagaagagtag

SEQ ID NO: 37867 - DNA, 765 bp, Glycine max
  Peptide Sequence Number=SeqID_154645
atgccttggttcctgagggactttggttgcgtgctctcaaatggaatttttcactctggtcacaccggtcaagtgcgtgcgtctggaacaagtgcagcgtctggaacgtgcatgcattgtatggcaccagcatcagcgcgtgcatcacaccggtcaagtgcagcttctggaagtgaagtggctttgagacatcacatgtttgctatgaagtatgttgcagaaaaggttgttgctcatgttcgtaagctttcaaatgagagtgttggaagtaatggaagctcaatacgaggtagtgacatgtctaattttgggattccaaattcatctggttatagctctcatgaccttcctggatctgctatgcgaaggctaggcactgcaaaaactgatatggaggaccttatagttagattaaatcaagaaatagctgcaaaggattttcttgcaacaaaggtcaaggatttggaagtagaacttgaaactaccaaactgaaaaataaggagaacttgcagcaggctattctaattgtgagagaaaggtttacccaaatgcagtgggatatggaggaacttagacgacaatcattggaaatgcagaatgatgtactattggagaatttagatgctactaaggagcagctggaaattttgttaaaacagtatggagagctagaagccaaatccaaagcagatgttaaagttctggttaaagaggtccctcctgcaatttgcccaagaattttgggtcatgaggttgttgggtga

SEQ ID NO: 37868 - DNA, 285 bp, Glycine max
  Peptide Sequence Number=SeqID_154646
atggtctctaatctgaaagcagccaccaagagtttcaaatcggatgcattgcttggagaaggaggtttcagaaaagtatacaaaggatggttggatgagaagacactagcaccgaccaaagcaggttctggaatcatggttcctattaagaaattgaatcccaaaagtatgcagggccttcgagagtggcagaatgcaaaaggaaaatcattatttaagtggaggtacataggcacagtggacaatgcttatgcttattcgaaagagtggagttgggggtattga

SEQ ID NO: 37869 - DNA, 834 bp, Glycine max
  Peptide Sequence Number=SeqID_154647
atgaagggagtccggcataagctggagcgcagcaatgaggagagcggagtggagaagtggcgtaactggatgatagggatctgtctggtcagcacggccggcagcgtgtgggccgattcgctggatcagcaacgacagcgctatgcgcaaatcaaacaggcctgggacaacaaacagatggaccaggttgagcagctgatgccaacgctgcaggattatccgctctatccgtacctgcagtaccgcctgctggcgcaggatctcgatcaggagaccgggctggcggtgaaaaactttattcagcagtatccgacgctgccgccggcgcgctcgctgcagacgcgctttgttaacgtgctggcgcaccgccaggactggccgggcgtgctcagcttcagcccggatgagccgaagccggtgcaggcgcgttgtaactggtactacgccaaatgggcgaccggtcagcagcaggcggcgtttgacggggccaaagccatctggctgcgcgggaccgcgttaccgaacgactgcgacaagctgttctcggtgtggcaggcgtcagggcagctgtcgccgatcaccatcctcgaacgcatccgcctggcgatgaaagccggcaacgacagcctggttaattatctggcgaaaatgctgccggcggattatcaaaccaccgccagcgcgctgattgcgctgcagcagaatccccagaccgtcaccacctttgccagcaccctcggcccgaccgattttacccgcatggccaccagctacgcctttgcccgcgtggcgcgtcaggatatggacaacgcgcgcatgatgatcccgcagctg

SEQ ID NO: 37870 - DNA, 951 bp, Glycine max
  Peptide Sequence Number=SeqID_154648
atggcatcgaccttcggttttacgcttcaggattggcaacgttgcgcacagcaggatgcacagcagatccctgcactgctggccgcacatctcgacgcactcgataaccaggataatgcctggctgtacctcgcttcgccggcccagctgctggcgcaggttgaaccgctgctggcggcgtatcagcgcaatccggccgcgctgccgctgtttggcgtgccgtttgccgtcaaagacaacattgacgtggcaggctggccgactaccgccgcctgcccggcgctgacgtatcaggcggcggccgatgccttcgtggtggccaggctgaaagcggcaggcgctatcgtcatcggtaaaaccaacctcgaccagtacgcgaccggtctggttggcacccgctcgccgtatggcgcggtgagcaacacctttaatccggcctatgtcagcggcggctccagctccggctccgcgtccgtgctggcgcgcggcctggttggcttctcgctcggcaccgatactgccggctccggccgcgtgccggcaggttttaacaatatcgtcgggctgaagccgaccaaaggctggttctcggccagcggcgtggtaccggcctgccgtctcaatgacaccatctcggtgttcgccctgacggttgccgacgcctttagcgtcgccagcatcgcgggcggctacgacgccgatgatgcctatgcgcgccagtcgccgcgcagcgcaccggccagtttccagccgcaaccctcgctggcgatccctgccgcgccgcagttttacggtgaccagcaggcggaagcggcgtggcacagtgcgctggagcagctcacggcgagcggtgcgacgctgcaccctatcgacttcgcccctttccatcagctggcagagcagctctattacggcccgtgggtcgccgagcgttttttggcggtcatttag

SEQ ID NO: 37871 - DNA, 387 bp, Glycine max
  Peptide Sequence Number=SeqID_154649
atggcctttgaaactcgtgacccattttttatttgtcaggaaggtgagaatcctacattgatagagtgggatcgctttgctcatagagaatatattaggctttcaatggaagaagatgtagaggatgcctctaacggtagtctagaacttctaggcctaggatcttcttcaccaacggatttctttgcttcatggaagatgaatggcagcggaatggagaaggaagagagagaggagagatgccacttcaaggagaagatgagtctagaagaagctcaccaccataggaggccatggataagagcttggaggaagaaggagatgaatgaagggagagggagagaagagcacaaaattttgtgctctaaaagagctctgaaatctgaa

SEQ ID NO: 37872 - DNA, 174 bp, Glycine max
  Peptide Sequence Number=SeqID_154650
atggacattctcaccctgggtcaaggtttatgccaggggttcggggataaaggggatgtcccacattatttccttgatacacaagcaataatgatgattaggaaatttcatgcaaaactggtcatgcatgcacacatgtggacactcaagcctcaagtttttatggtcatgtga

SEQ ID NO: 37873 - DNA, 273 bp, Glycine max
  Peptide Sequence Number=SeqID_154651
atgatgcttctagcacactccagacatcttctcgaagatcccaacggtcagatcatggacaattgtcttgtgaagtttcagaccaaatttcgagaagatccaacggttaacaaaggctggacagcatttttaccgaggcagcttcatgtagctttctctagaagcttcattaagaggcttcctccagaagcttcattaagaggcttcttccaaaagcttcctcgtggcttctttgagaagctagatccttatctatccacactcctctattaa

SEQ ID NO: 37874 - DNA, 372 bp, Glycine max
  Peptide Sequence Number=SeqID_154652
atggactatgttatatgggagcatcatggggaagtgattagtgagcctaatgaatttgatgatgatgatcagaataattgcaatgatggggtttatgatgttatacatgacttcacaaattgctatagagatgaggtggccaaagatagaaaaactgaagatgggcaattgagacatccaactgattcgattacttggcaaactcttgactcaaaatattcatcttttgcggcaaatccacgtcctatggctcttggaaacgatattgatgtatatctacaacctttaattgaagagttgaaggaattatgggagaaaggtgtagtgacatatgatgcgtcaaccaaagaaacgtttaggttatatgcgtga

SEQ ID NO: 37875 - DNA, 276 bp, Glycine max
  Peptide Sequence Number=SeqID_154653
atggaggatttgggagagttaactttagtgcagctggcaccactggagcaacatgacattgaggaatttttaaaagttgaagaacttgaatgtacaacattagccattgaagagaagttatggatgagcattgatgaacttctagaggagaacctagacttctggacgaaattcaagataactatggcactgaaagccagtgctgaagatgatgacttcaagttcaccagctatcaagcagccaagttccaagatgaggttttgaacatgaagtaa

SEQ ID NO: 37876 - DNA, 933 bp, Glycine max
  Peptide Sequence Number=SeqID_154654
atggaggaaaaggtgcacactgttttaaagctcctagaggaagagggagactcatttgccaagagagcagaaatgtattacaaaaggagactagagctgataaactttgtggaagaatcatttagggcataccattctttagctgataggtatgatcacatatcaactgagttgcaaaatgccaacaacaccattgcttctgtgtgcccagatcaagtcccttatatggatgatgatgaccaggattcacatagggcgaaaaccccaataaaaatgccagaagggtacaaaccaaatattccaaaggttctaaagcctccacttagagatttaaaaagtgtcataacagccacaaagaaactcaatcccaagaaggtagcatccacagctggagctaataaagttcaaaaatctggattgagcagaaaggaggcgcttacagaggttgacaagctgcatatagagattctggaattacaaactgcgaaagagtttgtgaagagtacttatgataatgctattaccaggcactgggatactgagcagcagatccaaggattacaagagaaagtgtccaatttgcaagatgaacttggagaaggtgttgttatggatgacgaggaagcccgatgtttgatggccgcagcggctcttaagtcatgccaagagacattattgcagttggaactgaaacaggctatttcacttgatgagaccaaaattgagaccaaaagggtaacggaagcaagggaaaagttaatttctctcatgaatgagttccattatgatcaaactaattccaaagatccaagggccaaaagaggtgtaaaagaaatagctggaaccaaggacttggatgtagatgtggacaatttgaatcaacagagacaggagttgcagcaattgcaggagaaaaataaaagaacactttga

SEQ ID NO: 37877 - DNA, 444 bp, Glycine max
  Peptide Sequence Number=SeqID_154655
atggctatccctttgatccgtttggcatggtcaatgtggggtgggaggagaaaggagaaaaaggcagtttccaaagcctccactctgaattccaaacaatcctctgaatggggtcttgctaaggagacaaagatggccccaccacaaaggaaagttggaaggagcaaggaagagaggagagtgcatatagagtacgatgatgttgtgttggttgcatctgatgatgattgtagtagtgactggtgcttgtccggttctgaatctgatgactcagattggtccattgggtggtcggagcctctagcctctgattttcggagcaatggtgatggttttgcagtgcttgttccttgctataaacctagctgcaaggtggtggaggcctcaaataaggcgcttttgggtttaatcaagaacctctccaatgaattttcttctggatga

SEQ ID NO: 37878 - DNA, 684 bp, Glycine max
  Peptide Sequence Number=SeqID_154656
atgaggaatgttatggcttactggcttaatcaactccagtccatgatggcacagcagggcaatcccgtctccgctgaaaaatcttcatccgctaaaaacctgctgcccggcgccttgggcgacattgctggcttgttggtcgccagcaaatcatcgcgtaagctgctggcgaaatatggcaccggcgcgctgctggttggcggtggcacggtggccggcagcgtgctgtggaataagtatcagcaaaaaatgcgcggccagcaggcagatatcgcgacacagacatcaacagcgtctacccaggaaccggttgtgctcgatgcgcgcagcgagcggctgattaccgcgttagtcttcgccgccaaaagcgacggtcatattgacgagcgtgaacgtcagcatatagaagagcagttgcgagcggcgaacatcgacgtgcagggccgggtgttgatcgacagggttttaacccagccgctcgacccgcaacggctggcgcaaagcgtgcgcgatgggcaagaagcgctggaaatttactacctcagctgcgcggtaattgatatcgaccattttatggagcgcagctacctggatgcgctcggtgacgcgcttaaactgcctgaagatgtccgagaagagatagaacgcgatgttcaggcgcaaaagcaggcgcttgattcttaa

SEQ ID NO: 37879 - DNA, 465 bp, Glycine max
  Peptide Sequence Number=SeqID_154657
atgagcgatctcgcgctgcaacgcgcgcaggagatcgcccgcaaagtggtgctggcgctggggggatatggactgttcggcgttgaattgttcgtttgcggcgatgaagtgatcttcagcgaagtctcccctcgcccgcacgataccggtatggtcactctgatctcgcaggatctttcggaattcgccctgcacgttcgcgccttcctcggcctgccgatcggcgccatccgccagtatggaccggcggcatcggcggtgattttaccgcagctaaccagtgagaacgtgacctttagcaatctacaggccgccgtcggcgcgagtctgcagttgcgtctgttcggtaaaccggagatcgccggcgcgcgtcgcctgggggttaccctggcggttgctgacaacgtcgatgaagccatcagccgcgccaaaaccgctgccgccgcggtcgtcgtgaagggataa

SEQ ID NO: 37880 - DNA, 897 bp, Glycine max
  Peptide Sequence Number=SeqID_154658
atggacgagtttaaggctgaattggagaggcgtaacttccataaacgcctcaccaatttatttgacaacaacatagatctagctttggtgaataagttttatgccaatctttacagctccgaaggaccttcaccaaagcaagtcagggtaagaggccacgtggtgaagattgatgcagacagcctcaacacttttctggaaacacctgtggtactagctaagggtgaaaccttactcgcatattccagatattgcaggttgctcgctgatattagagaaattgaggctgccttatgtatcccaggtcaggggtctgttttgaatgttgaaggccacctagggaagattctcaggaaagatttaacaactcttgctcaggtgtggagtgttcactcgtactctaacctggctcctacttcccacacctcagacctgatagtagatcaagctaggctgatctttggcctagtctctcagatggacatgaatgtgggagctttcatctctggtcagattacatctatggcccagtctaactcttctagacttgggttgcttctgacagcctggaaaaactgttggaaccctgatgatctaacaattactatcagaggggccaggagagcgaggacaagaccagttgaggccccttccatatctatagctccttctccagcatgtaccctagtagctccttctgcctcagctcctgcagattttcagcgttttgaagccatgcttcaaagcatccatcaggggcagattatcttattacaaagtttacagatggtggcacctccagactttattccttcagtagagcagtttaatgagtgggtagtctggcccggaactcagtcttctcttcacagggaagatgaaggtcccacaacccag

SEQ ID NO: 37881 - DNA, 246 bp, Glycine max
  Peptide Sequence Number=SeqID_154659
atgttgctaaataataacgtcatccatatccatgtaagagtggtcatgttggtgcgcatgatccgcactcgtctttttgcagtggcacgggtgaaatcttgccccagtatgcatactagatgcgtgatagcctccctttctggatgtgctcgcacagttggtcgccctccaatatcagggggtggcccaggaactgataaaaggaaactaactggccccttaaccgggagcgcaagtctcagttaa

SEQ ID NO: 37882 - DNA, 531 bp, Glycine max
  Peptide Sequence Number=SeqID_154660
atggacccgaagaagtccaacagggtcctggggtttccagctctggttacgggcctctgtcagtcctacagggtgcccgtccccccagcgaggtcatgccatcgtgacataggtaaggatcgcgcccacaagacacccagtggacccaaagaagtccaacagggccctggggtttccaactctgattacgggcctttgtcagtcctacagggcgcccgtcccccagcaagttcatgccatcgtgacataggtaagggtcacgcccgcaagacacttagtggactcgaagaagtccgacaggtcttggagttgccagctctgattacgggcctttgtcagttctacggagtgcctgtcatccccagcaaggtcatcagcccccctactaatcgagctttcatcaagaagtactgcgtccccaagcaggcgcagggcgaaacaccacagcagcctggggatggccggcagcgagcaacagacgcatcgccatcacctctagagttcacctcagctcatccacaaaaaggttag

SEQ ID NO: 37883 - DNA, 381 bp, Glycine max
  Peptide Sequence Number=SeqID_154661
atggacaacataagattcaccgcacctttcagagttcaaaagaaccttctccaagttccttttacctatcacaggcaatggctgcacaactaccccaaatacgttttattccactacgatggcgagatacatttcattagggtaagaacactcggtactaaatgtttttttgctgatggcttgaatgattttagaagggcacacaacctccacgaaagcgtgattctacgtttggtcgccggtgacaaaaacaccactttcaccgttcatattgacggacttgcacaccaccactctaacctaaaacccatcatttatagaaggagatacatctttactgttgatatcacagatgatatgcaacaacagaacctaccttta

SEQ ID NO: 37884 - DNA, 540 bp, Glycine max
  Peptide Sequence Number=SeqID_154662
atgagcaacattaccatctatcacaatccagcctgtggcacctcacgtaacacgctggagatgatccgtaacagcggtaacgaaccaaccattatttattatctcgatactcccccgactcgtgatgaacttagcaaactgatttcagatatgggtatttcagtacgtgcattgctgcgtaagaacgtcgaaccttatgagcagttgggtcttgatgaagacaaattttctgatgagcagttgattgattttatgcttcagcatccgatcctgattaatcggccgattgtggtgacaccattgggaacacgtctgtgccgtccttccgaagtggtactggatattcttccggatgcgcaaaaaggcgcatttgctaaggaagacggcgagaaagtcgttgatgatgcagcaccatatcacgatggtaatgaatttatacctttcattatgcaacagcagataatgaaaccgatgtatcaagctgatcgaccatttcgcagatttgcgattgttcatagctcaggaccggtcgttgcttaa

SEQ ID NO: 37885 - DNA, 387 bp, Glycine max
  Peptide Sequence Number=SeqID_154663
atggcgaaagaaggagaagaaatgacatttttccaaagctacttggactacaaggctcaaaacgcacaagtgagtaatgccctcagaaacggaaacgtcgtacacactccagacatcttctcaaacatcccaacgatatatatcagggtgttacacgatacagtggcaagattcaagaagactagacaaagagtaaaagaaccaatgattctattttcgtctgtgagcaggcctcactttgctactcttgaagggctccgagactatgcttttttgagttgggagatgaggggttggtatacaatgtatctatatgtagtgatcgcacccgactgtcatccagatgatttttgtaagaccatcaagacctggaaggattggtggtag

SEQ ID NO: 37886 - DNA, 375 bp, Glycine max
  Peptide Sequence Number=SeqID_154664
atggacctctttggtcacaacaaacttgaagagaagaagaaaaacaagtttttgaagttttggagttttatgttgaatcttttttcatgggtcatagaagctgcaatggtcatggccataactttggcaaatgcaagaggtaaatttcttgattgggaagattttgttgggattttcatgctccttcttttgaagtcaaattttatagaggagtataatgttgcatctattatggcttgcttggcatcaaaagctaagtttctttgtgataaaaaatggattaaggagtttgcatgcattaatgtttcaaatgatataatttatgctaagcaagaggatgcaaatgtttgtctacttgaatgtgatcctccatag

SEQ ID NO: 37887 - DNA, 1197 bp, Glycine max
  Peptide Sequence Number=SeqID_154665
atggggaaccctcccttaaaacctagcttccaagggggcaaaaccaagccacttaagtacttcactgaacgtcccatactacttgatgtggaattaggcacccataatacttatgtccctatcataacattgcccctaagagtggatgagtcagtagctaattttcaagttggtaccacagcaggttccgaccgtcgtcctccgccgctggccgccatcatctccggcggatttttccgacgagaccaaggttcggatcgcctcgaaaagcgcaatccacccctagaacttgcaccaccatcggacgccccacgcgccgcttcttcctcgcacgctttccggcgcgtgcagctcacgcgccgccgtgccggcgtcggaagctgccccttccggtctcggcagcttcgtcatcgcctcctgggtgcgtttcaggcctcacctccttcttccaacaagccgtttggtcagctcttgtgtgttttcctctcttgtgtgttagggtttgctctgaactggaaaaactacccttcgtggtctgcttccgtggagttgtggttccttggtcaaggacaccatgaccacttggagaaaacctcagattctgtttcagatgatgaaagacctgaatgggaaaagcttgattatcaactgtgtgtcatgttatggcaatcagttgagccggatatcttggaaatccttcgatcatttaaatcatgtcgttccttttggaagaaagcccaagaaatctttgccaataatatccaaagtttgtttgatgcaaccatgaaagttacagccctcaagcaaatcagtcatgacatgatcgctcatgtgggtaaggctcgagctgccgtggaagaactgaaaaagttccttgtagctgattcattagaagaagtgaataggaaacttgacaagttctacatggttcttattttgagaagctttcattcagactttgatcatgtgcgtgatcaagtacttgctggagaccagattccatcgatggattccctcatcactaggcttctccgcgtgcctcatttattgaaggatgagaatcctactgatggagtggagacgtcagccatggttgcgtctcgaggaagaagaagtagccgcaacaatagaggaggtcgcagtggaaggggaggacgtcctcattgcactttgttgaatatcttttggggtttctaa

SEQ ID NO: 37888 - DNA, 294 bp, Glycine max
  Peptide Sequence Number=SeqID_154666
atggctaagactatgctatgtaaaaactcacttcctaaacatttcttggaagaaacagctaacacaacttgctttgttcaaaatagaatattgataagaccattgattaaaaagactccttatgaactatggagaggaagaagacccaatacttcaaactttcatcctttcaaatgtgagtgttttatcctaagcaccatagaacttgttaaatttgattcaaagattggttcgtatgttgcacccaaggtagatgaagtcaaacagtctgatgaaatccttcctcagacttga

SEQ ID NO: 37889 - DNA, 357 bp, Glycine max
  Peptide Sequence Number=SeqID_154667
gtgtatcatgagactcataaatgcaaggacctccttgaaaaggagaacccatcaaagggttggtccagtgcttgccagcacccccaagctaacaaggaaaaaggacccaaaaagatttgggtacctaagattaaaataatccctattgcagatctccttcatagaaggaaagaaacaccactcatgcaacaagcaacgacagctcgtggtagtcaccggtggtcgtgggtggtggaagataagtttctagggtggtttggatggtgttttgagagggagaggcgtaaaattatgtttttcgcactgaagaacatatttataatctatagatctcgcttagcaagctcgtctcgctaa

SEQ ID NO: 37890 - DNA, 630 bp, Glycine max
  Peptide Sequence Number=SeqID_154668
atggttcctgggcagccccctgatcctggaggagggccaactatgcaagtacaaccagaggaggaggctatcgcgctgctactgtgtataccggggcaagatttcacctgtgtcgctaccgggagacgggtgcggatcatgcgtaccagcatgactactctgacccagacatggatgacgttgctgcttagcaacatcttgcctagcgatcataatttcgacctccctcagccaaagtgtcagttggtgtatgccatcctaacacggatgagcgtccacgtggcccaggtgattgctgacgccatctatttgtttgcaggtatggcgcctaccaggcaccctctggacccagataagtccaacagggccctggggtttccggcgctgatcatgggcctctaccagtccttcggagttcccgtcgcccccagtaaagtaatccgaccacccatcacccgggccttcattgagaagtattgcacggctagacaggcaccgggtgatgcaccacaggccgcaggcgcgccgccaccacctcatcaggctgacccagctgggtcatttgacacggagcggtacttgcggcactcgattcgccagcacacggccaaccacagggggctggggcag

SEQ ID NO: 37891 - DNA, 291 bp, Glycine max
  Peptide Sequence Number=SeqID_154669
atggtcttggaagtccaaactcaggagcacaggtcgcttgagcaaacagaccaatggcttgcacccacttccggattggcacgcgattctcctcaaatttcagccggcccatatcaattagaccttgcaccttacgcttcagagccctacaatgctcaatggaacgccccggggcttctccgtgacaagcacacgttgcgttcgagtcgtattctaggagaaatggagattgatgaacctgttatggctaccattgaattatcaagtagatatgggagcaagtcagcatag

SEQ ID NO: 37892 - DNA, 156 bp, Glycine max
  Peptide Sequence Number=SeqID_154670
atggagagatctggcagctcaagtagtgccctcgatgatggagagagagatgataacaatgataatggacacactgtcggttttgcagatctagtgtttgctggcgagaaaattgaagtaggtttgaggaaaaggtgtagatgcaattggctttga

SEQ ID NO: 37893 - DNA, 702 bp, Glycine max
  misc_feature (12)..(12): n is a, c, g, or t
  Peptide Sequence Number=SeqID_154671
agggactacacngtcctcgccaacagagggccacacgccctcaccttcataggactacacgtcctcgcattcataggactgcacgtcctcacctttagacggctacatgccctcgcctttagaggactacacgtcctcaccttcagaggattgcaagtcctttcattcagagggctgtacctcttcaccttcaaagggctgcacgccctcgccatcagagggctgcacgccctcgccttcagagggctacacatactcaccatcataggactacacgtcctctactttagagggctacacgccctcaccttcagaggacaacatgtcctcaccatcgaaggactacacctcctcgccattagagggctgcatgccctcgccttcatagggctacatatcctcaccatcagaaggctgcacgtcctcgccttcagaggactacacgtcctcgccaagagagggctgcacgccctcaccttcagaggactacacgtcctcaccttcagaggactgcacgtcctcaccttcagagggttgcacgccctcaccaacagaggattgcacggcccagccttcagagggctacacgtcctcaccttcattggactagacgtccttgcctacataggactacacttcctcgccatcaaaggactacacgtccttgccatcagacggttgcacaccctcgccttcggatag

SEQ ID NO: 37894 - DNA, 1158 bp, Glycine max
  Peptide Sequence Number=SeqID_154672
atggtgacaagggtcgagaaagggggaaaatcctttggtttggggtgtgatcctgttgtgggatcattgattcctgcaaaaaagaaggattacaaagtcaccaatcgcctccaagaggggaaacgccctttgtacgccatcgttttcaataccatcgactttcgttatcgcgacattttcgctacagttgggggcaacaagccactctcaatccttttcgtgggcggtggcggtgcagatccgaggctcgcgacatggagtattggaagctctgttactgtttatcaatgccttgatgaaggggatattgctgttttgcaatcttatgcggatgaggataagaatgagtctttttacaccgtgggttgggcatgcaatgttgacgggaccccacttgttgtggctggaggactcaatggggtaatccgagtcattgatgctggcagtgagaagatacataaggtttatcaggatgaatctattcggttatggaatgctcatactggaatatgcattttgatatttgctggaggcgggggacatcgtaatgaagtcttaagtgttgattttcatccatcggatatgtatcgtatttgtagttgtggcatggatagtactgtaaaaatatggtctatgaaggagttctggacatatgtagaaaaatcatccacatggacagatcttccttccaagtttccaacaaaatttgtccagtttcctgtttacactgcttcagtgcatataaattatgttgactgtaataggtggttgggtgattttatcctctcaaagagtgttgataatgaaattatcttgtgggaacctaaagtgaacgaacaaactccagggaagggtgtagttgatgttcttcataaataccctattcccgattgcaatatctggttcatcaagttttcttgtgacttccatttcaacatagttacagtgggtaacagggaagggaagatttttgtttgggaattacagtcaagtcctcccgtacttgctgcaaagttgtcacatcctcaatcaaaatccccaatcaggcagactgcaacatcctttgatggaagtactatattgagttgctgtgaggatgggacaatatggcgttgggatgtttcaaaaccctcaacctcaacctcaaccgcagcctaa

SEQ ID NO: 37895 - DNA, 3759 bp, Glycine max
  Peptide Sequence Number=SeqID_154673
atggaatcaatactgggtcgggctctggagtacactctcaagtactggctcaaatccttctcccgcgaacagttcaagctccaaggccgcaccgttcacctctccaatttagatatcgacggcgacgccttgcattccagcgtcggattgccgccggcgctcaacgtcgccaccgccaaacttccgtcggtgagcaatgtgcaaacggagcctatcgtggtgcatattgatagactcgatctggttctcgaggagagttctgattctgatgaatctcttagttcgaactgttccacgccgtcggctgcctccgtcaagggaagtggttatggtttcgctgataagttcatactgactgcgggtgattgtcagattgcagatggcatgactatacaaattcaaacagttaatctattacttgaaactcgtggtggttctcgtcgccaagtgggagcaacatgggctccacctatggcatctatcaccatacgcaatcttttgttgtataccacaaatgaaaactggcaggttgtaaatcttaaggaagcacgggaattctccagtaacaagtacatatacgtcttcaaaaagctggaatggcaatctttgtctattgatcttttacctcatcccgacatgttcacagaggctgcattaggccactctcaagagggatcaaactttagggatgatgatggcgcaaagcgtgtattctttggaggagagcgttttatagaaggagtatcaggagaagcatatatcacaattcagagaactgagttgaatagtccacttgggcttgaggttcaattgcacatcaatgaagctgtttgccctgcattaagcgaaccaggattacgtgcacttctccgctttatgacgggagtatatgtatgtctaaacaggggtgatgttgattccaagattcagcagcgatccactgaagcagctgggcgttctcttgtctcaattgtcatagatcatatatttctttgtattaaagatactgaattccagcttgagcttttgatgcagtccctctgcttttctcgggccagtctttctgaaggagataatgataataacttgaccagaattacaattggtggcttatttttaagggacaccttttgtagccctccatgtatcttagtgcaaccttcaatgcaagctgtcacaaaagatgctttccatgtgccagaatttgccagaagcttttgccctccaatatatcctttacaagaacaggagtggcaattgatcgagggaacccctctaatatgcctccatgctcttaagatcatgccttctccacttccaccatcctttgcttctgaaactgttattgactgtcagcctcttgtgattcatctccaggaagaatcatgcctgaggatatcctctttattagctgatggaattgttgtcaatcctggtgacattttatcagatttctcagtgaaatcttttattttcaatctcaaaggactggatcttacagttccttttgacaagaccaaattggatatttccaaaagtgacatggacaatacagtccagacctcctttgctggagcaaggcttcatattgaaagcctttgttttttaaattcaccctcactgaaactaagaattctgaacctggagaaggatcctgcttgcttcagtctttgggaaggtcaaccaattgatgctagccaggagaaatggactgctagagcatcccagcttactttgtctctggaagcatgtactgacagaactggatgtcaaaattcccttgaacagacatcaggattgtggagatgtgttgatctgaaagatgcttgcattgaagtagctatggtaactgctgatggcagtccattgttacaagttccccctcctgggggtattgtcagggttggagttgcttgtgaacagtatctgtccaacacttctgttgaacaattgtttttcgtcctggatctatacggttattttgggagagttagtgaaaagatagcaaaggccggaaaaaggaaacaattggaggacattagggatacatcttttagtggaaagctgatggacaaggttcctagtgatgcttctgtgagtttatcagtgaaaaacctccaacttcgatttctggagtcatcttctgtgaatattgaggggatgcctttagtgcaatttgttggagatgatctgtttactagtgccactcatagaacccttggtggggccattattgtttcatccattttacgttgggagagtgttgtgataggttgtgtagatgatgaggggcacttgccgtgtgaaaatggctcgttcttgagttctaaggaaaatgctctcttattgagtgataatggatatcctcaactaagaactgttttctgggtgcataagaacgagaaacatctattgaatggaaatgctcattcagtcccttttctggacataagcatggagcatgtcataccattatatgaacaagatttggagtctcatagtttgaatgtctcagcttctgtatctggtgttcgtcttgctggaggaatgaactatgctgaagccctcctgcatagatttggaatacttggacctgatggagctcctgggattggtctctgtaaagggttggaaaacttacaaaaaggaccattgtcaaaactttttaaggcaactcctctcattgttgataattcagaagatgttggaagtggaagagaagggaaagaaactggttttcctcaactgaaaaagcctggtgatgtggatgtaactgtagaattgagagactggttatttgcccttgaagatgcacaagagacagctgaaagatggtggttctcaagccatgtagatgaagacagagaagagaggagttggcatgcatctttccatggtttaagagtaaatgcaaaaagtagcccaacgaatattccagatggaaaagggcaattgcaaagaataaaacaacatccagtagaattgattactgaattgtcaaacttgaaaaacaccccatttttgtcattgggagggtgcgggggtagcttagatggatcattagacctattacctttttctttctgttcacaagttggaattcaaggtctgcaaatcttgaagcctcatttgcaaaaagacattccttcatcaacacctattgcaaatgggggtaaaggattcaccaacacagttggaggaattggtgttgaagttcgcttgatattgggtggggagaatgttgatgatgaaatggtcaattgggaagtggaaaacctaaaattctctgttaaacaaccgattgaggcggttgtaaccaaggatgaggttcagcacctcacttttctgtgcaaatctgaaattgactcaattggccggataactgctggaattataaggttgctgaagttagaaggttctgttggtcagtctgtaatagaccaactcgggcacctaggaagtgaaggcattgataagattttctcttctgaaaagtacagtagagacggaagtgttggtagtagaggactttctccattgccgaatctcaccataaatgaggaatcacacaaaacttcagagcaaacattgactttgcttgaggaagcacttgtggattcacaggctaaacttaatgatttaatcagtgatattggtacttccgagtcttcttcctctcaacaccttaccgtcatccgacttagtcaaaagatagagactatgcacgacctgttgatgcaattacggaatcaaatctga

SEQ ID NO: 37896 - DNA, 642 bp, Glycine max
  Peptide Sequence Number=SeqID_154674
atggcttccacagtgttctcatatccttctcctcttcatcttaaaacctatccacacaaaacatcatcaaacccttcagagttttccattcacatccaacccaaaaagcacttttccattagatgcacatctttggactccattcctgaggctgagtttccaactccagatccttcctcaagcacagtgaacagtgcagagtcctttcccattgagaagagaaggaggtcagagatagtgagagagagaagaggagaaaaactagtgcagccagagccaccaaactttgaaataggttggaagaggaccaaagagatcaacctagagaggccaatagggcatgtcatagctgatttcttggagaagctggagaccctcatggagaaggagtttggatcaacagaacttctggctaaggttggggagattgtggccgagagggcaagagaggaggctgagattctcatggatgaagggaaagtggaagagagaatggtgactgaattgtttagagtgttgaagttgatggagatggacttggcaatggttaaggctgctgtgaaggaggagactttgggtgagaggcttgagctggccaaggcaaggtgcaggcaagccatacttgttgcttattccttttga

SEQ ID NO: 37897 - DNA, 267 bp, Glycine max
  Peptide Sequence Number=SeqID_154675
atgaaggagattttgaagctgttggaaatcatagacataaaaaacctttcatctgctgaatctgtagcaaaggtatttcaagcattaggaagattactattggaacctcttgcggagaagttccttttagacttcaaaacaagtgatcatgaagcagataatattacaaacttcattgctagttatgctgttagcattccagatttatcgataagaaatatctcacaaatggtgctgataatttctgtgaggccacaatactattaa

SEQ ID NO: 37898 - DNA, 1259 bp, Glycine max
  Peptide Sequence Number=SeqID_154676
atgggtgtcaattttgtggctaattgcggtgttatagtaatttacttttcctgtctcattcttccctttccttcctcttgtttcattaatcaggatcttattatgcgtggtgacaaaagtatccccctttacagtagagttgtggatgcacagtcacctatggcagtagttatccctaccaaaggatctgaatttagcatgaaactgcgtaatggtgacgtctcttggcatgattttttggagaaagtcaataatctcaaaggcaaggaattcatagctactgaacaaccaatagagacattcacaaacattctcttttcttctggaacaacaggtgatccgaaggcaattccatggaccaatattactcctctaaaagctgctgcagatgcatggtgccacatggacgttcgtaaaggtgatgtagtgtgctggcccactaatcttggatggatgatggggccgtggctagtatatgcatccttgctaaatggagcttcagtggctctgtatattggatcccctcttgggtctgcctttgccaagtttgtacaggatgctaaagtaacaatgcttggtgttattccaagtattgtacggagttggagaagtacaaattccacatctggctatgattggtcttctatccgttgctttggctccactggtgaagcatctaatgtggatgaatacctttggctgatggggagagctctctacaagcctatcattgaatattgtggtggtacagaaattgggggtggatttgtttgcggatcactactacaggctcagtcattagctgcttttagcacaccagctatgtgctgcagtttgtttattcttgatgatgaaggccttcctattccacaaaatgttccaggaataggtgagttggctcttggtccgctcatgctaggggcttcaaatacactgcttaacgctgaccattacggtgtctatttcaaaggaatgcctctcttgaatggaaaggtattacggaggcatggagatgtatttgagcgtactgctagaggatactatcatgcacatggtcgttcggatgatacgatgaaccttgggggaatcaaggtgagttcagttgagattgaacgcatatgcaatggagtagatagcagcattctggaaacagctgcaataggggtaccaccttctggtggtgggcctgagttgttgactatagctgttgtattcaaggattcaaatagcacaaagcaagatttacaccaattgaggat

SEQ ID NO: 37899 - DNA, 417 bp, Glycine max
  Peptide Sequence Number=SeqID_154677
atgtttgagttgggccaacttgcccaagcgagcaaaattttgcctgagcgagccttccaggttgcaaatacgaccaacaacgagaaaatacacatttttcactctctctctctctctctctccaaaactctcacccaaaccctaaaacctcctcctccaccactcacgaccactggtgactgccacgagccgctgccacttgccaccagaacaccacatagagaggatcactttaatcggagcagaatatccaaaactcaactcgaggattcagtagagaacaaagccttcaaccctccctttgggcttcttcgagagctctgtgtttggaccaaaggacgtgaacctaagagatatcaaaaccgccacaaggagctaacgagagaatatacacaggtgaggggagtttatggttag

SEQ ID NO: 37900 - DNA, 120 bp, Glycine max
  Peptide Sequence Number=SeqID_154678
atgtcaggggcggagcagggtgaggtagggaaaacccgactcccgtcaggggcgaggatggaggcacgggaaaaatgggaaattggggatgggggcgagataagcaaaaacatatcctga

SEQ ID NO: 37901 - DNA, 450 bp, Glycine max
  Peptide Sequence Number=SeqID_154679
atggataattctaatgatgaatggtttgttaacttggaagatgacaacgatgttaattctagtgatacaaatagttctaatggaagtgatgctgaagtggatatagatgttgacaatgaagaaggggttgaagatgttgacaatgaagaagaggctaaagatgttgattgcatagggtttaaattaaaaaatttaaaggatgtcacaacagatgacattacacccatagagttttcatgtgaacataatgcatataaattttatattgcttataccaaatcccatggatttgggattagaaaagattatgtagattatgatatgaatcataatattataatgcgtcaatttgtatgcaacaaaaaaggtttaagagacaaaaagcatttaatgagggataataggaaaaaggatcaccgatctctaactcgtacaaattgcaaagcttag

SEQ ID NO: 37902 - DNA, 138 bp, Glycine max
  Peptide Sequence Number=SeqID_154680
atgtacgaaaacccaaaagacgatggtcagcatattttgaaaataagggttcgggagttgtttacgcatggggaagttgacaagggtgttcccctcgctcctacgtattcctcaattgaggaaatcagacctatgtag

SEQ ID NO: 37903 - DNA, 717 bp, Glycine max
  Peptide Sequence Number=SeqID_154681
gttcgtgaaagccaaccaatgggagagccaagatcttctgcaacatcatcaccacctccgccaccacctcaaccaccaccaatctccctcgtccaaccctcccacaaaaaacgccacaaacccaaagtcatccgcgtcttccgctccgtcttccgttccctccccatcataaccccctcctgcaagttccccatcgaccccacccaccaccaccaccaaaaaaccgtcgccgccgtcaacaacgccgcaaaaatctccggcaccctattcggccaccgaaatggccgcgtcagcctctccatccaagaaaacccccgctgcctcccctccctagtcgtcgaactctccatgcaaacaaccactcttcaaaaggaaatggccgcgggaatggtgagaatcgcgctcgaatgtgagaagcgttcggaaaaagacaaaacgaagatcatcgaggagcctctatggacgatgtattgcaatggaaagaagagtggttacggcgtgaggagagaggcgacggaggaggacttgcacgtgatggagcttctaaaggcggtgtcgatgggtgccggcgttcttccggttagggctgacgtggacgacgccgatggcgggggagagttggcgtacatgcgggcaccgttcgagcacgtagtggggtccagggattctgagactctgtatatgttgagtccagaccaggggaacagtgggcccgat

SEQ ID NO: 37904 - DNA, 341 bp, Glycine max
  Peptide Sequence Number=SeqID_154682
gaacgaggataagggctacgtgggagtacgtgagctcagttggaggtgggcaacaggggatggtgggttatacgtgatttatggatatggagaattgtcttgcaccatcgcccgaccgccacctagtaccacattggtacctggagatatgtcgcgggggtcaggagaccttggggacgtcaggcgagctcctggcagtcaacagataaaaggaacaaagaccacaaagcaaggaggcttgtgtggtggctggccagctgtgaatcttgcctctggtaatcgattaccagtctgtgtaatcgattacacagaggaatgggtcactggtaatcgattaccag

SEQ ID NO: 37905 - DNA, 408 bp, Glycine max
  Peptide Sequence Number=SeqID_154683
atggagttacttaacaccaaattggtgcatgaactagctgaagccaacttattggccaagcagtttatgacaaactgcgagaaagaaaagaaagaaagagaactaatggaggaaatgtgtgaagaactagccatgcaaataggagaagacaaggctaagttcacagtagtactaagcgaatccatgagaatttgcgagaaagtggaagaagagaggaacatgatgcaaatggctgaactgtggcgtgaagaacgcgtgcaaatgaagcttgctgatgcacaacttgttcttgaagacaaatataaccagttggtgcaactttatgcttctctcgaaatgttcttcatgtcaaggggtactgaacttgaaactacggagctagaggatgctgagtcgatcaaacaagaa

SEQ ID NO: 37906 - DNA, 252 bp, Glycine max
  Peptide Sequence Number=SeqID_154684
atgcacggtgcgactcgaataagaaaaaggtgtaacgaaggcttccacgagttcacggctgaaacgaacagtgaagaaggaacggtgaagaagcgaagaaatgaagagggtgaagacaatgtgaaaggaacaaaggatgcggggaccctacggggcgggaaacatagtccccgtcctcgaattagctgcgggggatttttcatccctatcctcatcccttcggggaatttttccccgaccacagggccctga

SEQ ID NO: 37907 - DNA, 327 bp, Glycine max
  Peptide Sequence Number=SeqID_154685
atggcgtcaagcaacaacattcaggcaatacctcgccaccgcaggagggggactcagacgaaacactctggtgatggcagttgcagttccccagtgaattcttgggaattaggttccaagaaaaatgaggtttctgcgaggaagctcgctgctgggttatggcagatgcagtgtatgcaagtctcaagggatcatgctgctgctttcggacgcagctcgcttccttcctccgtgtcgcagctagtccaatacgtgatctcacaccatggtctaaatttgaagctagtccaacaacttaattatctctatccaaagtcccatttctga
